United States Patent 7,868,149 (PLANT GENOME SEQUENCE AND USES THEREOF) - sequence listing, part 105

SEQ ID NO: 56778 - DNA, 8359 bp, Oryza sativa
agcccatgggtttcagatggacaccgacataataatacaaaccatattagattgcatcaacgatttatatggcaagtatctgttactgcacatcacacagcaccaaccacatgctacatttgtactcttgtatatgtacagatctcagaatgcttattatgtatgagcatgtcacgcatcagatatatatgatggtggaatcaagaaagttcattctcagctgcaacagaacgagtaaaacacttgtaatcacaagacagatcagaaacagcagatataattcactatggttgtaccaggatgtgaaagctcatagtaaatacttgagaatgaaacagcagatataattcactttatgtacaagtaattttcatatatgtatagttgttatatattacaggaaacactctgctgtccatggaaatgatcacttgatccatcctcacagatttaccgtaaagcaatatgtccatggacttttcactaaacttacaagcaagtactttaaacagctaccaagaacatctcttgtccagtaattgtccaaaataactcctgaatattagcataccctcacatctgaacagaaaggtagtcttgcctagtttatatagcaacaaaggttggtgcagtcctcatggcgaccatttgattacatgattaacgtgtctgctgccatgaatagtaaggtcaaaccaataattaatcaaatttatggaacatataagtggatgagtttgtacgaatacatatgcacgaaagcaaaatccaacatcccaatataactaatagtatataccagctaatcaagaacggacataatattctcttaaaaatgtgacaatcttaaactaatagatgatcgtgtagcatgtactgatgtaaatacgaggcaaataccagcacccaatgctaacaaatactaacaggtaaaatattgtgcctgacattctgcatcaattgctcattttctcttgatgaacctaatttagactcaacagaacacatggtatgtctccggcacataatcaagacgcactagttcaaagtactacgttgtcttgtgcctagacagcaaccaaatcaaaagcatgcattggcatcaactaatatgaggcatataaaattttaaattaatcgcaatagcgtccaaacagcgcaggtatgaacccaaggcttgctaattctgtttcaccagcctacaaaatctgcaccactaagacgctactcaaatcacaggacaacaaaattaccaacccgacaagaacaaccccagacaactcaattcaccatccagcgtttcgccacaagcaatttcagcatctcacgcaggaacgcggaggagctcctctggacggtccccacccgtgcagtgcactgaaacctagatccggagtgcacggaacaaccaaactgttcatcaatcccatgatcccagcacaaacccagcacaatgatcacggctcacgtgatgagccttacgttacgagacagcacgctacatcccaattatccaagcacccgatcaggggggctacggaatatccacacgctaaacctagtttggggagcgatcgaacagagatggacacacaccctgaccacaccaagcacacggaatagctagctatctaaacaaatcacgaagcgtgtgccgcgagtagactcacctggtacggtaggtggtaggaagtgttgggggcgaaatctctgtagggcgtggggctcaggtggcggcggtggcggggccgcggaggtcgtcctggatgggggggaaggagttgcagcagtagcagcagcagaagcagcggccccaccgccggaagcagcggcagtagcaccaccgcccccgcacccgcgctctccccgtcgccggcgccggcgccggcccgccgcccgagtaatccattagaaagaaagagagagtgggtgtgatgaagaggtggagtgggtggaaagtttttgggtggaggtggaaaaggaaggaatcacatatggagtgaggaaagcaaagcaaaggggagagcttcagtgtggaagcgaggggttctggaagctcctcctccatctcttggattccatcgtctgccttcccgccattcccctgacaccgaaagcgcgcgagttccatcgtctgaaaaaaaaaacaacaaccagtcaatccacctacctgaagaagaaacgaggtgtggcttgggaatttgaacttgattggcagattaagaagatgagaatagtgatcaccgatggaaaatgtcaaccgtcagcacgcaatcagtgatcagtccaagatggcgagcgtgtccactcgtttctatcccttggagttcaggcaaacaagcttgaaaagaaactaatcagctctgcaagaaacggcctccgcctacactgattatcctgatactccagaaagaacagtgatctactgatcttgttctcttacagtttcaaacagatccacccaagaggcgttggcaaacctaataacaagatagagtgagtagaaagaattctagtaacagttgagactcaataacgaactgcatcaaatttgtaaaattcagtaatggtgctaatggaaagtagccattttgttttgaggatttcacaattaacaatatatcaattcagatggtttagcaattaaaaacaaaacacataaatattgatagacctgagagttcattagttaccaccacctgcacgaaagttcatcatagttccatccaccattttaaaagaggattaatatgcctacaatcttcataagacagggaataacaatttgaagcaaactaaaagataaaatcaattgcagtattcatcatttcacagaaaataagcactatatcatggcaaaggtggtattgaagaacagtctgtgcaaactgcaaaggaagtctattatggttttctccatactcaccttggttactgatatatcgaccataaataccttggccagtattttggccatcctttgacgatgtccatgattccaatcatactcaataatgtaaaatctttttcaccaatagtcattgcatgagcatactccatcacgaaacacatggaaacgatgacggtcacgcacaatgatctcccgctcgtagagcttggacacaagcttggaatgcacatggcaatcacggcacactcgaaggttcttgacaatacgaataggaacgccctggggaatgtttaagataccaaatgctaatgccagcctctcgctgtggtaggatagggcgatgcccttatcttcctcatcatccatgtccataatcacctggcttgtatccttaacatagccaattagttgcaatctcctctctatatcttccaatagtgcatagattttccttgtgagaggatgtcttgtatccccggaaataaattcatggaccaaaccatttaactctatgaagctcaaacctgtttctttcttggctcccctatcctccatcatctgccgaatggtccttgcttcttcccatcgaccattgacagcatataggttgaatagaacaacataacggccaccatcatatggctctagctcaataagccgcttacccacacgctcacccacattgatgtcattgtgcatttggcatgatgacatgagtgcaccccattgagaagcatgtggctccattggcatatccagtaacagagcttcagcttcttctacattccctgcacggccaaggagatcagctaagcatccatagtgctccctttgtggcttaatgccataatcctgcatggacttgaaaacccttttcccttcgtccacacgccctgtatgggtgcatgcacataaaacagcaataaacgtcgactcatttggcatgaaacccttctgaagcatccttcggaataattcgagagcacgctcaccatagccattcatcgcaagcccaccgatcatcgcattccacaacaccacatcgcgacgatgaactccatcgaaaacttgccaggcatcctccatgcacccacatttgcagtacatgtccacaagagctgtctcaagcatgagatttccacgcctacctccaaaactccctgtctccagatacctatgaacccaacgccccctttcaacggcgccgagatgcgcgcatgccttgagcacgctcaccagcaccaccacatctggcctgaattcctcccgcatcatccgatcgaacacccataaagcctccccaaactccccggcacgcacgcacgcgtccaccatggcactccaggaaaccaggttccgctcgggcattctggcgaacacctcccgcgcagcgcccaggtccccgcccttgccgtacccggacaccatcgtgttccacgagacgacgtccagcgcggcaccaccggagtagagcaccctgcgcgcgcggtcgaggaggcccagcgagcagtagagcttgaggagggagttggtgacgacggggtgcgcgagcgcgccgcacttgaacgcctgagcgtgggcgaggcacgcggcggcgaggcgcgcgcagcctgcggacggagaaggggacggggaagacgacgacgacgacgcgagggcggcgaggaggagggagaaggtgaacggggtgggcggcgatgcctcctcgcggatgcgggcgtacagggcgagggaggcggccgccggggcgccgcggcgggcgagcgcggcgtggagcgggcagcctcgggagggcgccgacgagaaggcggcggcggaggaggaggaaggtggggtccggagccaggggaggaggcggcgggggagcgcgggcgccatggcggacaccttgcgttcagaacagaggtgcaaagaagtttgagccttggcgcgccacgtaaaaacgaagagactcgcaaacgaatttgaatccttcagctgacgtttgtccttgaattcgatttatttcaccatgattttgtacgaaaaataaacgattactagtactactgtacgaatttggtgtagaatcttttgcattccagacttatcacgggtgttgggcacatggtaaaaggggtatcagtataatgaactccaggtttattttactactagtatgaaatcaggcactggttttccaacttattccatattttgcaagatacttgagttgtgcaaatcacagtagcatatgaaatattcccctctttttatcaggaaattttgttacacaatggtctagtatgtactaatagattttatgttcagatgttgtgctatttttcaatgataatagatgtgtatctgctaagcttcttttttctgtagctctgcgtgcaggaaaacacaagcataaaatctgaaaatgatgtctttcggagatgttttcatcattaaaggtcaacaaatgtcatggatcttacagctttaagtgaagcaacacagatatgaggctcaagaataacaactctggtatatactaacatctaaactatgatcgcagctatatatggctagttgaacatgaaaattgtggcaccgagagggggatcaaagagaacaaaagggacaagaaaacaaaaaccatggcatcccagcaatgtcgccgaagaacgtttgtactccataaactgccctggcttcttggccaccaaaacatggctgatcacttcacggaacaagccacacatacaaagtttttcgccccatctgtctaaaccggggtcaatttttagtcacactttatgttcctgtagatccttctcacaaacagtgtcgatccaagatacccgacagcacctggaccaaaattcgaaccggtatcagttgaaaccatcaaattcttgggtttaagcatgctaccggtgtagaagagcttaccgcagagtgttcctaaacctaggcagaacataagagtgtagccgaagtagaaacttgtctgaaagaatcctgacatcttggtcttcacatggtaataatatacggagtagaggtaaacatagacggcagtagaagcagcagagaagaatgaagtccactgccagtggtagttctccgcattcagcaggaaatatgtaccaacgattgttacacagatggtgacaattatgaggatcaaaaagactagcaacatgaacccatatacatagtacacctgtcaatagatgatcaggaaggatgcataagtctcaactctcagggctccttagtaatgaagcctgtatgggaaaattagtgttgcctgttttaccttgtagttccaaaatgatgtgaagacaaagtacatctcaatgaagatgctaccaaaaggaagcagtcctcccatgagggcaatgacagaaggcgtgaggtaccatttcttctcagggatagggcgaggaatagtctttactctgcatggattatttggggcaccactccagtttctaccaacaacagttcccaaaagagcaagagggaaagatatgaaggcccacaggatgaacacaaccaccatagtaccaaatggtatggcagctaatgatcgatagaatatagcgattgtgttaagcactaggccaattccaaagcacataaacggaaatagtgatgctgtcataatcattgccttgatccagtttttccctgctcagcaaaccaaggatttaaatgaggtgagcatcttatagtaaaataggtgtgtgcctgttcaagatgtaaagtaaactgagttcatacccccatgccgtgaataaagtgcaccactgacatatccagagatgaatgaagtaagggcataacaaacaatgaatgttgtgacaatagctcctcgcctacaataagaatataaggtgtgagagatgcgcttttgcatagaatcagaaagtacgattagacttaaatgcttcataaagtagttcagctacttgtgaaataaaagcaaaatatcaaaaataaagataaatgtgcactccaaagaaccttttaagcagttcattgacaggccgaaaattagaaaagggggctgggtttcatgtgaaggcggtaattatgatttgacaattcctcacatgtcataatgtgattgtagttataaccacacattcaggcacacctagaatctggaaagccttactgcgaaaaccaatgcagtcctgtctacgttaacaaattgtgtattttaaactggaggtggtgtatgctgtttggcttgacaaaagtaacaagtgacaggatggagaaaacttaggggcctaaggcatttagtagaagctgcctttatagaaatcggtgttaattgtagtgatttgaggtaaatcataaatgatgtgcatacccaatatacagcattccgatgattgccaacaaaatcactagcagaataagagcagacaactgtgtgccaacaccaacaagggctgaaagaagagccaaactgcgaggaggccggaaaacatccccatggacaagcttccatccagattcttcactgacatctctttcctgatattgaataaaaatgtcagcaagaggatgtatgaagcgcataacagaatttgtacattatttgaatatagatagtcaatcaccagagtttcaagatcatcatcgtcgcgggcatactttgcatagtcatttcttagagtgcgcatcaaaatcattgacactagcccagtgagaaagataaccatcatgaaagaattgaagattgagaaccaatggatctgccataaaatggattatctgtggtcagaggaaatgctgcaagatatacatgggaaattgagaatcaaggcataattttttatgtggaaaattggcaacaaaatacataagaaccaaggtgcagaaccaggctttaattgcagaaactgagttcttacctggtgttcaaagaaagggtagtcaaggtatacatcaaagcggtgagcaaatgttacattggttggttcccacttgacagaatatgtcatatccaatgccttacccgcatcaataagctttggactttcttgagtaagattaacatgaataatctacaggaatgtaacagtagtaatactcagtttcttgaaggtcctgcgaaggaataaatgcaagttcatgaaacccaaacctgattgccattgtatctgatgacgatgttcttgtgagtgaaaaggaaatatttgttatcgctatttctgtctgcctctccaacaaaacctgttaagttataagttattagactatatataagatctttgagagaaaatagtaatgataaaagaggatacataccccatagaggcaaatcatctttgatagtggcatagaatttcccagaagtgtgcagaaaaggataataagtaaatcaataagtcacagtgcgtaaaaatgtttatgcgtactgaaaaatggcaagtaaacacaccagcggagtcaaga

SEQ ID NO: 56779 - DNA, 4786 bp, Oryza sativa
gatgccgatagagacgaactctcgcattgcaacccctccatttctcaccactcgcgcggcgagatctctagcagagaccacgcgacgagaccccgatccagcacgagggagggactggctacccggagatcccgccccgccggagcccgcgccacgcagatctgaccctcccacccgggcgagcacggatctagcggaaccacggcgcacacgtccccgccacggcggcccgaacagaccccgtcgccgccgggtgggtggcgaccgagtgttccgacgccgaagcgcgcgccccccgtctgttgttcccagcgaggcggtgaagtgggaggaggagctggttggttttttaccttgtggtcggagtcggaggcggcggcaaggggggcgaggaagacgacgaggaggacggcggcggcggtggcggtggccgcgtgggcggcagcggaggccattgggagggacggcgagtgcgaggagaggagagggagggagcgcgggcggacgcgcggtgcagtggctctctcctctctgctcctcctattgtgttattattacgagagtactactactagtactagtatttttttttctttctttttgtttttttatcctctcccgggctgttcgttttgtttctctcttttttttacatttattaataattaacactgcttgaaacgggcttcgattgttttacattttaacccactttcattcactcagatggtctcatgtatttcctccataaaaaaaataatctaaaaggggatatgatttatccaaattcgttacattaagagaggttacatcctggtcacagcgtgttttaggtttttcttttttttacggatagagtatcaatcctataagttttaattaaaataaattggacactggaaaaaatattaaattatcaaatgtcttgtgtgttggtgtcatcaactggtgttgctgacttcctgcatggaggagcgagatggttgatggggttgaggaggttttgaggagaggcacctctcgccggttgagggtaagggcctgtttgtggaactttagattttgagaagcagttgtttgacagccagtttctaaaaatctggaaaagccctgaaacccagcttctccagcttctggtttcttagttcattttttagaatctgtaactacatattctcagaagctgtgcattgtttggggtagcttctagcagaagcagcttttgtaaaaagctgcagctgggacaagctcccccaaatagggcctaaggctgtgttcgctagtttcggttaggaacacatgtcctatgcacgaggggtctattagcgcgtggttaattaagtattagtatttttttaaaaaaaaatagattaatttgatttttttaaaaaaagtaactttcatatagaattttttttgtaaaaacgcaccgtttagtagtttgaaaagcgtgcgcgcggaaaacgagagagtggagttgggaacctatgagaaagaactcagccttataaaacgtgcaatgtcttacggaggggtcgattagtaaacatattactttctccgtcccaaaatgtaactacctagtataggatgtgatattatctagtcctacgaatctggataggaggtagtacaacaaatctggacagcttcgtagtggtagcactggtggagaaaccatttatactcccggttggcaaccccctttagtcccggttttccaaccgggactaaagatgggcctaaagatctttagtcccggttgaaataaccgggactaaagatggatctttaatcccggttggtaacaccccccgggactaaacgggactaaagagacggtagcggcagttccattaggtctccttttctttttttcattgttttttagccagagtttaatccctatatttcctctcaaatcgagtgggatgcatatccaaatcaaaccccgaatcaaaataacatcccagaatattcacatcacaaatcttaagttacttgtacacacaaatcaaatacatcacaaatcttaaaaaaaaaattacacacaaatcaaatacatcacatattatacatctcagatccatacaacaaatcacaaaattatacatctcagtgaatcacaaattgtaaaaaaatagaaaagaaataatggatgccggtagcgccacctgccgccgctcgctactcggccttgcgcggcgcctgctgcgtgcggccccgccggctgcctgccgcgtgcggtcctgctgggcacgggaagggaggaggcggcccttgccgggatgggaggagaaggggaggagggggaggagagggccgggatgggaggaggaaggggaggaggaggagagggagatggatctgaggagagatcggatgggaagggaggagtcggatgggaggggaggagggggaggagaaggccgggatgggaggaggaagaggaaagggtgatgcatctgaggagagaagaggccggttgttggtgagtggatagggaatatggattatatactacgcatgatttggagtaaagatctagaagatcccaaccgggactaaagtgatgatctttagtcccggtttgtgacaccaaccgggactaaagatccccgcccctctgacaagggactgacaggggatgaaccgggactatctttagtcccggttggtgttaccgggactaaagatcgtagaatggctgtgggattttaaaccgggactaaagaggatctttagtcccggttctttttgtaaccgggactattgtggttttggggcgaccgagtaaagatcagttttctagtagtgtagataatgtcacattctatattaggtagctatattttgagacagggtaagtaatgaatattgataagttatataagaagttttgtgcaagtgtggtaggtatttaagtagaacattagacgtgtagtatttatgtaaatggattaacaaaatatagaatagtataatttctattggtaattaaatagctgcctatgtgatatagtgtgacaaaggttacatgtagtaaacttatactacaaataaatagcatttttccttttttttccttttactttatcctttgaatatttcttgaattgtggatattttgtgttttcatcaaactcgttgttatagtactagagtatttttcaacttttttcattgtacagttgattgttcgtatctacttgtatagttttctttttccagtgtccctacatggtatttcactttttgttaaaaatgtcacttttagatttttaagatttgttcttcattattatattaatagaatacttgtcgatacctcgtgccatttcatcacgcaagacaatatataaaaggtccttttccattctggccattttgctcaatatataacggccgatccatgtttttttttgtcatcttaatggtaccaacattattcatgaccataggaggattattgggcacctagctatttatgtgcacagtgcacttgcaaagaaagagcatgtacttcatcattcttcttgtagtgaattgttcactgattttattatagcggtaataacacaaatataaatataatcaaataaaaccattttttgcgaggataaaaacctttttcgttgtggttgattatattatagtcggccaatagcgattgaatatacatactgggcattgcccaaagtacttttgacggtggatccaatggtattcttctaagtgattgataaatattgcttatcatagtttgagaaaaaaaaagtcaattgtgtgtcatgtacttctgtttggtattgaagagaataatatgtctttcatattgttctcttcaccaaaggatggattaagccttcttatgtcataagagtataaaaccatcctctcacatttctttccatttaactataaaacactactcaatagatcattaatcaagatgattttgctacaagtataactaggtgaacctcgcgcgttgctgcaaaagtttaatatgataacaccgagtaaaaatattgtgtaagatagctagataatataatcttgcgtaagtttatgtggtttataataatttaaatttaaatagtatataaaataatgattcaaatgtaaaagtaagttgatgtagttttatgagagaagaaaaggagggagatagtttggatcatagattaatcatctaagagctaaaaacaattgaggtgatatgacttaataaaagaagaaaataagtggataatttggaccgtaaataatcatctaagtacaaaacagttgagtgatatgggttaatgagaggagagagagagagagcacattttcggcatgtttggcacaactctagctcttaactccagctttaagccggagttgtgccaaatggtttagatcctatgtttttaggagtgaagttagcagagctactccttaaatatggactacgaggtggagctgggtttttattgctccatagctccattccaacccaaaagacccactgccttcaattttttttagcatatttacacacaaacgctacagaactacccaaaactcacctcctcacccctctctatccctcttgaaacttcacctcccatgggcgagcacagacggcaagccaacggcgatgctccgacgggggcaggcgagcagtgcgagcagctggcgcgagtggggaggacgcgctggtggcgcacgaccgttggtggggattctatttttttttaatttttttagatctagagctaaaagctagccaaacattttt

SEQ ID NO: 56780 - DNA, 3932 bp, Oryza sativa
attcctgcagcccaagccaacttagaatgtgtcccctcttagtataatgaatcaagatatatctggatatgcgtgtgtatgttcatataaataagtgtgtcgtgttgtgcgttgtctatgttctgtgtttataaagaaaaaaaaactaccatggcatctccgacggattgagatccagtgcagttgttactatcactgcaactttagtagttgcaaggtagccgatggatcaaaaacagcggctcagatcatcagaaaatactgttcacgaatcactgtagcgtatactatgcaggggatggcagagtagatccaagctgttggctgcatcgatccaacggtcataatatgctatcactgctaaagttgtagtcgttattttaactgcattggtcataatacgctatcactgcttaattcatccccgaccatgagtagtcctaaagaaaaaggaaggagagtgtgagggtattgcaggaacgacgtgggtttctttattaccgtttccaaccaacgcgctgttggaaccttcgccttgtcttcgtggctatcttgggatcggtgagcttaacgacgcgatcatgatcatgccaggccctgtatagttcataaaacaaaaattttacgttgtcacatcaaacgcatacataaaatattaaatgtagggaaaaaaatcaattacacatatttgcgtgtaaattgcgagacgaatcttttaagcttaattgaaccatgatttgataatgtgatgctacagtaaacatttactaatgatagattaattaggcttaatatatttgtctcgcagttttctggcagaatatgtaatttgttttgttattagactacgtttaatactttaaatgtgtctacgtataatccgatgtgacaaccaaacctaaaatttttcccaactaaacaaggcctaatgcgagttgtcggaactcgggaaccctcctgttcggcgctgatcaatggctcaggccctgtttagttcccaaaacaaaaattttcacgctgtcacattgaatgtttggacacatgcatggagtgttaaatgtaggaaaaaaataattacatatattgcgtgtaaattgcgagacgaatcttttaagctaattacgctataatttgacaatgtggacagtaaacatttactaacgacggattaattagacttaataaattcgtctcacagttttctagtggaatctgtaatttattttattattagcctacgtttaatactttaaatgtgtatctgtatatccgatgtgataatcgaagaaaaagaatttccccaacttgactgcacgctgcagcccccagcttcggttgtgtacaataaaataccactgtagtagtactattctctagtacatcgtggtcaacactttggcagttggcacgaatcaaagtgaccttacgacgcggtaggagtcaacataagcaaaggcaaagaacttgcaccgaatcgggcacactgccgacaggttagaagcataattaagcactggaccgatacattgacgggagctaggaatttacaaaaaatactaggactgaatcaatcaataaagacctcaaccaatgcaatttgttgaatcctcaaaacttttcatgattttttaaaggatttacaagggattaaaggaaacaagcctgatgttcaatccctaattatgtgtctccgccccggaccgataaccgctttcaaatgcaagtttgagaaagaaaatgaaggaatagaaaaaaaaacaaaggattgtaaataatacagaaataactagtgcctgattagactgcagaaaaaaaaatgaaatttgagaaacacataaactcgagaagagaaacagaagaaaacttttcgttaggctgaaccttatgttaaaattaggtgatacacctgctttgctttggaatttatgatgggtatacgtgaaatattgcacgatattgaatattgaaacattatgaaaatgacgtagggagaagataacgtgtcatgcttgtacaaaatttaagatgctactacatctgttctaaaattttgtaatctaggatgagatttgacccataaaaattcattgtcttaagttgagtcaaatcccatactaagttgctatatttttagacggagaaagtactccttccatttcataatgtaagtcattctagcattttccacattcatatatgggaaatgctacttatatatgggaaatgctacttacattgtgaaacggaggaagtaatagctaatgatgatgagttgatatacttgtatgttgagctttaacttataataattgtataacctatatagaaagtatagtttctactggattcaatgggtccaatcctcaatttaaaatagtgggctcaaagccagcacaaacagacataaataatagctgtgggccgaaaccaccgtgtccgaacggcattgcattgcacgtatgcacggcaaaggttgaattaccacggccgtgtcaggtggaagaaagctgtgattcttcaacattggtaagcacatcgaagcattgttagtttggtccaatacctcttgaaaaaagcaggtgaaagcataaaaggttgcaaacaatgattgtattctgtgattgtccttttgaatttgattaatgggagcagcccaacattaccaacctgcataattcagaaggaaggggggtaattctcaattctgaccaactacccagccttattttgaatattgtacatgtatgcaaaactataacccaaaagctaagattttgtaaatcatatgcacaagcactggatgaaaaaacgactgatctgagcagctcattcttcgtcctcagtctcctcatcgtcgtcgctgctagcagctctgtacctcgccccgtccccaacattatctccctcttcctcagtctcctcgctatcgtcctcgtacagcacattcctcggccactggtgctcttcgacaacattaacaggaggttggtatggctctgtgtaacccctgcgcttagggaccttgggcagtggcatcttggccgtcaaggagggcttgcttcttcgcttcgacatcttcgaagaggcggcttgagcaccggcatcctggtagtgattagggtgctctttcttcagatggaggttaagtttgtactcatgaatgtatgccttggcacaaccatcataaggacagacgtatgggcgatcagctgagggagtgggtggagctgctgacggtttcggtgtgtgactattatgggagtggtctgctagaccactgcggtttgttgcagacccacctggattctggagaccaccctatatcagtgttatgaaagtaagtggtcagaactggttccttcctaagcacaaatctggaggtataattagatcttaccttttcatgctgttgcttgatatgagcccttaattttgattcctgtgtaaaccttcgagcacattctgggtacttgcacacatgatagttatccacagaatgtgttttcatgtgtgcctttaaattaaaatccaatgagaaagcctgcaataaccaggaccaaatatgttaacaagaaacataccaaaacctaacaaattaacagcaacaattaccgataatgccaaagggggtggggggtttattccataattagaatgtttgaccatatccaagcatggcccaaaaaaactcaatactattagagaaagggaataagtgttgatatgccactccatatggactatttaacatgtatttgaaatttatgcatcgtacggaaaatgcagtcaaggaatagaaatgaatgacaaagtttacaatggagagatcatattaattacctttccacagccttcatgagggcagacaaagttcttctctcctgtatgaataagaaaatgcctcttcagcttagagctgggctgcaggaatt

SEQ ID NO: 56781 - DNA, 1124 bp, Oryza sativa
acttttgatggtcatatttcatcttggtacacagaccaaagataagtaattctacttatcatccatttaagcatgctactagttattcctcgtaaacaagcgattcattaatatttacatttctcgatgcccatgtagtcaatcttgtgtggaagaatggagagtcacgcattaaatctgagaaagtcattaagaggataggttgttggattgaaatatgcttatgaaaaataaaattttcagatttggaaatatgcctatcaaaagtaaatggagggagtataaagctagcaaaaagcttagaaaaacttatctaaacaatgctgatgtagaaagcttttttttaaaaacaaattgtacttccaagagcttcttttttttttttaagaaatcgtacttccaagagcgttgcacaaataatccatacatccattagctgtttagaacgcgtactaattaccgtcaaagctgtcacaaagtcacaggccaagcaaatcgcatagctcccctgcggtaaagctagccaggggaggggccaattcagaaaaaaaatgcctaaacaggtcctctctgataaaccaacctcccatggaattcaagcagccggcaactgcaagggatcccatcgcgcatgataacatcacgcgcgagcatacggacgataaaccgcacatagcaaagtagtaacagggcggggaggcaaagcaaaaaattgaagagggcggggcgtacctcgcacccatttgtagagcgcgcatgggccaccggcgacgaccagatcctgcggaaccctaacaacatgtataagcgcgtggcgcggacgagagatcagatccgaatccgaatcaaaccaacaagaagctctctcccattagaagaagggattggaattcgaggaggaaagaggaacggaccactccttgacccatcggtggcggcggcgcccggcagtctgcatcatcgtcgacgtcggttaatttgcggcggcgttaggggggggctaaggggagaggaggagtggagggtttgcgttgcggctagggttgagaagcttgggggaggaggaggaggacggctgggatggtgacggcatggtggtggagggaggtggtggtggcggctaa

SEQ ID NO: 56782 - DNA, 3053 bp, Oryza sativa
ttttgcacgtcactagtctgactacctccttgacacctattggactacccgttggttagaccgctcgttaaatgtcggtcccgctggttaaaccactcattaaatgtcggtctgattgtcggaatccagaaaaaagcgtatcaacgaaactcttgaaagtagattaactttattgcatcaatatgtgtttacaaagtgcatctaaatcactcctctctcaactcacaaactaggattgaaacatcgaagcaaaccctaatttttctctccaaaagatgatctctcctagcctcaagccatcttctatttatacccataatgtggttgtctctagccacgaatccaactagaactaagacttctaatcacataggaaacataccaaaacagggaaacaacatccccatagaattccacactccaatattcctaaacttagactccaatcaaatttgactcatttttccatacgcgcacaacaccatgtgtatgccatatggaaaccttaacctccatatgcattgttctctagtccgagcatcccacatgatatctttgaccgtctggacctcaacttctcctaagcctagtcctgatctatcatcggttatactcctccatattcgagtacaagttcgcaccaacttgactcacatcagcacacaatagtatcatatacgaataggaaccatctgaaagtcataaacatgaagcaatctagaaattccacgaaaataacccgaaaccgactctccctcgaagtctaccagtctgacagtcgggctacccatctgaccacccaaacataaatgtcatgatatttaacgacctctaagaatagtatagaacatagaacgataaaccaaataaccaaactatggtatgatgagggagcgataatgaataagagaaaaatataagaaataagctcatgtaagtgctcaaaggtttgatggcctctaagaataaataaaacatggaataagagaaaagtattcaaatcatatcataatgtgacgaaggagtgataactgaacgaaaagatatagcagatctaaatctaatgtaagtgtgatatgatctgatgacctgaaagaataagataacatattaaaaagaagatataggagattcaactctagtatgatgaatgagtgacaaatgaatcaaaagggatagatgatataaggccatgtaattgcctgaaggtttgacaatatctaaaaatggataaaatatggaatgaggatgcaagtggttaaatcatggaggagtgatgaatatgaaaagatatactaatctaaatctaacgcacgtttggtatggctcgatgatatgtaataataagataaaatattgaaaagaaaagaaaagtggttcaactatggtacggtgaagaagtgataaataaatagaaagaaatagattatatgaataaatagctcgaacaactaatgacctttgagaataaatagaacgtggagagatgatgatggaagtgatcaaatcatggtgcaatggatgagtactagatggatgaaaactatgtggtatatttaaatataacataagtatgctatggtccgacgatctctaagagcaagatagaaaaccaaaatgaagaaataggtggttctattatgatgtgacaaaggagtgataaatgaaagaaaagaaattgatgtgtgacacatgagtgataaataaaaaaaagaaatagctgatataaacccacgtatatgctagctacaaaacaaaactaaagatatcaggataaagtgaaaaggtcaattaggcctagagggggggtgaataggctaatttaaaaacttaagtaaagtagaagcagtaattttcggaactaggctgggaattttcggaacttccgaaaatgcacagagctagcagcgcacacaaaaagaagtatctagatctagaagtctaccacatgtaatccaaggcacatacagcaactagaccaatagcggcacaagcaagcaaagttagaggagagggatgaagagatatcaccaaggtgaagcttgcaaacttgttcccggagttcaaatccttgaggggattctactctccgttgaggagctcactaagagccgggtcttagctaactctttcctcaagaggttgcactaagcactcctccttccactaagaggtatctcttcccttgcggaggcgagatccgaccttcacaaacttctcccggccaaccacaagtagatcggtggctcgggagtgacacctagccgtctaggagtcctcaacctccaagagtaaaagatgatgcaaagaactcccagagatgatgcaagtgctcacaaatcttcacaaagaccacaagaaccacccacacaaactcgaatccacactctcacacacacaccaaatccaaatcaaacacgggtggagagatgaatcgaggaagcaaggctcaaatgaactagagagagagagagagcaagccaatggcacaaataattggaatggaaccagcagccctcacaagtgaggggaggtgggtatttatacccacatcacaaatctgcccgttggagtgcaataaaagggattttcggaacttccaaaacaatttttttcaagggaatttgcaccgggaattttgatgaaagcaatttgcaaacctttgataggagatggagtgaaaagaatggtcgaacatttaggccccatttgagcttatggctagcacgcaataaaccacacaaaacaatagccacaagacaaatggatgatccaaagatcaaatgagagtgaattaccatgagacaagatgattcaccctcgaaagagggaatgtgcgaatctattgcaaattgtgttaggaccaacattcattgaaaaatgagatccccatacacatagattcaaaatatccacaaaaatgtgactagtgtccatccatgaattgaatgttcattttatcacaaggagtaaagtaacctatactagaaaccaaaaacaaatgtatgcaaaagatcaagctacgtttcgagaatccaagatattgagttcac

SEQ ID NO: 56783 - DNA, 13705 bp, Oryza sativa
ttattagctatcttaatggcgctctcattgtcacataggagtgggattttggacacatttaggccatagtctctcaaggtttgcttcatccaaagaagttgagcacaacaactccccgccgaaacatattccgctttggcagtggatagggcgacggagttttgcttcttggaagaccaagaaacaagggacctacctaagaattggcaagtactcgatgtgcttttcctatccactttgcacccggcataatccgcatcggcgtagccaatgagatcaaacctcgctcccttaggataccaaagactaaggttaggagtgtgcactaagtatctaagaattctcttcacggccacaaagtgacactccttcggagcggcttgaaatcttgcacacatgcacacacaaagcataatatcgggcctagatgcacaaagataaaggagtgagccaatgatggaacagtataccttttggtcgacgtctttaccttgctcattgaggtcgaggtggccatttgatggcatgggagtgtggattggcttcgcattctccattccaaacttcttgagcatgtccttcaaatactttatttggcaaatgaaagttccttccttgagttgcttgatttgaaggccgaggaagaacttcaattcacccatcatggacatctcaaaacgcttggtcatcattctactaaactcttcactaaaagacttgttagtagaaccaaatataatgtcatcgacatatatttggcacacaaaaatatcattattatgccttttagtaaaaagagttgaatcggctttcccgatctcaaagccgtttttcacaagaaaattgcgaagacactcataccaagctctaggggcttgcttaagcccgtagagtgccttatggagcttggacacgtggttgggatattttggatcctcgaagcccggtgattgctccacatataccaactcgttgataggcctgttgagaaaggtgcttttgacatccatttgatatagcttaaaattgaggttagtagcaaaagcaaacaatatgcgaattgactcaagtctagctaccggcgcaaaagtttcaccaaaaactaatccttcgatttgggtgaacccttacgccactaacctcaccttgttccttattacgaccccggcctcgtcttgcttgttgcggaagatccactttgtgccaatcacattttgccgaggtcgctccaccaaagtccacacttcattccaggtgaaattgttcaactcctcttgcatcgccattacccaatccggatcattaagagcttcttccacccttagaggttcaagagaagacacaaacgagtaatgctcacaaaaatttgcatatgagaacgagtggatactcccttgttgatgtctcctaagatgttgtcggtgggatgatctctttggatactttggtggattcttgggcgagctaagttgatcggtgagggtggaacttgctcgtcttcttcaccttgattcaagcttgaggtagagggatcgtcggcttgggttgatgtaggtggttctacttgtgttgaggaagaggctccttgttgtggctccctaggacgtacgtccccaagagccaatcttttgattgcttcgctcggatcctcctcttcacctaacacatgtgattcaacttgctctacttgagagccattagtttcgtcaaatgtcacatcacgcgcgatctcaacaatactggaggttttgttgaaaacgcggtatgtgcattcatttgacccatacccaagcaagaatccctcattcactttaggagcgaacttagaggatctagcctttttattaagaatgtaacacttactaccgaaaacacgaaaataagagacatttggtttgttaccggtaagaagctcatagggagtcttcttaagaaggcggtgaagataaaggcggttgatggcgtggcatgcggtgttgacggcttcggcccaaaaacggtccgatgtcttgtactcatccaacatgatcttcgccatctcaatgagagtcctattcttcctctccgctactccattttgttgaggtgaatatggagccgagaactcgtgcttgatgccttcttcatcatggaaactctcgatgcacgtgttcttgaactccttgccgttgtcgcttcaaatgttcttgatcttgaggtcgaactcgttttgtgctcttcttgcaaacttcttgaagatggcttgtgtctcactcttgtcatgcaaaaagaacacccacgtgaagcgtgaaaagtcatcaacaataacaagaccatatttgttacctccaatgcttagataagcaattggcccgaagaggtccatgtggagaagctctaatggtcttgtagtggtcatcacattcttgacggggtgatgtgctccaatttgtttgccggcttgacacgcgctacacaccctatctttctcaaattgaacatttgttagtccaaggatgtgatcgtgctttagaagcttgtaaagattcctcataccaacatgggctagcctccaatgccaaagccaccccgtgttagacttagccactaagcatgtctcatgtttggctttacttgaggaaaaatccacaaggtaaagctctcccttgagaacacccttaaaaactaccgaggaatcattccttctatagacggtcacatcaacatcggtaaaaagacaattgtaacccatagaacataattgagaaacggacaaaagattgtagtttagagattttaccaagagaacgttggcaatggaaagatcagagattgcaatcttacccaatcccataacctttcccttttcatcgtccccgaagactatgttatcttgtgaagtgccatttggatcaagagttgaaaacattgattcttctctggtcatgtgattggtgcatccactatcaatcacccaacttcttccaccggagacatattcctacaagagatcaatttctagttttaggtacccatacttgcttgggtcctctcatgttagtaacaagtgccttaggcacccaaagtactctcttgatagaaatattcttgccccttaggcctacatacttagcaacaacataaccactagcattcttcctaagaacataagatgcatcaaaagaaccatgtgaagcataatcattagtaaggatacttttggccttaacaaaattgctaagaccttagggactcttgatcatcacactcttgtccacctttccttttggtggaggaacatacccaagaccctcatggttgaagttgtccctttgatagcctaggtactcctttagggccttactacccatatggcacttaagtaggccattgtgaaggagtcccataagcttctcattttgcttttgcaaagcactcaaagaaatagagttagtagcacaagcttcaatatcaatatctttgcatttcacacatggttcatcgcttgggacaatttttgaacaagatggctcgctagggagagagacactattctttaaggtttcgaacttctcttcaagagagaggtatgctttgtccaagccatccactctctcttgaagttgagcgttcgccacctcaagattagcatgagactctttggtttgcttgtaaagctgtaccaatgcctcatttttctctctctccttagcaagctcactcttgagttcatgacaccgctttttctcacgaatgagcaaaacatcttgcctctcaagtgttgcatattggtcctcaattttcctaagcaactcactcaagtgtggtagggattccttagttatggatttaaacaattcgtcatccataacctcatcctcctcatcactaacaagatcaacattaaatgacttgagaggagaaggtaccttaggctcctttgccatgaggcaaatgggagcatcctcatcacttgagttgtcgaagagtcttggtggtgatgaaggcttgacggcgaacgcgacgactccttcttcatcacttgagcttgactcggagtcggagccgaagatcatcacaaggtgagcttggccataatgttcccgcttcctatgcttgtgcttctccttcttctcatccttcttctcacccttcttcttatcttccttgatgtgggaaccatccttgaggtgggggcaatccgcaatgaagtgcccgggctctttgcacacgtagcacactcttgcggagtgtcttccacttgacttgttggagtagtgcttggaagaacctcccttgaagaagccgcttcgtctcatgaacttgccgaacttcttgacgaagagagccatctcttcatcatcgatctccgccttgctcttgctcttgcggttctcttcttcttcttcctttgccttcaaagccaagtcttccttcttgatgcttgcggttgagctttggttgatgtattggatgacatccttggactcttgcacgagcatgtcatgggcaaggatgcgtccgagaaaatcacgaggtgtgagagtcttgtagtccggacgctcacgaatgatgatcaccaaggtagagttccttggagtgattgctcgaaccatcatcttgaccacaacatcattggtcatgtccttggagccaagtcccttgatctcattgacgatcttgctcaactggtcgtacatgtcgcttgggctctcaccatccaacatcacaaatctctcaaattgccccttgaggatctccaccttggactcacgaacactatccgtgccttcatgcaagttccgaagcgtgtcccaaatcactttggcactctcaatgccatccacacggttgaactcacttccactcaaggcgctaagtattgcattagcggcttgagcgttcttgtgctcgttctcgtcgtcctccttggtgggatcttcgggattctgcaaaacatagcttttttcgactattctccaaatagatgggttaatagacttcaaatgcatcttcatcttatgcttccaagcggcatagtccgtaccactgaaatatggagctttgccgctataggtactcacataagatgtagatgtagggggatagtcataagggatgttagctcccttatcaccatcgatcccatcccctgcttggcccgacatgatctctccaagcggttaagcctaattaggatattaggctctgataccaattgaaaaggtcaattaggcctagagggggggtgaataggctaatttaaaaacttaagtaaagcggaagcagtaattttcggaactaggctgggaattttcggaacttccgaaaggattttcagaacttccaaaaatgcacagagcagcgcacataaaaagaagtatctagatctagaagtctaccacatgtaatcaaaggcacatacagcaactagaccaatagcggcacaagcaagcaaagttagaggagagggatgaagagatatcaccaaggtgaagcttgcaaacttgttcccggagttcaaatccttgaggggattctactctccattgaggagctcactaagagccgggttttagctaaccctttcctcaagaggttgcactaagcactcctccttccactaagaggtatctctacccttgcggaggcgagatccgacctttacaaacttctcccggccaaccacaagtagatcggtggctcgggagtgacacctagccgtctaggagtcctcaacctccaagagtaaaagatgatgcaaagaactcccggagatgatgcaagtgctcacaaatcttcacaaagaccacaagaagcacccacacaaactcgaatccacactctcacacacacacacaccaaatccaaatcaaacacgggtggagagatgaatcgaggaagcaaggctcaaatgaactagagagagagcaagccaatggcacaaataattggaatggaaccagcagccctcacaagtgaggggaggtgggtatttatacccacatcacaaatctgcccgttggagtgcaataaaagggattttcggaacttccgaaaattccagatatgagaaatagtcgaagtcaacgcaattttcggaacttccgaaaatttccagaacgcttctgtgtattttcggaacttccgaaaatttccagagagctctcaaacggttctgtgtattttcggaacttccgaaaatttccagaacgctcaaacacggttctgtgtattttcggaacttctaaaaattcttttcggaacttccgaaaatttccagaacgctccaaaagagaaatgcttcgaagaaaaattgattttgagcacatgcatcactccttatatgtctatgcatcatcccccttaatagtatggctttcctacgacacaatgcgaggaaaaagatacaatataccatttgatcattgccgcattgcatcgctatgtcgcattcatgggatatgcattgtattacaacacgttgaggacataacaaccttcatatttgcttgaataaaaatgttagtcctctctaatcgcattgtaatcaatcatcaaaatcattaggggcctagatgcactttcataaagaaaatcttacactcatatttaatatcacacattctatcttcgcgtcatctcatcccacaccgttctgcctacacatctctttctccctctatttttttttgcctttgtaggaaaacatgtatttaatatcacaatgaatttatttgttattgttggataaatctgtacgaatgtaagtgtgtgattctagttggattgtttatcagtgtgtatgaatgattatatgaacacaatttactatgaatcaatgcaaattgtatcacttttttttgcattgattacatccttttttttgaaaatcagtatcaccagcgattaatgtgaggaataggcaatgatactacttatggtagtcgtttcaaaccccggttgtggtacctcgaactatcatcatcatcaattatccactgttggttcaaaaacggacagggatgtcattgttttgattgacattgatgtgttatggtccgacaacctataagattaagaatttaagatatataagaaagaagaggtaggttcttttaccatgatgtgatgaaagaacaataaatgaatgaaaaaacatatgatatgaggacatataagtgcctgaagatttgacgactcctataaataaataatatatagggaaaaagatgcaagtgatccaatcttagtgtgacggaggagtgaaaaaaaagatgtagtagatctaaatctaacataaatatacatgatatgacaacctctaaaagtaaaataaaatattaaaaggaagtgacaagcggttcaactatggtgtgagaaaagagtgatgaatgaataaaaacaaatagctaatataaacacacgtagatgctggccacataacaaaattgaagacgtactaatgaaggaaaccttatacttatattcaatattacacgttatatctccatgtcatctcacaccttgcgccgttccacccacattttctttgtgtcatcacaccctgcaccgttccacccacacttgcctttctttcccttcctacaaggcagattgcaaggaagatcctattgccattgtttgttttcacaccatcccattgggaaccttttcttacgtgcgaacgatgctacaccaaaatctatcatgacaaaagcaaaaacctaccgaatccaaacaccataaaaaggcttcatattcaaaaattcaaaccagttttgactgtgggcacacattatcttaaaaaaatgactgtgaccaagtgaagtggtggcaactgcaacatagtcctaggctactataatttgtagtggtagaattattaattttgatatatacttaatactttgcgaatgactataacttgtacatagattgcttgtggtttttatacttgctagttaacaatagatgtttaattatgacagtctatacctattaatagatagttccgtcatgttggttaaaaactcatggtaccagtgggtacccagtacccgacgagcatggatatggttttttttcccacccagcgaagagtattgcacatgggcggacaaggagttttcgggtctcgggtcaagcatgttcttgctccacccaaactcgaccgacccattgtcatctctaaacataagtgtccatagtatgatgatatctaaagtataataaaatattagaaagaagagataagcggttcagctatggtgtgacgaacgagtgataaatgaataaaaataaatagctgatataaacctacgtagatgctagccacgcaacaaaaactgaagacgtctaaacgaagaaaaccttacacatgtattcaacaccacgcgttatatctttgcgtcatcgtaccctgcaccgttctatccacactttagtttttttttccctttccacaaaggcccattgcaaggaagaccgtattgccattgtttgatttcttacatgctaggaaaaaaatagtcacaacaaaggcaaaaaaaaactacgaattaaaacaccgtaaaaatactacaaattcgaaatttcaaacccattttgactatggccaagatttatctatattcttttgtgatgtaaaaaattttgattgtgaccaagccaaagtgtgatattgatgaggagcatacgaggatgagaggagagaggggtggtgtggtggtggtgtggtgggggtgggggtagtcgacaaagcgcccaaagtcaaacccaaccaaaagtcattggctccatcgctgcggtgggctgacagcccgtacatttttttaatccacccccgaccgtggactttgcaccatttcgccccccctttttttagaaacaaaaaacccacaaaaagtcgcccacccaaagctcgcctcgcctagcgacgatcgcgagcactcctcctcctcctcctcctccgactccgatcaaatcacaccggagaaacctcgccgtccggccacaccggcggcgcgcgctctctcgctgtcgggggggttggcggtggcgcagccgcggggcgagaaaaatctggtctcggacgcccggctttgttgactaaaaccgggcgggcggcgggcggcggcgactacttcgcacgcgatccgcgccttccttcctcttcttcccttgtttggtgcctcgcctcgtctctcctctatttcttttcgcttggtttagttggatttttgcgttcttggtggtggtggtggtagtggtcgtcgtcgtcggcaacgcgggagacttagcgttcttggtggtgttcgcgatctttgcggcgtccagtggcagtggattgcgtggtgggattggcgcggatcctgttttgctcgtttggttgtcgatcgccggcggtggattccggtggtggaggtgtttgggttgtgagctcgtcggcggcggcggcggcgcattgggtgttgggggccgagatgggcggcgtgtgctcggcggggatcccgggggacaggtcgccggcggagctgtcgttccgggcgatggggctcgtggtggagcaggagctcaaggcgttcccggccgtcgccggcaaggtgcaggggaagcacaagacggcaccggtggaggtggcgccggagcctgatccgccgcgccgcctctcccccgagaaggccccccggctgtccaccggcggcggcggcggcaaggctcgccggtcggtctccaaggagccgcagctggtgcgctcctcgtcggagaagctcaaggccggcaagtccaggacaagcacctccggcaaggcaagtctcccgattctttttcccccctctatttcttcaagcaacaggattagcattgccatttggattaatagatggttaacatcgatcatgaacatttttgcttcaaagttgagagactgcaagatgtggactccgtcttattttgttgacgtaatttaggcatttcttacactgcaatttgtagcataaacaatgagacaatgatctagttgccttttatttttatttttttttctgtgtatgtgtatcagattgtgcatattcaggcatgagctttgcatttctgaataagctctcctgacctgctggctgctgaccggtttccaccgtgtaatggtgcactctttgcaggcttcagacaaaggctcggtgtttggtagagccagcacatctgggattgggaaagcagtggaggttttggacacactgagcagcagcatgacgaatttgagccctgtaggtgggtttgtggcgggcgcgaagatgaaggggagcccacaaaagattcttgcgtttgaggttgccaacacaatagtgaagggcatgagcctgatgcagtctctgtccaaagaaagcgtcagatacttgaaggggaccgtcctccgatcggagggcgtaaagcgtttggtttctagcgatatgagtgagttgatgagaattgctgcagccgacaagaggtttgtgatggatgagagtgatcttgttgctctagttctaacttccatgatctgtaaatgagatcttcacattctggtcatctttgcaggcaagagctggcgctattttcgcgagaggtgatcagatttggcaatcgttgcaaggatactcagtggcacaacctcgatcgctatttttccaagtaggttcacagcttcacactgattacatgtcctgatgattgatatcagagtatgatgaactcggttttgatcttgtgcttgtttgcttccaggctagaatcagaaattacgcctcaaccaaacttgaaagaaatagcagaagcagagatgcagcaattgttgacactggttcggcacacggctgtgagtacattacacccttaaatactcccctagtcacgaaataatgcgatcatagaatgtgtgcaaccacgataattttgacagaacattctctggaatatatggtttcaatgaaaatgatacgagtgaaatatttatggtataacacacatatttttctggatatatgatagtagaattcagtgatcaaagttgctacagttgagtttgaaaaggaaaaggaaatgtcacgctttgattttggaggcagtatgtatttagtggttatactgaaacgagaatcgattccaagtgttatttattatgctactagatcatgtttgcgtcaatcattaatctgtttgctatgcatatttcaccccatgtccatctgctccatgctagcttttcctaatacagtttctgtttcatttttatattgttcataggatctgtaccatgagttgcatgcattagatagatttgagcaagattatcgccgtaaattggaggaagagaaaaaatcagttgcttttgaaagaggtacacctatcatcatcaatacctcacacccttgtagattgaattaggaagccattagtcgttccctttgagaatgattgtttgagtacaatgaatgagcaggggacactgttcagattataaggcaagaattgaagagccaaaggaggcatgtgaaaagcttgaagaaaaagtccctttggaataagatgctcgaagacgtaagcgtttgtactgaaatttgcatgagatgaaatgtttgtataatgacagaaagataaccctgtcatctgggtttaatggttaatctgaaccatgtaatcttcattctgtttgtaggtcatggataaacttgtggatattgtccactttttacatgtagagattcaagaatcttttgggacctatggtatgcctagttgctcagaattttcaatcatcaagtcactaattcagtatggttaccaactgattactttggacttctccatgcttttggtctcccttttttctgtagatggagctttacaattgaatcaaccttcagagagccgtcagacgttaggatcagctggcctctcgctgcactatgccaatatcatttcacagattgacaacattgtaagtttttcttcaggttatttatatatttttctgttcatgtcaatacacaaaatttagatgatcttaagcttatcaggtgaactgtcaatgttttcccataggatttaatagctggtgatatttttccatactatgatattatccgctcgaaagtatggtctgtattcccccaagttatggccatacaggacaatggcatgagaaagatagaatgatagaatttgaaaagccacttaagttattgggattcttaaactgcaatggtttctttcagaactgctgcttttgtgttcaggcagtcaacctctgtaaatgttacagtcacaagtcacaaatttttgctgaaaaatatatttgtagagttagagatcttatgattctagtaaagaaaataatgcaaattatacttctactgaattgacatcaagtacaattatttgttgaacattgactgaattactgaatctgtttactgacttgattttggctaaccgaaggtttcccgaagcaccgttccaccacaaagcacaagagatgcgctctatcaaggactgcccccaactattaagtctgctcttcgaaaaaaactacataattgcccacaaccacaagaggtattttgatgcttaataaaagaatcgctcgataaattgcattagtgattcacatcctaaatttgtgtcttgctgtggtaggttccgatcactgaaatcagatcttcaatggagagaaccttgcaatggattatccctattgccaacaatacagccaggtatagcactgaaaagatccagccagcctttgattctactccagatactgacgttctgttcatcattgcttgtatgctacatcagagctcaccatggattcggatgggtcggcgagtgggcgaacacagggttagatgctcatcattgctcatccgtgcactccatcaattaatcagtccaattattgtgttatcaaaacatgagaaaacaggaccaaaaattattaccatgctaatcagagaacaagaaaaacacttcgcgctgttgattttaacaagttcaaagttcaaactataaattactccctccgtccctaaatatttaatgccgttgacttttttaaacatgtttgatcgttcgtcttattttaaaaaatttaagtaattattaattcttttcctatcatttgatttatttttaaatatacttttatttatatatatagttttacatatttcataaaagtttttgaaaaaaaaaggttaaacatgtttaaaaaagtgaagggcgtcaaatatttagggttgaagggagtataaaactgtagattggtcgaatgctcgaatatacatcaaatcagttagagttgttccacaggaatattatcacattttcatctggaagcatgtacgtacgagttgcattgctgtattgttatattatcttttatacataatatattccgtatcattatctagcagcgcaattgcgtgtgtacagtacatccagcttactgaacgcaagaaattctcatcatgtttaattccaaactaatttatttacacaggaacgatgcgatgcggagggcggctgggcagccagacgtgatcaagatcgagacattctaccatgcggacaaggccagacggaggcgtgcatcctggacctcgtcctgtggcttcaccacctcatcagctacagccgcccaagcaacggtggcaggtccaggtcgccgagcaggtcgccggtg

SEQ ID NO: 56784 - DNA, 12773 bp, Oryza sativa
gaggaccgcgcgatgctccaggacgtgtacgcgggccgccggcgtcgcgctccctgtcacagcaggagccaggagctgtcgtcagctcgcggcggcggcggcgccggcggcgacagctcgtcggcggtggcagccgcggcgcagctgagcaagaacgacaggctgagcaagagcagcaacgatgctccggcgcggagcggcggcggcggcggcggcgggaagctcttcccgctgagcaggaggccctcctccgccgtggtgtcgcccgccgtcgacttcgacatcgacggcatcaaggcgctggcggatgcacagaagcggcagtgaccgtgacgtcacagccaccatcttcttctccgccgcaaattttgctcaaactgtccactgctcaaacgcagcgacgccggaaaaccgtgagaaaaaataagagaaaaaaaatcaagaaagaaatggagatggccagatgatgagaaaccaagatcggtgatggatgcttaattagggtgtgattgatacatgatcaattaattaattaatcgccattgtatattgtaggagaaagaaagaaagaaaaatagatggatagatagcccaagaattgcagctgtcaggtactgtactaccatgagacaatcatggatggacatgttatatagtactccagctgtgcaatgcctgaagactagtagtactactacatatatcaacagactctgcaggcacatatagatagtgaccaaaaaccctcctgcttgtgaattttcaacccttcttgtcttggaatggaatgcacagtttcatttctgtttgtctgcactgttctgtgcaggtacattcactccatgtgctgcactacatgtacaatgtgggcttgcatgtacccaagttcatgagattgttggaggggggacccttgcaaagatctgctagcctctcctcgccctgtgtgggtcatggatgatggatcaatccatgcatggtccatgagggagagggagcaaagattcaggaagaaacagggagatgatcagagaggttcagaaaagaagaaagataacatggacgatcgcattgtccttgtgccatcctctgggctggagtccactctccagctactacagctgtggatcaatccatatgcaggtgcacctcaagggattcagatcaggtgcagttatagctgtgactgcaacttaagaactgcaagcaatttcagccgtccatttcagtgatcaatggctcagatctagtgatacagcgaccgtacaaacagtattatgtactacagtgttttgctacagtgctataaacagtatgcctcactgatctggaccgttccatttgcatctgttgatgaaaattggtactgcctaagttgcagtcccagcagcgactgcacctgatccggattccacctcaaggtatagctgcatgaggaaggggaaggctgccgcatgggctcatgggggcgcaataattcgccatgccaccatggtggtgaggagtgaagtggacaagtggtgccgatctctatgtgtactatgttggtctctatctcgcgtactccttccattctaaaataaactaatataagaaaaaaatgtgatacaacctaatactccctccattttaggttataagatgttttaactttggtcaaagtcaatgcttaaagtttgaccgagtttatagaagtaataataatattttcgactcaagataaatttattaataaatatatattcaattattaatttactaaaaaactaatttggtaatgtaaatattactatatttgtctataaacttagtcaaacttaaagcagtttgactttaaccaaaaataaaaacatcttataacctgaaacggaggaagtatattctttgcctccggttaggttcagcaaccggaggtaaatggaatggtgtcacatacataggtgtgaattacatcaggagatagacgtcgcgcttgtgtggttagtggttgggaaattaggcattggatatgagaggaagggggcccgtatcgaaatttattaagagaggggtgagacaattttttttagaactggctagccagaagatcgccctcaagcctttctcatcagttaaactagattaataccccaccgcgttgctgcggaaaattaaattgcataatatgtaaaaataaaatgtaatttgattatcaaaactaaaacaatttgatacaattttaagcctaaaaaataattgagattgcatgtttttaatgagagaagaaagaatagacaatttagaccatagatctatcatctaaaagatagaaataattgagttgatgtggtttaatgagagaagagagaatatcattaactacatttagtggggatgaactatataagtatatataggattgaatggcaaaacgaccgatgaaacctttactgactgcggtaaaaaaaaagtaaatacaaatggtttggatgcaattaaaatactacgtactagttaataaagcatatatacacaattaatgatcatttttactagtgtactccctctccgttggttttttaaaatatgattgaccgtgtacataaaagtatatttacccatgaatcaaatgataaaaagagaattaataattacttaaaattttaatttttaataagacgaacggttaaacatattttaaaaaaccaacgacgtcaaatatttagggacgaagggagtaaaaaaacaagcagctcgtgatgaactgctcataagctcatgagataaaaaatccaaacatggccccgttcgactcattatatgaccaccagtttgagccgttccaagccacgaccttccagctagctgtttttccgcccctgccagttagcaaccaagaacgaactcgatcgatcgctgtattcttctgctcattgccgcttgtttttcatctggaacgaagcagcaaacaattcaacacaacacgacgcaagacgcaagcaaagctttgattgtcatcagaaatgtcaccttgccttacggctcatgtcatgcacaccacatgcatatacatataatacatatactccaatttttaatagataacgatgttaactttttatcacatgtttaaccatccgtcttattctaattctaatttattttgtcatgaattgttttatcacttaaaaatactttaagcatgatttatatcttatacatttgttcttataaattattttaaataagacaaatgatcaaatatatgttttaaaaatcaacaatatcatctattaaaaaaacggaggaagcatgtactaccatacaaacaccaccattgccaatcaatctgccatgccaagacccagcgagaggaaaaggctccacgcttttcggcaaggaaacaatcgctgatggggttcggtggcatattgcacacacatgcacacatggagttgtttggttcactcctaaacattgccaaacctagctaaatttgtggcttataaattgatgaccacaccttaggcaacttttagctaaaagataggtgtatgacatgtagactttgaattgaaaaactttggcatgccacaactttggaagtgaaacaaacaagtattctagaaagtgtggtaaagtttgacaaagtgagggagtgaaccaaacagctattaactagtattccagtagctagcatgaaggaattaattaaagaatctcttctttcactcgcattatggttcccctttggctgcaaagtagtgtgtactctttctacaggatgaagatgctgcttgatgtagtagtttaattattgctagatggataataagaatctataattaatggacaattaggatgccttgtttataattaactttatatatatgcatgaggaatccatggactatatattattgtggactttagcatggggttagctagcttgcattgtcaggactcaggaggaaaaagagcttgagctgaccactatcaattttttttaaaaaaatccttaattaacaggatcatggcctgtgaataattgttgcatcactagctagtgagcaacttcttttttcaaaaaaggaatgaaggctaacatctttacttggcagacactccggtgtcttaagaatactcattagttcaaatttaaactgaaacattttttgtgatagtattttggagactgaaacctactacaagaattatatggtcagcatgtcgtaatataatcaaccagttggtgtgcagttacatcgactgttggttaatgatttatgacagccccgacaaaaaaaaaatccccaaggttgctataacaagtaaggtcacaactcgcaaatagcaaaagaaatggcaggaattaagaatccgtgcgagttgacagtgcggtgcttctctgataatctcgcacaatcttgtcgaaaaggacacattgcaatttatataaaaggaacagttttaatatatatagaacaccctatctttagatcccaatgtagcagcgatatatatatatatatatatatatatatatttatatttattaaatttgtttggtgctccatggtgcccgggcaccattgttgaaattgagtatatatacatatatacatatgtatacatatacatatacatgtatacatatatatatatatacatgtatatatatacacacacacatatatatatatacatatatatatatatatacatacatataatgtagcaattttaatatagagcaccatgtctttagtagatcccaatgtagcaatcatccatccatataattttggttatagccaataaacatggtatcgtgcgcttttattacgaagaatttggcatatacgaaagggattgtagcttagcgattacagtgctcaagtagttcagagttggttaaaaaaatcacttgctaaccctatataaatacttattaagaattaatcaatggagaacagatcctcatgcagtggacagtggtatcaaagaaccagtccgtataggggtcggggggcagagttcgcgatctttctcggacagattggttgagacttattcttcttaatgaaaagccgaggaacggtcattcccgccagtcaagtttttttttttaaaaaaaaacattgtcatatgctccaatttattaagagaaattttaaaccaagtttgatatatataactcgaacttgggtggtgcaagtatacattgaggtatgttctatacttctactcatatgttgccatgtgtataaaaacactataagcacgctcatttcggcagcctgccatgtctgtatgtaacattagctatacctaggttaagttctaagaagaaattagggtaagatacatcatcatttttcgtgagcacacttttcaaactattaaatattatatattttttaaagaatatatattgaagtttttgtaaaaacaaataaatccaagtttacaatagctaatacttaatttaatttcgtgtgctaatgagttgtcttgttttttttaaaaaaaaaaattcaatcctaaccccttttcgacactcagcctaaagatagtttaaattaatttcatgcttacacagttgatcaacaatggccacccagagaaactttagctaaagataatttgatcagcaatggtcacccagagaaactcaaccacaagttcaaacctaagcccaacctcagtgaagctatcacacaccaacttacctcaccggcaacaacaacaacaaacatttgactataactaatggtgccgatttattggagattattaaccaattaattattaagcacactaattaatcaaactaagaatcttgttgttcatgtatgatactcccatcttagttaatcacacgaattgattaattacaccaaaacacaaatccaaacccacaataataatcatataaactaataatagtaaaacgtacacgagtagtagagagagatggcacgcgcgcgagctctcatggcgccggcgccggcggcggcggcttggccttggcggcgaagcaggcggcgacgcgcttgcaggagcggtagaggctgagcacggagagccactcggcgagggcgtcggcgagccgcggccggcggcgccggagccggagacggcgggcggccttcgccccggcggggtagtagtagcccggcggcggatgcggcggcattgcgccggaggcggcgtactcggcggggacgacggcggaggcgtaggggtcggaggccgccctggagaggagcgagggcgggagcgggagcggcggcgcggaggggtagtgcttcccgccgccgacgacgccgggcggcggctgcttggaggaggagcgggatgacctcgccggcgtcttggggatgccggggcggtgctcccacgagaatgggacggaggaggcgcggagcggggaggggaggaagcggtggaacggcgacggcgacgtgggctgttggaggaaggagacgaatggcgacgacgacgacgaattggtggaggagaaggaggaggaggagcctccgccgcctgccgacgacgggaggagccgccggcggcggcgccggcgtggagttgcggtggtcgccggcggcggcggcgggggcggcgaggaggaggagggcatggtgggtgggggcaactcgctggggccgtcgcgtcgcggcgtcgccttttatgctgccgcgcgcgcaatgccgtcggccacgtggcacggtgacgtggccaacccggctgcttcagtccgcagcaacgccaacaaagcttttaccagagctgtggcaaaattaaggctgagatcgtttgttggctttggggttggggtgtgtgggagggaggggctaaacatcccctttcttaacttggggagtgtttaacttacgttaaaattagaagtttgattaaaattggaacgttgtgtgtgtaggaaaattttgatgcaatgtaaaagttaaaagtttgaagaaaaagttgggaactaaaccatgccttgttactctcttgcgttatttataggcacgcctaccaaactgttaaatagtgtatttttctcttaaaaaaattcttcatattaattcatttttttaaaaaaatatgactaatacttaattaattgtatgctaatgagctgctttattttgagtgtacgagggattagttactgtctccaaccaactaacgcggtaatcattagtgcataatgaattgattaattattataattttaaaaagatttgtttgatattttaaaataaacttatatatagttttttatgaaatgggtcatttagcagtttgaaaatgtgccaatgaaaattgagataaaatatgtattttagttactccctccgtccctaaatatttaacgccgttgatttttttaaacatgtttgatcatttatcttattaaaaacttttgtgaaatatgtaaaactatatgtatacataaaagtatatttaacaatgaatcaaatgataggaaaagaattaataattacttaaatttttttaataaggcgaacagttaaatatgtttaaaaaagtcaacggcgtcaaatatttagagacggagagagtaagaaaagaacgggatcgaatagctcaaattcttcacaaatatgttcttctttttctttttgcaacgatttggcagaagctgtcgtgtttcaaattagttcaagtctttaagatcaagttgttttaaatattctggtaagtggttttagaagtgtatttcacgacaggattatgagcagagcgagtttaaagtccacttgtgcactgatggcacatttgaaattcggagcgccggattaataccactttagccctaccgtctcttcgctcttttttcctcgtcctctctttgtaaaaagtagaatgtgactaatgtgcgatgtttccttcaacaaacaaagcacaaaagcgaggctggtaacacaagttaacagtactgcaatttgaaactttaattcattttctgtgacgaaattgtaatatatacactgcgatttggaggtttaggctgctggtgatacgtcgttgaatcacatttctctcaaaagctttgcatggacagtaggttctccgattatttttcagcaccacgtgtacacgaggatggtgatggttgcaattaaccgttttaactctaatcactgagataatgcgcacggctgttcacttcatcctgtctttttttgagttgattaaagaatgggttgcagaagatgcaagggactgtatatatactacctccctactctagttaattaacaaattcagatttagatcagttgcatatagatatagtttgatcgatgtgatgcagtactgatcttggcagaacgatccaatgagtatggctacctttttacagtgcatgtacttttctctgtcttcagatttcagttatcttcagtagtagtagctttggagtgaaacttcccatttggaacaacgcactctgaattcaggcagcttcccaggattcatgcatgcccagaaatgcaatcccaattttcttcttttttttttacagacttactcaagtggtaaattgcaaatcacgatacaagaaacctaaactttcacggtaaaaaaagaagaagaaaacgatggaatttttttttcctcatgccagctacttccccttttcatccatttaaattggaaactcggcatcgcaaataacccaatctgaaatctacacgcccatggatgcatatgcatcgaatgacacatgtagcccatttcgccatcggggttcatcactgacttgacgaggagaaaagcaaagcgaagcaaagcatcggagagcaaaacacccagaaaagcgaagcaaattagagtaaccagctgctatcagagacaaaagctagcaagataagcactaaacaagctaggaaagcgcctgattttgattgtcattaggctttgcttttctgcaatcctctacctgcgtctgtgtcgtctgcgtttgttcagacgatggagatagctagctagatagatggcttaaacaattaattgtcctggttaattagttcatcatttgtcatgcatgctttcatggtgttaattgctactatcatttagtatcatctgttcggataatgtccctccatttgaaaatacaagacatattttgtttcactaatgtgatagaaaagcataaccataattaagtattttttaacaccaatttaacaaatttagttgtcacaaaaattacatcataatagagtaattgttggttaaattcttatcctaatgaaataaaaattatcttttattttgaaacggagggagataatacgccataaatgattctcctgggataattagtcaccatttatcatgcaatattcatggcgttaattatcatttaagtatcagctagctaggacagcgttttcagcttgcaacagacaccaggaagatgacaaaggctaacctagctgacgggagttttctgaatatcgagtacaggataattaaatctgtgttttgtagtatctggcatcgtgttgcaaccgataattcgaggaaaattaatttggggtgattcttctttcactttcaccctaatcttggagccattgtcaaagggccatgtggtacatgctgacctaatatattattgggtgaagtccattatttggcttggctctgaactttactcttcagtttgaagtccagttttttcttttaaagagaacggtttgaaggccaaatagtttttgtttttaccgtcgaatccaacattttacttcgcgtgtcgggtcacgaagatttagttgagataactgtcagtaaaaaaagatagagttcttgacaaaatgtgcatataacagacaaaattactcagaaaagaaatgcctactctgatgcctaaactctgaactgacggttcttaatttacagcatactatattcagacacaatagtaatatgataaacgtacgcatcaggtgtacctaatcttgttgaaattaagtggcatgagcattgcagtttaaccattaagcacttctttatataaaaaagaacatttttcacatgacgcaaaacggcaaaatggggagcagaaatgaatggcattgattctccagttttatattttcagcctccaattttactaccttgcctgcaactgtttgagcctgaaaaacaggtcgccgtcagattagcagggcaaatgcagcatcattaagcaagcaagaaaagctgtggtccggctaattgtggggggcactagtgtgcatattgctccataaagtgtgtgcactccgaaagctacattcataatgaaatctttgtaatgccctgaacatgttgagcattcactgacagtatcttctgaaaaaaattcagactactgtttacagatagtattcataatattggcacatgttttcatctttaacgcgattatgtaataaacaagaatgcagcatacacaacatttttactatctttaaggtatcaccaggtactaggtaccaggtaccaagaggctacatgccatccttgattgcgtacttgctgtctgaagattgatatgaatcatctgttctctactagtttgcattggtcttggaagaatgataagaatgaattcagaagctgtcaattcattggttccttcgttaggtcaggtagatagcagaacaacatcaggcaatgatatgcaaaatacaatgagtacatgacaagaaatactgcatgtaattagagtgtctgcaggtagcaattctaaacaggatgcagagttcttcgctgtgagagtttaaggctcagcatatgatgatcaatcagtcatccatgcatgtaatcttttgtacggtttctctggaccagattgtgcattaagacacatgagttatcatcattcatcacgcaagcaggttggaacagataaatctgcataattatgggagtttggtatgtaatggagcagatgaaacagctgctacaggagttgttctacaagaaaagaagagaaaaatgataaaaaaacgatctatggaaattttaaaaaaatcccttttgcaaatggccataatgatttgtgatagaaaaaatctagtaatataaggaaataaaaattatgtatcatgccgtaaaatctgaatgaatagaactggttgatttggaggtagaaattcttcctttgtagcactaatggaaattaatagaacaaaagaacagtagtgtttttcatctgatcagtgatgtgtcttcccaacttaactcagattaatctcaacagctatcttggatgcgctgaaaccaacttccctactccctagtacttacaaacatatgcgaaagccgaagaggaacatgattaatagatacagttagttggtcttggtccactgcttacagatgaagctgcgccaaactaaatacaatttggtatagagtcatatgtattgtcagtgcatgaccaattgagcatgataagcaaaaagcatggacaaacaaatacaacatataacgtgttggttagggatatcttcatgatactattttctgaagtatgttcagtgccttgcgactgataacagaatccagttatggtacagtggttcagaagttcattcagtcagtaaaattcaggtactacagcagtttgtcgcaaacgcatggtgtggtgaattaattcatctacaggccttttgagctggagtttcctatatgagagcttgtgcagaggccagaaattacctctataagcttacaaaaacaagagcaatcacatcatttgctagttgcttctgttttagcttaatcactaattgctgtcaagtatgaacctcaatgggaaactgagaaactgtaacgtggatggatccttgtcatgctcataattttatggcttagtgactgataaactgataactaacttacgcaataaatgagacatggcaagaagaatgaggaggcaggagagatgttcttctgtaggctggaaatatcagttatgcagcttcagatggttcagagaagcagtcagtgacatagctttaccagtggtaagttgtactggtaacaaaagagagattgctcagagtacaattgcagaattgcagcaatacttatctgcaaaatgtgtaatctggattgtgaaaagaaaaacccaggcattcagaacctgtaattaaaaaaaaaacgaaacgaaccaatcgggcatgtagactgctgatgaatgaagaacatggagcttgcctatcccctggactaagaaacaggtgaataaaaagctaagctgcacttcgtgctacgactgaatcacccaatgcatcgcctgttcatgcatgagctgctaaatcgcaaagaaaagaaacgaaaaagatcccaatgcatcgcctgttcatgcttgagctgttaaatcgcaaagaaaagaaacgaaaaaagaaacaggtgaataaaaagctgcacttcgtgctaagattgaaccacccaatgcatcgcctgttcatgcatgagctgctaaatcacaaagaaaagaaacaaaagaaaaaaaaggtcccaccgggattcgaacccaggtcgccagattcaaagtctggagtgctaaccactacactatggaaccatttctgattttcaaaccgttagattcattatttattcgtagcatatatttttttacatcgatgtttcaaatcttctctcgcggcaaacttcctatgagggatgcaaacgatggtcttttgtttccatcttggtattaccaatacaacatcttcaaaatgaaacagggg

SEQ ID NO: 56785 - DNA, 7358 bp, Oryza sativa
  unsure (1)..(7358): unsure at all n locations
ttcagaagggaatcggctcctctaacgtttaagaggcacgccaccacctaacgtagcttgtgcatatgtcgtccaaattaatcggacggcctagctctatagggatatcgtcttcctccgctaatccttgaattaatctttagtttgttcttctctatcaaaaaaggaacttgccacatacccccagaataggaatgcctctggctacacgcgctactcaccggtaacagcacgccaatgctttggtccacgacacgcaacggcgctctggacctttggtgtactgatcacctgactcacaataccatctcctaagtcctaagttctaaaaaaatacaacagcatcatatatatagcggcaatggaaaaccggcaaatcaaccatcctatatgatactcttccctataccacaactttcaaaccacattcccctgatttttcaatagaaagacatcggagatttgtgctctttgtgtgttagcaaggatttttttcgtcccttggtccttagctttttctttgccacactacgatctgctcgaaggtagagagagaagaagtaatctcatgtattagcgactaagctaagccctctctaaaacgattgcttacgagaaactgttttgcgaaagaatcaccaggtgcgtccgattaatttggacaacatatgtgtgagcaatgttacgcggtgacatgcgtcttgaacattagaggagccggttccttctaaaagacatagaaataagaaaaacaacgtataaatggaatctctgcttggggggtgttaagtagtacaaataatcacatatttatctaaaaaattattcatcagtgtattaggccccccatgaacaaaccatatgcatggatactaggttgcgatttgggttagtccttggccaactagccgtagtatgtgttggctgcttagctttgcatgcagcaatcctgcaatagtaaatagctaaccgctgaggttaaattcaattaatatacttgtgtaattttatgtgttccttttgaactgcaacgatgttcttatatattttggcaacgtataataaggctaaaattaattctcttgtgttgccaaaacatatgtacacattatccgtgtgaggcttttagaagacaaaaatattaattgtcatgctatttttccgtattaattatcatttagtaagctgccccctcatgttcaaatactggctctgccactgaatgggacgttgtgctctttggaatattgttagattttaaaaatagaaatatttgagctagtgcctgatggtcctcgggaaataaatcacatgaattttataggaatcactcttgggtgatagaggaagtagagagaaataaacagaggacttctcacaggaagacaaatcacgaactcttaaggcatctgtagtgtttagttcggccaatctaatcgaagagttgaacaaaatttcaggtcagtagctatagtattcaaatcgttttgttttgtaggacctgtaaaagagaatcacccaatcattggtgtaccttttatgcatgcatgcacaataaatagtattttactccttctgttcgactccaatgtgagttcgatttgttttgacacctacgacgttcaacaacgacactgtgcatgattcgattctcctaccgtaaaatcgatttttcgttcacactgtagaggctcttgcctcatgcttattttcctcttgaaaaaaagggctggaaaatcattctataggatgtatattaccaaactatcgaatccattgaatcatataagaataaaactttaagaatgcaatcttctgaaattcttatgaaactaactaggtgtccgtaccataacattataaagagaacacctttcttctgaaatactaaactttttgagaagttttacaattgagcaaacactcagattctataatttgccatttgcaaaagcaaaggaggccccaacttgtttataggatcttaagagggggatggagaagaggggatgagcagcacaaaaagcccatcagcgcttcctcacctcacctatgtgactatcttcaattcttcatcccctcttcgctctcatcaacaagcaaatcgagaaaaaaaaaagaaggggagaaaaaataatataataacagaaaaggagatgaaaaaggagttccccggccaagcgccgacgagtcggttacactccgagatggacgcggcggcggccggcgggggcggggcggcaaagcggaagcgcagcttctccgaggacgacgcctacctcatcctgcacaggtaaatccatctcccccatctctctctctctccgttctctcgccccgcggcggaggcggcgggtcgtttctagggtttcgtttcaccggcgcggcgctgcccccccccccccccccccgaacctcgcaggtaccagccggcgacgatcctgacgatgttgcaggagatgggnaagcaggtgggcgcggggaaggggatcgactggagggcgctggtgcggagnacgagcaccgggatcacctccgcgcgcgagtaccagatgctgtggcgccacctcgcctacggccacgagttcgtcgagagcgtcgagcccgcctccctgccgctggttcgccactcgccgagatttctgttacttttttatatatattcgggaaattgttgagattttatacagtagtagaagtagatctcagcttgttttcagtgttggttgttcgtttctctgatggtgctgtgctgctgtgaccgataattcgtaggacgatgggagtgatctagaatgtgagattgagattgtccctgctccgggtaatgaagcattagctgaggccacatcgtttgccaaggtatcactttctggaaagaccattatcttgtacaaccgaagcctataatttcgtatagcgtggatgcttctttcgagtataagatgctaaaactggttgatttccccttttttcgcacctttttttttctgtgtgattatgtagttcttgtgtgtgtgcgtgtgtcattttgggttcatacgaggcagttgttgcacatattatttgattatggtcgtgatctcctattttatcaccgttcagtatctatctgataatgtgtagtgtttctattattgttggcttccgcaagcacagtttatgctttgacactaacataggttgttgaataacttagtagttatgctagtgtgtatagtttgagatagacagaatatgggcaaacatattcaaaggctattattgatgctcaatactggcagtgttcatagcttgattggtgcttcattatcaactggaagatagtgctccgtgtgtttttcactacaaatagggcaataaaaagttcctttgtggatgtgaaaatgcatgggaaaaatgttctcttttttcagtgtgtggccttccctgccatctaataatttacaagttaaaattgtgtgtagtggcacacttatagtgcttgcaggcagtcttgaattacatgtgtctagaaagacataaaagggcaatcaattttagtttatggaaaagattgtcgtatggaatgtgatgcacaaaaccacctaacctctagtttctttggcaattttgcatggtattcttttgaggcctgtggttctgtgtaatggcacctgatcctgtcatgcaatttcagactattatcaccggatcttcacgtgaacaaacctctggtcaacgtgtcaactcagaagctgctgcgctaaacactccaaatgaaaagatagtgcgtgttccatctgataaacagcttgtgcctggtcaccgtctaacaaacggtacaggtccggtttccagctcaaagcagccctcccacacaggctcatctcctgatcctttggaccctaatggacatcccaaaaagaaaaagaagcctaaaccatggtccagagaggaggacatggaactaggagcaggtgtacagaagcatggtgaaggaaattggatggaaattctgcataaatataaatttgatagttcaaggacgcatcttcaacttcaacaggtaagatcaccttgtcaattgcataccagcacccatcattgtgctttgttcattcttattcgcctatatgggattaccattcctgaagtcgcccaacttatggttacatgcattgcaacaattctataatgaaagagtcggcacctccttgcacacagtgcaagtatttaaaaaattaggtgtgctgctgttgcaatcgtttgatcgcttttcatctaagcctatattagagttttcacccatcctagttgagttcttttgtgtaatcgtgcatctggcagttgtgactgctgataactgataaccatggttgatattcccccattttcctcatgtagacagctgtagtctaataagataatgtatgtttttttttcagagatgggcgcttatttgcaagcgtcaggggtcaaccaagcctgctacccctaaaatacccaatgttatgtcggaggaactaaaggcagcacaaaaagcattttcattggccattgggacgaccagatcgtctacattaagaccaggtatcgcaactggcattttttttcccatgtgatcttcggggtggtctttgctgatactttttgtgcttatatgaactgttcatgcaggaggtgtgccacatcacaatccaatggttactactacgaatcctgaggtgaaatctgttacagcaccttcaccattgccggtaccggtgcatgttgttccggtgcctgttccagtgcaaccagtacaagtgcagttaccaccacctcagttgcatcaagcacctgcgcaatctgcacctccacctccaaaagtatcaaatgcttcaaataagtcacgaaataattctaagaaacaagttgcccaatcaattcctgtgaatggccctttgtcgatacaagaggcagctcttgctgctggtgggcgaattgccgaaccaagtgttgccaccaattttttaaaagctgcacagtccacaaaagctgtgcacataagatctcgaggaacaggatcttcaaaatcttctacgggatctaaaacacctactgtggctggtgaacctgggacacagcttggcagtgatcaacacctagaattacaaagtactggtggtccatctcaagttttgactgcacatgcaactgaacaagttcataatgtttcagaagtcgctggggttaatcctctgggacaatccgctggagtgcatttatcagaaactaagaaagcactgaacaccacaccagtgtctggatcttctgacaaaatggaaatagatgacaactctaattattttgcagtcacaatggaggacttgttccctgaggatgtgaagcaggaagatgttcaagatcccaagattgaggaggccatagaccccaaggatgcagacatgttagaatttgatcgctttgtggcccaaggatgcttaaataaggataatgtggataagagcaaggctgccaagattgctccagaagctcaaagcgttattggcagccagaaaaaacagctgaagacgctgcccacagttggcaaaagcaaccctgtatttgctggacctccagcaactgcgaaaaagaccaaagctccagttccacagggtgggatgtctagcggcatagttggcgtgctgaatagatcattaggagggaaggcacctgctcctgctaccacaggcacccaaagtactgtccagaagcagcaaagcatgagctcaaagggcaacttgttagtgcccaagaatgtggcgcctggcaccgtaacaccagccaacaaccgggccaacacagcggtgaacggggctagcaaggtgaatccaccagccagccagaagccagcctaacatggtaaattccttgctataataacgccctaggacttttgtgcgcttagtttacttttgaaatgtaaatagggccacgtagataccatctattctttgcccccctttgcatttgtagctcaattcctttctgaaccaaagcactggtgaaaacattaggttagactggatacaccgtttaatcgctttgccttctctgtgatgtcttagactgatatgttccatttgttaagctggcctgagattatcatgccgccttcctgtacagcctcgcctctttctccgttggatagtttggttgattggccaaatattcagaaactatgtcattgtggcctgatcaaactgtgaagatggcacgccatgcaagttgtctctatcggctttaatttatggctttgaaaaaaacaggggatgaattctggaatggccttgtttttggctcaagattttttccatgctgcacgcattgcgacgaagatttggagtgtgatagcatttcatacactctactgcatgtactgtaattgatgatgataaccgcgtggttgatgtgtcaactgctaccgcacacagtggatgttaagacctctgtttggtgtaactgtcacacacggtggggctgcagcctggtgaccacgtgtgccgtggcagttggcattttggtcactcgtgtcttgtcaggtcgcttgctttgatcattctttgccattgcggtgacatcgtggcaactggcaatggacggacgctggcaatgctgctggttgttcgaagctgattttaagttttgccagaaatttattttaaaattagtcattttgtcgtctctaaaattgtttttgattagtaggagtaatccacaaacaggcggggccgagataacctagtacagtagagaatcttttggtcccagaataaaaatggcactattccactacagagtgctcgtcgtatgaagcatttgcccagcagttcgttcaaatgggacaatatttggatataaagaatcctacacattctttgtgaatttgtacgttacataatgccgaaattccctttgtcgccgaagtattcccttcggcatataccaatggttggggccttagggtgtgtacaatggtaattaatgagactattgattatgaatctttactaaaatggaagagatagaaagaagaaaggaaaaacatcatttctacagttaacaacaacgattatttgctctctataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56786 - DNA, 1349 bp, Oryza sativa
agaatacaagagtcgagagcctaccaaacttctcgtggtatcaatatgacaaatggcgggggaggaggaaaatataccatcaacttcagttaatagtgttgaaaaattatgagaccagatcgaggaagataagtccgtgagcacaatcttatcaagtgaatatatgtggaagatgaataccagatgcatgtcaaaccccctatctctgtccgcgtttctcctagaactcgtcttcgatgaaactaccacacattttcgtatacatggtaacaaaaatatccatgacctaaggctctgcttgacaaagctatcaaatttcatgcgtcttttcacgtcacatggaacatttccatgtgtgttttcccctaaagaaaaacagtaataatattaatattagtatcacacggaaaactcaattcaactcttaaggggatatccccttattttcatgtcacttaaaaagttacaaattttttttaaaaaaattagtagaatagactaatataagatatgtcacttcacaaacataaacatgtaaattcaaattcaacttatacaagtagaaacaaaaataacaaatttgactaaacgcgtaattcacggtcaaatttgctatttttgtttcgaacagtataagtctaattttaactcgcatgtttgcgaaaagatatatcatatattgatctatcttaatagttttttttataactttttaaacgagatgtacaaaacaagggagaaaaaaaatccacttccgtatcacactgttactgtcacagtgctccgcggtagactattcccccacacgcagccgccacagtctcccccgtccttaacaaccaccgccgctacagttgcaaaagaggagaagggcgggcgggggctgggccccacgtgtcagcgacacacgcagccgcaccgccaccgagtataagtacgagccccaccccgacgcggcctctccctccctccccccaacgccaccgaagaaaggctctcaccaatccaacggtgctcgatccatccatccatccaatccgcctcgctccatccatggcgtctgcggatgcggtctcgccggcgccggcgacgtccgccgcggcgcagcagcaggtgagcgtgcgacgccggccgatgtggatggttggagttggggttttgtaggtgttcgtccggtgctgacatggtggttgggtgattttgcagctgcggaccgtggtgctgagggtgtccatccactgcctcggatgcaagaagaaggtcaggaaggtgctcaggagcatcgaaggtacgtggcgcgcgtgcgtgcgtgcggcggcgcttcgccggcgacggcggcgggcattcgg

SEQ ID NO: 56787 - DNA, 1797 bp, Oryza sativa
ctatctgataacaattagaatgtgtcattgtgttcctttcatatgacaccatgtaatacatgtacaattgctatatctaatttaaatggagtatctcagctgcatggtacattccgttgtttggtgactctagccaagttctcagaaaccgcctgagttagattctgatcctcgaatttaaggtctagattaaacctgagaaaatgcgaaggaaactgattataatttgtacgggtaaatagcaaagttgttcgagatgttatagttcaaagttttaataatttgatgacggtgctcaagatataattccaagctggcaggcaatgcataaagaaatgaacacaacaggtgaaactttctctaatactccaagaaataatccacttacttgggatcgagggttattctctgaatttctctgacagcagaactagctgcatataaagagatttttccaatctgtacagggacaaaacttttttcaggttctccaaaacctaagaaagttaggcatgaagtcaacttataaccagattagtactagtcaggtacctcgagcatcttcagttttgcatcatgatcatttggtaggcagcgaatctcctgggccattcgggccgactcccccaaactttccggtgacaggaaatcaagagccaattgaaccgtagactgaaacattttgaagaaaaaagagaagatttaactctccagtgagagagaatcaacaccatgtgcaattatcatgtgctccctaagcatcgatgcctcccagcatctattttctatctgtatttattcttttggtatgtctacatccaaatcactagataattaaacatatgattatatgaaaaccctgcattttttgctttttatagttcatttgcccaatttttaaccgccatagagattgtttacccaaatcgacattcacatcagcacattctttattcatagaagaaagcttttgaccatacagagaagggaagtatgagcacataattagtgtttggagtaccatggtaagaatttgatggagcaaaaattatgctttatccaaaatcttcacatatttaggttgcatattctaaatgatcacttacaaagcaaacaaaaatatttaaggacaataaaagggcaaatacgaggaacggaagaatcacacctggagatttttcacttggaatgggcagccagcaggaacaaatacagcctcaccgatatgttgttggaatgtccagggttcaattcctgtaacaagatccaaattaaggctctcacaaaaagtaacttagaaccacattaataagatagaactaaatttcaatagcctgagattatcctcataaatattattagcattctgcatggttcactaagcgcatgtactgtagcacggaaatcagagatcaggcagcaagcagatcctagcaaagcagactgcagcacttggttgcccttcaagcaaagaaccaatggagtcttattggttactggaaatttagacagctattgtctatttgctttggtattgcaatgaaatgttttctttggaatatggacacaaagtctgaggagtgagtgaagtaactacatgaaatgagatgctatggcatatcagtaatgataagttcacagctaaatcatctgccaatttagaagcgacaatcatccatgccgtactttgtgcttaccatattgatccttcagtatccttttatgatacttgttgagatatatagactgttcataaataggattcttaacctgcaacaaaaacagataatcatgaaa

SEQ ID NO: 56788 - DNA, 1102 bp, Oryza sativa
tcatcaaactttgagcttacatggtcaggtgattgttcccccatatccacattcaaattttgaacaggtgcatgagcatttacatgcattgtcattccattggcaatcttttcagatcgctcaggttgtagcctctttggacatacgtcatgccctttggctgtatgcattagcatatgcacctacaagaggaataaatagcacatgtatcagatgacttttatttcatgcacttatctgtttagaattcaaatgttttttttctccctcaagcattctcctttctgaccattggataaatatccaacagatcagacaactccctaatccacttcctgcccatccgggcatcccctgatgccctttaactgccccaatctattcacgcttgtgttcttcgtttcccccaacctcgacccaacccactgctctcacccaaccggcacacagggcagtgccacacgccagcctggcttcctaccataacctcggagcaccctctctttcccctccccaaccttctctttcccctccccaccctttacctttactctggtgcttgacagcacgaatcttcgaacaggatctaaaagaaaatcgcatgttcttgcctcctccctttgcaacaaaatcacaagaaactcgaagtgaatctagaaagccctacttaccacatcagccatgttaatcattagatttgtcactgaatcacctttaccagcttcttgatgtcttccatatgcaattaacagcttcaagccaacttcaggttgtagggtgtctgggggcaatttagcagaaagatttaggagcccccacctggaatgtataaaatcaactaatggaaaattgacaataaattctggtctttggcatagcagaaactcctccaatacactgggtgggggccactctttcaatttcagcatcatcaattccccatcttcccccttgtgaccatctgaataacctttgataaactgtttcagctcaatatccacctgaaaagaaatagaacacaggatatattgttcagatgatcatagtactaagacttggtagctagaaaaagttatccaatccatcacgggctgcaggaatt

SEQ ID NO: 56789 - DNA, 1529 bp, Oryza sativa
tttggaggaagatgttggttgctatgggcttcattgtcgcgtagagtggtgactggtcttcgagtccatgattggttgcagatgttacggagatgttaggaggtgttgtggtgaacgggtctatattacgatgagaggccctggtgggtgcgcctcctttgctcccaagggagaatactggtgtcctaaaatgaaattagctctaggagggagtttatatagagatcaaagttatcagcttgacggttggatctatctcaaatggctatcaaaagtgagtaaaatttagcaattaataaatgggcacataccgtccataaatacccaatttcatataatttatacttctaaaagctaagtagcttaccatgtagctttgtatcccgcgactcttatacaaggcggtgtccaatctttaggtataatacgatggaggtccaagagtatcacaacctccattcattttctatgccttgcctaactcaatgtttagtgacatatctataacaaatttaagtaccatataattcacacatatctattacgtttgagtccgcgtatttaatcgatgacatctttttacaaaagttaatcagcttagcagagtgtatttgatttgtgatcatcctttatgtgtatcacggaaacctacgctagtgctatatatatgtcacatacacaattattttgttttgagttggactagtcacacaaattaccgtgcttcatcaacgacactttaatacgcaaacttaacacaaaccccctcggcgaccggccgcccacacgcatctcccaactcgactcgacccaacgtcccaacccaagccggtcgagttcgcgttcgcgtcgcaccgcgtcacgtgacgaacccgatatcaaaacccccgccgcgcccgctcccgaaccaaaaccctcgaacccgacgagtatcccgaccaccactctctctctctctctactctccctcctcgccgcgccgcgccgccgccgccgccatgagcgcgggctggaggacgctgctgctgcggatcggcgacaggtgcccggagtacgggggctccgccgaccacaaggagcacatcgtgagcgccccccccccccgtttccctcccctccccgctcgttttgttctctcccccccgggggggcctcccgcgcccgaaccctaggttttcggcgtccggatttggggggcgtgcttgcgttggttcgtgcttgagtgggcgtcgttcctggttgcctgcggtagggggagtgaggcggtagtggtggagctggggagctcaaaaccctagccacctgttaacaattgctgggcgcttggggtttgggtgtgtggagcggagccgtgacggtcttgtccggatgatggagatgaggagagtagtaacaacaggaaggacagaacgacgtgttttgataatttgttctgcataatttctaccatttgaatattggaaaatgtgtgtgtgtgtgtgtgttttaatgatgaaaacagttcaaggtagagagatcaaaattgaacc

SEQ ID NO: 56790 - DNA, 892 bp, Oryza sativa
tggaccaagctagtatcgattattgtaactttggaagctcgtgatagccatcgaaaggaacatcttggttcagtttcatggctgtgtcaaagccatttttctcagcattaacaccattgcccattccatcaacctctagcttaagacaaacaagatttggcactactttcttgaggtcatcactaacagaatcaaaataatgagtgccttttgtaagttcacttcttgaaaacctttgaataccaggcacaatgaatacaaggcaattcttcgttgtgctgacatcatttggcttctctgagtgccaccctcttgcaagcaaacgaggccagacagcttcccaaaaaagatcatttgatcttgtcttgcttcttctgaaatcacccgttaagaatttgattatatcttctgaagcaagagaggaacaatctttgcctgcaggcatgccgggctgaacagaaaggacttggtttggtttggatgggtccaaaacaaaaccagtcaaatcatccttccctttaccgatcgcaaccgcctcaacaaaagcttctattccaacaacagatttcagatgaaaaacaaaatccattaatgatgtttggctgtcgttgaaagatttgaacatctgcaacatgaaaaaaacaatgcaactcatatagcactgattgatagaaaaacattatctattaatatccataaatttgaaataacttagttctgtgaaattaaactacgtaaagttccttggaccattgcaaattgaactccttgtgtgtactcatacttggagagcactagggttttttgtctttttggaacagctctaccttaaaaagtgcaaagagaatacaattcacaaaaaaggtagatcaagacacagaaaatcccaaca

SEQ ID NO: 56791 - DNA, 923 bp, Oryza sativa
ctcttttatatgctatatgtgttgatggcatgtttatttgagaaccagtgcaaccaatggacaaatattctagtcaactaatttgaccttgcttacattcatgaatcctctgaagattagctcagagcacagcatcaccaccatcaactcttttaagtagtataaattaatatttttattttatgatccttctacacttgttttgaccaagcgttttctttgtaggaaacttgttatggtgtgctttgtcgagaatacgaacactccaaagatgcaatgtttgaggtcagcacccaatattctatcatgtgccttttcacatagtattgtctaaattcacaattaattcggtcttttgtttttatagcaagctatatattgtcttagtcctatgaagaaatatcgatgcctaaaattggcatatttccaactgcagtcagtttccccttctagaaaaaaaaaactatagtccattggctaagccaatcttagtattccctactttctcaaatataagcatttctaggattcgaattttgtacacaatataagcattcctgtagtactacttgtcccatcaacctctcattcaaaagttccccatctttatccgcaaccaccctcccattcccaaccacccctcatttattttcaaaccttattccttaatctctactaaacaacctacaaatacttatatttggaatggaggtagtatttgtaaagaattctaaagccaagatgtctatttatcttgtcaacttttctgcagtgaaggcagaaaataaagatatcaatggagagatagtatatcttatattctgcatcttgtgaatgaattgatatgatactaactgaacatactttttttttgagcagtttctcctccaatgtgcagatcaattgcctcacaagattccttt

SEQ ID NO: 56792 - DNA, 4152 bp, Oryza sativa
aaaaatctagtactcatatgccttttgaatttatgaagcctttgaagtttttatttttcgagaacaagccttgagaagttagattagctcttaaaggtggttgcaagccacaaacacactgcataattgtgagtgctgattaacatgattgatgaaactattgtgtgagaggaatccgaagttgacatacgctttgcttcatattttgttttgcttggtcctgttatttcttgagctgttgcatatgactatgctctgttcttttaaatatagttttttttcctgaagctgttattgttcattattctgccgcctatgcgtgtttgactgttcactatgtatcctctatggaacttggattgtcaatttcgttccaaacattacctatatcttgttttaagtttatttttacacaatattggtgtaagaacaagacatggcaatttagtttttattatttgacctaggcattaaactaagtccgtaagatggctctttttttgtttctaatttcagataggtttgataaacttggaaaatgaagatttttccaagggtattgtcgatacaacacatgccaatttacaggtacatgtagatgtttttcttatgccccagcagtattaggtctatgtagatgtttttctttcggtgctgaatactaagtcgaaatcacattatggttctccttcttaaagattatcttaggttataaatgatgtcttaattgcaggatgccttgcataatgaaaatcgtgacagaatcaggatattgctgcgatttctctgtggcctggtaagttttgtatttggttgatttgatttgattttgttgttgacattattgtgcttgttgctttcctaatcttaattggtgatgcctgaaatgtgtctaactgacgtactatcatagtgttatgtttcatacaaacaacacatctttgcgaataattgaatctgtttgtcaacattcccaagtatgcaaggctattagttcttgtctttcaaccttactaacttgagcgcttatgaatcatgcaacagtgcatttgcatgacacaacatagcaaactcacaggcatttataactagtgattcataaaatttgcatttggttagcataatctttacttttggtctgcattctaaaagttagtgctaggcgctgggtagccattccgattaggcattagatggtcaatcaggcagctaactatccgtggcgactcttgtgctactattttagtgttcatttatctaacttctctgtcatatacttgctaattgcttttaattgactaattatgttggacctaggtgccacctaggcggtgtgcaggcaccgaccctgcccgatcctctagcacctagagccttcttgagccatgtttttagttctgattctccaaattgccacctaggactgagttgacaagttataaactgtgaatgctttaggtctcctctccaaaagagcagagtgacttctttctacactcttcaattcttcatatgtcgtgacaaacattttctttaattgcacactatatggatatgattgagctgtttgtggtgcaacatagttttgttttttcttttctccattcttttcataactatttaatgtttgccttgtagatgtgcagcaaagttgtcctgccaaattctattattgaaacatttgaggcactattatcatctgctgcaacaatattagatgaggaaaccggaaatccttcgtggcaaccacgtgctgatttctatgtttattgtatcttggcttcccttccatggggtggctcagaattgtttgaggtaacttgaactgctgttctttactgctgatgtgaacatatgcagttcagcatgactgtatcactgtatctaaattagttgtgcatgtgaatactatttcatgtacatttctgttttatcatttttcttagttttatttcctatatgaccagctagagggaaagctgaagcgtcaacaattttttgaaacatgtgaaactatatgaaaatacaatacatttccactttaggagcacccgttgttcaattattcttttaccttgggatccatgacatgctaccttcgtttttgaagccattttgaaattgtatactagaaaattctgcagataatccagtggtataatacactaatgatatgtaacatgcagcaagttccagatgaatttgagagagttctggttggtatacagtcttatataagcattagaaggcattttgatgatattgctttctcagtctttgaaacagatgaaggcaactctcccaacaaaaaggtgaacatacactgtttctccttatcaactcagactccactagtgatatctagatcaatgttattaaagttagtccttgcaggatttcatcgaagatttatgggagcgtattcaagttctttctcgcaatgggtggaaggttaagagtggtatgcgatagtccatatgatttcttaatgaacaaatgttgttgaccttcagttgcaattgcatatgatatgtgacaattatacagagttatatcacaatatgtttcaaaaaccctatatgcatccaatagttacattcagaacacctttttcttatattaaattgggctggtggtattccaaaatcttagacatgcttgtgtctaattggtttctgcactctattttacttccttggcagttccaaaacctcacctgtcgtttgaagctcagctggtagctggagtttctcaccgtttctccccaattagttgccccccacctactatctcgcaatcatcttctgaaatagtaaaaggtcaagaaaagcatgaagctgatctgaagtatcctcaaaggcttcgtaggcttcacatatttccaacaaataaagctgaggtaatgtgcaaattttcttctgttcatgatatcagtgcaacttttcatgtttttgattatcacgttttcaagtttataccactttgttatacactacaaagtcattttgttatataactcttctttaaataatacattgcaatatttcactctgagtttgctcaatttgttgccagctgtgttcctatatgcttcatgctgtcccagtatgtacaacccagagtctaaaattaaattttatttcataaagacgcaattacacagatactgttattagatagaagcaaataatatctgaacattggaccaatatgttccttaatacctgactttgtgtgaaatggaattaaaataatctgttacttttaatgattcgaatattattaattaattccttgtagctgttccatttgtcagacaaaaatagtcacacaggcagacatctcttgtcgtatatgactagtcatgtgaaaatggtatgattagatttgtcctggaaaatatttttatattatataatgattgaacgaacagctgctaacacattcatataacaagtagcggtcaaagttgaatcttgaataccaaggtgatgtcaaacatgtcatattaattgcatgcagttacaccagaaactactgtgcacatcagcttcagtaacagtaacaattccatcatttcttggtttgattcatttctcatatgtactttttgcaactaatgtactgtatcaatatgtatgacaactgtattccatgtcctttatgtctaaccatctagttttggctgcagaacatgcaacctgtagatcgttttgttgttgaagaatgcatattggatgtgctacttttcttcaatggatggtcagtagttcaatttttccaagattatcaacacctttatatttttcacagtagttgagactggagggtatcacctacatacctgctaatatttcatggaaggcatagttgaccatcaagtcacaagatttgcttgtcagtctttatgctaaacatgcactaccatattcttattgctcttgtgtcttgcttctcttacaaacaaaaattggtcatatttagcccccatacttttgtcttattgtctattgctatgttttgctcggatgtagccagtgaggagttttaacttggttttacctaacaagacttactcttctcaaaataagttgtggagagcctatgctttaagatttggagtttcttcttcttcttctttcctttttggtg

SEQ ID NO: 56793 - DNA, 2605 bp, Oryza sativa
ctgtggaggtcacggcgcagcgaacacgcgctgagtcgctggtcgtatacggagccgcaggcgcgatgagtcgacgggtatcacggctgcggaggtcacggcgcggcccgcacccgccgagtcgccggtcgtcgcggctgcggaggtcacggcatggcgggcacaccgagtcgtcgccggtcatggcgtggcggccagggccggacgcatgtgtagggtggcggaaacggaccttcactcaccgcaggcaactggaggaaggcgaagaggatgcaggcggcatggtgatgggggctcagcgtcgaatcaaatcctagggacaatttggtcattttaccctgatactaattttggctgtcaaccttaaaacgtcaacttttttgggacggaggaagtagtctctaatgcaaatgttctatcattactttctcaaactatatatttataaaaaaatattaacaatataactacatgaaagagtttttcatgacaaatctactaatataatttttcatattttaaatcctaataatttttcatattttaagtcataatctactaatacaagaagtagcatctattaatgatttaagattttgaggtttgattgcacgcattctaggatttcatcttttcaagtttcaagaacggaggtagtactatatctttatatattgagcattcttgcgagagctttattggtagcaaaagatatcagcaaattgttttgacacgatttaatgtttgcctactgattagtgaaatttcaacttgtttactgattctatctttgttatgtttttctttgaaagacagtcgcaaagaatgtgcattttatctggtcagcttacctgtgcctttccgttatgaatacctgatggctgagaccatattttcacaggtactttttaatcttcagtgtttgatttttgattttagttgatttagtagtgtagtttgtatagagaacttcactatgaaaaacaacccttcatgcaacgcattctaaccagcttcaatgtgacatagttttggtttaaaaacccaaaaaatcttggactaagttatattccactctatgcaaactggctcaaatcagtatatgcgcatagctaggatactacctgctaacggtatttatgcatgttgcacattaactagtcaagaaaagcatatgtttttgtgtgtttaatcatgtattatattgatattttgcagctactgttattgccgaatccccctttcaggccaatttactataccttggttattatcgacctttgcaaggtactattttcatgcttttgatcttgtgagctaacactgtttgttgtgactgcgttactgtgtgataccaatatattgttgagactaatatgccccccttagcaatatgttgtctagatcatggctgttttgatggtttactcaacttgccaaacttctatgccacaagtgtggcttgccacagtttttgtggtgccaaaaaagctagctacacttgtggcaaattttggcttgcaagtgagtctgacttgtggggcataagaatagtgaagtgtggcacaccataactttggcttgcaaccaaacgcttgcctcaaaaagtcaaacttccctaacttgagttgacagtttggcaatgaatcaaacaccacctattgtttcattttggtaaacaaccagcttctgtgaaaaaatgttagtagcattgtgttgtacatctctgaactatattcaagaacagctgttgatacaaaaatgtagcatattggcctaatgtaagattgttttggtgagctgaggttatcagaaaaaaacaatcagttctctgtactgttgcaaagctaattcgacctatattgatctttcatgaacttctggatacggggaacgcatgctgccgttttttttttaacttctgggtattcaattaaaagcattctttgggtattcaattatgcttttaatgcataagtacaacgcccaaagaataattcagcttctggcacttttagtattctttgggatgatacactgagttaattgtctaaattccaggcattgccaggtgcatttccttcagttgtggtaggagcagtacatgctctttttgacagaattagcaacatggatatggagtgccgcacccgacttatcctatggttttcacatcacttgtaagttgattgttctactgtttactgtctgacctgctatacatattttttctgttgtttactatctatacgtctttttcttgggaatttcttgtggaccattacatgagatattccaaaacctttaaaaaaatcgtcgccttctttctcatatcaccctcaagacaaacttcaagtcttattgctgccaaattgtgatcgatattgttctgctttggcaggtcaaattttcagttcatttggccttggcaggagtgggcttacgtcaaggaccttccaaaatgggctccacagcgtgtttttgtccaagaagtattagaaagggaaattcgcttgtcctactttgacaaaattaagcaggttagtgatatgcaaggaagcatattccttctcactgtttctactgatggaccaacagtcatttg

SEQ ID NO: 56794 - DNA, 2835 bp, Oryza sativa
aattgcttaggttactattcaagagctttgttgaagtgctaactgaacgtttgccacctatttctgctgatggagatgttcctaatttacgtgctggagacccgaatgtaaattcttcagcccgtgaccctgaagcaacaaccatggaaatagacaatgaaaatggaggagataacgataggtcagtttattattttgtttgcaatgctattactaggataactacttttacaggatggacaactatttttcatgggcggttcattctgaaacgagctttttgtggaaagcttgcatgaactctagtagactaggattttgtattagtcctgcatatatctataagagtaatttactcttaaaatgtagaaaaaaaattcagtagagattgctagataccagtcaagacaaacaggttcttggatggattaatatcagctgaccatgatttaattgcagtattcacctatgtcttgaagtgccaggaacccatatttactgttcagtataaatatgttcgtgcctgcattaggggcttggctgtcattattcggctgctaacttgtcttcatgctttagcagtcagctgaatggtcaaaacaagaaaatcagtcacaatgttggagagcttgagcaatggtgtctctgcacattgggctatctcaagtcgttttctcgtcaatatgctactgaggtgaggacctgtggggagttagagttatcatgctgtaatatggatacctgttagatcaaattcctttttataaatgattaggccaaactggatttctccagtgtagttaaactatctgtctgacaatttctgtatactctctttgattccaaatgtaaatcattttatacttgtgcaccgtagttaagaaaaaagctcaaatgattctgttacccttaatttacactgttctggaaaaaagaatagtcatttatttgtgagaggtgtagtagtatttatttttttcaagggcaaacatgaaagaaaagaaacaaatggcctagaagttccaaacagcttacagtcaggagaaagttgagaagcctaatgtgttagcatttgaaatatccaggctacggtgtactagagccaaatatcacaggctgcatgttaaaattgttttattattacaaaagaactcaaggtcttagtaaatgactgatttttctgcagtacgttttaagtagttttcttttccatggcctccatagcttctactaattggatattacacatattttgcagatctggtcccatattgccatgttggatcaggagattttcgttgggaatattcaccctcttatccggaaagctgctttctccggtttgtgcagacctaccagtgaagggtctcacctttgattttgacccttccagtgagttggagtttacctgtattatacgcgacaaatttttcatcatgcttcactaactggacatgcccaaaagtactctgatgtgtactcaggaactccatcgattctcctgtaatcctggccccgaggaacacccttggtggaaagcactgtaacgactttaggtgattaaattatcagttaggtttatttgaattgtagtggactaattttcttgggtgagtaattgctatggtctagctttcttaattccctctgcctgtgttaggacaacgccgtgtttattgataagctgatctgaagccgtcattactttacatgttgagctgtcgcattggtgggtttgttacttggtccaaattccaatggaacttgcttgcaacactggtccttgcaacgtcttctgagcttctactgagcatgcactgtcaaagctgtttttttacctgccatggagtctggagctgccataacgaaaatcttggtaatgctatgctttgtacactagcgactattttatctctgggttagggtagatcggaaaaaggatcacgagctaggtccaagaggggtctcttcacgctttcctgtctttaatttgttgtttctatgcaattgcaaagaatcattacggagtaaaacggaagattctgtgccacaaacaaaacagcatagctactacaactggaatgggacgtttaccaactgaagccgaactatacttcttgtttatccctaggatgcaacggaatatttattcactaatcaggtggatgaaaattaaggcgcttgatttgaaaaatgacagatgaatcatccagcgaaaaatggacggtttttttagggtgccgaagtcaccaattagtgtgttaaacaagggcaacaaaacgaatgtttcggataatgattatactcatttgatcgggcacataattagtgcgtaaaatatttacgcggcaaagcgtactcagcctaatccttacatatcataatccataaactatgtttaggagctgacaaaaattgcaagcaaataatatctacaggtttatggctttgttttgcagagaaacacgtggaaaaaatctctttggtttcgggtaaatgacaatgcgcaggtgctggttctgtttactgtaatgaacaaacaggttaatctctactgtacatgagatttacagggttatagaattcattgcccaccatgcttccaaaccgttccatttcgtaagacctggaaacaaacaatccataatcagcaggagatttcgtataagtacaaaaacttcaccattttaatgcatttattcaacacagtgaatttcagaagctatgcgcatgtaaggggcaattcatgactactccctctgtctcaaaatataagaatctgtgtccagataagacatcctaatactatgattctggacaagactcaattctaga

SEQ ID NO: 56795 - DNA, 2208 bp, Oryza sativa
  unsure (1)..(2208): unsure at all n locations
ggaaagacgagaaggactaaccatttagccttcagaattttatactcaggtggaacttaccaattaccaattacaaaattgttcttgagtgctggcacatcatcagtgccccacagtaacaccaataaaaggtattatgctgcttcgaagttagtataagtaagcgtcagtcaaagattcacctaatctatagaaccatggcaggggaatgcttgatatggagcccatatgttcccgataaaacacatttgcctacctacagcagaatggttgccagagttcaaaccatcacgcatgaaaatccggttctacctcagctggatccgttcacacagtaattgcgtaccaactgccaagaagatgctctaaactgtacaatatgcttccaaaaggaacaggttaatcgaagatgctccaaactgtacccaaaaaaaaaaaaaaacactgaatgcctccaaaacgtataagattaatccgaagtggtgatcctatttgtatgaaaaagcgctggatgcctctaaatgtacataaaccaggcaagccggtcccagttcctatggagctcacgcagacttagtagacccatctcttttgcaccgtgtaaatatgctgaggtaactgcagccaggcattccaacaatagctattcatggggtgccatttcatgcaattctgaacatatcaggtgttgattaactccatagaaagccggacaagtctcagtagctcattgacattgttgaagttaaaatctaaaactgttcttactgaagcaagaccatcgtccacagtttttcccctttcctgactgctagcagcagaagcaatagcaacctgtgatttccgagttgcatcgaatgcacaattgacatcatttgtctaaagatcagaaaaaacaaacataagttagattccgaatatcattattcgatggcaaagcactgaagtttcattatgctaactcattaattactacaatcacagtcagttattgatgatgataaataaatattcaattcaattaaaaattggttccatgctatctgcttcctgtggaccaatgtggaagcatatttgccaagcacaggatggtgtccaaaacagggacaacaatgtttaggtaccagtaccactctcgattgttttttaagttgcatattcactttatgtacatctgacccaattatcaccaaaccaaaagtaattttggtagacatttgaccaaactatcatttacattttctatggtcaaagtgtaaacaactcctgtcatcaaagcggatgctgttcatattactgtattaaattgcaatatttatgggtattcatgggtttggctactaaccaaaattacgggatgtaagtggctaacccgtgaacccgcttataggtcaaaataagcgagttcgcggcttattttattctataagtggatttgnggggtagccactacacccttacccaaaatgttaatgagttaaatgccattttgaccattgataatgtatnttcaatttagctattgagaactgcntgattttaggccctgtttggcaatgcagtgacttttcaaaagcactcattatctatatttttttattaaaatattagttgatttttttagctttaacagcaaagccttactggaatcactaaagatttccctcactaaatagattccaaagcacaggatagcagtagcaccatagcacaaataaccactactgcctgtactaattgagctaaagaaaatgttactgcatcaaactcctactaattcatttccaatttgaagggtatagtcgttaatatacattgttcaaatccccaaaagagattatgtattaaattgcaattggttctgcctgtacgaaacaagcctccacagcacagagacataaaccatagactagaaacagttcacaatggaacagcttgcatatccatatctataaacatgttttcatgaagggacagatgaaggaacctagtaataaaaagattgtaccaggctaaaggtaaatagcttgattgaaagtaacaattaattgggacatgtgcaataaggtacttacataggcaagtaacctcaataagtgtgcttggttacgaacggccagtggcaaatggttgccagccacttggggtgagtttccacccttggttgaaagggcctttgacaatccatggctatttaaattatcgata

SEQ ID NO: 56796 - DNA, 12383 bp, Oryza sativa
ttatttcaaacttattttagaacaaatttcatatagaaagttttcgtacgaaacacaccgtttagcagtttgaaaagcgtgccactttaatccaaaacttcatccaagttttgttggacattcgaacacggcctaactggcgttatgggttaatgctgtttggatggcaaaaactgacgttttagctttctccacaactctctcccttttatttctccagaatacccctcatgcatgcatgcaaacagtaaatgctgttgcttcgtctccatccagcggaaaaggctatatgggtatttaataagggtataacaggaaatatggtgactaattaataagtcattggtatttgcaatgctgtccaaaatgtcagttaatatagaattggagggagtacagtttatagtgaccagatagccatatcagcaaaatggatttaccaagaatcgtataaaccaaattagatattcggtaatgccaggtcaatataatccatatatccacatgcaggcatgcggcactctctaggccaacaaatccattactagtatatgcctgtaactgtattttttgtataatttggtttatctagtaaaccatttgtagttacataatacaaaactatgattactatgattacataaatacaagttgcatagccatttgtgatgtgatgaaggaaggatgcaaactgttggagaaaactgtcgtgcacttctttggtaaagatcgatggaacatgagaaagcggttaagggggtaatgtggtcgttggtttgtttggaaggtctttttcgctttgaaaggctttggagtctttgtgctcttttagttttatgtaaggtgcttgagcctctgtgctccttttgtttgtaaacttgtgtaagaactgagcttgttcactcggaatttctgtggctgtatacacccctgttggtgtagaagccgggttttataaattcccattatctaaaaaaaatagctgagccctgtgcctggacttccaaaattctacccattcttgatgcacaacataggaaaacgacgaacaatttggtcccacaacttacattcaaatcttactttagtctgtgagcttttaaaatagtcaatttcgtccatcaacttatacatttggatcaaatggtccttttactgatgtggcgtacaagtagcactgacttgggatttagatgactcagaatgccatgagaagacaaaatataccattcccttacatatcacacacacaatcaatgttctctttcaacaaagaatgcaattcattattctctatgaataccaaatccagtccctacatgtttggatgcacacagacctcgcataaacaagtcaagaagcagcaagcggttattttcatcttaatcatttagtgtaaggcaactgaattgatggtcaaaattggtccttttgatgagctaagtgagaaagttggggaccaaattgctcatcatcctaaataaataaattggtaatactcgaactccagtgagtgacacagtgcggaacaaaggatagtagaagcagcctccaactcccagaaaagctcagcaggaataaaaaggattcaaatatttcaaattaaagtttacaagctagaacaaacatttttttagacatcaattacctggagctatctgtacaaccgactgtagttcttgtcgatccttgcttgcactagggtgtttgtaatacgctgctttgaggtaagccacttctacacatttatatgctaaagcgggataagccattgtattgcatcgttcataggcatgagcacaaaagctggacagtcaaataaaaaaaaaagcattttagtatactgcatttaaaaagcttagttcatatagtttcaaagttagacatagctaaccatacgtgaagaaaactctgatcaatttaatatggatgagtattcactacgtgattagatgcaaccatccaattcgtcatcattcagtgtagtttaattaaaacagccagatttatcttcaatttgtttgaaaaaaagtccactttactaccttaaactattttcacagtccaacctaccctttaaacattatttaggctcacttaatcccttagtttatttgtgcagacatatgtttgcaccctaacctggtactaggtggtattgccagtgtcgagtagtttttaccggtaaacctagccacgccacacatatgtgctgaggtggagtataagggtcatggcaggcgccaggcggagcaaaggtaggatagatcatgacattcatgcttcgcgtggctttctgatttctgcttccagatagttgcatttgctcacgtggcgaggctgtggtcaaggttcctgcccaccgtcaaccgtctccaattctccatcctagcgatcgcagccactaccgcatccttagtaactaataatccattgcagcaacatcagatacagaagatggatgttaaatccagttttaaagaatagtcagatcagatggatgttgctgcgtaacagaattttggttgccatagctgcaccagcgctgtgcgatgcagccgatgctgtgggcctgttactgtgacatcatccatcctacacttttcggcatgctgccaactgtccctctaaattacaggtgaccacaaccacgacgaagtccaagtgagaaaccaacaggcaacagctcattgaagaagacgcagttgctgcccttcaagcttcaaccacagcaaggacatagccaggctgcgtctggcgcacaagacgtgacttgactgatcaaaaccactccacgctggcaataccacctaacaaaactgggttagggtgctaagtgggctggtattaatagattagggggttaagtgagcctacaatgagggcacactatggtgtatggcgggagcttctaacctccaagagctgttggccaaggcaatacttgtgccctaggagggggcgaatgtgggtgggtcttttttgtgttttcagcgggtgtgatggcgtgtttttgttttgtaagtccgaccttttattccttgcttaatgaaatgatacacagatctcctgcgtgtttgggaaaaaaaagtgagcctacaatatgtttagggggtgaagtggacttatgaaatagtttgaggtagtaaagtggactttttcgtatttttaaatacctagactgttttcatcccttggtgaatcgtggtgtgtctttcttttgtacctatgacaactttatataaacttttgctgaaacgaagtatataaactttatagacttattcaatggacatcacaggtagctcacctgcagagttttgcagtttcagaatacatcttcattgactgagcaacatcgcctgatctcgaattgtccagattaggagtttcccaaagagatgcaacatgcagaaacttcaaagccgcttcaaagtacaggcccatactttcaagttcaagtcctttttcctgcagggaaaattgtcattagatacttccaagcaaaattgacagcacaattatgctgcctgagacaacatttaacacaattggtgtcaccaaccttcaaatgattagccttgtgttttagatcccgagcttccttgagtgcaaatgcaatcatattaccatccctcctaattggactcgcagaatctccattttcaacattggaccttaattgtgtgtggttttttgaagcacctggttttactctagtggtgtgaacctctgatttgccttctttcatatgagaatgattatcttgaccaatagacttttgcatatcttgattatcaatactaggacgtaatttctcttttctggatgacatctctatctgcttatttccctctgaaatcaagttactggatccatttctaccttggcgtgaaggagcactatttttacttttatgtccagtggaatcagctgtagccctcgggttaaaacaatcctgctgatcaggttgtagtgtagggccatgcatatccaagatctttttatcaccagggtacaattgattatctactctccccataccggagttatttgtagaaccacgcagaatggcttcacccacagcttgctgcccagtatgtagtaaaccaacttcgtgggttggatatttcattggggtatgcaagatgcttgaatcagcattcaattctccatcttttccagttttcctggccttagaaatcttatcagtgtttgaatttttcagtggtgatgaagatactgattcaacgggagagccctttgcttctcgagaatttttgtttctccgagagcttgagacctttgaagagcttgaagttgcaaccgtagaagactgaagacaggcaacatccctcctagtgggttccgccaagttcaagacctgtctgggaggttgattatcccatagttctgatggaccttctttacaagtaacaaatttgttgtcagcaactagctcattatcttgacgccttccagcagaagaaaataatgcatttgcatcctgaacttcttcaggcctagcttcggacttctttatctttgataatctctcgttcaaattctcattatcgccccctttgcttgtgtggtccattgaactgagccggttatcctcccattccttcactgtcttctttttgccagacaaatctaatgtttctatgcctgcacgatgttctttcatcttctcatgaaaggccacatcatcatcattaattctctttgttttttccaaaatatcaaaccttgaagctttttccttgcgtaaagaaaactcatcttgttcacatgagtcctttgacatttttgcttttgcagataaagctttggtttcatcacgaactttgttgccagctaaatcgtattcatttttccaatctttgttaaagtaatgtcgatcctctttttttgtcttcttagatgttttgtgctcatctcgatcaattcctctcctgttttttgattttgaatgcttcttcgatttttctgtaagatctcctgtatttaaataggaattatatgtcagtaaacaatttaaataactaaacacagtatttactgaaaaatatcagaagataatacatatcagctaaatataagcaataaacatgaaagagagcagaacctccatctgagtggctactgcgactcttgtgcttagacttatgcctttcagaagctgatttgctctgtggcaccagatcatgtgtgcttacaggatctctgtcattagtataatgttcactatcaacaacttctctattttttgcaggggcttgttgattgctcgtgagagtcatttttgcaggggcttgttgatcatgctcgtaacagttttcgtctttcagagcatttttccttttcctactctgtcccagttgtccacttatattgtaggtgctagatgctgctacacttgcatgcgcagtgtgagggccacctgaagaaacaccagcggcagggatttgagtgacataaagtgcatttagagcatttgttgtttcatcctcactaatgtcgcatttgttcatcccaggtctgcaaagacaaatttggattgtatttttcagtaatggaattttttcttccccaattgtcagaccactcagagaaagaaaactgcatgacccttgaattagagtgctacctcaatgttgaatttgcacagcttatggaccacttaaaaatacttttttttttgtttaaggcggggtggatgggtgttcggggggagatatcagaatctagtcaaattacctgtctaatcagaaatcgtttaaggtgtacaaagaaattccagatcaaataactatatttaacaacgtttaaccatgtactaaggacaacttaacatatgtaaggtgccaattgaagcaagcatgtatggtgaggcataacactggataaatgcaattctaatcaaactgaactagaacttacagccagtcaagcatgctgcatatccacttttttggaagcatggaagtgtttgtcccgtaggggaggagacgccatttatgacacatgtcacagcatacccaattatcctctatcaaaacaggtgcaggaagagaagctgcatttgcaggtccaggtataatcccgccatttgacggcatatgcaactgctgttcctctgaacctggaaatgtgccatgctttacactggaagggatctccttttttgctggcccagttatatgaagttccttctcattatcactgttcatcatcttctctttccgttgaccctgaacacttacactctccaatgaagccccttccttgtttcctatagatctcttaggcagattttcactaaggtctttatgagatttttctttcgatttattttcaaaatgattagacttcaaatgagaatcagttgccccatcattaactagtacagaagaatgggtaaaattaccatcctctaagaaactagatggtgctacaaaattagctttgtgttccttctgcattcgtttgacctccgttctagagttatcttccacagttctctcactggcaaaggtttctttaccatgaattgtcttcaaatcatctgatgacccagcaccccagtccttgtccacattgccttcaaaatcatccatggcaggctcaaatgttctcataggttttactttgctttctttcttcctatcatacggagaaaatttgtgactacttatattcatgtcttctgaagtcctgtccactttactcgccttaagttttactttcccccgtggtgctaaacaaccatttcctgaactgtcaaaactactgttttcttctatatgctttgttacttctgttttgactgcttcgcttttaactgttcccaggtcattgcagcccatctgttgtttcggtcgagcatctttagttgattcttctgtgaattgacttacaccttttaactctgtggttggggcgccagaagaacaggttatatcatgtgtgtctgataaaatcactcggctgccaggtatttctacattagcctccttgcccaatattgcactagtattatttgcatcttttctagtctttgtatctatggacttctttttcttgccatcaggcttcattttcttagccacatgggctttgacatgcccagacgaaagagaaagttctgaatggccatcaactgctctaggtacattttttaagtccagattagtttcccatttgttaaccaatggggtgaccttattcgtcaatttcagaatgtttccatgcagaggtgacagcaagaatcctccaggaactgaaaagtacgtcatgatctgattgatcatgcagataaaaatataagctattataaccattgtttgactatgcttaatgacatagaagtgataattcagtggttataaagcatttatacctgcaggatggtccgaggagattcatatggcacattactacacactggagattgaccctcatgaccatcaggacttccttccatggatgaagaagaagaaatatcaaggcccaggccactgtagatagatgcattctttcttgccaaagtattagtggaaccaactttgatccgaactttgagtgtcttctggtcactaccattaaatgagctgtccaaggaatcagaacaagcaacagagtccttctcaccgtttgtgcttgagcatatttctcttttacataaatcaccagatgacggtgcagtggaaccattatttcgggagatagattcatttgccacagttgaagggtattgacccatgctctgcatttgtaatcatgacacatgaacatacgccagaatatacattggttaacagcacaaggaaaactaataaagcacctcagcagattgttgataaggtgatcttgaagtgccaacgtttgcaaccttgggtgggcttctgctttgaggcaaaggtggaggtgagcgctggtatgtgggcaaaaacgaaccatatccaccgtattttgatcctgtcaaaaagtttttcccacttaatatgactgaaatgcaatgaacaaaagcgacaagtacagcaactactagctctttacctaggttatctgcggatactcctccttcaaagtctttctgaaaatgtccaagaacatgttgaatcttttcatcctgagaaaaaaaaaacatggaaagcaattaatgaggaccagagataaatgctttgatcacagaaacggacatatcacacacaagcaaacataaaggtttctgggtttcctcaaaataaatgctctcagttcgtttttacttgtaatttacgacatcaacacagtctccaattcatatgttttatcattgccttctccaaccatacatttattaaaagaaatttgaaatataacaatatgaaagcaccattcgttacaaatctagtaataacatttatacatttcaaatcttagtatgtatgcaaattagggtttatgttttcaagatttcattgcacgcattccataacggcatctatttgtgaatggagggagtaactggtctcggaggcaataactgcagcaatcacctaaaaacactaaaaagaccatgtgtgtgtgtgtgtgtgtgtgcctgcctttaacagaatttcaacatcttttagttagggtgtccaagcaaaccaaacacccttttgaccataagtcagaactttggataccagatggggtcaatcaacaagaaatgaatgccccaaaaatggataacaattcttataagtcggtaaagacttgcgcatttaattaaaagggaattattacaatttaatgtttattaatgggtcgtttagtcagttggcttttaccgcacaccaaaagtggattagtagtaaactcaacacatcacagataaccgaaacaacgaggcaagctagcatcgcttcacttgtgaggacagcgcaatgaaagaagcttggactaaattgatcattgcgcttacacgaatcacctaaacgagcagagttcaccattcatcctccaaataattcgaatggaacgaaggcgcttcctcaccctaccgagacaaagacgaaactgagatgttgatggtaaccacttaatttaactaaaccaacatcctgcctaccaatcaacgaactgcgaaatcgtgcaaaagctgccgcgcatctcctcccaaaaccataccgatccagcagtcccccgcgctgaacggcgccgaaatcaacacattcattcgttcattcattcatttccgcgaggccacgcgagagagagggaggcaacaaggatgggtgggggcgctcacgatgtaggagaaggcgacttcgggatcgaggcagagcgcgccgccgccgccgtcgtcgtcggggaaggcctccccctcctccagctcgacgtcgccgtggcccatcacacggaacccctcctcctgccgcccccgcaccgacagcatccgccgccgccgccgccgccacccagctccaaatcgcccgctccctcgctagggtttgaaggggatcacgcgattcggcggctccccgtcgacgctggctgtggccgccccgcccccctcctccggcttcgacctcgccgcagatattttttaccgcggggcccctccgattatctctatttctgtttctatccctctccctcctgtctctctctcaggctcagcttagctagagctactcctagtactaggctactactactagctgtgtatgtgcgtgttgcgtttggttggttggatggttggttggttgggttgggttgggtggcggcgcgtgaccgggtcgtttcgtttccttgtgtggccgccgacttggggcccatcacctgacacctgcgggtcggtttggtttgagatatgcggacccatcgtttatttacggaaaaaaaagtaatttatgattaatatatatatatatatatgtatatatatatatatatatattattagcgattaaaagacttaaaaataaaatttgataaagaaaacttcaaatcagctttaaatttaatgttgaaaattcaaattttatctaagggtgtgtttaatttttttggtgtaaagtttttgaaatacacggacacacatttgaagtattaaacgtgcactaataacaaaagaaattacatattccacatgtaaattacgagacgaatttattaagcctaattaatctttcattagcaaatgtttacttataacatcacattgtcaaatcatggcgtagttaggttcaagagattcgtctcgtaatttacatgcaaactgtgtaattgttttttttatatatttagtatcatatgtatgtgtccaaatatttgatgtgatatttttattcaaaattttttgatctaaacccggcctgataagcataaacgaaaaaagatgtgacccgttatgcgatgcgtttcggttccgacacgggagcgggcaggccgggggtcacgccaacggtgtttgcgttgtgggcgtcacgtccgcggtacgcggcctcgttcgatctcctgtgggcctttcttcgtgggcctccgccacagccacaccctacagcagtatagcccgataggcgagagcgcgtgaagtgaattgattgtcttgggtgcaacgggagcacccacaacaacatcagagtggcgcagcggaagcgtggtgggcccataacccacaggtcccaggatcgaaacctggctctgatacacgattttttttcatctcaattactactctccaattaatttttattttctcttactactctcgaattactctccaattaatttttattttctcttattactctcgatttttttaatgtcttctcaattactactctccaattaatttttattttattttgtattttgtcatctcaattactgctctccaattaatttttattttattttgtattttctcttctcagttagtactactcttgaattttcttctcaattactccctcaaactcctaatataagctccaattaatttttattttctcttactactctcgaattactctccaattaatttttattttctcttattactctcgattttttttaattttgtcttctcaattactgctctccaattaatttttattttattttgtattttctcttctcaattagtactactcttgaattttcttctcaattactccctcaaactcctaatataagagattttactttcactgtttgaccattcgttttattcaaaaaaatttggaattattattatttttgacttaatttattatccaaagtattttaagcataacttttcattttttatatttacacaaattttttaaataagatgagtggtcaaacaatgcaagcaaaatgtcaaaattccttatattatagtacggagggagtaccactctcaatttttaattctattttattttgtattttgtcttcttaattagtagtactactcttgaatttttcttctcaattactactctccaattaatgtttatttggtcttaccactgtcgatttttttcttattttgtcttctcaattactacactctccaattaatttttattttattttttcttatcagttagtactactcttggattttattctcaattgctactctcgattttgttatgttgacttctcaattactactcttgatttttttttagtctcctcttttatttctttttgttttctgaattactactattgatgtgcgacagatatcgtcatcagggatgcatgactgccaatttttttcaatctattaaacttcatatgttttgcctttcatcttgctaacgatcatgccgtatatcaccggtcgaacgatgcttccccgattcatctgcatgccaatgccattttgcctccgcccgaccggcgacgccaaaactgaccagttcaagaagatatcaaagcaacaaattctactgtacggtaaataatcgaactcgatcgaatcaatagtcaatctaatctggaaaacacaagtttacatgcatactaagcttaacgagcagtactaaaggacagagctcctctgacataaagtcagagggacgtgaatatccctaacaggtaggtcctatctttatggacacacgtgtcagtgatcatgtctctttacgtcagagaagcctcttccgtattaagaaagtggtagttacacagagcacattagtaattactccgtaaatttcccaaaataaattactccgtaaaatcgaagagacgaaacaattgatacatgggcttttattgattggagagcagtacagtgtctagctagtaccataaactgagatgccacgtactagcatgcagatgcagtacacgtgtccccaatcatacacgtacggcgatacacgcatcgaccagcagctgataga

SEQ ID NO: 56797 - DNA, 6625 bp, Oryza sativa
caattaacagttgcttagagcacccgcaatggtaaagtaaggtgctatctataaaacatgtacatctcagcaatagactagattaatagtaaactacttcaatggtatgtctacatgggtatctatagctgtctaatccattgcctcgtttttctctatagactatctccaggttagtagatagctttgctctctctcttcatttaatctcttccaagtagtaaaatatgctgacatggatctcttgtagagagcctatagatagccattgtgggtgcccttaagctggctagctagctacttcctccgttttataatgtaagtcattctaacattctccacatttatattgatgttaataaatttagacatatatatctatctagattcattaacatcaatataaatacggaaaatcttaaaatgatttacattgtgaaacggagggagtagcttgcatggctggatggactccttgcttgctactagctagagatgttgagaaagaacgggacaaaaacaagtaaaaaagagaaaataataggacgtacggcaacgaagaagtctttcatgaggaggccgtagaagaaccagacgacggcgctgagggtgaggaagaaggagagccagaagggcatgaactccacgctcttggtcctgatcacttgcctctgcaaaaccaaatttaatcaaacttgatgttagttcttgttaatatgctaattaattaattatcttataatcaaattaatgaaacagatatatagttagatgaagctatggtattttttaatagataatatcgtatacatatttgatcatttgtgtaattaaaaattatataattatcatctattttattatgagttgttttataacttaaaaatatttaaagcatgatttatatcttatatattttatgtttaaaagttaatggtagcctctattaacaaacggaggtattatgtatgtgactatgtgaggaatgaattaatgcgcttacgatgatggtgagcggggcgacgaagacggcgagggcgaaggaggcgccgatgccgccggcgagcgtgacgcggcggtcggtggccttgacgaggagctggagggcggcgacgacggcggcgaagagggcgaggttcatggcgcagacgagcttgagggtgaaggccatggcctgcctgggggcgtagaggaggtagacggtgaggtagagggactcgacgaggcagccgatggagttgatggagaggaggaggaggtcggaggtgaggagggcgtagtagagccacagcattgcgctcagcagcgccaccgcgtacggcaccgactggaacgactccgtcgacttcttcttgtacacccgataaaacgtcggcctgcattaatttgcattgcattcacatcatatatatccattaattagcttaacatgttctctctctttttttttcaagatgcatgcaaattattaacagatcatggacttaattagctcaatgctcatgaagctagtaggtacttacactggtgcaaggatgaccaagaacgacaatatgttgcctgcaaaaatcatttaccagcaataaggaaaattagttagttcgagtggcaaattgaagtataatgcatgcatgcatggatgcatactatacttgttgtggaaaccactaatactactgcatgctagatgtggttagttgttatagaagtgtgtaatctcgaattagctagtgtgtgcatgtgtgttacctacgatccccacagcaaagaccaatgcctgaaccatcttggaggatatgagatgctagcttaattagagtttgatcagaggatgatctcctctcctgctctacacaccagtattaatccaagagcaatttaggagatcaaccctctagctagctgtgtgtgtgtttgctactaccacctgaactgacacaggttgctcttcctgggcatcgtccctggtatttatagggccaagaaaggagagcccaacatttatattattagtagctcgctcgatcgccggatcaactcaagattagctagctaaattaaagaggccggagagatgatcgagttccatttgcttgtttgatcgagctttgccagtgaatgcatacgtgtggccgggcgcactcacttttgcttgcattgatccccggcctaatctcccctggaccctctctactgttcatgcctttgactggcctatgtgtcggtcatccgttcatgacatgttacattaggctagggcacttcgactgacacatggaaattcaccctctacatgtgtcgatggaagtcccaataatggaagcatgatgataatatatatgcatatgtagctatatgtatgtatagcttggtgacagcttggcatgcatagatcgattcaatacatacattcttgatcactcagaaaaaaattatgagggtttgaaccaaactatgtacatggcagagtctcgacgtttaatttgttcctcagatattgaatttggattgcaaacaaatgttagtttcaaacccctagctagctaaaatttcatgtaggcggtaatttcagcattaaaaaactcttaactatccaaacttggcacgcaaattggggagctagctcaaaatttgtttgaaagtagtcttatatttgatggataactcttgtttgtttttctatacattcaattgttgtttctaagtgaatatattgaacatctataacaaaccaattaatctagctagctacaccagttgattaattaaaggtatatattttcttctccctatttaattatcatggcaatttcttagcttgagagcagatgttgttgctaaaacgagatgaacgagtgatcaggtgctttgacctttgtttctatggttgacttttcctttttacattgatggagattcaactttgagtaggtctgcatttagccttcctcttaataatatgtgagatgttttttttaaaaaaaacaataatatgtgagattgaaagagtgataatatatatatgtaaacagccaggggcggttgtgttagcgtcggtgtcagacgacaccgacgactttcagcaaaacctatggttaaactgcttatccatatattataacactatagtttaagtataattagtatgctatgataccaatgaatcaattttatggatccaccacggtaattaaacagccaccaaatagtttggtgtttggaattaatcaccagtcacaaaatccaggtttgatttttttccccaaaacacaattttggctattaatctgatgatttgttttatatcatatataccggtgtgattaattgtaatactatgaaataaatttctgaaaaaatatgcatattttctttcttttctatatgcacctatacaatttatattactacaatacactttgactttttctcaaagttaatctttttaaaataactaaatttacagaaagtacaacaatattttcaatacaaaataacatattatcaaaatatatttaatattatatttaatacaactaatctggtcttataggagttgctatattcctataagaagtttgttttttaaaaaaatcaaagcaacttataatataaaacggagggagtattcagtactctatcataaataattgtgtcttctgtcacttttaaaatttggagtacagaattactaaaatgttttaattggacgtatgaaaatcatacggatagatatgctcaaaaactacaatcacaaattagtatgcacagtttattgccccctttttttttttccggttttgctaaaaaactgttgacagttttttgtttggaaaactttcgattttctagccattagatgtgctctaggattcgtgcaacatatacacctagaataaaaaaaatcgcatgggcaaggcagtcatcgaacatgatgcacacgttaagctaagccatgcaccttcttattagcaataactcttttttattatatatcacttacaccctagttatatatcacttacatcttaattatagagtagttacataacacttacaccctagttacatagcacttacacactagttacagagtagttacacgatagttatagggtagttacattgtataaaattatgatttgcaatttttttaggagcgcatattacttttgaatttgaaagtttttttcccttctacatgtagaccaatttcttgttgttcaatcagcttagacactaaaattcatggtttgtactagtgtggattgttcccctataaccattgatgacaaattctgtagtcaaaaaatttgaaagttttggactaaaaaactgtcgacaactcccagctagtcccatatagaaattagcgcgataaaagttgcaacgacgcggagagagtaccttatcgatcgatcgacatccaaaacacaacaggtatcgtctgtgacccgaccgaaacttcgcttaattatcgaaagtgcttttcaattcgatcgttttctttaacatcaaactaacacactaacgcgaccaaaagttaaaaagagggttgggcacttctgcatgcatgtggataccccatatctttgctttgaagttcccattggagataaatgggttaactaataagaaagcgttttaggccagctatagtctcaagcttagctgcatgcttaattagttaattaggaggacaaattaaaactgttgcaatcgcacgcagcacgtaaacaaaaaaaaaaaaacccctagtccaatcctgtcctctttttttttacccatccgtgtgctgtaaaaatccgtaccggcaaagtggattaccttaatttggacccgcggtgaaagtgtgtaacgacgcgcagtttatccctatagctactagctagtagtaagcttttgtcttccccgcgtaggcgcgtacgcgcgcgtcaaaaagcaaaagcatgcagcagcctacgcgcggttaggcctgggtgtgccggcgcgagatccgcaccgtccacgtggggcgacctacgttacgccttacgtggggtaatctcagccgttgacgtgtttctccggcgaaatatgttgtggttttttttttgttactaaacggcggctaattactagtgtctgcatgcaaaactaaaaaatatatattacaaaacgatatgagtgacaaattaacaacacactgctttacagtcaaaacaaaattttatggtcaggtcagtcgtcccacctatgaccaaatgcatgtaaaattaatcaattttgcaggcggttcaacgcccgcctgcgaaaatggcgatgccctaatagatccacgtatgaaaatcgattttcgcaaacggcacccttcagaccttgtaaaaaaaatttgttaaaaagaaaccaattttcacaccatgtagacacctatttaaatacacattcagagcatgacggtagaacatggcatgtaagaattttcaacaacagtagaacaatatcaacattgtcgtcgcagccagaagcaacacacttctggtcgtcatcattccatcacccgcgttgtcgaatccgccttcttgcccacacgtcgctagatttgcccttccacttgcctgccattgagggatatgtggccgtcccaaggactaccgccgttgtggacgagctcgcctaagagggggagtggatgcaatggatgatgatgctgccaccagatattctctgtacactaaagtttaaatcatagtgcttatatttacgcgtatgatgtgaaaaaccattagtcatataatgacttgctgctggtgtaactatatagaattgcccctcaaaaagccacagattatttaagggaaagtagacgaactaataaatatgacgttttttatcattcaaaatgagcaacatgaaaagaatgggcaactaaatatatcattaatactaaaatcatttaaaacttataagggatgagatatttgtggccatgaacgacagggatagtggtatctggcactttgcatgagaagggcaggccataggctggccaaattagtaacttccttcctcaatccttttcctaccctcaccttattcttcccaaaatagttgggccatcttcaaaaatgccgaaatttcgattaatgtgggaatcgaaatctacaaaagtggcgcctataaaaatgccagaaaatcatttatctacaaagttcttgtgttttaacattgatttcgacaaatatatctattaattagttatagttttatatatctgtgaatattagttgaccatcaatagatgtttccaatagactatactgcatgtaaaaattttctagcgtgtgtattagacaagcacaatctaaataggtctcgtaaaactgcccgagagcagatcagtacatggttagcatagtactccttagactaagtagttattttcagagaccggattgtagaaacaaattatttccttcacgtttcgattttttttaaaaaataaacttttgtattttattgcttagaattaagtaacttgtgaagtttatttatcacaatatttaatttgtttctataattaagtagagctaatctcgctcaataatatgtatgtttcaaactagatcggtctagtgctactcca

SEQ ID NO: 56798 - DNA, 2210 bp, Oryza sativa
cactaccacatgacctgcaataaaatgtaacgcgccctattagtgccggttaaacaaaaatcgatattataaggcatttctcgctcctagacctgcgtgtataagggtagacaaaaacctaactaatgatcccagttagtgctgatttttaatgaacaagtagaactatatgagcaagtcgccctagcgctccaagtgaaataagttcacattatccatctctaccttctattgctctctttatgccctttctcctttctctccccactcaccgaccccaacgagcgatggccatcactacctttcacgattgttccgtatccgtatccctccgggtcaccggatccaaccaccataagcttagatgcggcgatgacatgtcggttgctccaccatggcgaccataagccggagcagctatgactaagatatagaggtgactaggattaggacaacaaagctagtttttttaataatagaaatggtttacatcttcaatctctaccgacatgcacaaatctagtttagcgggagtagtgtgtaggcatatgtatggctatgccgagcgagctgtagcagagggcatcgagtagaaggagcggaactagcacgatggtgtgagaggctaccacacttcatattaattcctcaacgggcttagatcagatccagatctagtaacaattgtaagtatcaaagacatactccctccgtcccattttaagtatagcaatggttttccatgcccaactttaatcgttcgtcttatttaaaatatttttgaaaaaaaaacataagtcacgattaaaatattattcatgttttatcatcttataacaacaaaaatactaattataaaagaatttgaagtaaaacggactatcaaagttaggcacgaaaactcatggttacacttaaaatgggacggagggagtaatgctttacaattgttgagtaaatacattcagtcttaaaattccgcgtccaccacgagaaattagtgtaaccagctgaaattaaaatgactaaattatatctgattgcatgcactgcagcacatcaattaaactatcttaattagtcatcagcttaattcgtcgtgattagaaacgccggcctttcctcctaactgatcaactgagattgggactatatctcttggtgggtgcgcgtatgttctcctagttaaagaactgaagaaaccgctagcttttccatggaaaagaactaaacaaccgcaaagtgcaacgaattaacgatcgatatcctcgttacctcgtagtgtgcatcgatcatgcatgtatgagctagcggacgcgtgctttaattttcaacaatttttggatcgattctgcccactacaccagaatttgttaattgatactccctccgtttctaaatatttaatactgttaactttttagcacatatttaaccgttcgtctcattcagaaacttttgtgaaatatgtaaaactatatgtatacatataagtatatttaacgatgaatcaaatgatcataggaaaagaattaataattacttatttttaaaataagacgaacggtcaaacatatttaaaaaagtcaacggcgtcgaatatttagaaacggagggagtataagaatagggaccacctatacatttgccgataaattttctcctaaaaatttgacaaatgtaattacactgtaacttacgtgtaattacattataacttgcatataactatagtgtaacttgtatgtaactttcacgtaattttaaatcgttagattgttataagatttgtacaagtggggaagaaaaaaatcacagcagacacacatgtgagaggattagttcccacaacctccattttactgaaataacatgttacggagagatttttgaaagttacgttatagttacagtgtaattatatatgtcaaatttttgggagaaaatttgtcaagaaatatatagcaaaattgtaagaataagatggcaaacgaagtgcatgctatcttacgatttgtcggtaatcaatatccatctttgtatcttacagcatataccttttaatgtttgtcattgtttcaaacacagctttcccatggtactatatagcgtacttggatcggcaaagtatggttggtaccaagtataatcaaatatccagacggcgttgatgacggtctctccacatatcctcgtttttccaatcaatg

SEQ ID NO: 56799 - DNA, 1169 bp, Oryza sativa
ccgtcgccgtcgccgcagccgcaggcaatgcagcagcagtggtcgccgtcgtacctgtacatgccgtacccgcactcgtcgccggacacctactaccgcgactactacagcccgccggggacggcgcacgcgccgccgctgcaggacgagtaccgcatgttcgacgacgagaaccccaacgcctgcagcgtcatgtgaacgccacgcgccgccgccgccgccgccggctagcaggccaggccggccgggagaagtagtagttgaggagaggtagagtagcttgtttacactctcctccattggagaggtcaaagctctccttcaccgagcattttcttttttttttctttttccttttttttttcttcacttcctctcttactgttctaattaactagagcatgtaattgtaatgagacacgccaaattatatatgtttttctcttatcattttgtataaggcaaagacatatacatatatataacagattacataactactataagtactaattatttttctatggatagagaaggttctatcttttgtagagaatattcttgctacatctcttcgttttgtgagaagctatgaggattgaggatggctctctcatcatgctgcatctttctctaggacggcggactagggtgttagtttttataagcataacaacttacgtagattctataaggaacaattgaaattttaatgttttaaaacgatggatacgaatatactatatttttttctagtttaaagtttagtaactggctatattccactaagtgttaaggcattaatggttactataattttacaatagaaattgtgatgccttatgtgtctaaaatcggaatgcgtaaacacggacatagaaaaagactacgagctaattttcgcgcactaatagtgtttatttcccatttcttgtattggcttgtgctcccgtgctttaatttggttatcttattgttttattttgctccctttaaagagatgcgaaaagaaaaatcttatgttcacaaatgcatttttaaatataaaactagaatttaaaaggaccaatataagatctaagttttaagaaacactacatgcattccagaaatgctgaaaactgttactttcaagtctttaggccctaaggctttttacaggggaccat

SEQ ID NO: 56800 - DNA, 6707 bp, Oryza sativa
catggcatgccagtcttagaacacacaagggggttcccccagattctcttgttaattgtgcatgaattgtctttggggatagaaacagaaaagaaatgccaaatggttatttcggacaaaactaggaaggtagcctgcacattcacgtgggtatgcgtcgtacgctaagtttgagataagtataaaagtgaaatattaaacggagaacatctgccgtgatttgtccataaattgttttcatcagcattaattgcttaataagtttctaacatgttagtaacatcatatttaagcaatatctataagcaattatttataatcttcttttatcatttgaaaataaagtagactttttgtttagaaaacatgttaatgaaagtaaagtaaagtgttttttaattgcatatctattataatagttcattaaataataaattggatgggacatgaatctccactaaatgtatgggtttatataggctaatacgattgatgtagtttgagaggtgatccatctataaacatttcatgtagggtgggtgagaggctccatgcaacctaatatgaatacgataatgacgaaatataattgcacaataatattttggaaatgtcatgtaccagtaccatgaatacatgcttaacttttatataagatagatctaacggttgtaagtaatagttcaccgatttaaaaggcatataagtattccagtaatgtaacttaaaaattatgattgttttaatatccaatgctattgcgaagtgagcgcggctcaattggttagatttcttgtggtggaacttgcccacctggttcaagtcctagacttgacacgggtgctcgcagttacggctaattattctttcaatggtaggtgacatacccgtcgacagcgagacgcccgcggtgacatcgtcaatctcaaaatgtgtcggctcagtcttttggaggtactcaaaagggtagggtgtgcgcgtgctgcgtttctaaaaaaaatccaatattattgattgtttctattttactttagtagctaagaaatagcaaggagacaacaaaacgtatttgatttttttcttaaaaatgtatagattagtgaataatagcttatccttagaatatatatgatccaaagtaatggattttttaataacgtagttaacttgatttttaatattaaattttatagtaaataatctaatttatctcctacttaggctacattctatctcatttgttgagcttatgtagggcatgaaaaacgatgtaggtcatctacgtaatattaattaagtattaaatattacaaacatgaaaatagatttttttttaaaaaatatagaaagtatttgcaaaaattcggagaacatactcaagataaatgagtcagagccaatctgataaacactttagagctcaaccttaaatttcttatgtacttttaaaaatatgtacaaatcaaaaagtatagattacttgagtcattaacggctaaaattctagctgtgttttgcaagaaaaaatgtggcatattttaaacaatacatttttttatttgtgtttcattatttgtgtttctgacaatatgtcccgagtaatattttaattactcattatttcatcttgaactatcaatgtaggcccattgatgcaaataaaatctatctaaactcaacaattgtagtatgaaatgatacgttttttatatttatattatattatagatctatttttgggtgtgtatgtgttatatgaagtaatatatttttcttatactaccaccttcactaaatatttgtcgttgatcatcataaagaaaacaaaaatatccagaggaagtataatagaaaaatctagtttaaaattgttgttttcttttggtagtttcaccaaatatttaacgttggccttcatggaaaaaatacacaggaagtgaaaatccagtttaaaaggcaatgttttttttaactcgtaccatcgtacgtatatgccttcttggcctattccggccattatttttaggaaagtattatatgataaattaggagaaatatattactatttataatgaatctaatctgacggtgtaaattaatgggtccaccaacttaaatgaaaatcgaggctagattttttttctttttctcaaaatttctaatattttctctattttattaaagcgccatgtggcagcttgagagcgtttttagagcgccatgtggcggcatgagagcgtttatagaaagtttaatagacttttagtatataatagatagatagatagatagatagatgtcaagaacaacagggactcctctgctagcatgatgggagccatctaattgtgccaatgcttggaaccggtggttccttacatgcatagatacaaacatagtgcaaatctaatgattcatagtgcaaatctaattattcacctgccagctagttcatccgggcactcgagagttcctcgaataatggtgctacatatcatgttagggctccttttaaacgtagcgaaaatagaatacagaaacaacaaaaacataagattttaatataaatatattataaagacacaataaaaataaatagatagccatttgagtagactgcaaggaaaagaacaagaaattgagtagagatagatgtagactcgttaaaaccccatgagttcttacggtaacttttctctaaaatccccatatttcgagtcgttcgaaagaaattttatagaattctaaaaacctgaaccttgttctttgttccaaaggatcgaataggattcaaatcatgcaaaaactcatctacaaaattctttgttccaaaaggaggcctaagtgtatagctagcttatcacaactttagtttggtaatggcattgtacattttttgccaatttttcctcgaaaacaagacgtttgattcaattggatgatttagcacacatcgcgctcgcatcaccgcttcactaccaacagcgacagcattttcggtgtcactcgctcacttatcactagtgcttgatgaattgaaacctaattttggacgcagagtaagtggggcgccagagatacagatagagagagagagaggaagaaaaaaaaaaggataagatatggttggtgcaatagctctctgcacgatggatgttggatgcaattatttatcacgcatgttcctggtttttctttatctgatttacttgtttcacaaatttgtttctttctatataatttttgttccatcttttaattcttctctccccctttttttttggcacattttctttcacaggatcgagtagccatggaccaccgacatggaagcatcggctaagattttctctctagcagcatcagcaaatggcacacactctcacacagtcacacacttggtcgctttcattggtggacacaggattatatgtcaccaattcagattccttgtgaagaacagagctgcccatgaagctccaaaccatgcaagcccaaaagaaaaagaaaaatctttgtgtttatatggctttagtttggaagatcctaattaattgtcatcagccatggacagatgccggttcaggcgacctggtcttaattttcagttctgattttattttggaggagcatttggtgaactaatcactatcatatgacaattaagctaaaggaatggcagggatactcttgaggttctccacaagaaatggctttccttttttttccttgtcttaattaggttggtttcatgcatgatttggagatgcttagctggtggtgaccatcacatgctgcatctgcaaagtgaacttttgagtcattactcctttgctctcctctcatatgctgctgcatctttggtttaggttagcgtgatggagaggaatatgaagaatatgcaatgccggcctgcctgtctacctttagctagcttacaatcatcaaggttttagcagtttggcatggtctaactgctttggttccctgtataactaccttagatggctcatgccttttctgcatatccgtggctgtccagtcagaaaaaatttttagatttttgttttcaaatataagttaggtagcgtcgacctataagttaaacttatagttgtagtgaggcaaaaagctagatacctcattaattttgttgatcacctttttttttctgaaaaagctttgtgagaatctagctaggtatattgagtcatatagtagtaacacctagatcgaaaggtggtagcaagagtaacaatctttaaaaaaaaaatcctggctttcattgttttaaggtagcgtcaatttagaaacttataatttgtagcgaggcacactaaaaattaacaaagacctcattttgtcaaccacaattttggtttatgaaaaagttatttttgtgaatctagatacgtacaacgaatcatatagtaacacctagataaaacagtagtaacaacagtaatcgtcttagaaaaatgttacctttcgttgtttcatactccctccgttttaaaatgtaaattttttagctgttaaactagacatgcttatattttaggacgtaggtagtaggtagcatcaatatagaaacttgtagcgagaactaataagcacctcatttttatcaaccacgaatctagtttctggagaagttcttcatgaatgtcacaaatttagttttatttttgataaacagagtagatcaaaaggtagcagcaagagtaacagtcttaaaaaaaaaaatccgcatttcgatcttttatagatagagctgtcttacaccctgttgaactgaaaaaacactcaaaatatgactagaagaaaacgagtacatcggatgaaaagctacatctgaccaaacttgaaaataacttggattttggatcatgttggtctggtactagctgtcatggaagagaagaacaggatcaacaaggacggtattagtgcgtagggacgacatttgccagactgatttgccaaatacttcacctcttggcccctaccagtgtacatatgtacctgtctgcaagagctttagtagtactccctccatattattttaatatatgacgccgttgactttttttaatgtttgaccattcgtcttattcaaaaaatttatataactttattttattgtgacttgattcatcatcaaatattctttaagcatgacataaatattttcatattcgcacaaaaattttaaataaaacgaatggtcaagcgttggtcgaaaagtcaacgacgtcattaattaaaatatggagggagtactacttactaaagcgattttgcaaattctgcaaaatcgtgtcatccctttcttgtagaactcaatttgttctgtgtcttttgcatgtggagaataattttgtggcaatcggccaagggtgtagttttacgtagctttgctttctgaaatcgttcttgatgttgagaacacgtaccagtaggtaatatagtgcacttaaatttgccgacttgggaagtttatttcgttgagggaagaaacttgtgctgaagaggaagccaggagcttcttttaaaattttgcagaaaatggttgatgtgctgaattttctctggtcacctgatggtttgaagtttttgctagataggagtatttactgcaccgagtggccttcgaagaaatttagactggtgggtgactaaatttgagaatattagaggtgctgacgtggtgatcgatgtaccaaagttcaaagtcccactagctcctaaacaatgaaattttcggaaaataaaaactgttttaaattctcaactttctagtagtttatttatttgtttacatcctcaactagtgattaaaaaaatcattcagctatttaaaatagaaaacatttatgatatactatagctgcagtatatattgtaaaggttggtttgtccttccccctcatccttcaccgtggcgaggggctgccaaccactatgagtctacacatgcaacaccgcctctagccaccgcaagcatgccgtagtgccacctgtcaccacgagcacacgacacaccatgagtatgccgcgtcatcaaaaaccatggccagctgccatgacattgccgaagggagtggccgactcactcgggacgatgacaggacgattcgatgagtggctagggactaaagtacgaaattgctaaaaatgtcattttcaattttgtgacaaaattttaaagcatccttgttcgtactggaaatatatactgccagtaaattgtaccgtaaaagtcacaaccatcgtttaacgaggatgtctgaaactgtgaaaattcttggaggggagctgcaattaaagccagtaatagtattgacatttctattgcaagttgtgttctgaatcttctgatcgatgagcctctgtctacatctccacatctgggggctttcattgaactattcctactggaagatactgtcccctgttcgaaaccgattcttttgtttcaactgacgaaaatttttccaaggaaattaaagttccatgcatgccattggtttcagaaagaagtggccaatcaatctgaccaaccaaccaaagttgagagccagtagcaggtagcagcagatcatttgctgaattaaaaaaagaaagaaagttagtttgtgctgaaacagcacaggctgtaacctgttacctgtacctgtacccccctttggtaggagaagagaccg

SEQ ID NO: 56801 - DNA, 1404 bp, Oryza sativa
gctgaatcggatcggatgggtgcttgtgccacattccgtaacaagaagtggtaggtgatgactttacactcgaaagatccacgaggctgacatggagctgcgtcggcagcgatggcaatcagcagcagcggaaggacgaactggttgacagtctgacaagcagccacgcaagcacattttcttgttttttcctttaattttcaccgccttttagctcatcttttgaatcatgtaaaccttaaaaacagtccgtaaaaggagcctttttggaaaggtgagatcttgcctggccattcttcagaagttcagtttttttttcaaaacgtttttttttctgagagctccatcgatcttgcattcttgccttttcccaggagtcttaaaccataagcaaagatcagggacgaaaagaggaagaacacgctgtgatcagtccaacctaatgatcatttcatccactgcaaaaaatgaaatatctaacgctgtgtttagttcacccccaactatccttaacttccaactttccatcacatcacatcacatccaaaactttcctacagatataaacttttaacttttttttctaaacttctaacttttttcaggaactaaacgcatcctgaatatcatatatccaccttaaccctatctagactctctgctgcactgcaagatacagcttttgatcagctgatcgtttactgattttttttgtcagctgatcgtgtgtttgtaagaaatagaggggacacttagttgcgtacacggctcgttgcaaactcgcacgcccattctgctgatgctgggatgcgtcagagtcagcggagatcaaagaagcagaagcctccaggatggccaaaaaccggcgacgattccagcagtaattaaaccgtacgtcgcagcagccggctgctgctgctgcggcggcggcgacatcgtcgttggcgtcaaagtctactactatgtcccagcgatgatatgcatggcagcaacagctaaattatcttaatggcttagtgtcagcaagtcggcacatgagataacgtagttaacacaggagttcgccaatggcgatgaggtttctttggggcaggattagtaggcgggccattaggttaaaaactccatgtgctttctctgcaagcctaattaagaccggacagcaacatctcgtactatgtactatactatactagtagtaagtactagtatagagtactctgcacatctcgctggatgaacaggtgatagattcaacttgggaatcagctgcatttagcttagcttagcagctttagcctagtggattaggacttgggaagagggggggaattagtagtgggggttaggatttgatcctggaaaatcaagtggagaaagtgatgcttgcacttgttgacactg

SEQ ID NO: 56802 - DNA, 4174 bp, Oryza sativa
tgtgcatttgaattcctcattccaaagatcattccaaaagaggacagttgagcctgactgtattgtgcacttggctatacccctgaagacatctgtcagaacaataatatccctccaccaaaaagatcctttattcatgattaaatgtgggacttttgaagtataatatgattctgaaatcaatttaacccatggcaaatctgcagctttgtaaaactttacaaggtgcttcaagaggagggcagtgttttgcactctcaagtttcttataaaaattgataaccaaagtttaaagtttgacaacttgcaaataacattattaccattcgccttatttaaaaacaattatgtaactattttttaaatatataacaccgttgactttttatatacgtttagccattcgccttatttaaaaacaattatgtaactataatttattttattatgacatgatttatcattaaatattttttaagcatgatcaaacgtttataaaaagctaacaacgtcatatattaaaaaacagtaggtagtaccatatttttcagtggtgaccagaccctgataccaaacttttaataatatcattttactttcatttttaaggatctatacaggttgtcgagaccaatgggacaacggggtgtgcgatactagttgtgtaagcttacttggtgctcatcatatttctaactgttttgctttagaaatggcttaagctttgcgactaaatatatgagagaaaaaaatctattatctccctaggtagatctacccaaaggaaacatttcctcaacagataaaggtttttcttgcatgttttgaacgtaggatgatgtgtgagaactacaagatccttagcgtagaacttaaactcacataaatagttcaaggatcaagtaagtgatgcttaacaacactacttcatatccacaaaatatcgtacttctgattttccctttcagaaactctgagggataatacaaataagatttgcttaccttacactgattatgtcacaatctttactccaacatactagcaaggtggactcttaacatgttactactagaattagaaagtggcttctgggatttagttgaatgatcttgcttctttgtattcttctagttcggccaacttcctcttttatagaagctggagagggaggctcaactttggcttcatccttatttttacaatactgcagcatcacgggcttgctagagagttgtgcgtcttctattgatctaagtgtcatagtgattcctaagagcacggctagcttatcttttgcagtgatttgtcattcaccacaagtaggtttagactctttaggggaattggcaaattatctgatatacttaaaatataaaatattcagccaattattccatatcttcgaaatattctatcatagatttcaaaaacctttcataagaaatataacaatacataaagtaccaataactttataaatgtatttaatatttttctttggaaactccttattctagtaaaagttgatgaacaaagttttaaaagttggaccgtaaggttcatgccttaagtgccaaatatttcctatggtcataaatatttagtgctcttttgaaatgcgagattgaaaaataaagtaaaagaaaaacatataattgcgaagcgtgaaatgattgtttagtaggaaacatatagaaatcagatgagaagattgacccaaatgatttatcttcaatatataggttaattaattggagctctttactaactttccttcagaatccattctaaaaaaagaatttttttttaaaaaaagacatgattgaatcattttttaaaaagactttcctatgaatttttggttcggattgaatccccaactattttatgttttctctacagaacaaaaggccttaacgcagattcgatcgaaaacttctttgaaactttgaccatacagttgtccacgtaatcaacgacttagatacattgtgcgtcgatggtccatgccaatttgtcgttgatgagagacctgcaggtaaagctccctctcatcattgaattggtggtaggacgatagatctgaccgtcgcactcatgcagtcaaacagcaaaaagaaccaaactacaagatggcgagtagctaggttcacttattatcagcatcacagaaaaggtttaaaaaaaaggagaggagaaactgataaagtaagaaagaaaaggatgtatctccttttatcccataatatagtaatatatgattaaatgaaaaatttaatcgtaaaagcaatctaaaataaaacatctaatagtaaaataaatttagacaaaagaaaaataaatttggatctatcttaatttattttactattaaatgtctcatccgatcgtatattgatttattgcgagacgaaaggagtacgctgcatcactcatgtatgatgatggaatgaattcaccaagctaatgcaatgcatgaatcatggaagctttcggccacctcgcagcaaacacggagcagcttagctagctagctagctaggtacgtagcccacaaagttaagatagcgtgagtctggtcggccgggcacgtacattgagcatcatgggcatctcaaaccttctaatatatgctagaagcttaaatatgctagctaaccacatccacggtaaaaaacatgagacgcataatatttgacttctaggttgatgaagaatatttgacttctaggttgatgaagaggaggtggctcgtaaatcgtggggcttgttcattttgctaccattttcaaccttatctttggtaaagttactttaaaaaatggctacatttagtttgtttccaaattttagtatgtactccttccttccttaaatgtttgacaccgttgactttttttaaacatgtttgactattcgtcttatttaaaattttttgtgaaatatgtaaaactatatgtatacataaaagcatatttaacaatgaatcaaatgatagaaaaagaattaataattacttaaattttttgaataaaacgaacggtcaaacatgttttaaaaagtcaacggcgtcaaacatttagggatggagggagtacatatgaaatcttgccaaaatttgacaaccttgccaaaattttggcaaccttaccaaaatttggcaatgccaaaacttggtaaggttgaaaatggtagcaaagtgaataagcccgtaatatttgacttagtggtcgatgaagaggaggtaactgggttgggaaatagtccctctaatggaagtgtacattgtgtgatattgctattgatattctgtgaacccatatatcaatgaccacattataatgattttgtactaaaatatactaacatcatatatgggttgtcccactagtgtcatttcaccttaatagtcggtcagtcggagcatttgccttataactcatatgtatttattcttcaacatgataagttcctagtggttcggcggttcgagcttcgcctttgtcgacctcgtcactgcacctagtctagcatcgtgcccgacgccatcgatatcatcccctgtccatctcttccacatcctcaacgctaccgatctcaccatcgaccatgcctcaatccacttccaggtacgctagctcatgcttgctcactcgtcacctcatgacctctgccctttaatcttctcaccgcattgaggtctcaccgtggcaggtgacaattggttatgagatttgatgcccatggaggtatatctctttgatggtgatgagatcctagtgttcaagttcgatagatagcttccgctccatgagggcgtgctaaagtatggaaaagggagagaagaaaatggaagccgttccgtttaaaccaaacagtctcccatgcacagtggcactattttattatgtttgggttaaaggttaaaaaaagatactgactttattgtattttcataaaattaggtacgatattatccagttttgcatacctgctttggtggccggccctgattggggactggggttcttttattacttttctagtttccatagcatgaaaacatatatgtttatatttcttagctcaaaccaatctacctatgtatcatcatgaaacaataatagttttatgtacaattcatgaaaaaagttttactccacctaaaaat

SEQ ID NO: 56803 - DNA, 3958 bp, Oryza sativa
accggacctacgaagaggtggctgcttcagttcaccgtgagtgtttttgtaccgaaatgacaatcgtattacatatttaatccgcagttaaggtgcctaacattttatcgacggcttgcaggttgagcagctacaggcggaggccgacgagtactcctacagccgatgtttggaggcgtacttgctctggctttttggctgggtgatgttctgtggcggtcacgggcacgcggtcgacaagggactcgtgcactacgccaggagcatcgccgacgccgcggtaggcgaggtgactcagtggagctggggttccgcattgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaagttaggcggtcgtatcctgagtttgttatggagttcgaccgccttctgccgactgacgtcgtgtgggagccctacagtgccgcggctacccaggctcgtgcgccagtgggtctgtccacactctgcaccagggaccaagcgtactggatgactacggttccgatggtcttcgacatctgcgttgagcctcacgcccctttccgcgtgatgcggcagttcggcttccgtcagccctttccagtactgtttccgaccatcgtcccagctgctgtcaccggtaagatcttgcactacgctttccgttgttgcattaaaatctgcctgttcacaataatttgtaacatctgtcgtttcacactaatattacacattaattcgcaggtactcgcgcaagggtcagcagtcagctggtgactggcccgccaagttggcaacttttgttgaggactggttgctcgcaactgaggaggtcgtggaccacgagggagagccacacactgaggagtcgtaccaggcctacctacgctggtaccagccacgcacccgtactagggtcaccttcgctcccttggagcagcagccccacgttgcgagcactagagacctctatgccaggcaccgcgaccaggacttcgctcgtgctgtgagtaccctgcatcgcaccattcctttatgttttcatgtctttctcttcgtcaaattttacgaatatttacgaacaaattaatcatgcaggtcgacgacatcaaccgggtcgtcgttgacggttcaacgacgatccaacgtttaggcgcggggattccggtacccgtagaggagcacctgacgacgtacacgcggatggtggagtcgatgcgctcgattctccgagtgctcacctgtcgtgcagacgacattgctcgggcagacgcagctgtacagcggccacccgtaccgactggtccccgtccagctgcgcacgttcctaggccgactccccctccgcacagaggtaagtatttttattactatttttgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcaacaatcaatttacatacattttatgtcttagcttacaagggtcccgttgtcgatgtgtaggtttcgcccagtttgctatgacgaaggccgcccacttctcccatgctgcagggtcagcgtctcaggcagctgtgtcaacctcgcactcagcgcagttctggcagtacaccgggacttcgtcacaggcagccggcacgtcgagtcagggtccaccactggaccatgctgggacctcgtcggaccgcttgctgccttccaccttgctcttcgacatcactgattttgacttcgcttcaggctcgacagaggacgtcattggcccctcacagctgggaggcgcaccgccggtgcagacgcaggaccaggcgcaggccactcctccgcgggacactcgtgctacccgtgctgtgccaccggatcgtttcacctactcccaggaccacgtgcgagcacaggcccggaggaccaagcgtggtcgcagcgcggggcagggccagtagagcagtcttctctttgtttacttgcttcactttccagtactgtatgcttgtgtaatgactacgttgttgttatatgtgcacgatacctttcggcgcatgcacgactactttctgccgcaccgatgcagcctcctttattcgcgtgtgatacgagtatttgcccgccatttagcgcatacgaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcagaactcaatcacattcagtactctcttccccacttgcttcattacaaatctgaccggctttcgtcaatggctagacgccggggtgttgaggatccaaactggcatagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttgtttgtccaaatattcttgacgacgatttcatggtaagaatattttgaatacatgaatccttattttctcacaacatttactaactttgcttgctttacatctattctttcctcccaggaaccaccaaggagatgtcaatacagagaatggatagacaccagaagggttctaactccacctagccgtgttgtgtagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagtcgtatcatgttcaaattgtactactatttcttcatgttacataattctccttgtttaagtctatataatgtttctacgacccagactgcgataggcctatataaattatccgagtactaatacgtcgaataaggtacaaaataatacctcacttaacatatgaaattgcgcaacaaccaactttaatacatttttataacaatattaacaagttttaccaataaatacttctttatttattattaacataacatagaaaaatcttttggccgtacttttttcatctgggtagggacccagatgaaa

SEQ ID NO: 56804 - DNA, 825 bp, Oryza sativa
aaacatacttcagcagaaaatagctactaggtgaccgaacttgcattttggagaccattattttgacgtcagaatgacatatacctttgtaaccggacagagagtatagtagcagtagctagtattaatcggcacaaaagcgacagcaaaaaaatcattgaaaagtatgatacaagcatgccagccataaaaaatgagaccgatacttaatacttcacagcgaaatgcatttatttttcaacgtacaacaacaagcagccaagtccatcaaacaaaggcagacatttcgatcgatcgacgtgtgcctcccccgttcgtctgaagaaaaaaacgcgagaaaattgcaggtttcaagtttcagcgacgccgatcgatcgatggattgcgcctgcgccgccgccatggtcctgcaagcgaaggcaacgttgaattattggagatggggggaggaaatgcggcgagaacgacggctccaatccaaaaccatttgacaatttttcagggctctgacgaatctccgaaaccattttcacaatttttcagtcttgacaagcactacgtataatattcagtcaagaattcaagatgatcttatttttcgttaatactacctctgctgtactagtcatccatttgagcagtatgtatgcgcactaattcagctggcaacttttgtgcgtctagtggaagtgcactaactgtctctcttgtgttgccgtcgatccaacagtcaacggcactgcatgaattatttgaaaccaggattaagaaaatggatgaatagcagagagacacgattttaacagtaacccgtttgatttaaca

SEQ ID NO: 56805 - DNA, 1115 bp, Oryza sativa
tcgttattgcaaaactgccactaaaaaattgcaaaaatgtcattagaactgtcattcaagtggcatccttgcaatattaaaaaaaccggtggtaaattcgcaattgcccctattttcattgggcacaggtcgcttggcgccacctttagccgtcggagaaaactcgatgtggccattagtagtgatggtctatcgatactttgcaatgagactgtcaccaaaaaatcatcggtagaaattgaaaaacattttcgctggcgcacatcattagctggacacgcgtgaagaatattttcgcaggtgactgggctatatttgtccagcaacgaaaacggtttcacccctgcggtcgattaccgccagcaaaacaaacgtattttcagtagacattggtcgcttggcgccacctttggccgtcagagaaacctcgatgcggtcattagagcaagtttaataagtttaatagtatagccaactactaactccaaatcatctatagccaatctaatagctcattcatacaatagttattacctactacctccgtcccatattacttgtctttttgagtttttgtttgtcaatgtttgatcattcgtcttatttaaaaaaatttggaattattatttattttgtttatcatttgctttattattaaaagtactttacatatgacttatctttttttatatttgcactaattttttaaaaaaacgaatggtcaaacgttacaaataaaaagtcaaaaacgtcatctattatgggacagagggagtataagtatatatatactacaacattgatatatatccaacctctcatacacacataatgtccgtgctgcattccttctctcttgttttccgttattgtactcgctattagtggtgatggttctatcgatattttgcaatgagactgtcataaaaatcatcatcagaggaagctgttgaagaacaaataatacaaccaccaccgccatgcatggcgcgccattgatgcgttcctctggactcctccgatcccctctgtttatccagctcaccccgtccgtaggaccccccccccccccccccacattgaattgacgggtcgccctccccgcacatgcatat

SEQ ID NO: 56806 - DNA, 1162 bp, Oryza sativa
ctgcatacgccgctcgccgcgcgcggccgggcctgcttcggagagggatctgccacggccgcaggggagggggaggagaggggaaggggaggaagagggaagaagacaagaaggagatgagaagatgagaagggagcagaagatggcagaatataagggagaggaggagagatgagtggatgagaggataaggctgttggtcctctcgaggaggcgcggcgcgatttttttttcgtttttcttttgtctcggttgttataagcaaccgggattaaaattggatctaccaaccgggactaaagatcatagaggggtctaacacatcttgccttctttcgaaccgggactaaaaatgatctttagtcccggttagtgttaccaaccgggactaaagatcaaaaagtgacgtcagctttttcaaccgggactaaagatcatttttagtcccggtttttatttaaaccggaattattatggattttgggcaaccgaccaaagatggtttctctaccagtgcagttttcccaaaaaaaaaaaaggaaaaaagaatgtagagctgctgtgagttggtaagaggaatgcatgcatcgctcagcttggaaaggatgtatgtgtacccaactacccatcggtatacacatccactggccctcctcccctccctgatcaccttcccactgcaccaaccatgccaatcatcctgaattcctgattggtatatccttccattaatttgatcgattcacgtgtagctagcttatagttagcccagccagctcgatcaacggcgcctacggtcatacagggccaccactccacagtccacaccaattgaggcagaggacccggctatactcgagctatagctagacttgggacatattctgtgatgatatttgacggcatcaggttcactatagcttttctctccgtggacatcgatggggcggattaggcctgtttggttcccaaaattttttcaaaaaacatcacatcgaatatttaaacacatacatagaacattaaatatagattaaaaaaactaattgcacagttagggaggaaatcgtgagacgaatctttttagtctaattagtctataattagccataagtgctacattaattcacatatgctaatgacggcttaattaggctcaaaa

SEQ ID NO: 56807 - DNA, 4712 bp, Oryza sativa
atggatctggccttttcccagctttacacagtacattgaattagaaaaagtacaccgaaggtccctcaacttgtcatcaagttacaaaatcgtcccctaaccgcaaaaccagatatccggtgtcccttaactaatcaaaaccggtcacagcagatccttcggtggctttgacctcgattttatcctacatatcggctgagttagcgtgggacccacatgggccccacatgtcagtgtggccacgtcagcatcctctctctttccctcttctctcccttcctcatatctcactcacttctctgcggcacgacggcatggtgtaggacggcagctcgttcagcggtgcgacgaccctggcgcgggggcagagcggccgtgcaacggcgctgtctggcgaaggatggccgcgtcagcgcagtcgtgcgaatcctgggcggcggtttcggcgtgggctgcccggcagcagccatgtgccgtggcagcgcggcgcggcggccggcgacgcgggggcagcggcaaggacggatgagaatccgaggatacggaggcagcggtgaggagggatggggatccagggacgtaggggcggagaggtagccgtcgagctcggccccggccgagctttgccgccgccaccgctcgctgggcttggtcaagggaggggccggtgagcccgttcggacagtgaggagaaagccatgcccaccttccccttccccacggcgcagatgaatgccgaagaagagatggaatctgagacaggaacgacagcggttggagtgtgctggggcatgaccggcgacaacctgccgccggcgagcaaagtcaccgagatgctccgagagaacggcttcaccgtcgtccgcctctacacgccggacagcgccgctctcgtggcgctcggcagcacaggcatctgcgtcgtcgtcggtgcgcccaactacgacctccccgccctggcgcacggcaggacagccgccacggccgcctggatccgcgagaacatccaggcctacccgacggtgttattccggttcgtcgtcgtgggcaacgaggtctccagcgccgacatgcagctcctcgtcccggccatggagacgtccacgccgcgctcgcggcggctggtttgggacacatcaaggtgacgacgtcgtccgcctgcgccagcctgccgccatgcagctgctcccccgcgcagctgttcccccgctggagcccgtgaagaagagaggagagaggaatagaggtagggaggggaggtgaagaagaggctgatgcgtggggcccacgtggatcccacgctgagtccactgccatgtcgaaaataaccgagctcaaatcagcggaggggtctcgtgagcgcaggtttagtaagatgtgggaagcgttgtatccggttagcgggtcggggcacatttctgtcactcagatgacacgttgagggacgttcggtgtacttttttccattgaattcgaaagcaagcattgtgcgatcaggttcaaaatttatgattgaaatcaatttgaatagtgaaaggattatcgagtggtatcttccatgctatggtattgtataaaatacatgattttgacaaaaatatatgtgcagaacagagtattataatgatacaaatagaactcaaacgtcttcctagaaattttctataggattgttcaattctttgtttgaaggtctccctagaaattcccataggattaaaattctttaatttcctatgttttcctacaaatcaaataggtttaaaatagagaattgcaaaatgcataaaaatataggaatgatggcttggttagactgcaggaaaaatataggatggtgaggagagaaaaagactcaaagaaaacttttcatgaaaacatgatgtatggattgaggcatcttatatggatttcatatgatccaatagcgtgcagtcctttatttcaaaggtccgtttaggaaaaaaatgtccattaaaattaaaatcatacaagaccttttgaaacaatcatatagaaaattcacacgatcccataggatatcagagtacctaccgttcatggtaacataaatctaaacgtaaatcccataggattgttcatattcgatcgatctaaattcacacataaatccaaacgtttgcatgaaagcattagtatcattctaacaactgcattagccattttgacgttcgtttcatttcttttctcgctggtctcaccatgttcatgttgttgtcacacattgacttaatttcatatcatccttcttgttcccgggtgaatccggtgaagacagaacttgtcacccggttgaaattagccaaattagccaaatccagtggtggtttgttaccgagaaaaagatttatgagtttgatgacaggagaaaaagatttaaaagaacattcgatgtatagcaccaaaaataacttggtactataagaatttttcttcgaccaaaagcatagactaccagtttttctttaacctatagcacttctgttgtattttgaggtggcgacgttagatcggggtagagaaaattatcctcagtctcatttgccattcgttttccacaccacatacactcatctctttcctgttcctcatctcctctttctcgttccccatctcctcgttctactaagcattatcgcttgaaaaaaagaaatatatgttaaatcctattctggacacaagacaagttctatcttattccatgttctagataagttctactcatgcctttacctagcaggtagctccctttaatccaccgtcgtgagcaagccaccaactgccgctatcgttaagcaagctgccagttgtcgtcgtcaaacaagctgctagctgccatcatcagcggcgtgaccaccgtcgccctttgcccaacgtggaatgccttacaagcaaccgccgccattgccctttctcttccgtggtgtgcgacattacggctctgttcttttggaggggttggtaacccctcctctcttcataaaaaacggagcgatagattaacacacgattaattaagtattagccatagaaaactttaaaaattgattaatatgattttttaaagcaactttcttgtataaactttttgcaaaacgtgtaccgtttagcagtttgaaaagtgtgtatgtggaaaatgagggaaatgggttgggaacccatgagaaagaacacaacctaagtatgatggaacgaacatcagcctaaccatgattgctatgctagacatacatgaccaggggaaaattagtatatctaaaaataagtgctgactcacggtaaacactccaccatatttatggttgtcatggaagtgctatgagtcaaataaaaactggtggtctgtgcttctggtcgaaaacaaaaggttctttttttttgccggattgttttcttcttacgtatcaaattttctccaaattagaggcatcgcccgtccctcaccctctcgaccacatgtcgtcttagatagttgaattgcaggggccatcgttcaacctgaaggtacatgagtgctacaatcaacaagatgagacggaccctcttaacctgtagggagaggccacatcaatagttgccgttgctcttggcactattccctacccctttccttatttcattgtgatatgaagaaaatataagacaatgagcgaaatgatagtgatactgttctttttggttaagatgtagtttctatctcggttttcatcggtacttatttcaaaaccgctaaaacggtgtgttttgtatgaaaactttctatatagaaactgctctaaactatcaaataaatccatttgtaataattaaattttagtaattcatagggcgttaatgcttttcttgttgtacgaatcatcagcttcgaacagaacccacgagcgtcgattttcaatctgacgccgcttgtagatgcattgactgtcctgcagtactgcctggcgagcccaacccccacggccgtgccaagtcgtcgcatcgcaccaggcgatctcgtcgtccctttccttgtcgcaaaccgcgctggcccctctgcaaactcgtctcgtaccgtaccccaaaaaagcccaaatccctcactccacccgcgtgatctcgcaggggcaatccggtaaaactcctccctgcctcctcctcctctcctccgcctcaacgcaacgcgcgtgctgctgcgccgcgccgcgcctcgcctcgcctcgcctgtgtgtctctctctcccccacagtgcgcagcacagcacatgttgtgtgacgcagggaaaggaaagcggtggacgaggagaggggaaaaaaaaggaaggaaggagttactactccccgcaccatataccaggcgccagcagcagcagcaaccagcaagcggagaggagatggagactactactcctcctacttgcaccgcagccgcagccgcagcccaccaccaccgttcgcgcgcgcggctgcctccgcaacgcaacgaggagaagagtcgaggagcccaaccaccacccgaaacttgacccccacccgcgactctcattcgatcacgcggggcccacccacgcttttaccccttcctggattcctctacgctactgccccttacgctaagcgagcaatgttcccaaacactataaacccaaactctgcgccgtggtagcacaggcggcggggtgtgacgccgcggtggggggacggggatggaggcgg

SEQ ID NO: 56808 - DNA, 2757 bp, Oryza sativa
ttttgggtaaatccacggtgtgcttggtgctgattgattcgtcgtgccttgtgatggtaggagctggtcgggaggggctcggcggggctggttgcctgcagctcggcggcgggggcggcagcggccgcaacctgccatcagtgccggagggtcgctaataccatttgttgtacaagctgcgacagaagggggtactgcaccaactgcatctcgagatggtatgctccggtatatgttgtgctgttatagagtaaattttagttccccataaggatgatttccgagtagattcagaacaggcttgaggactgaccatttgtaactattattagagaattttattttcagcactcagtttttgtgttctaaaagtccctgctaggtgcagggtagccaccgcgattaagcattagatggtggattatgcagctaacctgccttgggggctattctgctgctactttagtgttatatcgtgtatttttatgtaatatgcttgctaattgcttggaattctctggtcgagtttgccctaggcagagcccttgccgacctattagaatctagcatcttcttcaactatgtgtgcagcttatgattagtatatgatcacactgaaagaattattcctcagaagttgttgctagacaattaatgtttgtgatcacactgcggttagtaatggtaattcccaaactatcatcttattgttcacatagaaaacccttgtgtatacaatgttttttttttttaaaaaaaaaactgttttagggcattctattccaatatgcagccaaagcacatggatattttactagttaccttattaatttcagaagtacaatcttcgccttgtcttttaaaggctaatttttccccatcggctcactcaaaatcaccaaatgcaaaggcaatggctatccggacaccacagacctatcatatgaagtactccctccagtcacagaaaaactgtcctcgttggaagtgtgaagccaaactattgaaaattgaccaggacatccttgtgattatttggccagatttcatatatctagccatctggatacttttggatcattacatgcattatgttgtcctacacttttttaatgttaccatgaactgtaggtactctgatatcccaattgatgatgttcgaaaggtttgtccagcatgtcgtggcatttgtaactgcagagtttgcttactaggagataatgtaataaaggtatttaacctttaccaagagtttttcccttctccgttgccatatttatttattatttttatgctgactgatttttcttaaatttattattttcactcttaaatcacaaggcaagggttcaggagatatctgctgtagataagttggaatatcttcatagcattctggcatctgtccttccagtattaaagcagatttattctgatcaatgtttcgaaattggtgttgatacaaaagcttatggtattccagttcccctcttaacattcttttctgttattttcatccgaataatctcatatttctaacactagcgcaccatattctttgtgtaggacttaggacagatataatcagggcgaaggtcaatcctgatgagcaaatgtgctggtactgtctgttgcttatttttcacaagaagattcttatttctatgctttggcttgtagtgatacctcaaattatcctcgcagtgacttctgcaaagtgccagtatttgattatcaccgacactgcccaaggtgtttgtatgacttatgtcttgactgttgtcgagacataaggcgatctaggaccagtgttgcaagaggagaatatgctgaaggtcgtgtggtagatagaagtaaagatacttcgaataaaagagcaagaatggaaccatctgcagaaagtgcaaatgataagtcagtcccacaacgaagggacataaaaaatattgacattagatctttattccctacatggagagtcaataatgatggaagcattacttgtgggcctcatgaggctggtggttgtggctcctcgaagttagtgttaaggcgaatattcaaaataaactggattagtaagcttgtaaaaaattctgaggaaatggtcaatggttgtaaagtacatgttcttgagaatggatgctcatcctgcaatgatggcagaacattagagttaactggtcatcgtaactttggtgtctcaacatgttcaaataatggtggtattgatcggttctgtgtgttctctcctgtattagaggacttgaaatctgaaggtattattcattttcgtaaacactggataaaaggagaacctgtagttatcaggaatgcgtttgagccttctctgtcatcaagctgggacccactaaatatttggcgaggaatccaggaaatcatggatgaagaagtggatgacgatgtcattgtcaaagctgtggattgctcaaaccaagcagaggttagcaggaaattttagttgctaatttgtctttctgaacaaaagttactctttttagatagaggaatagatttatctcgccttctgcataaggcacgcgaacaaaaaagttgcttcctatttgaattcactgtgcctcctgtttgcactatatagattcccaagtgctatgacttctattctgggatgttgccatgctattaacttttagtgctactgctagtctatttgaatatgaattcatgatcatagcacgtattactcatctggcaaatatgtaacatagaagtgat

SEQ ID NO: 56809 - DNA, 3863 bp, Oryza sativa
tttgagtttttgcttgtcctgtttgaccactcaccttattaaaaaaatttgtgcaaatataaaaaacgaaaagttgtgcttaaagtactttggataataaagcaagtcacaaaaaaaataaataactctaaaattttttgaataagacgagtgatcaaagagtacagataaaaactcaaaatcccttatattatgggacggagggagtagtgcatttgtgtgactccaaccatcttgttgctagtgataataagttttgaaagaagtgttgttttaagagatactatgtttgttgagtaattttcaacgtaatttctttttagcgttagtttttaagtcgctacgaataaatacgtaaaaaagttatctatattttaattttattctctaataagacattctggcttattagttaatatgggcaaaggctctaaccattggcaaaatttaacatttaaaacttaactttggagataattttatgatgttttcaatgaaatatattttattgtattggcttttaagttgcttaggactcatctctactgttataaaaattgaaggtttttaccggtactttggtacgtcattcgtgtataagtatgttattttgtgttattatgtatgagtcggtttttaatgtcgttcgcttttggaaatatagaagaacacatataagaaatctctttaaataaacttgcatgctaacttgagacgatcaaactcctaactataagtcatgtttttctaaaaatatatatatccaagtgaattcccacagtgaattttaccttaactaaaccataataacaataataagattaccgttgcattgcatgggcatatttttctagtaaatactccctccgtcagattttggagtaatgtgatactataacctaatacaacgaatctggataggctcatcgtctagattcatagtactaagttatgtcatatccctctaaaaccccttatattatgagacggagggaatataaattaaattgtttttgtcctaataatttgtgtagcttgtaatcacctcatggccaatcgatgattgttaagtctcgtggtaatttcagacacaagtttgaacggttttgctattttacttgtgacatatttttaggctcttgtctttcactttttagttcataggatcttgcatcttgtatatctttttaattacacatggttacagagttatattgtacttatattgagttgtagtgcacttgcactcaattacagtgcacaaaaaatagatgttggaattaatgtttttctctaaatttatgatttttttgacacgattgtctctttttttaaaaaaattcatttaaaacaggctatatcccttggttgaaaattttgcaagattcaaaactataaatttgtccaaaaatcattagttaattccagtttgatttgtaaaatcatgtttttcagcgatgaacttcttcttgttctactactacattttttattattacgatggacatggcgtgaaatcttgtaaaattttatgaaaaaggtacaagtagtgtccacaagtgaaaagaaatcgttgaaactgagaaaaatttcgtcaatattttgaaattctgctatatttttttctaaaaaaaagtttgaccagttaacctagcggttcaaaattttgaaattttgtgaaaaatgtaatagtactagcaatttaggcaattgacgaagcttgggacaggagcagggtttacattactggttgaccactaaatttcgagcactattagtatcgcggtttccaataaatttcgatcagatttcgataaattttgattgaatttcaatcaaatctactgtttaaccctcaaaatttcaatcgaaacttaattccgagcatgtcgctcgcacgccacccccgaagaatctggagagatcagccttcgcttccccccgaacgccgatgggcttccgcctcgcccacctcgccgcctgcgtggcccgcgccgcggcctcctcctcccgcctccgggggccacgccccgccgcctccgcgctcgtcgcccctctcctcgcctcgccgtgggagccgagcggcggcggccagccgcactggctcgtcccctcccgcggccacgtgggccactcccaccaccaccaccacggcgaggaggtggggggcgaggcgtcggagaggatcttccggctggggctcgcggccgacgtcgtcctcaccgtcgggaaggccgtcaccggctacctctccggcagcaccgcgatcgccgccgacgccgctcactccctctccgacattgtgcgttgcctgagccctgatgacaaaatcggtgctccttttcggcttgatttttttttttggtgctgattgtgcagggtttttttgagatgtgcaggtgctgagcggggtggctctgctgtcgtacaaggcggccaaggctcccagagacaaggagcatccgtatggtcagtctcccaattctcttctactctgtgatcctcgtttgtatacggatgtgattcttggctatggtggcaggactgatacttaggtaaatgtcatgcattgttctaagctcgtggcaaaccgagggtccaatagatactaattatctaattattgactgatatactaattaatatgatgtaaattaactagaattgaataatctacctggggacctctgaccccaggaattactatgtagtaacgccacttctaagaggcatctgtctaccaatttatgggagttttgcaattagttaactgatatactgactgacaagacgacaatctcctgttcccacttcctttgttgacataggcagtttacttgcattcataatggaattgcagaaacttagctccactagaacataggctgttactagggtcatgttttatgtgttaaaactgttaagaatagtcaaggctcatatatgatgattagcctactttttgaaagaaaaaaaaaagaatatgaagggagctgaaatccgtcagttgtttacagtatggaagctattactacatgtgcttgtgcgttattgcagccacatgcatgttcatgtgtgcaacaagatataaatgctagaaaagttagtaagggcattttcttactgattctcatgttttttctaagctacctgaattgcttgcgttataataattattaaagtctacatagaacagcctccatgcctatttgatttattgtcttgtttgattgcgctaaaagtgttgaagattccatgtcttattttgcttcccttccaggtcatggaaagtttgagagtttaggagctcttggaatttcaagtatgttattagttactgcaggtgggattgcctggcatgcttttgacgttcttcaggtctattactactcaatgtcacaatgtcaagaacactaaatttatgtttttcagtgatgttgtccttttttcttatataatttctgtttttgtaaattagtgtttggtccctgatgacatatactcccatcatacataattacacatggacttcacatgttgaagtttgtttatttcagggagttatgtcttctgctccagatattattggcaatgtatcgcatgctcatcatagccatggtagcagtgggcatcaccatggaatagatttggaacatccaatccttgcattgagtgtgacagcttttgcaatatctgtcaaagaagggtaagtgagtgttttctactgtactcatgctgcgaaaactgtgtaagtttttcttttgttgttctaccagattttacaatcttatcttatgtggtgtacttcttgctgttttcagctactaagtgttattcgctacccttcttgatattatttttgc

SEQ ID NO: 56810 - DNA, 2553 bp, Oryza sativa
gtctaattaattaggaatgtttggattttttttttttgctgaaaatcattttcaagaatgaaagaaatttggtctgtttacatttactgttccttgtttagtgctttacagtcttcacctttagaagtttatattcaagcagtagtggagacagggaggggcaggaaggggtctcgcctcccccaagcacactatatttactgtagcttttataaaattttaaaccgttagtattgttgggcccctccaactaataaaatccagtgtttctgctccgccactgtattcaaggctagctttcatgatgctacttgaagtgatgatttcactgatgcagtgtgctggaactagttgatgcagctgtggatccatcgcttctacaaccaatcaaggaaacaattttgcaggttgatggtgtaaaggtaatacagcctggataaatttcctttgtgccatcatgatttttaaaatgttaaaccgataagtcgaaaacaatgaaagtattgaaataattctagggatgccatcggttgaggggaagaaaagctgggacctccttatatcttgatgtacacattgaggtacatggcattgtgatttagtttattgctttggtatttattttttttggatttcaagatgagagccctgacagttttgtaatgtgggtgcttaggtgctaaataagagaaattgattatgatatctgttgtattgtaggtatatcctttcttaagtgtcagtgcagcacatgatattggggagactgtccgtcatcaaatacaaaagtcacacaatcaagttgctgaggttttcatacacataggtagcctgcaacctttaaaccagaatgctctctaaccatttggctactgtacgcattgagttctttgcatgtactaattggtatctctagctttttttttaatatcgcaaacccgtatatacatactgcctactggaatgcatttcattatgtgaaacaagctattattatatgttttgggcagctaccttgattgtgcattatcttattttagtccaatctatggtttgcgggactgctactagtatgcatacttgttcaaaaaaaaaagtgtataaatacatcttttactcatagtactacgattatgtaaaactgttagacacagagaatttagtgttgcaggcttgaaattttagagttctaactcttgtggctttctgaaaagctgttagacacatgcagtttgtattgcaaacgtacagttctgaagtacatggttgtgcaattaaccacgagacatggttgtgcaatctttctcatggttaattgcacaaccatgccaaaacccacagcaggaatatttatgaagtacatgcattgtagatccttcatattcagtggaatccaacatggaccaaaaagggatttgggagaatatagagagaagaaactcagatgctatcccacgacaacaaacggcagaagccattgtgtcttgtataatttcctcccatttctcaaaggtaaatcttttcacagtccatgacaatgcgaacacctccctcctgcatctactgaaaccatgatttggtgcagaaaatgtcacttgaacacctaatgctgcattacttgcaaggacgagtgttacttcaggtcgaagtttcaatgtctccagaaattatgatccggtaaattagctcttccatttctatcccaaatcttcaccttacaagtttctaaccctgtgttttttttttctccaattgctcgacccaaagggatgcaatggacattgcaaagcaagcggaagaggagatactgaaggctgattccagcataagccaagtaagcgtacagctaagattgggccagcaaattaagcaacttaagctgccaggaggcaaaaatagagcgaagaatcaacaggcacaaatgcagtagcgtcagctacactgtcacggttgattaggctgttttttttttcttttttttttcaaacattattcgatcgacttcgcttgctgctgagtgctgaggcagtagactagttctagcttcgtacagagtgatcttagcctgttcaggcttcagagatactactatggagcagtatatatatatatatatatatatatatatatatatatatatatatgggcaccatggtgcccgggcaccatggtatcaaatacacacaatcactcaaatttttcaaaattttcaaattgtgagtatatacctagttataataactcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatatatatatatatatatatatatatat

SEQ ID NO: 56811 - DNA, 7019 bp, Oryza sativa
atgctcgacttctcggtgtcgctgctggtggacacggaagctgcctccttggtggacttgcgagctcgctgacgaggcctgctcgagccagtggggtcagccttgcgcttcccgcttccgaggaggccaaaggcgaccgcttcaagggctcttgccgtgggaggcctgactctggttccttgcctccgaggattcattgcctgcgaagaagcctgaagatcaggctgagggttggcaggtcctcctcttgttgcctccggggcatcatgagcgatctcggtgtttgaactggaagtagtctccttattcttgaggatgctaccatggttgtctgatgaaggggcgtgcgcaattgtgacagtcttatcatcgtgcggtgtttctagtttaacctgattagccaccaaatcactagactgagctactcctttggcaggttttgtatcatagacgaaggtgttaggataggcaaaagacagtgagtgagcgttaggcacatgggtcttggtgtttgacaatcacagtatagtggttacatatagtggctgatggagtgaacagcttagtttgactagccaaatcaaatagagagttggctatacagatgtttggagagttagtatttgaagaagctgttggagatgctctaacattccaaccgaacgcaactagtttgacaaccaataaacccttgcataagcaactagtgtggctgacttggcatgattagtgtccgtggcatgccttgtgattggattctgaatgattggagcaatttgcaagtcaattaagtagtaacacttatgatttacgaaaaaaaaattacagccacagattaatttgtaatagacacatcttaccccccacataagaaaatcagaaaaaaaaaaggagaaagaatatagggacccacattccactagccaatacagctgctaggttgatttacatcagctctgggacgtagggaccatatctcgagggcccaccagatgggccgggtgggcccacggtccacgttcgtctgatctcgatgacatgagcatcgcacgaaatggcgacccctcctgtcctgcacgatggatcgttgtatgatgacacggtggactgcaccaccccaatggatcatccatctcatctcccactacaacgtattactactaattattgtttttttgttaaatggctaaatgacagaattgatgaatgattgatgctaatcactagtacatccgttctataatataatataattgattttatctgttgtaacttgtctcgcaatataagtaattttagtgcgctggttgtcacattaatcaacttcaattcggatttctttctattatcttcacttaaccaattctgattaaatagggcatcttagtttttctttctctttatccttaacctctctaaaaactaaaacaataccttatattatgcagggagatagtattcaagtgtacatgtaaatgaattaacttattataaagtttaaaatggatttataatagattgtaagaaagtcatatataaaagagttattacaaaatggagtttaggaagcatacatattcatatatataattggctgtaactcgttaagcaaaggctgcgatgttatattttattatcttaaaaaaaacgtattcatccattcatccattaaggagaaaagcgaagtgagaatagctcaactggttaggttccttgtggtggaaccagcccacccgggttcaaatcctagatttgacacggatgctcgtatttacggctaattattctttcagtagtaagcgacgtacccctcgacagcgaggcgcctatggtgacttcgtcaatctcaagacatgccggcccagtcttccgcaggtgatcataggggtagggtgtgcatgtgtgcgttcataggggtgagtgtacacacgttgtgagcgtctgcgtttttactgtgtttctcaaaaaaaaattaaggagaaaagaacagccatagttttcttttccttttttcttttctttttcttgttcttcctctactcctcctagctactataactccctttttctcttgggtcctgagatgtcgataaggctctagctaccgacgactctactacactgtacaccgtctctgtactatagtacgcaggcgctgttacttgccagtgcaagatatggatagatgctggatatgcataatcgagaacttgataggcgtccttttgcccctttctgctggccattgccgtcacattcgtcagctaatagctatagctaaagctgaaatctatcgaaattttgcatgcgcagctgcgccacccgtggctgtacgtgagagacccggtttccgtggtcagccttgacccggatggcgttttcgagttcttggcacagagagacacgcagtttgctcaacttgcattctgcttgcccccctcatcgagcgagagaacgagcgatcagcattggagcagaagcagaacaggggcatgttcagtgagccctaaattctgataagcagccaattttgaaaatccgaaaaagctagaaaacgttttcagtttattttctagattctacagttatgttttcttaaaatctaaatgaaaaaggtacaccagttaagagatctagtttcttttttattattaagaaaattgtagttgctagaagctcttcaaacaaaatctggggtttaatttgttctagcagtcgcaaatcagctgcgaatatgaagcattatcttgatgaatttgatcggataaactgtccgtttcatcgtcgtctgttgatgattccgtcttcgtttatgtttgcggagcaaacgcgcgccctgcactgcatgattcgatcagaacaatggggtcagcataataatgcagaccgagatactaatatagtacaaggtgttcattagttgtggtttagccgtggtatggtaggagtgtcacacactcatcgtcagctctcagctatatatatatatatccgagcttaattagctgatgcatccgttctcgcattcaacttgcgcttttttcctgatcgctttcagcgtcgacggagacggcagctaattggcttggttgcgactatgattagcacgtattagtatttatacgtaaatatcgaaatatatttacatattggagttttgtttagttttctctctgtagcggccgggcgagagagaacggcacgcctctccctctgtttcagtttttatttttcgtgtgtgtgggtctgaatttatgaagggtgtaccaccaagtactggacctggatcgtgacatgcgtgtcgtcgtacgtatacaatgcaaccgtatagaaattaaaggggtgtttaatttgttggttacagtcgaggaggagtgtacacgtactacgaccgatcgagcagctagctagcacacgggacagcatgcaggaccagtacgtgtatacatcgggtaaatcaggtggtggtcaaattaaaagtgtctaggttaattcaagtttcatcattgacagtaaaaagcttcagaaattcgatcggatataacatctaagagcacccgcaataataaagtaagatgatatctataatacatgtacatctagcaatagactagattaatagtaaatcatgttaatagtatatctatatgggtatctatagctctctaatacattgtctcgtttttctctataaactatctccaggttagtagatacctttgctctctctcttcatttaatctcttccaagtaagaaaatatgctgacatggatctcttatagagagcctatagataactattgcgggtgccctaagagcaagtttaatagtatagcccactactaactccaaatcatctatagccaatataatagccaattcatacaatagttgcttactatactattaatatatggtcccacctgtcatacacacattacgtcttgcagtccgtgttgcagctggctacagatctgtagcccgctgctcttctctctcttcttttatctctttaaaggtggtgtttgggaaggagggactaaagtttagtccctctcacaaaagcataattccctctctcccaaacacccctaaaatatgtttatagctggcttatagcctgatattgtacccgctctaatgtaaaacaataattaaacatatttttttaaccgattggggccacatgcatgaccgggggaggcatgtgccgtgcgtgggcgcgcgtggtcgcatgcaggaggcgagtgagcgtcgacaatatctcgacgcatggaggggcgtgtgtggttcatttcgtcgcgttgatttaccgccgcggagcggagaaaatagaaatcggttcggggtaaacaagccgccgggggctgatggatctaggttgcctgccgccgtcgcgagaggtctaatctattactctctccatttctaaatatttattaccgtttatcttttaaatatgtttgtccgtttattttgttcaaaaaatttaagtatttattgattcttttcctatcatttgattcattgttaaatatacttatatgtatacatatagttttgcacatttcacaaaaaattttaataagataaatggtataaaacatgtgctaaaaaaccaacggtgttaaatatttagaaacggagggagtaacttaataactaaaaaaaatccctcgcgtttactctcaccgtctcacgacctaggaagtttcacattaagcgaaagaagaggaagaatgaaagatagaagggtattaggattgggttttgtgtaaacggaaaaataacaagaaaaaaaagaagggtactatgattgagtgtggtgtaaaccgaaaaaaaaagtgaacacggacaagaaaaataggaaaaaaaagagaaataatgtggaaagtccaacaagaaatataatttaaaatagagtctagaaatacaattttaaatttttgaaaacttggataaaaataaataaaattttaaaagaatacatacagtatgaataaccttactaataatcaaccaggattggactttgcaagaggggatcaatcaaattgccatgcactgatctcctctaagagaaagggtgaaacctactaggatccgccgaggcaaacaatcaatgataggattgaaaataatcacattgattaaattgctcaagttagtaaaaaaaaattaaaattattttaccattttaatatatcttaataataaatatataagaatataaaaatctatgatattatgtgataaaaatataacgatactagagttaaaaaaaaacaagagaacaatcgctgtatgattaattgagttttgattagtataaactttaaaagtaaatttatctgatattttaaaataacttttatatacaaagtttttcacaaaatatatcttttagcagtttaaaaaatatgttaataaaagttatgataaagtctttattttaattagtaaagaactccagttgtcacttgccattgggccgctactgttaacgtacgttgccacatttctatgtgccgaaagcctctgatgattctgcctttttctgctcctctaaaacccgatcgccacttccagaggggagggaagagacgtgttccaagctactaaggctgtgtttgatacttggggttgggaacccaactccaccgcacggaaaacggagcggtccattagcgtgtgaataattaagtattagttaatttttttaaaaaaatggattaatttgtttttttaaagcaactttcgtatagaaactttttgaaaaaaacacaccatttagcagtttaaaaagcgtgcacgcggaaaacgagagaaaggggttgggaaacttgtggaaagaacgcagcctaagagcacccgcaatggtaaagtaaggtgctatctataaaacatgtacatctcagcaatagactagattaatagtaaaccatctcaatagtatgtctacatgggtatctatagctctctaatacattgcctcgtttttctctatagactatctacaggttagtagatagctttgctctctctcttcatttaatctcttccaagtaggaaaatatgctgacatggatctcttatagagagcctatagataaccattgtgggtaccctaagaagatcaaattaaaagatcccactttaaagggttagaccatttaacttttcaggccacacagtgcaccaagaggctaataattgaagcttgttctcggggagcgtatcctatacacacaggctctcgcgtgttcacaccatgtacaccaactaaaaattatcataaaaaattctaggaaaattcatacatgtactttcaatagtattacatctacgtgcaaagtcgcatcttcaaattcattctacatagagaataacaaaaaaagataaaattctgacaaaattgcaaccttaaaactggtcagattttttgttttttttgttacagctaaaatataatgaatttgacgttatacaattgaaagtatgtgtatgattttttctagatattttggtgatattttttagttagtatgcacgtatgtacacatgaggacctgtatgcataggataatatgttgcttgttctcgagggttaactgctagcgataataaaggccataggtagagaaaactgagcgatggattatttgtttagttaattgtacaccctctgtgatataaggtgtgttttgttgtggttagaatgccaacaaagatatatttattttttaaagaacaaaaattaaagcttatgcttatcccgcttcgttaagggggtttttttatggtgttgaaattcatgtcaagcttatacctgcccccttttttatctgaataagcaacaattcatattaaaacagggtcgaaatttatgcctgaatgcttcatgtcaaaacatgtgcgaaatcattaagtctttgaaaagtaggagtaaatatgtaaggacatatatgaaaagtaggagtaagtctttggaacgaatacaaactttagataaaaaaag

SEQ ID NO: 56812 - DNA, 4385 bp, Oryza sativa
tataaaaatacgttattttaataagaatgtaggtgcaaaacatacgaaaacatacgaaaatacaggaattatcgtttgcttaggctatgtgaaacagaaaaataacaagagagatactaaaatagaatttttcaagatcttgctaacttttctccaaaatctctatattattgttcatttcatacaaatactaaaggaaattatatgattcaatcctttatattcaagacctttttagaaacttttttataggattaaatcctccaaatatatatactatgtttttcgcaccaattaaaggggatgctaatgtaggtttaattaattcaaactagaatgcagtcatccccgaaagatggaagtattgaacaatcgggaaaagatgtgtgtgtaccatttccattttccttttgacctttcatactataaacaatctacgtagcaagtttgaactgggccaacagactgtagagtatcatgggctcatggcgataaataaaccgaacattattagacaaagtgtatattggtggtgtcataaatcctggtgctcacaattcgacagcaattttaaatacaaatcattaccatcctctagataggagagacagtattaaagggcacagctatactggtctgtccgtgcagtctctcgtgtgatgaaaaggtcttaacacgtttaaattgctaaacattatatttagtacgaaaacattttatacagaagttacttgaaaataaaaatctatttgtcttaagttttaataattaatactttattaattatatattaatcgttttttttacgtgcgagctaataagctctttcctaccgtagcttacaaatctaacttgcggggtaaaagcaagtagaggaatagagacgttgtgctcggtagtttgagttgaaaactaatatcttacacacgtaaaacagagcaattcattagcgcatgattaattaggtattaatttttttaaaaaaatatattaatattattttctaaaacttctttcgtataaaaagagttttgtaaaaatcacacattcagtagtttagaaaacgtgcacgtgaaaaacgagtaagaagagcttccgaccacagccttagagtaggtacaataacagactataaattagctataacacatttcgaggagataaaagagtatagagaagagtaatgggatacaaattttagtagccagttgtagcacggactccttcaagatacatgtgtgtatgataggtgagaaatcagatattaattatgtagtatatgtttgtaagtaattaatctataaattggttatagataatttggagtgagtagtccatccatcctgaaaaaacaattttaggactggatgtgacatattttagtacaacgaatatggacagagatacgtctagatttgtagtatgtgtcacctcctgtactaggttgatttttttataggactgatgaagtagttggctatagttgctcctagagagtgtcagatcaggaggaggcgcacagccggatgcacctggatgcagtttgatctcgatcgatctggttgactggttgtccgcatgcacgcacctggcccccgtgtacagagcgccgcatgcggcacgcaccttccacgttgcggatcggagtcgccacaaggaccgtacgcgcgcggacccgtgaggccgtgacccccgtcccaagcgagtcctcctacgggtctgtttggcacatctcaggctctaactccacctcttctggagctgaaacttagccaagcagttttagctccactaaaactgagagtggaattggatagagctctctcacaaaatgtactagagttatgaaactggatttagacagctccagaacttcactctagactcaactcctgaagttaaatttagaagttgtagctgtaccaaacatgccctgctccaccaactcctcctccttgcggtgccaagggtcatcagctcatcatccaagcaaggacgtcatcccagacgcgatgcatgcaagccacggcgaaattcagcgcgaccggattttgactgattaatcagctgcagttcgtagcatatgcgtgtagtatgtgcgtgtgctccgcgctaaactcatgcatttctgctttcacgtgacggtagactcctcctggcatcctgggccctggcctgtccgtcagccgtcagctttgaattgaaacagaaatggtagtagagagaccttctacagtctatacaaagtccccctgatgttattaattagatgaggatttttaccgtccagcaactaggtgtggtaccgttacggtaccgtttgctggccgttcgatcctggccgatctaacggctgatattagtcgggactgaccggtactaactcagcccttgattttgtaccgcacggtggagaagggtggaggggtaagattgtattttcgcgtgccatggtcggaagaggcatgcagaaaaccctagaataggattcgatgtcgtttcctggagggttcccgacttcggcggcggtggcaaagtcgatggcgacggcagagtggctccctgatggccgagtcgttccccccgcagcgacggtgatgcggccaaggtggtgggcatcaatttcgttttccggtggcgacggagtcgttcccgacggcggaggctgcaacggtgatggtggagtcgctggcggcggtggagtggctccctagtgacggcagatgagggcgacaagcttttctctctcgctaacataatccgattcccatcgtaacctccgtgtaatcaacggctagatttcatctggtaccacccggtacatttcgctggacagaaacaaagctctaattagattagttggatccaaatcattacaaatatattatgtttttaaaaaataacattattattcatttatatgtatccatattatacgaacatgcatataactaaaaccatgtcagtcgcatcacgttttatgtcatcatatagactaaaacacccatggacgtgggacctacattccatcttcttcctccttcctttactctttttccttctccatctctctacaccttgttgagccgaaaacatcgggttgtgaggagggtgccgacgagagagaggcaaatggggaggcaacagcgaaccactagctcccgttcacccgttggcctgcgaaggatggagggaatttagcgtcaccccgcttgagcttgctgccacttgccccgagctcctcccgacaatgaagaagactgttctcgctagatctaggttgatgctctccctgtcaccacaagctccgccatcctcattgcgtcattttctttgtggctgccgacagaaggatatggagccccaaacttaatgcctgagatttagtggcgcacgtacgacgggtgatttagccgccggtttctcgggattgccatcggagttgtgcagccagagctacgtgtatgaagcacccgccaccactatcgttgctaggcgccaccgtcatatgctctatggtgggagagagagagaggggggctagagatgtggggtggccggccagcaaaagaggaaagaaggcagatggaatcgttagtaataaataagtagtaattatttttttaaaatgacacatttataatgatatggatccaattaactttattagtttgtctaaacacgaagaaatttaacgttgaaaaccttacgaaccatacagctggttgttttggctcattgttttcattgatcgttactccaaaccaaagacgtgatttcaaaaaaaaaaaaccaaagacgtcaaaggctcaaagcttagcacacgacacatgcacaaaaacccatgtacgttcatctgcatcctcctcatcccatataatactcctagtccgtaacgacccatatgacacatgcatcggacaaattccgttgccgccgctcgatcgcgcgagagagatttgttgtatgcgcgtacgtacgtgtcctctatctcgtatgatctcacgctaaaacaacaaaaaaaccaaacagcttccgcgagtagagtagcggccaaggccatccatgtcgacgccgcaagccgcatcatcgccatgcctgtccagcagcggccgcagtcagcacacacatgcagcggcatgggcgacgtctggatttcctccgctcaccagttaactccaactcccccccatcccctcgctgaatcggacgatgactttgctttccccgatgcgcagtgcaacacaaccccaaaaatacttttattttttcgttgtcatcgagattcagaatagaccacacacggcgtgtgtaatgtaatgttaaagctagattgatttacacactgtggcctaaagttacagccactgtgatctgcacatctg

SEQ ID NO: 56813 - DNA, 1327 bp, Oryza sativa
cacgaatttggccaaaaaaaaaagtctatggctgctttgctttgcttctttcttgcagccactgcttgcgacgctcacttgctcatcaatcatcattacgcgcgttaattccgttgcgatacgggacaatatgtagctgatatatgtagtctcctgatcatcaatacgggaaattaaattggatggttagaagttgcatcagggggcatagaagaaaacagaacttcatctgaactttatactactccttttgttaatgtcactgtgtgaaggtcagatccttaaaaatcaattgatcaggttgatcacctgctggtcatacagatgtatactactggttggattattggcaacgtttgggtggtttcatcttttctgtttctggtttaattgagcacattgtaatgaccctttcaagccacttctttattttttttctgaaagtttggcgaaaaggtgtcccagttgactgagatcaggatttggcctccccattcgtctctgccgtctgctttcgaaacacatgtatcttatgggtctcatcacctgtttaggataagtaattgttggcgcatgcagcatacataaataatggcatgcctatccttgggtttgacaagaaagaaaaacaaagtgttaacgatgtgaggaggagatcaggttgattaattcagtggtactcgtccttgcactgtagctacgtcaggtgttgagtaataatccaatatataatctgggctatatggctaggagtaaagtagctggtgactgatcaggtgagctgatggtgtagctaacagcgctgtcttagttaacacggctgtttttttgtttttttttcttcgtccagatagcggatgtgtcatgtcggagagtctttgtcaatgttaattcgatcgtgggaaaagaaatgcagagagaatgattccaattgcaaccgttgatggctgtccgtgggttccaaaagtgctgtgacgtattggacatttgggcgctctcactctcatcatacagtatatatgctgcagctagctcctgcaagcaactcggtgctttgattaatcgcaacgtttatgccttgaagaacaattttgaagctaatgtgtatgattaattgaaatcgcaggacttggtctgtttggaatctaattaaccatcgtttgtgagcatctcgcctagctgatctgagctccaggtgactaaactaaatactaataaggctttatttggcatagctctatatccaagctttcattgagttagatactcctggctccacaaatctatagatatagatatagacctacaattacgttaataataattg

SEQ ID NO: 56814 - DNA, 1093 bp, Oryza sativa
attattattattattattattattattattattattattattattattattattattattattattattattattatgcagcttgattaaacatcgttcgatgtagtccagaacctcgatcagctactggctagctagctagtaatgtgccaagcgtaaataccatgcatattttgagcagctcatggcctatactttattagtatgatctctcttaaccttttgcgacatcgatccttacatataaattaaagctgacaactgacaatatctcgcaaacacaaaaaaacttgtagtaataattagtgtagcaaattaagccaaatcgatcggccaaatgtgtgtatacatatatattcgtgttacatcacctttgcaggcgcacattgagcagggtttgagacacactaatgcaacaacagtgtacaacacggttacacggccacacaatcattaataatgccccggccattaatttaatccggactagtccggccgtacatgaacacgtacacacagcacacaataatgcatgctgatatatgtgtgtgtgtgtgtgtgtgtgtgtgtgtgttcgttctccacgcgtcacacaagaaacttaaccaagccaaactatattaattaagttaactgcaagctcatcaatataatcaagcaaattaacctttttgcttgtgcatgcataatacagccatacagtactgtacacacacgctttatatatgctaaaaatcagtcgtacgtgcccgatcgatgagtagaagtggtacgcagctggcagctgatagctatggatcatcataattcatactagtgatcatggacgacagatgttaaattagctagctagttatcaaggaccttgaagtggtcgcggttcttgaggacgacgtcgtacatgtgggtggagcggaagcgggcgaagtcgcgggggagggagatgaggtcggcgccgccgtcgcggcggtggagctgcaccacggcgcggtcctcgtagtagcgctcccacccgagccccgccagcctccgctccagcgcctgcagcgaccccatcgtctcgttcgccggcacgtacaccagcctcctctgc

SEQ ID NO: 56815 - DNA, 5006 bp, Oryza sativa
atatcaacctagctctggagaagcagacagagagacagacatacaggcatcatccttgatcccatgttacacgggggtctctctgtccgaaacctgaatgtccttgcattgcgttgcattgcattggggccttctgaactactactctaattaatcatgtcgtccacatgcatgtgcttggctgaatgagcagctgcagcttgttaattagtactccagtttgctaacccggccgtcaacggatatgggagattattatcccttgccatgttcagacaacagatatgtttcgtagccgtgacatagaaactactagttcaaactgcagatatatatggataacaactctgaaatcgtaatcaatcgccttgcatggctgctatggcagtgggtcaatgcaagcaagaaagaaagattaattaacttgtatgtgtagtattcgcacagccgttccaaacaccacctaattagttgttaataattaataatgtactgaactatcaagcaaattaagctagttccatgagtgagtaggagtacgtcagtacgtggcccgtgacggtaggtaaggttccctttctttccttgtcaatcgatcaatctgctttcccttcctttcatccagggaattcaaggatccaagaatatgtacactttgctagcacttgcctttaatccatcagtccaactaattcatcacacagttcagttattagggaattatataagccaccaccacaaattaattggttcacaatatgtgtccagctaattaagatcaggtaccgctaattaagatcaggtacccaagtatagcatatgtttagtccaaattaaattaactagttcatgaggactacagcaagtaggtagcttaccaactctatgggtgaaattaaacatatgatctttttgtgtgttttgagtgttagttttcgactatcatgtctgcttgcatatatagatttttatcgatcaaattttgtgatgagcagagcagtcactgccgtgctagctaataactaacctgtgcgtagtgtgtatacgtattttctcataaatgatttgagatgaaaagaaaaagcagaggagaggagctagctaattaagcttgaattatatagataagtgcagtacacgtaagtacgtgacagggagcgatggagagacgaaagacggcgactgcacaacagatgaattgatggagtatgtatttaaaagcctcgctggcgatcgatcgattatattgactgaagagtaatctctgatggatcgatttttgaatcccaaaattaaacgatatgatatgatagagacatagcctgtatccaagttattcagttatacaactactaactcctgctgaacaaacctcatgaaaacttttaagccaaacaagtaattaatcatgcatctcatgagctcacaaatattatatgacgcaaccaaagctagcgtagctagctactcttgaagtggaggaaggaagaatatacatgtgcatatgtatgtatggtatgataaacttgactaattataccattggatcattgttaaccagaaatggtataaagaagacgcatatttttctttctcttgcgacggtgggcatgacagagacgcagcatatatagatggatggcatccgaccaactccaattggcgacgtcgtcttccttctctttccgcccgccacttcataccgccctctactcttgttgcttagctacctagctagctagctttcctctccactccatccacccacgcacctcaatcgatcgatcctccatggcggcggcggtgctggcggtgctgtgggcgtgcatgatgatgatgagcctagctccggcgagcttggcggcgtcggggttcgaggaggtgccgacgatcgcgttcgacgaggggttctcgccgctgttcggggaggacaacatggtgaagtcggccgacgggcgcacggtgagcatcaccctcaaccgctacaccggctccggcttcatctcctccgactactaccaccatggcttcttcagcgcctccatcaagctccccaaggaccacaccgccggcgtagtcgtcgccttctacgtacgtattactagcattcattctagctcggtgatcgatcaaaccatgcatgaattgatcacgatatatgtattgattgctggtgatgcatgcagctgtctaatggagatgtgttcgagaagacgcacgacgagctggacttcgagttcttgggcaacaggtacaggcacgagtggaagatgcagacgaacgtgtacggcaatggcagcacggaccgtgggcgggaggagaggtatctgatgccgttcgacccaaccgccgacgcccaccgcttctccatcctctggcactcccgcctcatcgtcttctacgtcgacggcgtccccatccgcgaggtcccgcgcaccgccgccatgggcgccgactacccctccaagcccatggcgctctacgtcaccatctgggacggctccacctgggccaccgacaacggcaagtacaaggtcaactacaagcgcgggcccttcaccgccgtcttctccgacctcgtcctccgcggctgcaccgcccgctccgacatccgcctcgccaccaccgccgacgaccaggacaggtgcgccgcggcggaggaggacctcatggagagcgacgagtactcctcgaccatggccatgacggcgaggaagcggatggcgatgcggcggttcaggcagcggcagatgctctacaccgtgtgctacgacaccaacaggtacccggagccgttcccggagtgcgacgtcaacatggcggagcggcagatgtactggcagtggggggagtccaaggtggttcgcccccgcgtccgaccacgacccggccgccgctccaagcgccgcccctcgccggaggccacggccatcccgccgcccgtgctcgtctccttgcagcaagctgactagtctttgattagaatattctattctatgatgaggctctagctccatcataattctttgattaattttgcttccttcacatgcgtacatcgatcatactgtaattagtaccccctgatgatagagattaatttattgttactgctgcttcttcacgacgaacagttataaccgtggtcttaattaaccattaactataaatctatcaataggtaatcctttgttggtttatcctatttgatgtcgatctggctatctgatcattggtacaagtatgttgttagttggattgatgcttaattagttagtgatggtgcgatgatggattgatgagaagaaagcagctgcatatacagaggtactccagttgcttatttggtcacaattgaattacgtgctactactaattaattgcggtggttaagtgtgcatgtgggagttgagagtgagccgcgcgcaggcagtctgcagtacgttcgatccaactcagatcagataatcgaaatgcgtacttgttgtggttgatgaatgatgatcgtattcgtatagatatagctaatatattccagccagctctgccctgtaaagttaagtagaggagataatgatgatgatgatgcaaattcatcccatcattattggcagtattaagctataattaggcagctgatgctgcaatgcataatgcttgttccaacttctccatccatcgtctgcatgcgctggtgctttgctgtcttccatttccacctccttttccctcaaccttttgtttttgtttggctctgcctcaggctcagctgggttggtattatgcgcaccgaaagcaagcattgcaagggcattgattcaattaaagacaactaattatacattaatccccaggaccgtgcatattattccatcgcttcccttcatcccaaatactacattacatatgtgttgtactatactataatgatgattccataatgataataatgttgataggtactctacatggggtttgtaatctctgtcccagcaggcaggcattccccttttgacaaaaatctgaaaccacttgcggtttaaagccccctttctctagtgtctagtctggaccctgcatatcgtccaatccatacacagattgataatccccgttaattttctcctaacacaatactaccacatagtatatttcttttctgtgcattccaaacagcccaaacaaacccctgtttgtagtctattccacctgccctcgtagtatgtgtggggacgatgttcattccccccttttttcctctgcacgaaaatgttggctgggtcggcacctaataaacatcctttacgaaaaaaaaagagaaagagaaagagaaaaggaaaaagagagaaacgacgcgagtttatcttatcacaacagggtagacaataaaacaaagagcatgtgacgactgcttacattttcccgacataaagtacaccccctgtgacaaacaaatcaaactagcccagcatttcactaatcattcaatcatttttttaatgcagtatcaaacaaatactaatccacaacttttactacttaccaaaacattgacccacgcaaagctcttactcctaccaagtcaaaaaggaaataaaagcattgttgaaaacaaaggcacctcctgatgaattgcccatgctgcttttcccaatattataccaaaatgctggaaaatggactctaaaactatacagacaagaaaaatgcaaccaccatgattcaataacaatggcttctaatgctaccaggtcagtgcacagatgaacggcttgtaccacttaaacatgacattatcagttgcaagaaatgcttcaatcttatcttgtgcaagaggaaaaatacagcagaataaatgcaaatgtgttttcaaataacactggtgaaaaggacttcgattgattcaacctgtcttattaagcatatcatataagttgctgagttcagtgaagttatgagaagtgccctcactttcccgttcggctacaccggcaggaatcaatcaa

SEQ ID NO: 56816 - DNA, 1670 bp, Oryza sativa
ctaagtatgtcctattgtacctcatcatcctgtatggtgtgatgacaggaggcccatctgttctgtaaggttagccatgttttcagctttggtccatccattcccctgttgtgtttccttttggtctagtacacctgaatcgacttcatcattatcaacagatagagggctagccaccaggaactgttcccagaaagaatcaatgatagcaggaagtttctgggtgtcatcgttgtacaaaatctcatcagtctcaatgggaacactatcatcaccttcttcaggcaaagagaatacaccctcaggaccaggcatttcaaagccccctccaggaatatcaacattttcttcagctactatatcttgcaaatctgggaattccagaatattgatatcagttgggcctggagccacagccttcggaacagaaggcaccgcactcatgtttggaacttctttgggtatgccgttgtccaaaacaactgggcactgaatctgaggagtcgaagttgaacaaatagctgaaagtccagagcttgtagctacatatggcaaacctgagttagctgggacctctgcaagggtaacaccagaattccgagttgatgaagagctgtcaagaccttgaccatttggcatataattctcaagaaggaaattatctgaattgcccatggattcaaatctatgtgaagaatctagctttaggatcttccttagcatcgctttggctgcttcattgatcataggttgatattttactatttgtccatccaatgaagcactttcagagtccaacgaaccatcctgctttggtagcctcctctttttgttactagcaactattcttcttctgctgttttcgttttgctgtacaaattgtgctaggaagccaggactatgcattgccttagccaggaaagacatcatttgttgttgccgttgctccattccttgaagacgcttgcccaaagtctgcagctgatgatctgttgtctgctgttgttgtctcagcctgacaagttcctgcattaaaacatttttatcccttttgagcatctcaatctcttcttccatcccaaacttccccacttctacgcaagcaggtacaggagcagctggcaactgaggctgctgaacttggttgtttccatgagttggtttccttctgttgatggtcttcagtagatgcttttgtcctctaagaaaaccttcgtttgcaaactcccacctatctggatcaactttcctaaatccctgctcataagtgcaccaatgagatcgttagaggccggctaacgtacatggcacagtgtatctgcccggtacaagtacttctgactgagtgttatatgattacagaagtagtaatatcattagaagggctaatgtaaatagcacagtttatctgttcggcttaagtgattctgagtgtattagcaggatcaagaaaagatgaaccaaagaaaaaacagacaagacaaccagtacaaactgtccatgattcacttaaaactgtttgtagttcacaaggaaacagctgattggccacattagggaagaaaactaccacaggatgcacaagcagtactggtgtaatagatatatttgcaaatgccataaaggccccagccaactgaataggaccaataaattgctagttgcaaaag

SEQ ID NO: 56817 - DNA, 2534 bp, Oryza sativa
tgtcaccaaagaatggaatccggagtaactagtctccaataagtattgaaggtagcaaatgaaagcagtaagtatcgtgatggtggattgtgcgaagtaagaaataacttcccaaagcagctaaagcaatagtggagggatccttgtgtattttgagtagagtaggaagaaagaggaatgggggggggggggggggggacctccgtaggtgttgagctgcctgacgaaggaggagaagttgctgtgcttgaagtacttggggaggaggtcgcgcgcgaactcgggggtgttccacacaacgaagctgttgttcccggggccccatgagacgacggcatcggtggccgggtcgtccaccatctcgtacgtcttcatcaggaacggcggcggcgcggtcgccaccccgttgctgaccgccgcgccgggcggaggcgcgaccgccgtcgtcaccgccccggcggccgcagccgcagcagcaacggcggcctccatgaggcgatccgtatggggaggcgtggtgagggtcaggggcgcgacagcgtgagcatgggtagggttagggggaggcgtgggatcggggcccgtgggtagggggggatttgagggtggggaatttgggatttgggttgcgggcggcgctaggttttttgggggctcgtcgtcggctgctagtgggaaggagacgagacgagagagagagacggcaggccgcagagaagaaaccaacccatccacaagaacaacaggggatgggccttttcttttcttttttctccgacgagggtgtttctgtaattttgctcttctttgctttgccgctgccgctgcggctgcgactgcgacctacctaacggcgctgccccgtcgccgtcctcccctccgccgtaaacatatctgtatcaatccttccgtttgtttgttcgcacgcccatgaaaattatccctccaaataatctgatttttatcttaagaataactttttattgttttccttgcggtcaccttttcttaataaaaaaaaactttttttataacaaacaactattgtagaaaccaacctataatacaaacatgtatgacacctacacctagctagacatatgtcatacgattgatacattgcatatacgcatgaaagcgaacttcaggcaggcaggggtcatctcgccactatcctacttactcatagccttatcctacgtattctctccgttcccaaaaaaaataaataaatcttaacacaaacatgttcgtttcgttgtaaattgtaatatgatatatcaagggcatttttagatccatttgaaatagcaaatagcaaatagcaaaagttttggtggcaaaagttttggcattgcaaaagtactagttggtgtttagatgcatcctaaacttttgccattctagcactttttagtggagagagagaggtcccaaagcactttttggcacaatttgctactatggcctagcaaatggtaaatggcaaatcgccaacttttgctactagtgtttagatccaaaatagcaaaaagtgctccaaaatggcaaaaggatctgaacagggcctcacatttatgcgtaggtttgtttttgaaattgatgaagtacttactccctttatcaaaataaactaacctcgtccaagacatgaaacattctaatacaacgaatctggacagtatgtctagatgtgttcagattcgctatagtagagtgtgttacatcatgtacgacattattttttttatagagagaggacaaccttagcttaactatacagagagataggactagacatgtgatgtgtctgtcccgagaagatatgtcagtggacttcatctaccaaaagcatcctccttttgagattgtgaatttggattcgtctttctttaatcgaaacacgtttagattcatccaaccctatctgatcccactcaaaaaaattgctattgtgctatcttcaaacatgggttttgccacatatgccattctgcattttagcttcgttaaattgccactttcaaatagatgttacatgctatagtgtccttgccatatgaatggacggaaatgccccttgtcctctttttctctttcaaggcttggaccgttgtcatcgcgtgctgctggagagggacatagacatgtgcattgtatctagccagcccgctgttggcaccccattgtcgagccgcgcgtcgcccggctacacagccatggttcttctaatctttatcgctcctcctgcatcagcgcgacggcgaaggccgttgaagaaggacacggacgaggacgaatgtacgacaacggtggttgtagttaggtggcatgacagaggtttggcgggggaggggggatgaaagtggcggtacattaagttggtgacagtggagcgtaggccgacgtcggtgagccgggatggtgagcatgacgtttggtggccgctggcaagcacctccaacatatgttaaagggaagggagaagaagtctaagatcatgttcttttctccaataagagctggatgaagat

SEQ ID NO: 56818 - DNA, 21049 bp, Oryza sativa
  unsure (1)..(21049): unsure at all n locations
actcttgcatggggtttaacaatgtcaggagctcattttgtccaaaatctgactcaacccccttgtacaaagacaggatgacaatcttcaagttaaggatggttacttctttgcttttttgctccgatgtgtattttcaggagtttgagcatccaacttgcgtttcttggctagttgctttgccttccttgctgcaacagcagggcgcttggctttttgagaactagcatcatgtcctgtctcactagtcctgccttgctgcttcccctggtaacttggacgctggctcaccttcgccttcttcaccacaccagatttgcttgccctaaggccttggtatgacaaagttgacgccttccgtttggtcttgtcactgccttcatgggatttgctgcttggtgttaaagctgtcttgtgtttcgatccaccctttgttttgccagcatccgtcgtcttctttggtgttgcatcagctgattttgcatgtgcaagcctcagaaggcgatctctaatcttgaaatcctgttttcttacgacagtgtttgcagcctcctgcatggcagatattaaaatggtcagcataaaagtgtatgattgagtcgtcaactggctatcttggttctgaatacataattcagcaaggaagtctttctgttatcgtcttcctccagtactagcatttaattgtatggcatggttaatgctaccatcttcaataaatgatgttcaaaatcacgtagtacatagtaaagccatttatcgacaaacatattatacatcaaatggacttctgggttttgacttatttagtgggtcacactgcaccagatgaaataggaaggtaaaagattgtacccttgtcttgaacaaaacataggcgataccctttcctagacttgtatctggatctcgaacaacacgtatagcttcaacatcaccttctgaaccactggaaccacagaacttttggtacacctcttcatcctgacatgccagtaaaaaaaataaatctgaccttttcttcaaaagaattacacagaccatatacaatactgaccacatgatactcacctttatatcaaacggaagattaccaacaaaaactgtccgctttctgtcataaagaggtccttcgcctttaagtttcttacgaggtggacatgccatatcgacacggacatgattgccatcaaactagaaagtatcaaaatcaagaaaaactatcttatcaggcacaacatagaagtttttgaattatataccagatatataaactaatcatgttttcagttctaagaaagccaactcaccagggccatattatgagataaagcagcacgtgcaccctgctcatctttgaacacaatataggcatgtacactgcaaagggtgaaaaggtacagacaaaatgagtctgagaaacattaggcaaacaatacatttgacatatgcagctgctcagcacaatcaattacattttacaatcaatatatagtccttgtgcattgatgggcgtctaataactgggatatatattgaatatcagagttgatggcatcagatcatgaaaaatacgaaatatcaacaaaatgctcttaaaggaactatacgaagcacgcgcctttttggtcttagtacaccattatatatttgggtaatcatgtcacttatctcctcctttgcttcaaacagcacagaaggtagaaaccaaaatgacaaagtaaagggctgtggtgattttagttgatcgaggaaagtattccatgcacgcagaaataattacataggcacatcagtaaaaaaacaaagcacgcgctattagaaacaaactgcagaatattgactcctaagctacaccaaagttgtttgttatatcactaaataaaagttgtgccacaatcaacactgttgagattcagaagtttcctatactacattcaactagcaatccaaataggacagataacttgtatatatcaagacagtagttaaaggaaaacactttaaggtgaaatgtggtaaaaaaagagagtgaaaaaacagggcatttaaccatgtataacaaatggtagagaacttaataaatgttcagggcatagaagcgaattgtaaagctataactaatggggaggagataggataggaaaagaaagaagtgtgagcaagcccatttcaatcggtgtttcaatgctaatgtcctaattgcaaccagctgtaatctgttcatatgtaatccatttgaaattgcaagcataaaggataggggaaaaaatgcatttcgtagctatctctgccatctatttaagcaatggcataaacaatcgtagttgatactagacaggcaagaatgcactcacttgtcgacagaatcattgatttttccttttatgacggctcctttccttggaatcttggtctgcagcaaagcacaaatcagcacagataagcatgaggaggacgaagatgaagacgaagcacagggcaatggtgctcacgtcggtgagtggcacggagcgtatcctgacggactcgatctcgccgaacgccgcaaactccttggtgagcgccttcctcttggtcttgagcggcaggttccccacgaagaccgtcctcagcagcttgctctcgtcgtcgaacgcctcctcctcctcttgccctgcccccgccgccgcagccacctcttcgggcaccttcctcttctccccgacgaccggaagaggaggcgcgggtgcgccgccgagcctccgccgctcgtggccggcctcgacctcgtcccgcttcctcttgcgccggggctcatccctgcgcgacttcgcggacggctcagcgacctcgggttcggggtgcttgcctcggggcgccgcggcggtgggcgccggtggagcgggctggtcgtcggagggcttgcggcggaaggggttgtctgcggagaagagggtgcggatggccgcggcgtcgtcggacgcgggctccttgttcttcttcgccattctcgccgccggtgcgaggcgacggcgagacggtttgcggcggcggcggtggggttgggattcggaggcggagggggaaactcttttgttgcggggtttcgcctagttggaactcgccccagaataggggacaggctggggcgatctcgaccgttggattcagatcgaacggctaggatttgtctgtatccttggcacgagccgcggtggcatggtagaacaaggggaggacaggaggaggagggggttttctagggtttctggagttcgacgaccgccgccgccgtcacgctggttcccatcgccgaaggagagaggatggaggagagccgcgcggacgggcggaacccgaaccagctccgccccttctcctgcacacgcaaccctctcgaccgcgcccatggctccgcgcggtgggctcagggggacaccatcgtgctcgccgccgtgtacgggccaaagccgggaaccaggaagggggagaatcccgagaaggcatccattgaggtcgtctggaagcccatgaccggccagattggtaactactctcctctccacgcttgctatcgctgctcgcccaattgaatcgctcaaatggtgtgctatttttattttttattttttatttgcagggaagcaagagaaggagtatgagatgacgctcaagaggacattgcagagcatttgcctgctcactgttcatccaaacaccaccacctctgtcattcttcaggtataagatctactcccttcccatgctgctatggctattgctttgcatttgttttgttctacctatacttattgacaaattgtgttagaatcattgctcttgtgttgtgccacgcaagttgactgtctgtactctcttgtccctgctttaaggacgctgattgctacaaaatcttcattgagtttgcttactgattcaagcttgctatattattgctgacttattgtcaaacttcattttcttagcgtgccatatcaagcgtactttaggtttagtgcatcatgccactgccttatatcgttttgcctttaatttagttatccttttgtttgcaggttgtgggcaatgatggttctgtatccttttgccgtaatgtactacttagtattgtttctgggtgccttttggattatgaacattgtacttgatataggaatgatttcagatttttggctactagctgcagtagattggcatttgaatttaatttcctgtatctctgtgaatctcataagctaactgctaatttcagctggttgtctacagttaggataagtggttcgttgttttattcctgaattctttgcctcgcaaaatgtttgttttggccggctaatataactgacttgtgatgagaaaatgccaagtattgatggaagtccctggttccatgctttttctgagtagtcttccaatcaacatactgtatacagcgtgctttatatgaatgggcatggcctgctatagcagatatcaacatgtagtatgttctttgtaatattcacagattcttagtatttcggtcttcaagatttcaatcaagcacaatccttgactaagtctagcttcttccatgtgcaattaatgcttgctgcgcagcccttgtttttgctggcatccccttgaaacatcttgcaggtaagttagtaatctttgtatgctcattgatgaaatatatctcataagcttttgtgatgcagttgcaattggttgtggagtactggaggatggtgaagtgattttggacacaaacaaagcagaagagcaggtagaaatttctcgttttgattaagtcctctgcactaggaaaggaaagaacgaatttttatctcgtttcttccctaaaaaacatcttagaactattggttcataattcgctctttaaacttgtggacaacaagtacatttttaatccctctactctgtggaaagttatcatattggtttctaggtgggtctagttgtcaggtatcatcttctgaaatgttatgttgattgtgtatagtcttaactgttgaaaatctaaataagttaatgctgagaacatctttaggagtgcatatgcattaatgttactgtttgctgtcatctgcagcaattgaaatcatttgctcatttggtgttccccaattcacgcaagtctgctagttcaaaagaaccaaaccagaaagaggaggattctgagagaggattgataacttccattacccatggagtgatgtccggtatggttatatcttgtgcctcagcttgatgtgttcttctggacattatagatatagggatgcatatattgtggctctaaacatgtcccctttctgtctcatgtaaagaggaagattatttcagctgcatagagaggggccttgctgcatcgtcacggatctcggattttatgaggacaacattgcagaagcaggcacctggagatgtctgagaggaggcaatcatgcgatagaaaacgcctcaacattgcagaagcacaaggttgtagcagctcatgttttgaatatgaaacgcgtggggactcttggtgcattattgatgtttgaaattggctcatagatgtgcatggatggtggagcgatccggcaggaaatatgtagcgccttgttcgcattttttgtgaatgttgagctgctttggtagtgactagtgagttcgtttgtagtactagtagcgagggaactgtcgtttgtttagatgagcaaggaagaaatgcctttttgtaactcaggaagaagtcaaagcagttgtgtaacaaaccactttgccatgttgctgcacatttttggtcgccctgtttatgatgaaggtgagcaatacatgagaggaagaattcatcgcttttagttgattcaaatcacagttttataatggaatatgtttaggattaggaaagaaacaagtgtgtgagaatatgattattattccacggtattcacagtgctgaatcctagtactactacatctgtcctaaaatgttgctacacacatcctaggataacgaatctggatagacctcccatcctctgtccagattcgttgttttaagatgggtaggtagcaacattttgggacggaaggagtagctggtaggagcagtgatagtagtgatgagttggaaggtgcatggttgatgagagagagacgggtagagaggcaaaggacgaaagcagaagagtgaagtttggtagcgggtcttggaatcgcaccgactgggatctatgatgaggcggcacggcaggtcatccatccattcatccaggttagttgttgatgcctcgtccaaggcagctagcaggagtacgacattatcatgaatgaatacctaaaaatagcgtgaggctgtgtgttgcacagtgcatatgtgctggctggcttgtttttactgtgcttcatttttagcgaggggcggtgaatggaggcaaataataattaaggtggtggtggtcaaaaaaagtaaagggggaaacgctcgcgaggagggtcagggagggagactaggagtcagcctggcgttgctagtgttgaaggccagccagggaagaagaaaccattgataatttgacattcacaaagaagggaaggaaggaaggttccttcggcttggttgcctttgcctgacggtgaattgggttgggttgcgtcgcgttgcgcgcacggtcgtcggctcgcgctccgcctaattggttgacgttgctctcctcgctggtggtattgtatatagcgagccctacctactccacaaaaagagtcctctcctctcctctcctctcccttgccaccaccaaactgcaattaattgtttgtttcgcaaaacaagcatcctcgcctcggcgtcccagatctctgctgctgggctgggctgcctgcctgacaagagaggcagcagccatggcgttcgacgccttcaccgacaagaacgccgtcttccgccgcctcaaggccaagcccgagaacaaggtaacttcctcctctcagatcttcttcttcttcttcttcgcctcaagagtcagatctcatgtactagtattgtcgtgtgcttgttaatttcccagatgtgcttcgactgcagcgccaagaaccccacctgggcctccgtcacctacggcatcttcctctgcctcgactgctccgccgtccaccgcagcctcggcgtccacatcaccttcgtcaggtttctttctacccccccttcccatcccgatccacgccccctcccctcacaagatctgcaatccgcccacgccatcacatccgattcctttcctcatctttccatcaccaaccaactctaagcccatcacgactcctaggaactagcgcagaccagctcaacgatctcaataatacttccctttttcttctttaccccccaaaaaagggatatggtacagcgcataggtgcctgtggttgctgggtttggtggatctggccgagcctttcatcaaaaagaaaaaaaaaaggtcctatttttggtacagcccatctggtggggaatgcagccggagatctaggttcttgggccatcaacgtcaatacctgctttacaccttcatcccatcggcatttgcattcacaagttacacattttggtctaacagatccatatgcgcattcacagtaaatcacctactacttcgttatatttttctgcaatgaacatattgaacttcattgctggctgctatatctatgatcactactatggctatgctacattgctacccatctcatgatgctgcacgtttgtcttattgtgttgtttctaccacacaaaaaaaaaaatcataaaatgccttgctttgatactccgcaaaagtactagtattgtgcctgccaaatgtcaaaactgtacccattttattttcactttctcttatacaatccgtatgtattttctataggtcaacaaacctagattcatggactccagatcaactgaagatgatggcttttggaggcaacaatcgtgcccatgctttctttaaacagcacgggtggacagatggtggcaaggtcgacgcaaagtacacgtcaagggctgctgagctgtacaggcagatactgcaaaaggaagttgccaagagttctgctgataacgtcttgccatcgtcgccagttgcagcgtctcaaccacaaaatccatccgatgacttccctgagttcaagctaccagaggcaccagcagagaataccaatgggaagcaggaacctgatgtcaccaattcgcaaaaagcacctacgcagacaccaaaagcccctactcatcccacttttgccacttctgtaaagaagtccattggtgcgaagaagattggaggcaagactggagggcttggtgttaaaaagctcaccacaaaggtaacactgtggatcattagcgctatgtatgcatgtgtttggttccttcccacagttaatatttaatatacctcctctcttctatctatatgatgtgaacattaaggactgacctttgcctttatgttgcagccaagtgaaagcctgtatgatcagaaacctgaagagccaaaacctgctgccccagtaatgactacttccaccacaaaaagtggcccgtccttgcattcacgttttgaatatgtggagaatgagccagcagttgattcaagaaatggaggaactcaaatgactggccacgtagcaccaccaaaatcatcaaacttctttcaagagtacggaatggataatgggttccaaaagaaaacaagcacagctgccacaaagacccaggtaaatattgaaccaatgtttgtgctatgtcaataagtaaataataaatagattgacttttctgatcaatacataagtttgcaaagtttactttctatgataatgtaaacactgcactagattttgctgcatccactagcttgacttgttttgatttcatgatgtcatttccccttcctttatttgctgcatgcttgcattctgctgtttaatcatcagtgaacatctacaaatttcacagaataattaccttttgaactttggaaaagtcagttctctctatgcaagctgttgttattgctagcatgttcttattatatcaaatagttttccgcttgtagatttttgttatgttaataagtactgacactggacgtgaatacctttcagattcaggagactgacgaagcaaggaaaaaattctctaatgcaaaggcaatttcatcatctcagttttttggcaatcaaagcagagaagagaaagacgctcaaatgtcccttcaaaagtttgcggtgcgtattagtttagcatctctttgtccgaggaccattacattgcatctccttcgaacttgtcgaagcattcttaacttcattccagacttgaaatttcttgtctattgtttatgtttgtgctagtacttcatttgaatattctgtagaagtttgcatcttttttttcccttacggttctccttttttttccccctttaattcagggttcttcgtccatttcaagtgctgatctttttggccgccgcgacatggatgactcgaatctggatttaagtgctgcggatctcatcaacagaatatcattccaggtagttattctgtaaataattgccagccttttgtcacctcttgcatatttagtttttaagcaaccgagcatgcaaatcattactacactgagttactactgaattattcagtacaaagattgatccttgaaacgcacaaatatcttacctgctgggattgttgtgcaggcatctcaagatctgtcttccctcaagaatatggctggagaaactggaaagaagctgacatctatagcctccaattttatcagcgacctcgacagaatcctttgagtggttgatggggcgagatcattagcattttttgttttggcaaacctgcacagaataccgtattgagtttaaaatgtggtgcagctcagagaagcatttgttgcacagctatgtagatgaaagtagaggattggcaattatgcgtctgtattcttttttccttttttactattgttggaaccctgtccgcatgaagatatttttattcgtttcttgacaagattgaaacatacgatggtattcattccagttagtggtatagctgggaagaaaaggtatactttgatgtgcctgtgctaaatggaaccagtcatgttatttcttatttctcacagtgatctgtgccactgccagttagagttcatcttcctattataagcagataagctattgcaaactggctggttgttccttttactgacgtctctgtcgatagcttaaatgttacaggtttattataatgcaatcttgcagggtggaaaaaaactgttaatttgtgaaggcaagattcagctaaccgtgtatggaaactgaccaaatactggcagtcgagtatgatagattcagcttatcgtgggaaaaatggtactttgcgaacagccgtctgtcgacatcatattatatattgcaatggcttgttttgctgtgattttgagccaccaatgataaacacaatgcaagttgctgtcttgccgggtgtatcgttgtagcagagccgttcaaagtgacgtggactccaggcggtgccacgcaagactgttattttgtctcctctcttttctccactttttcgtcgtcaaaaatgctggaacgtcaaggcccgcccgttgtgcaaatggttgacagtgacactgacagtaacagattcttgatgtaatcgcattagaagaatcttgcacaaagcaaattctctttgttcttgtgttgtgtttgtggcttgttattctaagcgagtgacgggagcatctgtgctgcctttgccaatttgcaatccacgcaaggctcgtctttagattcattcgttcattttatttccgagtcaactaagatatcgtgtattgtctgaacgattcaaggcagctgtaattaattaagatgacagaaaattcagagcagagcaggttatcttgaacacatcaattattgtgaccagaaaattatggttttgaatttgcgtcccctacaaccaaattcaggatggttgtgttatctttgggttgaagaagagtttttgtcctcaacattttccagctaggagccggcataccacagtaaaagttgaagccttgatcgagataactgatgaacaggcggccggcaaatttcacagccaatgatcagtgagtctaatggaaaatcattctattttattacaggaagatggctgattttacccccacacaaacggatgtgatactacagatcacgcgatcagcgatagcctgatatggcgatctggtaggttaggtagcacgcgtgatcatccattcatcacaagagattgtcacatggcccatgcacgctatcgcacaaataggaggagtgattgcaaagagaagaaaaatagattaagaaaagaaaagagattaattgatgggttctacgatgactgcgatgagacgaacacccgaatctgctccaggaaggtgagctgctgcggccgatccttgcggcggatgtagccgtcggcgacggccggcgagtactccgggtaccccttcttgccgctgcgcgcccacaggtcgtcggcgtagccgcggtgcgcgtagtaggcgacggcgtcgacctgggcgccctcggcgaggaggacggagatggggaggcgctcgtagtgcgcgcgggagacgccctccagctcgtcgaggcggtcgagcccgcgcggcgtgacggcgtagagctcgccggagacgcggtgtccggcgccggggaggttgaggaggaaggggacgcggtatggcccgcaaacgagcgggaggcgcggcgcggtggtggcggcgcccacaaagaagccgtcgccgtcccgggccaggtcctggaggaggccgtggttggagaagcccctcttcagcgtgccgtacgtgaacaccagcgtccgtggagccgccgccctcttcgcctccggcgccgccggtggctgctccgccgcgtcgcccgccgccgtgcccatgcgcgattcaatcgcggcgagctcgagtcgagcttttctttctttggttggttggttggtgttttgaggcttgggtcggcttatttatcgagagaggtgggcccgcttcgtcgatgtcgcgtgggcccagcctctcacatttgtcgcattagccttccagcccattaacaatatgggctgcacggagctcgactcaccttgcggcccaacaaacagggccttgatgcatgggcctcgttctacttccattggagaaggcaagcctctcctccctctccgaaccagccgccgccgccgccgccgccgactgctcggcgatcatggtcggcgaccgaaagcgcccggctcccttcgccggattctccccgttcgctcgctccctcctcttctccgcctcctcctctaaaccactacctccccccgaggatccacccgccgccgccgccgacgaaatcccttcaggtacgcgtgcttacacttaattggcaacgccgtcgccggggcctcgctacctccttctcacgcctcgccgctctccaggaatcgccggctccagtcgcgatatgccgccgcccaagcgcgccaagcgggccgagccttccagcgacgaggagcgctacagcagtgacgacgagagctacagcagcgactccgacgacagcgacgacgcgtcggaggaggtgagtgcctacctctaccttggttctagcctctctggagttcctactcatcgattgatgcgagttgctcttcggattggtgctcctagctcgatacggtgcaagcggacttcgccttctacgaccccaagcccggcgacttccatggcgtcaagctgctgctcaagacctacctcgactccaagccgtgggatctcactggcttcgtcgacctcatccttgagcagaccacggtgggtacggttgtcaagattgctgacgatgaagaggatggtgaaggaaatggtgctgatggaagcagcactggtggcaatgacgatctgtttggtctcattagcgtgcttaatcttggaagatacagtgtatgttcaacctactcactgcttcatccacaagatacataggtcttgctgcactggtggcttctgattaatcaacttgctggtgttgtcttgtaggagcaccgctgtatgaaggatcttaaggattacctgcttgctgtttgtggtgacaaggataccaagaagaagctcaagcaaatgctgggggacaaagcacctgatgtgggtctgcttgtgtgccgccgttttgtgaatttcccatatgaacttgtgcccaagatgtatgaatcgttatttgacgaagtttcatgggccacagaagacgaggtttgtcaagcaccttcttttatgaacgtcgagctcagatagtgtgaaacacattcttttctctactttcttataacgtgttttcaactgtcctcgcatatctgaagccaacacaagaactccgggactccttccggttcaagcagtacctaatggttgtcagagtacttgaggtgagcaatgcaatttgtttccatgtttgttttgcccattgatattcaaagcgacttgttttgttgctcagtatttccgtgtaagatgttgtatagatcatttttcaagtgtaattgtgctctgtatatgaaagttcctgtcttgttgtaactgcttcagctgtatgaataacacgtctttgccatctggtgtagaggaaaactccagcaaagcaaaaggcaaagaacagtacagaagaggatgagcctattatctatcctaagttagaagacgaaatttttcgcgaggtatcaagcaggacatgctactgacaatctgagattaatttttctttgtgcagttctgtttgatgtggtaacaaaactttcttcctcagctttcttcatggtcgttcactttcccaatacgttctgaacaatcggctcagcaagaggttagttgtgtataagtacttcaggctttattatgctgttcttttattcatattttcatagttactttcagcatctggaactggttcacttgtggcactggcactacaaatttcctttggtacctggattgatattgttatcttttggacatctgtttgactattcgttttaataaatatgtaagtatcatttattttgttttataattaaaaatactttaagcacgagtttttacatatttgcataatttttttgataaaacaaatagtcaaacatatgtccaaaaaatcaacaaacgctgtatatttaggaacagaggtagtagtagccaaatgaccaaatcccaatcatgtgaagtaggaacattcgttcctttgtgttatgctttcgttatatctttcttcttctgatgatcattagctcaccatttcaagcagaatctgaacatgcatcattctaagtttgatgttgtgtacacctaaattgaatggactccctgtctaccctttcagatgaagaattacaaggagatgggcttagtgatggccgtcaaagctgaagcaattccgaagttccgaaagaagttggaggatctactatctgaatagttctctccacgcattgtaggtcgtgtggaattttgctgctgtccacatgatattggaacctccatatcttctcttgctattgcttgttagtgtccctagtaagcgcggacgctaagtttgtgagtgcaaagccctaattgaattgctagcattgccatagtagaagagaaattcatgtgtaagaggaaatcaattatgaacttcccttatactgatatcaagagattttgaaggacttttttggttgctcgaagacatggtctttctcagcccatacgcaccacattttagctgggagtttgtttgatcgatatacatcacactgtggtcaaagtcaactgtctatgattgtttttgccatgaggtagaaacgtgtgacgaaactgtgccctgtgcataacaaccgcatctcttctgaaggcataggcatctgcgtccttaaggtcagaggacattagtcatgccttgcaaagtctctgaaaacatggatagctgaacaaaaacaaccagcgaccaatcgctcggtgttccagatgaaatttgaacaatggttgcaaatatatcatatctctaagccaaaacaagagcatcacgtaattaaactgccaagcacacacgggcgtgtagcattgcaacatcataaacaacagaatgttgggaggtgtcctaagcaaaagtcaccgctacttattaagaacagtcagcacgccatctcagtgtcttaactaaaatcgtagtatgacaccagcatttactgatttccacatggatttaaaggaacgctaataacatagtatactacttcttctggaagtattagcagggaggtatcacaataaaaatgtaaactgccaacaaatgatcatgaacgcgagtgcagccatgaggtcattgggcaaccttcaatcacaagttcttgaatgcagactcattagggtgcttgggagtaagcctcgccaacaaagccttgttcgggaagtgctcggcatcaacaaaatagaagttcccttcagccctaaaagtgacaaaaggtctgttggtctctggaggcctgacatcagcaaacttgattgtccttgtgaggggtgtagccagccatgacataatctctgcttcaaagctatctgaacctggtcgccacctgagcttgtgaatgtacgggctcacaaaccagtgtaaggctgccgttgtggtagcactgaggaaaatgacagtggatgcaacagcgcccttgaggattacattcatatctggggatgtcatgaatgttatcacagggccaagcgacacagagagacagcaggtggacagagaaagaagcttcacttttcttatggtcgatgatataggtccctggtaaactagcctgtcatctttgtcatcttccttgatctgcttggattttggcccaatgcttatcttgctgccactattttcagtttctttaacagcagcagcttgagaagcccatcttgcctgactgtacaaacaagtgactgaaccaaggccatcaagttttggaagaggattaggcttgaatgttgagaaatgcttccatgcaatacatccaggagcctgaagatctgataatgtaaaggacagttagctgactttaatcggatttttgacacctataaaaaaaataagaatgcaaatctatatacttcggctatccaagataatggttcagaaaccattaagttagcaaaggagcatgttgctttcagaaaggaagatcattacgctattaagcattttgaggtaacatacagtggtaaattggacttcaaccatgcgccctgttgaattactataacacatcttcctaacaaatgcacctcaatacagtacaattagacacatgtaactggcaaaactaaatcatgtgaaaccgaaagaggtattgggggctcacgagagtaatatgtagagaatagcagataataaatcatgaaattcaaggtagaagcttgaatccacagattatgttggattgtgggtggagttagaaaaaatcatccctgaaatagatgtggaggactgtcatttaaactaccttttcattgacacatgcactctcaccgaagtctaaccaccaactacaatctaacttggaaattccgagattactcacaacatagaagaacatatagctagtcagtcagataacattagcactacatagagggcacagcacctccaggagcccaggacctaatcaaactagaaccgaacttgtgcaccatggaatcgtatgcccgttctcacaacaatttcgcagctcatagctgggcactaccacgcggatcagatttaactatggagagaaccacggggggagagattcgaagcatgaggcgaacctgagacgcgggagaaaacttgcggcggcgaggtggttcccacggagcagtggcggaggaggaccccgcggagggaggaggcggatcggagcctcgccgtcgccatggtctccttccgatcgaggcggggatttgctagggtttttccgaagggatggaggagaggccaagaggagacgaagcggagcgggcctaaacttacaccacatgggccgatatgggccaggccttagctgggaggcggtttcttattggatccggatccagaaacctcttcgccttcctcccatctttctctctctttgcacgcggatctccacactccgcaccgccggaaccctagccgccgcccgtcgccgccggtgagattcccttcttctcttacctgattattacctcactactcgaacccaaggttttttctaggcacaaaccctaatagagttccccaaactaggcagattttttttacccctggtcgccgctccgtcgtggcgagcgggcgggatgagcagccaccggaagaacttccgccgccgcacggacgacgccgaggacgcctacggggacgactcgagcaactccaagcccacagccaccaagacccaaacccctcccgttcccaagcccaggtcgccgagacgtcagggcgcgagccgcctcagcttcgtcgaggacgaggacgacgatgacgccgaggagggacctttgtcgcagcgccgccgcccggctgctacggtccggcaggcccgcacggcatcgccagctgcggcgactctccaccgcctcacgcccgccagggaccgcctcaagagctctacggccgtggcagcggcggttcccgcgccgaagccgtccaacttccagtcgcatgctggagagtacacgccggagcgcctccgtgagctccagaagaacgcccgcccactccctgggagcctcatgcgtgcaccgccgccccctccccctccaaccgctgaagccccacgacagcgtttgcctggagctgccgccagtcctgctcctgctacaaacaccactgctgctgctgtagagcccgtggtgattctcaaaggtctggtaaaacctatgtcacaagctagcattggaccaaggaatccatcgcagaacgaggacaaagacgaagatgagtcagaggaagaggaggaggaggaagaaggaccagtcatacctgaccgcgcaacaattgaagctatccgagcaaagcggcagcagcttcaacagccgaggcatgcagcaccggattacatctcccttgatggaggtggtgtgcttagcagtcgtgaagctgctggtggatccagcgacgaggatgatgatgagacacgcggccgtattgcaatgtacgctgagaagtcagatagccagaggagcacgaaaggtgtatttggcgtgatcaataatagaggtcctgctgccagtttgggggttatcaatgatggtttcagggaggttgaggatgaaaaggatgacgatgaggatgaggaagagaggaaatgggaggaggagcagttcaggaaggggcttggtaggagggtggatgatgcttctgctcagagagcagcgaatggtggaccagctcctgtgcaggtccagccgcaaccatccggatactcaatcgatccccgttaccagccttcctttagcggggttttgcctgggacttctatttttgcatctgggagtgcagagttcctgtcaatcgctcaacaagctgatgtagcaagcaaagccctgcaggagaacatcaggaagcttaaggagacccataagacaacagtggatgctttagtcaagactgacacacatcttactgaagctctttcagagatatctagccttgagagtggtttacaagatgcagaaaggaagtttgtgtacatgcaggagctccgaaattacatttctgtcatgtgtgatttcttgaatgataaggcattctatatagaggaattggaggagcacatgcagaagctgcatgagaatcgagtgactgctgtctcagagaggagggcagctgatctagctgatgaatcaagtgttatcgaagctgccgtcaatgcagcagtatctgtccttagcaaaggatcaagctcagcttatctatctgctgcatctaatgctgcacaagcggcggcagctgctgctagggaaagttcaaacctaccacctgagctggatgaattcggcagagatatcaatatgcagaagcgaatggatcttaagcgtagggaagaagacaggaggcgaagaaaaattcgatcagaatctaaaaggttgtcatctgaagggaggagtgcaaataatgaacatatcgaaggggaactaagcactgatgagagtgatagtgagagcagtgcctatctgtccagccgtgatgagttgctcaagactgctgatcttgtattcagtgatgctgccgaggaatactcaagccttagaattgttaaggacaagtttgaaggatggaaaactcagtatcctctggcttaccgagatgctcatgtagctctgagtgcgccatctgtgttcaccccttatgtcagactggagcttttgaagtgggatcctctccatgaaacaactgatttctttggcatggagtggcacaagattctttttgattatggtgagcaaaacagtgaaagtggcactgaccctaacaatgtggacaaggacctcattccagtattagtagagaaggtggctcttcctattttgcaccaccgtattatgcactgttgggatattttaagcacccaaagaaccaaaaacgctgtggatgcaattaatatggtcattagctatttaccaacctcaagcaaggcattgcatcaactattggccgctgtcaatagtcgtctgactgaggccattgctgacatttcagtgccagcttggggatcaatggtgacaaggactgttccaggtgcttcgcagtatgctgctcatagatttggagttgcgatacgtcttcttaaaaatgtgtgtttgtggaaggatatttttgcaaaacctgttttagagaagcttgctctggaagaattgttgaaggggaaaattcttcctcatatgaagagtatcattttggatgcccatgatgcaattgctagggctgagcggatatctgcattacttaaaggagtgtggtcttcaccaagccaaaagttgcagcctttcatagatctcgtggtagaactaggaaacaagttggagaggcgacacatgtcaggcataagtgaggaagagacacgtgggctggctcgtcgtttgaaagacatattggtagaactgaatgaatatgataaagctagagctattttgaagacttttcagatcagagaagccctttagctcttattcggcataccacaagaattccagttttgactgtgatacaggttcttaatccttctgctttaggaaatgttgtaacttcatcaggttttctgtacattaaatgatcatgagttcctcgttcaatcctgcatgatgttatccatacaaattttatgggggcttctcaattcagaaattatggtcatttttaattaccatttaccaatgctaattaactgtctgcaaatatatatctttctagcacttttctgtgttatagacatattgtatgacagtttgagcgtgtctgtatggttaattttactatattttgaggccttgagcagaatgtctttgctgtttgcatcagcaaaccattttttacatttagctaactgacaatgtattttttgaaagatgcaaggtgtctaaatattgcatgaacgcttctatttaagattatgtttgatatctataacttacactaccagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56819 - DNA, 4926 bp, Oryza sativa
  unsure (1)..(4926): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgggtgcattaactctcttccacctcagctggagtccaatgtggctgaggccatgagtcagctgagctggagaattgtagatgcccttacgaaccaatctacttcagctctttcccagggtttaatatgagggtctaaaacttggaccagaactgacaaatgtgaatacaaaatgacctttcaataaaaaatggtatgtaatatctaagtcacttttctgcaatggaactgacaagactataaagctaaccattttaaagttatattcgcctatgaaaagccaaaaggccatcttgacaacacatttatattggaggacctaggagatgttagaataatatacgttgtataaagtgaaaacagacggtctagatatttagatctctattcacttgatgcataaataagcacatagtatagagagctaccacagttttatggccaaaaatcttccacatacatccctgtgagatcaacaactcaatgttctttcaagtcaactcacccattttgcttcctcatgtttcttcaggctctatccccatccttccaatctagatcctactagaattatccatcctaaagtgaccctatgatatttgagaactattgctcacaaggaactctaaagaacaacattggcagcttaataaacagacaggcacttgttctctatgcaacaaaagaaggttttcataaactgatcatagcaaatccttcagaaccaccaagataaatcagacagccattgcaaaaccatagaaagtactgtgtgaaacatatagtgaagtagcatactgaaatataagaaaagagtcacgatggaaagaaaagaaaacatatacaaacatactgaaacatctttccaatgaatttcttcactaaaagttatatttttatacactaacattttcctctcaagttcctcacacgaaaagaatcacgatttgtttggatgagtacagaaaggttttaaaaagaaataatcgtgatcatgccccaactttcaaccctaattgtgattttaccctcactttttagggtttgcatatttacccctgtttcttcaaaacgaaatcaccgtttgacccaactatggatggcagttaggtgggtcccacaatattggattaaaaaatagaaatgaaaaagaaaaattaattaagaaaatattagattaccaatctgcccctagtaatagtatcataacattacatgttctcctcacccccactgctcccatccccaaatcgtagatagatcacgtggcggtggcaccgatggcagctccggcgagccggcttggcgcgcgacggagacgaaggctcctcgatgcggtgacgcgagcagcagcaggcggcggtggctcctcggcgtggcgaggcgagcagtaggcggagaggatggctcctcgacgcagtgatgcaagcaccaggcggtggcggtggctcttggcgtggtgaggcgagcagcaggcggagacggcggctcctcacacaacgacgcgagcagcaggcgacggcggcggcgactacccctcaacgcgagcaccaggcggcggctcctcagcgtgctggcaagcaacaggcgatggtggttgtctagttttccaggtagcaatgatattgagtttagatggccatgatggagtgatttcacacacaaagaagttgaagttgcaagcacgggctgacgggctgttttcagtgctataggtaattctgatatgctatcagccatgttggcacactgatattcagtgctataggtaattcagtaattctgtattcagtgctatagatagcaacgatattgagtttagatggccgctatgttgacacactggatgctgtatcattactctatctgcagtttaacacttcgcgtgcaactcccattgtcgattgttccttcatgagttcatgcatgcttgatgtttgcacagttttgctatgaattaaacagcgtgataatggttgaggcgtgctgctcccagatttgtttgtaatataaatgttgtgatcctgttagtgatgaaactggtgtgcaaaattttgtttgatttcggtaaaagtttgtaaaaatcagttcagatttgaatcatttcatgaaatgtcagttcaaaacagttacaagtttcatacacaaactaggggtaacttcacaagtgttgtccaaaggtagagggaaatatacaataggaagcaagggcaaaaatgtagttttacactcaacttaacaccgttaaattgatcatccaaactaggggtaaagctttgcttcgtttcaataaaacaggggcaaaaacgcaaaccctaaaagtgagggcaaaatcacaattggacttcaaaatgagggtaagaatgcaatagccccaaaaaagaaaactagatttggcttccaaagggaagtgagcatgagatgcatacatttctagcaatgatagaggaggatgtattcaaactatctttctgcattccccaagtccccagtccccaacaatttcgcaccacccatggtccatggatagatacgcacagccacttcactagttgatgatgttcgtacttgtgcagttgcacatcatcgagtggggagcaaaatggttacagtagtaaaatgggaataagcctgtacttagcgcagatttggattagtcctagactgacaacaagatgttcagttccatacctagcagcgatcctttcaatttttgtaattctgattcaaaactaaggtattgaaattgaacattggcaatcgaaacagagataattgaagatggcatggataggcaagggaagtaaggataaaagggaggtgaccttgaaggaggcaccgatcttggagtccctggtccagtcgagggcgaggagcttggtggaggcttggtaggtggccttgatggcatcccctccttgaaacttgcgggtgacggcgaagtcccaggcgttgttagcggtgtcgaagcagggctcgatggtggtgaggcggtcttggccgtgcgcgtaggagtacttgacgcggcatccggaggagccgagcgtgtgggagaggctgagcttgttggccggatcgaaggtgagggagccgtcgagggcggtgcgggcgggcagcttggcggggcccggggagagggtggtggagtgcgtgtaggtgaggctgacgcggcggtcgagcagcagcgcggagttcatgaattggaagcgcacatcctgcaggaagaggaggaggaggaaatggggatcgattgattgattgatagcgcgcggcgagaggaagaagaagaagaaatagtagtagaaccgtaccttggagtggggcttgaggtcgaggaggaaggagccgggcttctcgagggtgaggatgaggccctcgagggagggcccgcgggcgaaggcggcatcggtggcggaggccttgaagcggaggtcggcggcggagggggtgaaggcgagggtggcggcggccgtggccttgtcgccctcgtacctgcccttcaccgtcgccttcatcctcgcgagctctgatcactttcgcccagtcgccgccgccgcctatcctccttgcgcttctcctctcgttggaatcgtcgccgccgccgtcgtcctcgtattttcttgggtttcccatccacctccaccaaccaaccctcgcccgctgcggctaggctgctagaggaatgtccatgggccaccgttacggcccagaaaaaaaaaacttcatcggccccatatcaaacacaaagcccattaggccccaaacatcaacatatcgcgctctcactttttctcgctcctttttccacggtggcagtagctgagctgtgcctcgtttcctttgccatggaatgcaaggaagaagatgagagcagaagcaatcggagaacagaagaggaagaagacaacataaatcgaaccaacaacaataagaaatatgaagcatcagcagcagctataagcaaaattagatagtcccatcgatacactctctattgcattgcaaacagctactagtacaaatttagactgacgacaacagcagcaaattgctgcatccatcagatcaacacacttgttcacagcaaagcctagcacggttgtgaactcaagtagtactactagctagtggagtagtaattattgttgggtttgcaagcgaggcggcacgaacacacgatcgaacacgatctcatcgattcctgattcatgattgataaattgctgttgcagctggagtaatctggatcaggcgagcgagggggcgatccagacaggctccgcggcgagcgagtggccgccggagatggccaacccatccgcctccccgtcggccagggagtagacgccgatggcgtgcggcgcgatcaactccacctccctccgcgccatgtacacgcagttccccctgatcccggacccctccgtggcccgcgccgccaccgacaccaccgaccccacgaacagcgcctcccccgccgccagctcctccaccgcctcccacttgcgctcctccgccgcgaaccgggacacctccacctccacctccaccgcgtcccgccgcacgctgtactccctctgcaccaccaccagcgaccccgacatgtccaccaccaggtacatacacacccgcccccgcacccgctgctgccc

SEQ ID NO: 56820 - DNA, 11981 bp, Oryza sativa
gccctccccctccgcgtccggctgcagcagcgcgatcgtgcccgaccgccccagcaccgccaccacccatccccgcgtggtgggcggcgccgacagcaccaccttcgccaccgggaacacggggggccgagggatgcccacggattcgccggacgtgacgctgcacagggcgatctcgcggtcgtcgtccaaggccatggcgagccaaccgcccatgtggccgcagcagcgggcggcgctgaggcgggcggggagggcgaaggggaggatctcggcgcggcggaggctgaagaaggcgagaggtccccgggggggcccagggcggcggaggaggaggcgcggggcctcgaaggcgaggtcggaggggaaggaggcacgggcgcaggtgcgccaggaggagcagacgaggcggacggtgacacgctccagggggctcatcagcttcatgattccttccaggagctccggcgggagatccgcccaccccacggacaaatccgcccgccgccggggatccatgtccgccccgccccctgcttctctctcttcccccctcccccttttcttcctctttcttcttcttcttttttaattatttttctgtcaatggccagtttatatttgtccttacacttcctccctaaaataactttgagtacctgtttgaaaaaaaaaacctaaatattttgcggggttcttgaccgttggatcactttgagattcgtgaagtgcccaaccctaaccactcattttctcgctcctcactccgaacgccgccacctctccgcccgatacccctcctccccaacaactaacatacaaatattgttatatgcctcaccaattatagaatacgccaacagtaccagcggggttcatcagacctcaccctccctccctatcctatttctcaagctgatgatggtgaggtgtccccatcccgttgtctttgacgactcctcaccatcaaagacaccactgcctcctagctcgttgtgctctgagctatcaacattggtcgttccaccgcccataaattactatcaagttcttgtattttacaaccatccttctaaaacttgaggaactctctcctctttcttctaccccgcctcaaccttaaccctatatcttaactggactgggcctcctaagatcaaagagctcaccggaatgtgaagaaaatgtcatggtgtacaaatctcagattgaattggatggtccaaaatatgtaagatgggactttgagtttctattgtagggagattaataattttggaaaactattgaccttattactttctctcttttatgttgtccccacggcacacaggacaagatctctctttgggttgtttaatttgattcatggttaaaatttgtcaatccaactacaatagcaaaagtacgagtaataacaaaaagcttgacgcaaatttaattggcatatgaatacgttagctccacgccttgagaaaaatattttctttttttaaaaaaaaatttctgcaacatcatcaagatcactgtttatttcttaaaatatttaatttgtaaataatctataacaataatttgttcaataatctaaatcaaattattgcctaaaaagtatgagtaagcacgatcatggaattcaatcatgcagacacggaaatacatttacatataacatgagacgtggccatattaggcatcaaaccaaacatcctcttatttttggcagccagggaagagacaaggtcatattaaggattaacaaacaatttggttttgtggattcataatgtaatttgatatttgatgagtagcaacgattatgagttgttggaggaagaaaccatgggagaatatatatgtttttattgggaataggatgaaaaggaatgatcggtcatctttggaatatagagagatgtttgatgaaatcaatgggaaattgcttttcctagaaagagtgagatgttcctcgctagggatttcatcttgggaataagttcactttgattcccttaactagtgatcgaatctgattcatatccctgaaccacaattacggatatctcgaccccccaactattaaaaccggtgcaatttaactcccttggcggttttagagggcggttttgctgacgtggtgtctacgtggcaatattgacctggtcttcgtccccattcggcgctgacgtgtcgattaggtggcattagaattaaaaaatatgtttgggggcccatttgtcattaaaaaaatatgtgtgggacccatagacatgtggccccacatctcatgctctctcttcttccttcttcctcccccctctctttctcttccccatcggcgagcgtgggacaggggccgtcggcaggcagtggtggtggcgggcgggagggtgggcgagcgagggtcgggtcccctttgcgagctcgcgacttcgattagacctctttcagtccccgatcaaccaagccaccaccacagtcgagcttctctcctcccagaaatcccaatccacacctcgctggcgcccaatcaccaccactgccgaaaccccccaaatccggtctctgccgatcaccattgcggagctcgagctgtgacttgccgctgcaatccatcccctccgtttcttcccatttctcccctccctctccttcttttccctcttcctcttccacggcagagaggccaggactcggggagggcggcagtggcggatgaggtccgcgcggccctcgcacgctgtgtccagggcgggctcagggtgggagcaccgaaaggcagtgacgaggagtgacctcccccatctcttttgtggtcggggcggctaggctatcagaggcagcgagggagcggaaggcacagaaggacgaaggcggtggctgccgctcttccaaacgacgttctaccactgctgttgccgccgttttgcttctccgactcgatgcttcttcgtcttctccaacgaaggcggctacacgaagccgggaaggttgtgacggcgacaagaggttgggagggcggtgacggcaaagtgggaacaacgccagccgactcctcttttcctcaaggagtcagctccttgttcccgccatggcatcctcgatggcgaccaccctctacgtcaattcggtcgtcgacgatgacgtttagtcgcacagctccgccgccaagctgtgccgctcgtcgccggctaccgccatgaccccatccatccatctgacgccgcgaacacagccgtgtcgttcggcccgaccaccgcgggtgccacacattgagctcatctggggcgggagcggcgacagctggggaatcgagccgctgccatttccgcatctccgtcgcgccttccgtcgtctccgccgctcaccgtcgtctctagccctcgcctcccaccgcgggaaagagagagagtgagaggaaagagagagaagggagcgacgaggagagggaggaggaagatcagagagcatgagatgtggggcccacatgttagtgggtcccacacatatttttgtgaatgacaaataggccccacacataaattttaattctaatgccacctacgcgccgcgttagcaccatgtggaacgaagaacaggtcaataccgccacgtaggcgccatgtcagcgaaaccgccctccaaaaccaccgagggagtcaaattacactgattttaatagttgggggttcgagatatccggtattgtggttgaggggtacgaattagattcggtcactagttaagggagtcaaaatgaactttctcctttcatcttgtggaggaaagcaatatatatggcctagtggatgaaaagatggctcattggcccattgggaagggaaggcaggagcccatacatattccaatttttctgggctgtcagtgcataaggttagtccaataaggaataagtctatttgacccccttagctcttgctcctgattggatcacctccctcaagcgtaataaaccaggtataatgcctcccctttaattaacgtattatagtcatctttggagttatactagcaaatatgcccgtgcgttgcaacgggtgaaaaaacgtaatgataatatacgtttttcatgcataaccacgtcgataacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcgcgtataattcctttttctttagaaacagacaattttttcgcccttttttatcgcgtcaacggagtcggaatcgttttgattttttccctttttttggatcggacagatttttttttgcccggtttatttcgcccgatcgattttttttaccgcgtcacatataattccttttactttggatttttttcgccctttttttaccgcgtcgacggagtcagattcgttttgattttttttctccctttactttggaattttttcgccctgttttcaccacgtcgacggagtcggattcgttttgatttttcccctttttggctttttttggataggacagatttgtttttttttcgccccgtttttttatcggacttttatcttttttttcgcctggtttttttattttttttaccgcgtcacatataattcctttttctttatcggaaagttttttttcgcctttttttaccgcgtcgatggagtcagattcttttcagctttttccttttcttttatcggacaattttttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttctttttttttttgctccacgatacatataattcatttttctttggaataggatagttttctttttatttttttaaactctttttaccgcgtcgatgtagtcggattcgtttcggtattttttccttttttttcctttttttttgtcggacatatttgttttttttccgcccggttttttttcactaggtttttttatcggacttttcttttttttttcgctcggtttttttctcccgttttttgacggacgacagaagcacctagagaagtgttttttttcttttctccaatccaatacagatcggatctcttccagggaaatcagattttttttctccagggaatcggactcttttttttcgctttttttattcattaaacggtttgtctctcggacttttttttcccttttaagggatcgggtgtttttttgccagggacaggtgtttttttcgcccggtttttttttcacttttttttggatcggacttttttttcgtccggtttttatgatcggacaaacttggttttttctgcccggtttttttttcacccggtttttttgacggacgatggaagcacctcttattttttaagtagtatatagtagagtagtagataataaccacaacatcatgcgttcttatatatgggcttgtttgattgcatccatttaaaaatactccctagcaagccaaaattttagcaaagtaagagttttgacaatgttacttcaaagcttttagttagctttgccaacatattggaattatgttcttcttcttcttcttcttcttcttcttcttcttcttcttcttcttcttcttttgttttttgcaacaaaccaaaatgaacaccgaagtcagtcgccattagcatttttttttggtatggtttcatacttttattgagtgttaaatcaaacacacgatatgatatatctcatcactagtctcatttgttttttcgagtataaataattataaatgtttacatggtaaacaaggttttttttcatgaaataatgaatcgtaagagaaataatcaagtgaatgaaagagatgatgaaggagcatgcatgcaggaatcctatgtataggaaggtaggaggacatgcatgcatctttttggttggcagcaggcagaggcaggcatggcattggcatcggcatctagagccgcatggatgatccagatccagtccagagaaagaaaaaaccaaaaggaaaaaggaaggtcaatgccatcctcagctgtgttcaatccgtacctccccggccaccaccggccaaaccaaaacataggccagccacccgcacccacagacccagaccaagcttttgcgtgcgtggtacgggtaaacgacggttactactaaatactattatctttaatttaagaaaactattttgtgtaactaatgggtaattaactgcacaacatatagaaggtatgataatttgtgtgattaactagttttagatgggtacccaacgcgttgtttgcgggagaagtgtgtgataaaatagtatatatgagttgtaaaattttatttcttggttactatatatttttttaccttaatcaattatccaaaggttataaatgattaggttgtatggtgtgacttttggagagaaaatatacaatttgcatttttgatgaatcattcaaaggctaaaaacaattaaggtgatgcatatcataactacacttagggtgagtttgagagataggggattgagaagattggaaagatacgcaaaacgagatgagccattagcgcatgattaattgagtataaactattttaaatttcaaaaatggattaatatgattttttaaaacaactttcctatagaaaatttttgcaaaaaacgcatcgtttagtagtttgggaagcgtgcgcgcggaaaacgagttgttttctcaccctatctcacacaaacgaacacagccttagtgaagatcaactttatagatatatagatttcttacatactatacgattttctattgtgtgcttatatattataccttgatcaaatatccaaaaggttataaatgattgggttgtatagtgtggcttttggggaaaaaagatgcaatttgtacccttgatgaatggtccaaagactaaaaatagttgaagtgatatggcttcatgaaagaggagggaattagaattagcattttctttacagagggaaaaatagtaaccttatctcctcctcctccctcctcattcacgatgtgcttgggatgagaaagcttgtgctgatgccgcgtgctccgcttcccacacaacaccttggccttgccggtgttggtgatgcctactagaccggcctcctcccgcccttccccctttgtccgatgttcttcttctccaaatacaatgatgtgaagcccctaccctgtcggtccttcctcatcgccggtggctcctatcataaccagtctcatttgctgtcgtctttcgatgccaaccctgcctgccaccacctctagccccatggctccgacagtgccaccgctgtcctccattgctcgctggccactacccaccactgctctgaccgtcgccactactgcccctctaagcctagggaaaacccccttcccctctttcttaaccccccctcccaccttaaccaccctcttgaaacctaatccaatccatggcaatcatcaaaagggcatcagagaagaagaagagctcacaattaatcactgaaagaatattgctatcatttttttcaaacgtgcaaaagccttgcacatcgatatattaatagggggaaaggagattttacaaccacgactagctgatgcaggtcatggggggttacaggagagatggcgggcacactagattaactaggaaagacaaccaaattcctgaaaacaaaaaaagagaaagagcttgtatctaaacgccaagaagaacttttaggggactagataacgccacaacccaaagctttccttattgaacgatacgatgaacaccaccatctccaccatgaaaagtatctccttgaaaacacgagcatttcttttcaaccacaagtgccatgtaacaaggaggacaagggagtcgaaccctttcctgttgtaatcccctgcagctgcgggcaagaatactcccaccaaacctggttgctattgcaattatcatcgttgttgattagttaccccttcttccttacccctccctttattcatagcaggtatcggagaagaggaagagcttccaatcactgaaagaactacccctggctgttggatgcccagacaagcgatttcaatcacctaaaggctagcaaaaatacccttagttgcttcctctcatgcatcccaatggccatgcatgggcacaatcacacggctattaaacaatgtggtgcttgctaatgcagtaaagccagctgctggtgcttgttgcacagggccagaaaagcaaagctacagaggccatggatctccgggccatatggtctccactggcagttgctctgaccaaaagccactgttgcatgcatgccaaacacagctaccgcagtactccactgcactgctctgcaggacgacctgacccagatctgaccatgcattgccttgcatatagcagcacatagatccatcatatccagagatgagaccacacgatgagactacacgacgacgctgcctatttcccatccaaaacaaacaaatctagtagatgaaatataatattctctctatttataaaaaatccaattctaaaaattaatctaaaattagaccaataaagtatatatgctagcattatgaatctgaacccatactagttttgattatttttccgcaaacttaaccatctcaagcgtaaccccatactccctccatcttagaatgggtccaattttttatcgtcttctttttatcctaaaattattttgaagtattcactgcatcagaatttgtaaaatagaggataaatatattgataatagaaaaagagagcaataactacattgggattaataaagtgggattcccagactttttaattttatattgatatgcagggcagaagaaaaattaacttattttgagattgagaaagcagggtaagtattttaaaagttatacttgtctctatcagttactcctatctcttaattagtatttaaatttctctgtctattatcgatctgaaccacactgccctcaacaatctctcgatacaataaaacacattatgacttctttttttacattcttgatccaaccatctctcaatggataaaacacattatactttttttacatccttaatctctccaatacaatctagaaatacttacttccatcattttaaaatatacgaattttaattttatgtgttttagaaatatatttgtgaaaagagggagcagtatatatatgaatatatatactgtgttactactactctactcctaattatatcagatccatctatccattacgacggtttaacaattttcagccttaattagacgatcgatgatttggtactgccttccaccattaattccatattgttgagacctttcaaagggattgaaaccaaattaggtgcggaataaattcacatctattttggtgtaaaatgaattaatgttctcaatccaatctaatttctttctctaccggattaactgaaaatagcatagtttcagctcaaattaaccagctatatatatacgtaccattgtgttgttatatttaggtggtgttattttttaaggaagatgaagataagttaggatacgtaaaacaagaaaaatattagcgcctgactaattgagctttaattattataaagcaacttctttgggatccgtacgggaagtacatacgtatcaatttaattataatacgctatacatccgtaaagaaaacttcattctttacaggaatctgcacaagtgataacacgtgtagataaatgtgaaaactttgaggtagtagccagtagactactccatgcggtcgtcaatgcatgcatggatgatctttttgttcaggtgtcacttggtacagtgcacctagcttacctagcacctcgaagctagctaggctttctgttcagttactactacatttagcctcgaaagaaaaatcaacttttatacgctaatttagtgatgtatatgttcaaatttatatacctaaattgatctattttgagacggagggagtaaccattacacctagctaatcttctgttcaatgcgcgtattcctaaccattcattttaatttggtcaaaactattaatcatctttgtgcatcattaattcactgtaaaatacttcatgcaaaatgcaatatatattggagtatttaataaataaccaagctaggaacttaatcaaatttactatatacggctatgtatatactttatatagatatgtacttgtctttcattctagactaaaacgaaataattacgaaaatgaagcctactggtggagattaattgagtgcataattatggagaataatgtgatggtctgaaggagggcaacaatattcttcgttgagagcctgagaatgacattttgacaagtataggtacaactcacctcaccggtcaattatattgcaaccatgcattatactatatggcaccatgcgttgaataattaagctacatgttccacgaaagtgctacacatttgtctgtgaaaagtgaaaacaaccaaatattgacttttagcttagtgctatatatatactatgtgatgttcacattatttcctgatagatagttaaaagtgtgatatatatatatatatatatatatatatatatatatatatatatatatatatatatatatatatatatatatatatatatatatatattgacttttagcttagtgctatatatatactatgtgatgttcacattatttcctgatatatatatataaatatatatatatatatatatatatggttaacagcacgctgtatttgctttcagaattgcaaataacaataaaaaacaactacaattaattataagtaattttcttagtgtacgtaatttattattttcaacataaaaatgttttgtttcctttgatacgctttaggttttgtcatatattgatgctacctatttcaactttgtgcccccaagcatttttagaatcctacgtccaccactaacattactttggtcacagtgcgctttctattggattttattgtgactatgaatttgcagatggttgacactggtgcgcgagtgtggtgtgcgtacggttaaatgtagactatttgaaagaacataaatccatttttcaaaataaaccaagcacctgtttgtagtgctacagtaaactcataaaagggacaaaattgaattttaatgaatgcatggactggcctgctatatattccctccatctacttttgatagtcatatttccaaatctgaaaaatttatttttgataggcatatttcaatccaacaacctatcatcttaatgactttctcagaattaatgtgtgactctctattcttccacacaagattggctgtgtcagggttacgggttaggcataccctttacctttcgatatacgttacatatcggcatggcatacccacgcgcatacggatacttcccgcgtacactaaggaaatccttcacgaagt

SEQ ID NO: 56821 - DNA, 12659 bp, Oryza sativa
caccaacctcagccaagtattccctgcttcaacgatgctggtgtggacccaagttagcgaaatcgtcttcccggtttacaccacgacgccgatctcaaccggtccgccaatgactggaaacgagaacgcagtggctacaaaccaaggcgactccatgtcgaaaaatcctcccgccgaggcggagaacggagtatcgacgacatccgagctcaagaaggattctaatgtggccaaaccttgtcgttccgacatgaaccgcgagccgacgaagatgacttccgaagcgacaaggtcctggtgtcctatccacaaaaccaggaaacacactttgcaagcctgctgggttttcctcaacgtccgcgctgaaatttgcgcctacaaagagcgtggaattcagcgtatttctccaactcgtgctgtctattgtcctattcacaagacaaagaatcacgacctttcaagctgcaaggtcttttccagcgccatggaagcgccatcccctaaggtccaacagtcacacatccccatctgggataaagacaaggaacgaggagcgacgccaacttcagatcgatttgttggggtaatcgatatcgatcctcacgaaccatcagtcttgcaccttcacaagcgcgcctcgggaggtattggctatcgatgatgtcggcatatcagcgtgcaccaatgcagaagcggagaatcaattgaccactccagctcagcacatcagagccgtcaacgctatactgagggaaaccccctacgatcccgttctgaacgacaatctcgcgcgttggacagaacgactacgggaatcagtgaccaacctcagtaacgcgttcgaagaggccgctgccgcagcacacccagagcagccaccaactggcgatgccaacggtgaaaaccctgaacggagggaattgcctcagcgagctacccctccacctcgtggcactggcgatctccgagatcacatcaacggccgccgagaggcacgacgcacatgagacaatgagaatcgttcccgacgtcatgtctcttcacggtgccatgataacgaagatcgaggagaccgctcaaacgaggaccgagaccgtgataaccgccacaaccaccacgatcacaacgatcgcgaacggcgggtgccaaacgatactgatcgaggacgtcgccataacgacgacgatgatggagactggcgccaagacaacagcgggagacgacgacaggattctccagatccaagccgacatcctcgtaatcgtacgccagaaccaaacgacccatcatcatcgtcatcatcctcgtcttcctcatcatcagacagacatccatgaaggacacacgatcgccgacaacccaccgcccccagcgctgggtgtagggctttcagtcgttccctacgtgatgtccgatggcctgagagattccgaccccgagcaatagagaaatacgatgggagcaccgacccagaagagttccttcaagtctactccacagtactctacgctgccggagcagacgacaacgcattggcgaattatttgccaactgcgttaaaaggctccgcacgttcatggctgatgcatcttccgccctactcaatctcttcgtgggcagacctgtggcagcagttcgtcgccaacttccaaggaacctacaagcgccacgcgatcgaagacgacctacacgcgttgacacagaacccgggtgaatccttgagggaatatgttcagcgcttcaacgagtgcagaaatacaatccccaaaatcaccgacgcttctgtaattcgtgccttcaaatccggtgttagagatcgctatactacccaggagttggcgacaagacgcatcacaaccaatcggagattgttcgagattgttgagcgatgcgcccacgcagatgatgcgctaagacgcaagaacgataagccgaagaccgggggagagaagaaatcagccactgacgcacctgagtcaagcaagaagaagaatcgcaaaaatgggaaaaggaaagctcaagcggaagtcctcgcagcagaatacgcgaaccctcccaagcgcccagacccacaaagtagcgacacaaagaaagcatggtgccccatacacaagacggacatacatgttttggaagattgctttgttttcaaaaaatcgctcgagaagcacattgcatctgaaaaaggcaaacgagtacgcgtggtcgaaaaggacgtggaggcggctccccaggaatcagactcagcatatccagaccctgacctccacgtttcacacatcttcggagattccacaacatactcctcgaagcgagagtataagaaagtggaacgcgaagtctgttcgacatggttgggggctgcacccaagatgaagtggtctgaacagaagatagagttctcggaagaagaccaccccaagaccgccgtcattccaggaatatatccgatcgtggtcgaacccactattcggaacatcaaggtcgcacgagtcctcatcgacggtggcagctcaatcaaccttcttttcaccagcactctggacgcgatgggaattccacaaagcgagttgacaccaaccgatcaaccctttcatggaattactccccaatcctcgtccagaccattgggcaagattacgttgcctgtgacttttggccaatccaacaacttccgaacagagcagatcacctttgatgtcgctgaattcgatacagcttacaacgccatcatcgggagaactgcacttgcgaagtttatggccgcatctcactacgcgtatcaagtgctcaagatgccgggaccgaagggaacaatcactattcaagggaacacaaagctggcggtgcaatgcgacaaacggagcctcgacatagttgagcaaacgcccagcccacccgccacgactgagccacccaagaaagtgagcaaaacaaacaagacgccgaaaccggacggcgcaatcaagatcgttccactctccagtgccaaccccgacaagatcgtcgagatcggggcgacactaaccgagaaataggaactcgtactcatcaccttcctccgcgacaatgctgacgtgttcgcttggcagccgtccgacatgtcgggggtccccagggagataattgagcacaaactcatggtgcgacctgatgccaagccagtaaagcaaagactgcggagatttgcaccagaccgaaaacaagccatacgagaagagctcgacaaacttctcaaagctggcttcatcaaagaagtacttcatccagagtggctagccaatccagtcatggtgcggaaggccaacggaaaatggagaatgtgcgtcgacttcaccgacctcaataaggcatgccccaaggatcacttccctcttcctcgaatagatcaactggtggactcaacagccggctgtgagctgttgagctttatcgacgcttactctggctaccaccaaatcagcatggcaaaagaggacgaagagaagacatcattcatcacgccgttcagggtattttgctatgttaagatgccgttcggactgataaccgcaggaaataccttccagcacacggtccagggcgcacttagcgaccagctcggcagcaatgtcgaggcatatgtcgacgacatcgtcgtcaagaccaaaacatttgactcattgattgacgatctgtgggaaacgttcgacaacctccgacgatatcgcctcatgctcaatccagagaagtgcacgttcggagcaccgtcgggaaagctgctcggtttcctcatctctggcagaggaatagaagcaaatcctgagaagatcaaggcaatcgagaacatgaagtcacccacaagactcaaggaagtacagaagctaaccggatgcatggcagcattgagcaggttcgtcgctaagatgggagaacgaggacaacctttcttcgctctgctgaagaagcaagacaaatttgtatggacacaggaagccgaaaaggcattcgttgcactcaagcgctacctatcaaacccccctgtacttgttgccccccaacctaatgaataattattcctctatattgccgccacgccatattccgttagcaccatcatcgttgtcgagagagagaaagtacaacgaccagtctactacgtcagcgaagctctccacgatgcaaagacaagatatccacagatccaaaagctactttacgcggtcatcatgacatcaaggaagctacgccactactttcaagcccacagagtcacagttgtctcctcctttcctctcggtgaagtcgtgagaaacaaatacgttgtcggttgcattgcgaaatgggtagtcgagctgagccagtttgatgtccactttgcgccacgaacagccatcaagtcccaggtactcgccgactttgtagccgattggactatgcctgataacaaatcagacaaccaagtcgataacgaaacgtggacaatggcgttcgatggtgcactcaacagctaaggagcaggggcaggatttatcttgacgtctccttccggagatcaattcaagcacgcaatccacctcaacttcagggcgaccaataacacagccgaatacgagggactactcgccgggataagagctgcagccgcacttggggtcaagcgactaatcgtgaaaggggactccgagctagtcacgaaccaggtgcacaaagattataaatgctctaaccccgagttatctaagtatatcacagaagtcaggaagctagggaaaaggttcgatgggatcgaagtccgacacgtctaccgcaaagacaacatcgagccagatgacctagcacgacgtgcgtccagacgagaaccgctcgagcccggcacttttctggacatcctgacgaagccatcagtgaaagaggttagcggcgaagttagcccggacacccccgacattagctcggaggccacaaaggcagaacgcgccgttgccgatatcgagaccacagacgactggcgcatcccactaatcaaattcatcaacagcgaggagctgcccaaggacgatacagaggccgagaaaataacccgtaaagcaaagatctactgtatggtcggcgacgatctatacaagaaagcgccaaacggggtacttctcaaatgcgtctcgtccgacgacggcagacacctcctccttgatatacatgaaggcatttgtgggtcacacgccgccggtcggacattggtcgggaaagcttttcgacaagggtttttctggccaaccgtccttaaagatgcatgcgacatggtccagcgatgtgaagcctgtcaattccacagtaaacacacaaagctacccgtgcaagcgctccagactatccctcttacgtggccgttctcgtgctgggggctagatatactcggaccattcccacgaggacagggtggctacccacgggggaaatcaaggctgacaacgccatcaaattcatcaaggggatattttgcagatacggactaccgcaccgcatcataaccgacaacggctcccagttcatcagcgctgacttccaggattactgcatcgggctgggagtcaagatatgcttcgctcgttctctcaccctcaaagcaacagacaagtcgagagggcaaacgatatagtactacaagggatcaaaacccgcgtctacgacaggctcatgtcacatgacaaaaaatgggtcgaagaactcccatcagtactatgggtcgtacacaccactccgacgacgtccaactaggaaacacccttcttcctcgtgtacggctcggaggccatactccctagcgagctacgacatcagagtacacgagtacagaagcattccgatgaggaccaggaggagcaacgaaacgtcaatgtaaatctactcgaggaacatcgcgaacgagttgccattcgagcagccagctatcaacaggccctccgccgttaccacgagaagcgcatccgagcacgcatactttcgatcggcgactacgtcctccgacgggttcaaagccaagcagggcgaaacaaactctcacccaaatgggaaggaccttacacgatcacacaagtcttgcggccaggcgcattcaaaattgcagacggcgagggtcgcaagttagcaaattcttggaacattgaccaactacgtaaattctatgtatgagtcaataccatccgtacctgtaagacaccttacagtatcaataaagcctattcttaggcccatattagaatcaaagtgttcccgcccgatgatcccttaccctgatgacacctagcgttgaaacctatccttatgtccctttacgccgtcttgacaaggcctccgaggaacccaagggatcttcggctggggacgcccagagccgataaggccttgtcagatcctgtagagacgaaagaccatgtaagatctggtcatgtaagagttctcgccatgcatattaaccaagccgcgaaatcggaaattaactttccaacttcacggctgggggctaggatcagagcttattcaaccaaggcaggtcaaaggtccaagagccttatcctccgagaaaatccctcagacgacaaggctgggggctagggagagtgtacgactcaaacgactgattaaagtcgtgaactgagaacacactcttacacatgacatccggagtaagaaagatttgttaaagatagatttcttttctattttacaaaatacttcttacagtttttacacaaatccaaagctatattacacctttttcctgagatatctatcacagggtacgaagactaccaagaaggccaacgccaatccatagactggaatatcttctccgccaacggcgccatcgacctcgccaggtggtctatctctgccggagtcctccgagaacgagcaaagccctcacggagaaaatcgaggtccaggcgcgggcgatgatctcgtagacaagccaacacgtgccctccggcatatcggctcgatcgacgacattcctgcttcaaggcctcgtcgatacacttgccgacgccatcaagttgagcacaggctccgttcagccacgagatgtacccagccgcggactcctcgggatccccacgaggtactcgaagctctctacaaaccttggccatggatgtgcagcaactcttcaagtacgagttgaaccacacctcgcgacctcggagcgtttccacagcctgctttttcttcactacaaccatagttctctcgagttccgctacttcaaattttgtcttccaatattggatacgacgatcttggccagcaagagcactctcgagatctgctcagtgtgggaacgactaagtcaggctacacgcctcttccgagaacataggtgatctagtcagaggcgcaaaaagggatgaatggatcactaacctaaggaagtggtcgccatctccgtccccgaggcaagggtttggtctacattgtcgggcgatgcatgttggtcaaacgtgagagccggaataatcgccggtgactcgggttgcccatgctgctggacatcctcgtcatcaacatctctacaagggacaaaaagctttcaagatcaacatgcaagagtaagctagaataataactgctcgcacaaaggcggttaagatccagttttacacagcatatctagggagtacaagaggccccactcttcaaaaagggggagaacagattcccccaggtcaccgacttcttccatcatctccttacgcgtgttgctagccgccccctgatccaagatctcgcgcagatcgagttcaggatgcgccagctttacacacgcaaggacgtggcacgccccggtgtagatcccgttcgatgtctcctccccgatcctagccgcatgcttggaggggatctcctccatcgccgccgccagctccgcaagagaagatgtcaacgagaactcgtcgggattcgccgggatagtagacttaatgccacactccccggcgagctggtgcagaccagtataggtgacccgcaatgagccacggattttcgacagattgttcccaagctctgacatgcggtgctcgagcccctgccgttgtcgctcgttgccggccaccaactccctcatcttcttgaggtcctcacgagcctccgacaactcgtgtgccaatcggtcagcccgcttgtttgccgacgacgccgccgaccttgcctccacaatctcgtgaccgatgccgcgagcaccagcctcgaggaggcgccccatctcaacctagagctcctcccaggtgaggacggtagccggtggaccacggccagccgcgggatcgttgactgggccgcttggtgtcacctcgcggcccccgggtgcgagcatgacatccgacgaggccgcagcgggcgacgtgccggaggtccctccggacttgtcttgcccagccttcgcccgcgccgccctatgagacgggcatggttcagacaacactcgaataaaatcacagaaacttaagttcatcaacttacttctcgccaaccgtcacaaggcgttgtcgtcgtggaggcgggagagacgtgtccgaggcctgaaaaatggtcgatgcgaagtaaggcgaaattcttctggctgtacgatttgacgacaggatagcttaccgagggggttgatgccttgcgacgatgtccgctcacagaggagaacttcctcccctttgtcggaacattgccaccacttgtagtagcagcagcagcatcagacgcctccttggcgaccttctctttcagagacgccgccacctgatggtccgcgagcggctcgatgatgtcagtcagatgaagggcctacgcttaatcaagtcacgatgtgatctcggaaggaaaacgtagaatgcctatcgggtacacttacattgatggcagcatcacgttcagccgcacctttctcacaaaagggaacggggatggtactcgccgttgtcggaccactgatcatcacttggccaacacgacgttccacagctttgctgttcagacctgtgaatcgagaccaaattttgataaatcaagaggaacacgaacatgagcatgtctggataaatgcgagaaagataccccgaggagaaacccgggtcgcatcctccggtccggaataatcaaaggctggatgtgcccgagcctggagcggctggatccgcctaccaacgaagtctgcagcgacttcataccccgacaagcctcgtactcggagatcgtcgataatgtcgataaacgactggagagagggggtcaaagggggctttgcggtccaagacgaaatcttgtccggttgttctttgggaacaacgaagacagggtccgaatctttgatctgaaggtagaaccacctagtccgccatttgttgcgagaagaagggcactggaaggggatataacgcgacttcaggccatcccgaagtcggaacccgacgcaaccagacaccctgttggactccatccaacgcagctcgtagtagaagcgaaagagatcaagaaagggctctaccccaatgtaggcctcacaaagatgagaaaagatgctaaggaaggcgatagagttggggttcaaatggagaagagaaagaccgtagaagttcaaaaccaagagaagaaattcggaaggcacaaggagaaaaccgcagagaatatagtcttcgatcgcaaccatgcgacctaagacgggctggggattagtacctcctgcttccctttccatggttccgcgaccaggaagggcgccgtcttcctgaagcttcttcagtgacacactggtggaggatgatttgccgagatccatcgttgatcggagatcgccagagaaagggctcaggtcgatgaactagggtttcttgtggcagcggagaagacgaagagcgcttacaggcgggatgttttcttcacaataggcggacttcaaaatggatccccaaaattcctttaaatagacacacttccgacggtacgacttccaaggaaaggggagagatgcccgccggagatttctggatccgttacgcgcggcagttttttggacttcagtttaaattcactcgtgaccgttgggcttcacacggtgttctcgactacgtcctgtctctatggtcctcacaccgggaacgacaacagtctcgacacaacaagtcgcgaatggttacacgagttcatttaagcagaagtcgggggctactgtcagggttatgggttaggcataccctttacccttcgatatatgttacatatcggcatggcatacccacgcgcatacggatacttcccgcgtacactaaggaaatcattcacgaagtctacggatgggaagagtcttactcggacaagactgggtcatcaatgtatcgtatagggtctgttatctccgagttctacttggaaaccgcctgacctgcgatataaaagggaccccccagggaggacctggggcatcgaatctcagagccaacacgaccctcacagcctacgaagtcggagcccgcaaggagccaagtcgccggggatctagtcgaaccaactcgaccacgatctcgccggatccgtcaagttccattgttccctttgtaacttgtgttttccactatataatcccacatcaactagattatggctattacctaccaaggggtctgaaccagtataatcctcgtcttttgtctgcttgatgtcgtattacgtagattcttgtaccaacgtaccccaataccctctatatccggtctacgggtaccacccgttgacaggctgcatgtgcatcgagaaatgtaaatattaatgaatcgcttgtttacgaggaatgactagtggcatgtttaaatggatgataagtagaattacttatccttggtctatgtgccaagatgaaatatgactatcaaaagtagatagagggagtatttaattgatagtactgtgtacatataggagtttatctttttgaggggcaaggcaaaaaagggtaggatgtagagtttgatcggccaaccggcctatttaaccagtctcgttatcatggagacaacaggcactttacgctgttgctgcgcacttgatcgatatgcatttatagtttgtactcactatcttttagaacttaatatatataaatgtgtcatattatcatccactaataattatgattagagtattttaaatttcatagaaacatggcatatcattcataattttgttgtacttttaaacctcagtatataagcaatgtcaaatcatcatctccacatcatttttacattatttaaatacatacatttatcatttctataatatataacctatatttatccatatatcgtaacaagtgcgaggtatcaactagtaatttttcaacttcttgtgtcgatcaagcgagcaagtgataaattaaagagggtggaccagcatgcatatatttatataaataggaactagcatttatatttcgatgttaatgcatagcaacacagttagactggatagacattaggtaaagtcttcaaattaatgtaactttcactaaaaaaatgattttccatggcaatttcctttcatttttttcagatggactaaaaatagtcttgacagtgaaaaacacgttcacttttactagcggacgacataagcatcggctagtgaaaatcgatttttactggcgtgcgtttaagacgtccgtttgtgaaaatcaattttagaaaaatatgcatttgtacctaactttttcctaaaaagtcaaatgaaaataaaatttataccaaacttgtagatctagtattcgttataagattcaagatctattttacaacatttcagatatatgatttaaataacctttgatggacacatgatctgtaccaaagttatagagctctacgaaatctacaactttgtagttcatgaatttttttatttgaaatcatttagagagacaaataagtattttaagtttcgaacaatgaaaatcaaaacaatagcattctgaataagtgcttcatggtgagatggtaatgtaatacatatgcgtagagagaggtctttgagtttgaatcctatacaaaccacatacctgcgaatttaatctgaaaagttgcctaaattatcaattaggatgcttagttgtgttatatgcctagtaaaaatcaaaatattttttgattttatttttgctgattttcactagatgtcggatgcagtcagtaaagatcgttgatttggactaacttctaattgcttgctgaacgtctagccgctaggaaatataggttttagccgccagaaaaaaatgttttttatagtgtctgacccataatactctctccatctcattttaacctcagccatggttttccgcgcccaaatttgatcgtccgtcttatttaaattttttttaaaaaaattaaaaacataagtcacgagaaaagtaatattcatgtttttatcatctcataaaaaatattaattataaaaaattttcaaataagatggacgatcaaagttggacacgaaaactcatgattgcacttaaagcaaggttaatagtatagccaactactagctccaaatcatctatagccaatttaatagctaattcatacaatagttgcttactatactattaatacctggtcccatctgtcatacacgta

SEQ ID NO: 56822 - DNA, 6167 bp, Oryza sativa
aaatagatttttactcccggttttttcacccacaatctttagtcccggattgatagtcccggtttgaaaaccgggactacaggggggttacgaaccgggagtaaagccccgttctccaccagtgtaagccaaccctagaaactacaaaccaccataaaaccaagcaaagcaaaaaattaaaccaccacattaaagcattttcttcatcttatttttcaccagactaattcattcatttttctcatgtgcaaagtatgaaaacttgcagcagatggaatataactacctcccaaattaagtactactaatggggactgcatgcagttcatatatgtacatattagtagctagaatatgcccgtattttgttacggattaaaaagagaatcatatggtacggtattacatattcacgtgggaaaaatatatagacgatatacaataatatatccacttctctatctagttgaatcaagctgtttctagtagtcttcttattgtagagtacatttgagaacctgcatgtcattgataggggcggtggttgccaccatgcaccattgccttcttttaaagtggtataggtatttcaaatatccgaacatgaaagcacaaatatatgtacacgtttttttttaactaattaacctcccatgcgagattttgtgcagaaagaactagatttaaaagtagaacgtactgtatttaatatacatctctatctgtttacatgtatacatctataactatcttgatcgatctatcccgttataatctaatctagacctagagacggagacggagacggcgaaggggccaactcggcctccccttgtcttcaaattttacattgaattttatagctagctcgaggaaattttgaagaaaaaaactaacactattgccccctccaacatagattttttagtgtttccagcccacttagcatgacaaccaaatgatgcaaattaatatagatccttttatcctatcaatgtgataatttttaagccatccagaaaaagatgtggtacgtgactcctttttgccatctatctcttcttaatatagcacgcatgtactaatgacataaattagctaatatattgcacatatatatggatcagtcgatacaggataccaatcaaaagcatctagagggatatggatattttatttatcttcttgtaaatacagtatacctcagcgtgatacatataagcgtaagtacacgcctatatctctgacaatctttaatttggtcactaataatcgcacaggcgaccatcatatcatatatatgtaaattttgcatagtcatgatgtattaattgtacgtgctagaattcaatttcctctgatctcctctctcgaatattgaagttctgatatatatatatataggtactgcatggtttaattattagaacttgtgccactgatgatcatagctgcttacccctggcctgctggtggtggagtacacctgcatgtttgcattgatcatagtaggattatcaggctccaactcctccagctctgcaaagacctcatcagctgctgaaggttggatgccaagtccagcgccggcgccctccgtcgtcatcatcatgttggcctgttggccaccgagcacgacgtcggcgtagagattgaatggggaggaggaagaagacgatgagcttgtgatcagtgcaggctgcagctggttggtctgctgctgctgctgttgcttgtggcggctgctggaggcagtagcatgagtactgtgatgagaacgggcatatccggcgagcacattacgttgcatcggccatgggtggttgtgctccgccgcgtaggtgatcaccagcatgttggggtcgctgcggctgcgctccacctgcttcctcgccatacatccctttgagctgctgcatctgtagtaacccctgcatcatcaccgcccacaaaatcaactcatcagtgaattattattttttaattaatttcctgatcaaccgcatatatataaaattattgtgcctagatatatatatacccttagaatgcagtgtatgaatggtttgatcaaatttgaagatggcacagtaatgtcaaactgagtccactaagccagaataattgttaattcatcgagaaatttaattaattgtgagtaaattaagcttatcgatccctgtacttgaagtttcatttttaccttttaaattaatttgaaaacggcaaacatagctattttgttccaatttttgcctcaaaagtaaaagcaacttaatttgtggcagtcttgcaatatctactatttcaacaattaataatgtttgatttacgcaatttgcaattgggagtattagtttctcacaaatgacactacattgggtcataattgtgatgaatcacttattagatccccatgtatatatggaagaattcattgatgatagatttacattttagggattgcttgggcataggtgtatatataaccttcagacggtacaatgttgaaactccgacacaatctgaagtgattatatacgtttgattaatccatacatatccatccaaacccttattaggtcgttcaagtgccattggaagtttgaaacccaacactacacaaataattaatcaataatagacaagcatattgtctattatgatgctgtcgaattatttttctaaaagaaatgttttgtatacttgatttggatcattggagatttggtatattaaatgtgtattgtgcagtaaattaattttgggttctattcacgttggttggctttggctgataagttatacaaaagtaaacgaagcaaccgaaaataattttaggttaggccttttatatactatttataccattagtggtaaaaagccaaggttggaaataagtttaaaataaaaaaggaggataatttaaaattaactttaaaataaatgagtaaatgaccttttatcaccaaagtttcactttgaactaccctttaaaacatcttttctctttggactagattagtttgcctttgtttcactttgaaccatcccaaaaacttttctcgagcacataaatgactttaaccacatcaacacccataaaccgctaacttcctggctcacatgtagactattattcacaagattagagggtagatgcactagaaaagtgacttggggtggtccaaactgcaacaaagataatcttacctagtctaaagtgaaaatattagctagagggtagcccaaaaagtgaaactttggtaataaaagatggaccaaagtgcaattaactcaatttaaattgtgtcaatgacttataagccaacaagcaaataatggggaacttcatgtaatctagctaagtaataaacccaaagttgtggcttactaacaaaaaatgttgtttgaattgaaaattggggggggggggggggtgtacagatatatatgtacttccttattccatatgtaagccatttaaaacttatgtgcaagaattaaaaaaaaatagctcaagcgacttttgttaccctttatttatattgttttggaaaatattggtagtttatttatgagaaaaatataatttatttggcaagagaaaccataaatataagtttttttacaccgaaaccataaatataagttgaaattaaaagatgcctgcaaattttgaaacaacatacttttagagtttaaaaaaggctaagatggcttacacttggactcataggggatcagtatatatatatttcaaaagttgtttaattatgacaaaccaattgaaattgtctaaacaagaaatatggaagctgcttgttttttagttaattagcttataaaaaaggatggccatgattttgatgcttttgcccagagatacagtacctgcagagatatgagcaataaatattaatgaacttacataatataaaatgaatataattaatacctagagggaacataatataactaagcagtaagcacacaataggaatgaacgaaacatatatatctgatgagatatctcttgattccaataaacttcgtataaattggatcggtcattaagtataaaaatatttatgcagaaagtgattaattgtttatcaagaatgggaggaataggaatgattgaaagatatttgatgagatcttgatgcaaataaacttcatgtatgaatcgggtcattaggtacaagatatatatgaacagatcgattaagtgagcgcgtgttaaaaaaaaaaagaggggaagaaacagatgaaaatgtggccggtttaccgtggataaggagagcctttgatgggtttctggccgtacttcctccatgcccatagatcagacgggatcacctctcctccacctccacggctactcgtcgctggcggcgccgggatgcacaccactttcttcacctcattcttcctgtagtatatatgccaaaggatgcaagcaagtaattaattaattgcttgaaaataaactaacactaaatagttaagacttttgattaattggaaatcgattgatgtaagtattcctcgctcattagagaaacgtgaaaagcaaattaggaggaactgaagtcaagtatgatttagttccaaacctgtcaaagagttatgtgtacatgtacagttgctagatatgagcattaatactgaaaacggccatatgcgaggagtaaaactctgagaagagtaagatcgagttaatattaatttggcgatatgggtagggggtgcaagcatcaaatgccaatccatgaaatcctgctagcttgcttaaaggtgatgaagtcagaattaatgacgactcatatatatataatctgtcagtatatgtaatggatcgaaaggaatgctgaaaatgagagccaaagatatctgcacacacacacatgcatgaactaataaaaagatcaaagtgataaaaagaagcggtaacacaaagccgggatcgatcagagggatgcaaatcatcaattgaaggaaggaccaagatgtgtatacattaaggaagaagaggagtgatcgaaatatgaatccaattaattagagaactaattaataatgttaagagctagctagcatgccaaaccttttcatcatttgatgatgagcagacggcgtcagtggcgagatcctgatggcttcttctccatcatcggcagcgcctgcgcctccgccgcccatcaccacgtcgccgccgccacagagggcgtgctgggagatctggagagcaagcggccgcggcatcccgtagccggcgtcgccgggtgtgaggtggtggtatgagtcgacgaccgtggatggcggccccgccgtctcgaacggcacaggtgcgtcggtgtaagcgatggtggtagggcgccgaagctctccgtggtggtggtggtggtaagggatggtgatctggggggcgggatagtattggtgaggcgcctgaggcatgggaggaggaggaagaggatgcagaggtgaggggtgatggtgaggggtggagacgaggaatgcgcgtgcattggcacgggccacgacgtcggcgaggtcgccagcagcagcagcttgagcagtggcggcgttggcagcctcctcctccatcatatccatagtggcgtgctcgctctttctagtttctgtctgatgcttaattagctgctgctgctgttgctgctgcctattcagtattcactagtagctagtactggtacacacactcccactcccgtccagccttgcctgcaggagcactagtagtgcacgcactcacagtgctactggccggctactaccagctcgattgatctctgaatctctctctttttctctctctcacatgcatgcatgatagcatatgagcatgagagagcagagagttcgattgctcgatcgatgatcggtatgtatatgagtgggatgcatgcagagtcagatcgatcgatactagatatcgagaacgatcgaggtagcaaaggaaaggaagatatatagctgctaggtggcaaacgcgtcgtgttttgagtcggtcgtcgcagagaccatggatcgatcagctgatagtatttatttggccaccacacaagctacaagctacagcgcgaagcaactgttcgccccacacaccaactgtagatggatgcatccccccccccccc

SEQ ID NO: 56823 - DNA, 28754 bp, Oryza sativa
atcaatttcatagtagttgaaaaaccttgttttttataataaccttaaataataaaatacattaaatacaatagatatcattgggactaattaagagaatcactacaaaagttttcctaaacttatgtcatgaaaagtatactgaatatgccagactatatatataagtccaaataagcactgaacatatatgcacagagaaaggaccgttctcaatatattgattactgtaagtctctagtgtcactagcctaaccaattaaagatgagtatgcacaggtgcatttttggctttaatttactagcattattgttgtgccactttctctttagttttagtgaatttaacatgtagtacgtgcactcaatcagaattttacaacatgctttagtcgcgctaattaacctgtactgacattccgtcacaaaaacattgacttgctagaataactatagggcatgcatgcatgtggttttttttatatataaaaaatggtatgcatgatttacttgcatttgttattattagtgttgtcctagtatattgttggtacaatatggtcggacccattaactggcgagggcgtgcggaaggtctcaaccctgcaggttattagcatgcattattattggcatccaatgatatctacaatcttcacatatgatctttacacggttagaaaattattttttttgcacaatttttgctgtcgattgattagatgagataaaaactacaccagaaaattatgatccattgatgagcttactgaagctaaggatgcattgtatgtcaaaattactgaaggatatgactacttgattctacataccatggttttgatcctagttttatttaaaattaaaactaatagctcctttgtactgaattaagtaattttggaagaaaagcagaggaactcaatccaaaggaaaaaaaatcctatgtgcacacgtttggtttgtaggactgcattaaagtaattaatactccagattttggcggaattctagcatgaagtctaactttaggtttgcaaattcctttcggacttccgatgcattctctctctttctctctgcattatttctctaccaaatcaaaatgtgaacttaattaaatatgatgtgtttttcttgtggtacattcaaacatttcggtagtattgttttctatagaatttatcatggtgtgagttgtgacattttaattccgtgttttcctattcttgtactttaagaatctagtttgcgtttcaaatgagctctaaaatagttatgtgtaggtttagttgatgcagacaacatcatgtactagtagcaacgagcaagttaattttttctttgtgatttagggaattaattaattactccatatgtttcatatcgtaagactttctagcattgtccacatttatatagatgttaataaatctagacacatggacaatcctataaaatcttacattgtgaaaacggatggaggaactactccctccttccctaaatgtttgacaccgttaacttttttaaatatgtttgaccattcgttttattcaaaaacttttgtgatatgtgtgaaactatatgtatacataaaagtatatttaacaataaatcaaatgatagaaaaagaattaacaattacttaaattttttgaataagacgaacggtcaaacatttttaaaaaagtcaatggcattaaatattttggaatggaggtagtaattaatagtgcggtcaacgagtggtaagttactatatcaggctggctcgatctggatcgcatgcatggacaccaagtcactgtgacatgatccatcgagctagctagctgatgtgatggatcaagcgacaaagcaactttggacggtaggagagggtacgcacgtacgttcaatttgattaatttattagccgataaatatttttctttgtattttttttatatttttctttatatatagggagagagatatatatatagagatcgatatcttaccacaatgcatgcatgatactatcttatattatatcttgatcgatcagcagctagctggtccatccattggtccacaactccacacacacatatcgatctcaatatcttttatctctctctttaatttctagttattactgtgcgcttggctgcacacatagcagcatgcagcaggcagcttttcttacacttcccacaaaagcaaacaaaatcccagagcatcctactgtgcccatcccagggaaatgtacgtactgtgccagagccacacttccacattattctcgatctctacaatgaaatgcttctcaatttaaagccgatcgattgattggaattttttaccttcttgaagcgcttgttagtttgattgaattaatcattattccgaggaacacgggttagtaacgacgagaagcacggtggtccacgttaggtgagcacaattaatgacttttcaagtccttgggtgtgctgtcataactgctttattggtaaggagtgttgctattttctttttacagaacacttgttcatgtagttgtgcgattagctctaagtccctatcctatctcgatgagtctctagctagttcacattatgcgttggcatgcttccttaaagcctagtcataatttcgatttctcacgtggctctcttatattaaggtagaacgaaatttctgaacgatatattaacccacataaattaataaataaggaaacatgtcctactaaataactcgttgaagtaatttcaagcagatgcatgctagcaaattaactcaggcaaattgtgttgcatggctgtagctagattgagggaagtagctagctatagctagcctacaacatatatatcgtcttagcttgcctcgtcttggcggcaccaagattcaattcaacggcagctcaggaaaatgggccaggcaccaatagttccactgaaggatgtgcagtgtggacctaattacctaaccttgctgtagttaagttgcaaaagcacattcactgattgatgagcttggatctttagctaaggtacctggagttgtgtgtgttgagaatatagaaatataatgatttaatatattccataaataaatcatgacattacagatgtatactagcattaatgtatcattagatttacacatgtaaactaagcagtaaaacatgaacagatcaaatatacgcaacatgtcgaacacgtaccgaggtggcggaaagaccggttgctcggcaggaactactcgcggttgcgagcgtcgacgaaggcgcgcagcacgcgagcggagaggaaggcgagccgtcgtggacgaacagtgagcagtcgcgcgaagcgcttcccaaaaaccttattgccgccttctcccggtgcaggacgtcgaaggcagaggttcctgagacctgctctcccgatcgcaggtgcacgccagcgagcggggtggagtagtctacgagcgacggcgcagcacagaggaggaggcaaaccctagattgatttcgtgtgttttgcgtgaaggcggcggctcagtttatatagagataggtcgcttgatcagggcgcccgcacgatctccactccgcgtaaccgaaccggataagtcgcgcgtaacttatccggactccacgccgttttcacgcagcggatttttcggaatgtttccaaaacaaaacaaatccgaattttcctacagcaaaacaaaactgcaaaaggaggctgcatctgtgcaagggtgaggagccaattttgcggaccattcgacgcgtatgtcgtgcacgcgcgccgcctgccctgcccctgccctaccaggccaggtgaggcgaggcgaggcgagcgagcgcgtgttccccctcttctctccaccacacatgcttcaagaagctaggagggcatcctcccttttaaggaggtccccctctcctagaataagcaaggtggtactaaactccacatgcatgccatcccatgaggtgggcttttgtgatttttcaaagaattaatcttcgaatgggccttagcccatctattaattctaacaatcccccaccaaatctcaaaatcccactaagatttgccttttccaatgtacttttatataccagcggttcgatggagaccgatcaaggttgaacatccacctagaactccaagctacacttactcacaacttgaacaatggactacgtcttgaattacaagtcttatgcaagcaagtttcactcagagtcttatctggtactagaccgtctgtagactacccctcgggtggagcgtataagtcatactcctaggtctttaataagcttcctaaaagattcacccaaaatcttcatagactgcgaccaacagtcaagcttacaaaggtgagttctttcaagaatgctctgcaagacagcatcttcgctaattaaagccaacagaactcattaaggcatagccaacctgccttccagctcatgagagtacatgcatcttcacttagaggaccaacacatgtcttttctgcacactttgtcctcactcgtgtgcacccgggaaattcttcccggtcggtcacccatcccaaattgctccaggccaagcacgcttaaccctggagttctttggagattggcttccggaaaagaagttgcaacttgttgatatgagtattctattaatcctattaagccctaggaaaagaagttgcaacttgttgatatgagtattctattaatcctattaagccctaggccgggatgttacaccctcacccccttaagagagatcgacgcccccgtcgatcaaccctaggctaggaacgtcctctcttggccacgtccatgtgtccagtgccagcgcagcacgcttaaccctggagttctttggagattggcttccggaaaagaagttgcaacttgttgatatgagtattctattaatcctattaagccctaggccgggatgttacatatagattggtactctcctctagtttactaatggtttgttcttcccaggttctaattcacgggatttccgatcacatagactgggttaccaccatagtataactcacatgggtctcaaacccatctccttcgatgcattatctatcatatttcgtgatagtcccttcgtgaaaggatctgctaggtttctagctgtttggatgtaatccaacgctataactccagagtttctcaatttactgacagacttcaatcgtcttttcacatgtctagacgatttcatattatccttagaactattcactttgacaattaccgtttgattgtcacagttcataagtgacggagctcgtggcccctcaccgggagaccgcgcaggcccccctttgccggttcggccgggggcttagggtgagatctcaagctctctctgtatgtggaaagatcgcttgctaggaagaaacgcgagacacggcgatctatacaggttcgggccgctgcgaagcgtaataccctactcctgtgtttttgtggatttgtgtatggacaagttacaaaggattaactccctttcccctcagccttccaaaagggaaaaagtccccctctaaatgggcaaggtcctccttttatatctcaaggggataccacatgcacctttctctttccaaactggactgttctttttctctttaatgggcggagatcggtacggtttccatccgggagcccttctgatgggacaacccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacaccctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtccctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcacacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttctcaatcatctcttcctccaccgccatggcacggggctctgctctgctcgacggcagtgtactaccgccttcccgcatcgtgagcgagaggcacgccggactgccacgccgcttcatgccggagtccgccaccggtcgggagatagtgatgctgggcgaggggcgcccggcaccagactacccggggcggtccatcttcttcctccccttcgcaatggctgggctggtcccgccattttcttctttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctccgtggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagttgggaggaacacctcccccatctcctccccgagggggcggggcggcgcgtgccagcagtcggcgcccggagggggccgcgccgacgtcgcagcccgagggggagcgcaaaaagaaacggcttcgcaagacgggggagacggaaccatgccggggaaacctgatttcccctccaaggtggtcattcaaccgaccccctcgcaggttcgtctcactctcattgcaaccatctttctcccaaaaggaagctttttcttactcattttgttcgtcttctggttttttcttctgcttcagcgatgtcccgtcgcattcctcccgccaccccaagtccggccagtccgaggccgaagatcctgcggccgcggaggagcggaggcgagaatctgaccggcgtgaagccgcagaccgccttcgggaagctgaagaggccgcccgggaggccgcccggattcgccaagcggaggaagctgctcgggaggaggccgcccgggctgaggaagccgctaaggaggaggccgcccgggctcgccaggctgaggcaacagctgctgctggcgcgtcaactgggcccactccttcgggcaaccctcaggcgacagcctccggggaggctcgcgacgaggccgcgggcacatcgcctgggcccacctccccgggcgacgcccaggatcaaacgggtccgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctagatgggttcagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcggagcttgaagcccggaaggcggcgctgacggagatcgctcgtgaggtggaggaggagcgagcggccgccctcatcgctaccaccacgatgattgaggcgcaagacgccctccgccttcaaaacgccagccgggaggcggagctgaaagaaaagctcgacgccgcccagggagtccttgactccaccgctgcccgagagcggcgggtaacagaggctgaggcggcgtcccggcggcgcgaggagtcccttgaggcccgtgctatggcgctggaagaacacgccggcgccgtggagaaaggcttgacggaccgcgaggccgccgctgctctccgggaggcgacgctggcggcgcacgaggccgcctgcgccgaggaggagtgcgcgctccgcctccgcgaggacgcactcgctgagcgggagcgagctctcgaggaggctgaggccacgaccaaatggctggcggacagcctgtcccttcgcgaggtggcgcaggaggagcaggcgcgccgcaatcttgaatgcgtccgcgccgagagagccgcactggaacagcgggctgctgacctcgaggctcgggaaaaggagctggacgcgagggcgcatatcggtggggcggccgcaggcgaaagcgacttagccgcccgcctcgcagctgccgaacacaccgtcgccgatatgcagcgagcgctggactcctccaccggggaggccgaggcccttcgcttggcgggcgagattgggcccggcatgctttgggatgcggtctcccgcctgaagcgcgccggtcggcaagcgggcctctggaaaggccagacgacggtgccccccaccaatctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatggcgctggaggagttcccccccgggaccgaggacgatgcgcgcgcgcgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcgcgttggaatgagcccccaggcccccgccaatctccaattttttctttttctttcttctttttgtatagatcaacttaatctgcaatcaaaaatgatgaaaaatttcttatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggtaaggttgagcacgagtgaccttatttcaagttaagattcttcagaaggaaaaacggcacagacacaacctttaggaaattgaaactgcttttattgaaatgctgaaataagaaaagtaaggctgtgcatgtgtggtagcccccggctaaccctgcacacccgaggggggtgcggggttagcccgagcccgaaacctgacacccgatcccccccgtcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttctaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgaccgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccaacacgtagcgtttggaaatgcgttgtacgcgttcactcccttcgcagtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgtacttggcgtacgtaggcgtccatctgtgggtcagagcaccggtactccttacagacttggttaacaaccagctgagagtcgcctaacaccaggaggcggcggatccccagcccggctgccactctgagtccggcaaggagtccctcgtactctgccatattattggtcgctcgaaagtcgaggcggaccaggtatctgaggacgtctccgtttggagaggtcaacgtgacccccgcaccagcgccctggagagacagagaaccgtcgaactgcatcacccagtgggtggtgcgaggcagctgagaggggtccgtgctggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgaccctctttgctaggggccgcatccccggggcattcttcgtccaagtggcctctcggggcgcactcgccttctgtgccgatgtcctcggggtcggaggatgacaggagcggccttcccacagtggcctcggggccgtcctgggggtcgggggctcctggcgtcgtcggacaagcgggtaaagggcctactccggtcgtcaggggcctcaggcctccgttcggctcgggggcctcttctccctgctttctcccgggtcgagtcagcacagggttagcctcggggccaaagggcgataggtgcggccttcccgcagtggcctcggggccttcctgagggtcgggggcatccagcaccgtctgacaagcgggcagagggccgactccggtcgtcaggggccttaggccaccgttcgactcgggggcttctcctccctgctcgctcccgggccaagtcagcacagggcgggggtgcgcgaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtaagggcatgctcagcttcctccgtccaagtaaacggccccgagcgcttgaggagcttaaacaagggtagcgccttctctcccagccttgatatgaaacgacttagggcggccatgcaaccggcgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgccagatctgaaagtaaagtttcttggttgcgcgtttttacaaccaaatcatcaacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccacgcgaatctgatggtaaccagagtatgcgtctagaaaacacaaaaggtcgcaccccgcagtggagtcgacgatctgatctatgcgaggcaaggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcgaaagtgagggcaacctccgaccaccgcgcctggcgcgtcgcctcatgagtaggggccgcggccagaagctctcgcctcatggccttaaaactccggcgagaaacgtgagcacacgctcccccgtcgacagtggcaatggtggccccgggttcctggaaacctaggtcatcatcaccgtcatcaatgtcaacggcgggggccttctgtttggcctcacttcgccgtttaccggagggaactgccgcggacttgccctcacggcgttcctgcctcctgtcctcctcccacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccctttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttatgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataagtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctggtccttacgtccatgtggaggtgacactctggacgaggaggcgccctccgttgcacggggagtacgccggccgttacgccggcgctcgatgttgaggcgggcatccggctccccatgctgatcctcccgagtcgaaggcgtcgacgagggagtggcagccgaatgacgtgcagccgccgccgctcgccgcgccctccgccttgatgacacggaaccggtggtggcggcgccggaggtcttggtggtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctggagcgcgccctgaggcgtgctgccgtcaccgtagacgaggaggcgacgctccccatctcgccgttctcctgcaccacccgcgactagcgatgctgcggatttttcgactctctcgagtgcctccccctgcttaggattttggtgtggaggaggtgggggagtacgagctcgacggcgtgggtttggctccccgtcgtcgccgctcacactcggagagaggtcgtgcgcctttgcttgctcggccattaggcagaacaagggaaacttggcgcacacggaagagtatgagagctcagaaaacacacgctgagccccctacctggcgcgccagatgacggagctcgtggcccctcaccgggagaccgcgcaggcccccctttgccggttcggccgggggcttagggtgagatctcaagctctctctgtatgtggaaagatcgcttgctaggaagaaacgcgagacacggcgatctatacaggttcgggccgctgcgaagcgtaataccctactcctgtgtttttgtggatttgtgtatggacaagttacaaaggattaactccctttcccctcagccttccaaaagggaaaaagtccccctctaaatgggcaaggtcctccttttatatctcaaggggataccacatgcacctttctctttccaaactggactgttctttttctctttaatgggcggagatcggtacggtttccatccgggagcccttctgatgggacaacccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacaccctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtccctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaataaggatagccggcactggtttttcaacaataagcagatccattaatagatcacgcagccattctgcctcaacagtagcagtatccagtgccgtcagttctgcttccatggttgacctcgtcaaaatagtctgtttgcaagacctccacgaaacagtaccaccacccagtgtgaagacatatccactagtggctttgatctcatccacatcagagatccagttagaatcactatatccctccagtactgcaggatacccagaatagtgaagccccaattccatagtacatttcagataacgcattactcgctcaagcgcatgccagtgatcatctcccggattagaggtaaaccggctcaacttgctcacagcaaaggagatatcaggcctagttgcactagccaggtacatcagcgagccaatgatttgggagtattccagttgattcctaataattctcttgttcttgcgaagcaacaagctaggatcataaggtgttggagaaggcttactatcaatgtagccaaaacgattcaagatcttctccacataatgggactgcaagagtgtaatcccattctcacctctaattagcttaatgtccatttgataaacaagaagaccatgtgaggctgctagggaaagtagcacacgaattgtggtcaatctagcaacaggtgagtaagtgtcaaagaaatcttcaccttctttctgagtataacccttagcaacaagccgagccttgtacttttcaatagtaccgtcaggcctgagcttcttcttgaacacccacttgcaccccacaggtttacacccatagggtcgctctgtcacctcctaagtcccgttagcgataatggaatccatttcactacggacagcctccttccagtagtctgcatcaggagatgcttatgcttctgaaattgacttaggagtgtcatccacgaggtacacagtgaaatcatcaccaaaaatacttaaccgtcctttgtcttttgctccttcgaggagcttcactgtcatcctccttagtaaaatgttcatgtgtatgttcagtttgttctggtggtgtgattgaactgggaattatttcagagggttggctagagctactatgtgtatccttcattgggaaaaagctctcaaagaaggtaacatcacgagactccataattgtaccaacatgcatgtcaggtacctcagatttaactattaaaaatctataggcaatgctgtggtgagcatatcccagaaagacacagtccacagtcttaggtccaagtttgcgcttcttcgttattggtacattgactttcgccaagcacccccatgtgcgcaagtaagaaagtgatggttttctcccaatccatatctcatatggtgttttgtccttatttctattaggaactctgtttaacacatgattcgaggtcaacaatgcctcccccaccatgccttaggtaatcccgcggtgtccaacatggcattcaccaagtcggtcagtgtgcggttcttccttttagcaaccccattagactagggagaatagggaggcgtcctctcatgtataatgccatgttcctcacagaataagtcaaactcgtttgagaaaaaactctccaccacgatcagacctaagtctttttatctttctgtcaagttgattttcaacttctgccttacaaattttaaaatagtatagagcctcgtctttcgttttcaacaagtacacatagcaaaatctagtagcatcatcaatcaacgtcatgaaatatcgttttctacccttcgtcaacaccccattcatttcatagagatctgagtgtaggagttctagaggtgccaagtttctctcctcagcagccttgtgaggcttgcgaggttgctttgattgcacacaactatggcacttagaacctttgacaatggaaaacttaggaattaaacacatgctggaaagccgagacatcaagccaaaattaatatgacataaacgtgagtgccatacattagcctcatcatccacactgccacaaatatggttcacagacttattgcagaaatcagaaagggaaaagcggaacagacctccgcactcataacctttaccaataaaatatccatgttaaaacacgactactttattagactcaaaaaccaacttaaatccgtctctagtcagacgggagccactaacaagattcttgtcgatagaagggacatgctgcacattcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggcccctgtatcaacccaccaattagtagactgattaactgaaaaaacagtaggtaaattaccatacccgcttccatctccagtgttgccaatggtcacattagcaaacttagaggtctgccctgcaggtgtcttcatccccttgcgttgtggacactttctggccagatggccaggttgaccacacacaaagcaactcctctcatcctgattaggattgttgttgttgttcttcttcttgaagttggtggtcttctaagctttgtatttccccttgctcttgtcctaggccttgtgcacaactttggcagtggactgcccaccatcgcccttagacgcggcatctttttcctgagctttctcctcaacatcaagagatgctatcaacccctcaaaggagtattcctgtctcttgtgtttgagtgcagtaccgaaatctctccaagatggaggtagtttcgcaataatacacccggccacaaatttgtcgggtaagacacacttaaggagttcgatttccttagccatggtttgtatctcatgagcctgttcgactacagaatggttgtcagacatcttgtagtcatgaaactgctccatgatatacagatcattgctagcatcagtagcaccgaatttagtattcagtgcatcccacaactccttagcgtcggtcatatacatatacacctcgaccagacaatcgccaagcacgctaagaatgcatcccacaaagagagtagtggcctcatcgaattctttctgctgatcagcattaagaacgcccataggcttgccagtactcacccagaagcatttcatagctgtcagccacagagtgaccctgatctgccatctcttaaagtgcacaccggtaaatttatctggcctcagtgcatcggcaaaaccagccatagtaaaatcacagtgcgtataataaggtttttggattgttgagaatatagacatataatgatttaatatattctataaataaatcatgacattacagatgtatactagcattaacgcatcattagatctacacatgtaaactaagcagtaaaacatgaacagatcaaatatgcgcaacatgtcgaacacgtaccgaggtggcggaaagaccgattgctcggcaggaactactcgcggttgcgagcgtcgacgaaggcgcgtagcacgcaagcggagaggaaggcgagccgtcgcggacgaacagggagcagtcgcgcgaagtgcttcccaaaaaccttattgccgccttctcccggtgcaagacgtcgaaggcagaggttccagagacctgctctcccgatcgcaggtgcacgacggcgagcgggatggagtagtctacgagtgacggcgcagcacagaggaggaggcaaaccctagattgatttcgtgtgttttgcgtgaaggcggcggctcggtttatatagagataggtcgcttgatcagggcgcccgcacgatcttcactccgcacaaacgaaccggataagtcacgcgtaacttatccggactccacgccattttcacgcaccggatttttcggagtgtttccaaaacaaaacaaatccgaattttcctgcagcaaaacaaaactgcaaaaggaggctgcatctgcgcaagggtgaggagccaattttgcggaccattcgacgcgtacgtcgtgcacgcgcgccacctgccctgccaggctaggcgaggcgagcgagcgcgtgttccccctcttctctccaccacacatgcttcaagtggctaggagggcatcctcccttttaaggaggtccccctctcctagaataagcaaggtggtactaaactccacatgcatgccatcccatgaggtgggcttttgtgattttctaaagaattaatcttcgaatgggccttagcccatatattaattccaacagtgtgtgtgtgggcgcgcgctaggccccctttgattcaaaggaaattcatagaaattttagaggatttcattcctatagaaatttttcctatatagccctctgaatcaaaggaatagatcttatagaatcctatgaaattcctatggagtgcctaatgccatgcaagttttggaggaattttaacatgaggtagaaccttatggaaactttccttcgagtctttatctctcctctaattcctatgtttttcctgcggtccaatcaaacaataatttctatgtttttcctgtgttttgctatctctattttacacttacgttcctatcaaaatccaacgtttttcctattcctatgttttcttattcatgcgattcaagggggccctaccgaaaccctcctgccactaagagagtgtttgtgagtaggggaaaagaaaagattgagaagataagctagcgcataattaattgagtattaattcttttaaattttaaaaattaattgatatgagtttttaaagcaacttctctaaagtaatttttgcaaattaagcactatttaatagttcggaaaacgtgagcaggaaaaatgaggtaaatctcaatctactagaacgaacacaacctaaatattactcccataattaatcaatcaagattattttcattcttaatttacttaaaaaccttatacaattaataagtagggttaattgatgagtatgtacgtcttgctcagtatttttcaaagaaaggatatgtttgatagagctccaaataaaaaatggatatggagttgtgaagctaggaaaaggtcgtgatttacttttccatgtatttttcccagtagattcacctacaccgctctttaaaaatattaaaaatttaatggtgtttagtttggctttagcttcactagacaatgattcaggggatgggtcctgttaaatagcccgaaaacatccaaaacagaaaataatattgtcttaactacatagaagtaaggagtgaaatacatggccggtccttaaacttgtggggtggtgtcacttagatccgtgaacttgaaaattgcacgtttagttccgtgaacttagtttaatgaaccacacctggtccaatcatcctttgaccacgtttgaccgccaacgtggcatgccacataggcaacacttttgtgctcagccccctccacatatatcttcgtacataactttccctaatcagtgcatttcaacccaaatcccctaaaatatccctaaatcggctaaggtttcgacggtgaggttagtggaaggaggtcgagaggtagtggctgtggcggactcgacggtgagattagcggcaggaggcagcgtggtgcagcggggttagcggtggcacagtgcggtcggattagcggccggaggtagtgcaatgccgcttgcacactaggcatccccatggattctccaagctcgtccttgtcttgaagtcgtcggaagaaggtgttgttgaccaagtgcccgttgtgtaaggataatgtcattttggagcgcagagcaatggcaattgataatcaggaccacattttctatacatacaaggagaaaattgagagtgaagaacaatttaaggattttttttgggggggggggattttggtgtcactgaatagctacaaggagatatatgcgacgtgttgtgatgtggagggagttgagagcaaaagtgttgcctacgtggcatgccacgttggcggtcaaacatagtcaaaggatgtttcgaccggggtggtacattaaaccaagttcacggacctaaacgtgcaattttcaagtttacagacctaagtgacaccaccacacaagtttagggaccggccatgtattttactcgagaagtaagtgtaagtagtgttacgatccctttcggagccacaaatacctcatttcacgactcaaacgtttgtcctagaatgacattaattttaggtatgaggtctgcattcgccctctttgtgttatcctcatttctcttctcttagatagagaacacaccatcacctacctcaaaccgtcaggcgtaaacatcattaattagttagagcttaggcatgtcaaaaatctaggcgagcatatcaaagcacaggagaaccattaattcttaatgaaaggcatattcgcacattcgacccattctaatacgcattagactaacttaaaaaaaatcttttagaacgaagaaagtataggattgtaaagtataggatcgtataggatcgtaaagggttgaggtgaggggctcccccacttttcacaaccaatgcgggattattcaacaatctttccctttacacattagtgtctctcaacccttcaccgttttcctatggtccctcaggtatacaggtcccgcaggcacacggtccatcaggactttacacgtatgtccctcgagccagagatgttaaactagccaggctctgatacccattataggatcgtaaatggtctttctcaccctaaaaggtagcgaggggctcacccacttatatattgtcccttaatttttcacaaccaatatgaatctattcaacggagaccaaacagtactttgaaagtatgtagacgcatatactagaaattccgattttaataatcggtcgtctattagcaagggccccctggttttccccctcacgagcactgcacaatttcctgtagaaactatagcgatattgttgcaaacatatgtccagtaattcttttatcacaatgtatacagagctttactatcatttccatatatgtccgtagcagccatcatccctagattatatatatatatatatatcaaggaagatatatatataaagccatgttggtaaaaacaaaacaatgcaagatgcatacatatatttatggtggggatcgagtacatggcatggcactgttctaccatcatgtgtatgagacaacacgaaagtctgcagtgctaagttaataatgcatggccacaatctacacaccatgcgtacgtggggatcctttttgctaaaaatacaccatggggatcgactactgtttctacaggatcagaggacgtttttcatcttaatttttcaaaaataaaataaaatgaaaggatgtacaaggacaacttcgtctctatgcacacgcaacacgtactactattgagaaagtaattaacacttagcgctgtcggctcatttcatacgctagctagctagttagtgttttttttaaaaaaaaataatgtgaaagtcctgccatatccgctgcatcacaaatttaaagaatataatcccgacattattcatataacaatatattattaaagaaaatcctgttattaaatttgtatccatgattggcaaaaattgcatgaccattatctctaaataacggcatatatatcttacattctttgctagttcccttcacacctttgcaacacggcctagctagctagaaccgcaaaagaccaatatgcatggtcacctataaaaagtacttgcatatataatctaacataagatttatcaaaaacaaattcatttcgattttactgcaaacccccaacataatgcagatggcacaactaacaatactgacttcaaagctttaatttactgatctcgatcgcacaagcgtagtgagggcagtgatatgacgagtagccccgtactaatttcacattggatctgatgactaatactccgatccgtattagtttagttaagagagtggtggcttttcagtttaagccttcagtcttttaaaattaatttatttttctaagagaaatttttatttaacttctctgaccacaattatatagtacaacaatctaaaaagttttgggtgtcaggcatgcagcgcggccagcagctagctggcaaagtggcagagtttgatttgttaccactgatgactgatccgctcatgcatcatgcatgcatgcatatggagtatgtttgtttgtatatatatcatatcgatcctgaagagatctaccatatatctgacagatccaagcaatcatggatctcgatcgatcggtagatgcatgaacaacgacttccataagccaaacaacttgcgaagccgatcgatatatcattttgaaggactgtccacttgacttcattcacaatatatgttgagctatcttgtgttgatgggcaggcagggacacaagctaggcaagcggatcgacctaggatgggctggaatttctttctttctatgagatggtccggcccaacaattaatccttccatctgctctgcataagtgggctggcttactatagtatagtgggactgaaaaaggaaaaagaaaaacgaaaaaattcgatccatagcaactaaacaacctggtaaaaaatatactcgcattaagtttcctgcttcaactagaagcatagaccaccggtttttcttcgatacgtagcactttcatcacattttaagctaacggtgttagattagagtaaagaaatttatcctcgaattattttacccttcgttttcctcttacatgaccaggtcatcgaccaagctgctatgccttgcatccctcgctctgtgcaccgtcgagcaagtagcagccgtcgtcaccccattgagtctctcagcccttgtgttgataggttgcacacgtcaagccagtcttttccgctaacgaccattctgctctacctttgcagccctcgctctatgcaccgtcgaccaagcagtcgctgttgtcacccgctgagcctctcagccctcgtgcatgttgataggttgcacacggtcaagctagtcattgccgctaatgaccaagccgtagcgccttgcagccctcgcgcaataagcaacccatgagcagtagtcgctgtgctttgctgtcacgctcggtcaagctacttgcaagctggcgctgcagttgtagccccaccgcgcctcacaagcagtagtcatcgttgtcaaccaagccgttagagattgatgccccgggagcggtgccaacggtttcgagcacgaaagcaccacccagaggcgagagggaggagctgaggtccatggggctgcaggtggagaccgatgataggggcgagagcatcggtgttggtgacgagggtcgtagatccagccgtctgtgtagacataaatgatagagaggaggtgtcgagattggcaggcggagacgtagctggcgagggcaaagaggacttggtggctaacatggaacttttggcgacggaggacgaggacgatatgtaacaccctcgtcacatttaccatttatacatgtaagttgggatgaaaagcaaaaaagactatttgctcttgcttctctctatatagcatcgtaacgagggtgttacatatcgaagaaaaactagtgacacttgctgccttctagcgaagaggggaggaatttttatgctatttttttttcttttttaccgactgttttgagagtgctaggggtgtgaaaaagaaaaggaggcgataaggttgggaaaggaggaggaaacggacgccacgtcacaagatgagagagagagagagagggtcgcatcacatcacatcacatgatgctgctggggctgcaactgaagtccacggcccccttgtgcaagaaagaggaaagaaaattccaaaattgcttcacgcacccccccacccacacaccacgcgtcctccaccgtccgatctccaccgcccacagcccacaccacggtgggaacgggaacgcggcctcccctattcggcgcagttgctatacgtaccccagcctcgtacacaacgccttccccctcccctcctctcctttcctctcgcccaccggaatcctcctcctccgcccctaggcaaggcaaggctaggattgccgcccgccggaatatctcccccaccgccgccgccctcccgccggcccacgggattggattcgcctctttacaaggcctatcctgccctctctactaccacccttatcgatctctatctggtttcctttacctttcgatttgattcaaccacatcgaaatcgattctatctctacccgcgacgcgatgaccacctcctaccggtactgcttgctaatcccgatcccaccttcctctctctcttgtgcgctccatctcttgttattttactactatcatcttcagggcttggcttcgattcgttctaggtttttcttttcttttcttttctttatatatactcttggtgttgttcttgtatggtccgaaatgatccatgttgattggggctctagactgcacaggcatatgcatccaatatcttcttctaggcacaattaatttaa

SEQ ID NO: 56824 - DNA, 2913 bp, Oryza sativa
aaagaaaatgaatacccagtcttagttgagtcttttgtaaaaaaaaaaaatggaaccaaagaatgcaattgcactggatgaacatgtgctggattctactatccgcaagaggaagcgtgtgggtgctactcaatgtgctgaggccaatgacgcccccaacctctctcagaatggtccaaaacagaatctcgctttatttcctgattcgactggacataagaagtccaagatgatgtgctctgccgatgacattctggagaggtacaataacttcaagataagcgggatgcctgttcgtgtgatgtctcaccaacatggtggatggagagacttcccagaggatgttgtcaattcggtacagcagagcttccagttgaagaggccaattactagtgcagtattccagaacaggcacatcctgttggacttcatgcagatggtttgtttagattctgtgatggccataagcaagccaattgcttggatcgatgatcatggtaaatgcttctctccggattcatgtgctggagtaataccatctgaacctctgcagcatggaaaaaatgagttcttgaaaagttttcatgatctaagcagtagttatgaagctcatgaacatgatgggatgtctgcagctgaaagctcaagttcagcgtcttttgatgcagtgctttctgatgttcaggaggtcaataatgtagtggaggacaaacagaaggtactcaatgaaagtggtgaagtttctggggaaaataaaaagggccatttaagccatatgaatgaaactgctgatggggccatgcaagctcctcgtaataatcaaagtgtccagcgtgctgattcagctgttcggaatttgttgtttcaaggatcaggccatctatttactgaaaaagacatcatcggtatttatagaaccccaatgctagatcaacttgggaggtcccgttatagtcttttccagaaggaggtacaagtcacaaaaaatcaacggggaaatgcaaatgagcgttatgcatggcttgcttgcactaagggtactatggaggagatgatgatgaatggtgctttggaaatagcaaaacctctgcagggtccaatgtatggtgttggggctcatcttgctccagcaaactcctccaatatctggtaaataccttttgtttctgatttatttgttctatgtgctcttacgcctctggtgttactgcttttgttttggatgtatagtagcctatgtcttacttgaagtttgtccacagtgttggtttatctgatattgacgaaaatggaatcataaggatgatgttgtgccgtgttataatggggaatgttgaggtggttttccctggatcaaatcaatgccagccaaccagtgaaagttttgacagtggtgtggatgatctccaaaggccaaagcattacatcatatgggatgctaatgtgcataagcacatttatgctgaatatgctgttattatcaaagtaccttacatgaacaatggtactataccatgttttttcccctctcttttttaccttgtgtcgttattttccatttgccctagataacttattttatattactgtatgctatttggttacaggagatactgcatccaatatctctgagataagaaattctggtgcactagacaatccaaccaaggtatgcatattatggtttagctggtgtgctgttgttcactgaagcataattcagttctgtcatgtagtacgttttgcgggaaaattgaatttgtctcacctaggcttaatgatctattatgtagtgtagtggaaagggtgaatggatgcttagacttgaaggcgtgttttgtgcttctcgttatgggatttgctcactttattagcgaaatttccagttggcgtttaaataggttcccatttattactgtttccgcagttagtgttctttaacccgaaaaacataaagatgacaattactatatctctttatattttggttatggcctatggcagatccttattgaattccactcttgtatttcttgacttgatggtgatggaatttcatatttttcttcatttttgttgttgattagtaccttttaatgtctgatcatatatggtagtggtgtaggatgggggcgggaagatcaaagaactttgcttagttatgtgtttccttcttgctgatgctctttggatgtaaatgaaatttactgaaatggattcaggttctgttggcccaattcctctgcttttcataatttgcagaaactaatccggttgatttttctaaaagaaaaactggttcacaattgaatgattgataattggcacttaatgggcgagcttagttgaccttgattttgatgacagttttaggaaaaatttcatcttgttaatttgttgcttgcttgttgtgagcaggatgacagtctacagaccattgcgtcttcaggtgatgaacaacaagcatgtatgcttgggcgtgctccaagtccaaggtctcctagttcaccttggatgcccttttcaatgctttttgctgctatttccgctaaagtaccccgttcggacatggatctggtgcataaatattatgaagaattcaaggttatttgtccttcctttggagattttcagctacatgcaatatttgtttgctggcatgctaattatggtatggtttttgatgttaaaatagaggagaaagataagcaggcctgacctagtgaagcagctgagacagattgttggtgacaagcttttggtttctacagtagtgagacttcagcagaaggtacttcttttttactgtgctaactctttgtatacagttcacttaggatttgaagtcctccatcctcactcaatgtgaagcctgctgtgtatatttgaggaagcgtggtacatggaattatg

SEQ ID NO: 56825 - DNA, 1541 bp, Oryza sativa
accacgctgttgtcatggtaaccgtgaggtgaggtaatcttgtttggttaaccctagctagccttgatcatgtacctaccacagccttggtcatgcacctaccacgcaagcagaaatctttgacaaaaacttgtatgggctgatctgatgctacccacatccattgtttgcgttttggcttattagctgcaactagaatttaaattttaaaacttgattttaagttaatttaaggttttctttaacgcagtttatattctattagtattaggctttttagattatatacttagactattgaaacagattatttactataccattcgaaaaatacatattcttatttttttttactatttgttttgagttatttgttaagtttatatattaaaatatttaatttatctatacaatttagtagataatttacaactacaatctgatgaataatctgttttaaaccgagtcaaatcactaaggatattatataagagttttatgtataaattatttttagttgcttcgtttattttttctttgactttgtcagctgtaaaacaagcgttccagaagacagaaaattagttatatatatatatatatatataaaattcaaggctgttttatatactccctgtgtttcaaaataagtgtagttttgcactattcatattcaacattggaccgttcgttttatttaaaaaaaattataattagtatttttattgttattagatgataaaacataaataatattggtttcaataggactccttacgagcgttctttctatctactattatctaaaaatagtcaagttattaatgactagacgaaaccaaaaaataaccccttatgtacgaaattatagaagatcccctttaagatcaaacaattccatcgaattgagtatgactgtatgtgtgatagcatctactatatcaggaatatcaatgaaccccattcttgcaattgctcaggataccctcttttagctgctaggtctatttcttagttcaagatccctcttaataactggaataaaagaattagtagatctgttccgcccaaaatgggaatgggcgctagggttatgaacttataatcatggaatcgactcgatcatcagattataagttcattccataccggaccagaccgtgcacattcttattataagaagtggtcattcgagcctatggaaataggatactctgtttacatagaaatccccacgtccttacattctatttaggattaggaataggtgtaatcagacctgcttttgacatatctattctatccttatttgggtaccatatgcacctctttgggcttctattgaatcgagaaattggattgtatatctttttgattttgatacatataaggtgtcctacggataatgcaaatcgaagctatttgatgtctgactcaggcctatatgaccgatcgaaatactccaagactccacctttgtcatatattccatatatcacattagatagatatcatattcatggaatacgattcactttcaa

SEQ ID NO: 56826 - DNA, 23183 bp, Oryza sativa
ttcaacctaccaaaaacagtactatcatcagaagtgtatatggaacagctcaaatacaacgaactgactaagctcctgaattctcactatattggtatattatatcgaagttctaaacagaatggactagggctgctactgctttgcaaaagtataatcagtaaaagtgtaaaggatattctttcatgctcaaggggatgatgctcagaagatccacagttaggagcctaattatgcactatgatgacatgcaagtgaaacattgtaatagaagtgtttgtagagtgtaggcaatacccttctttatatttggcttcgattgactgatgtgctgccttgataccatagctcaaaagcattttcataatgccataaagtaaggttagagcttgaaaagatataccaatttcctttttgtctgctaaaggaatatttggcgggggtgcttgatcaaatttgtcctttaacatgcgcaactggtgtggactccactggaaaaaataagcaattaataatgcacatgagtagcaaatcagaagtgcctgagcagcaaagcatcaggacagaagtagataaattcttcacctaaaatgaatgcatctagatgatcgatgtattaaagacagcatgaaacatacatttgaagcatccctgtgatcaatgaccctagcagaacgcaatttaacaagatgtggacgtataacatccaaaagcttatcattgacttgttcagcctcatcgccaactggtatctgcattgaaacaagtgacccttcagaagagagaaacagcatagacaacttacaaatttatcactgtccatgcacacctctaaaggttcaactgtgcgcctctgaatataacggctgacttcaggatcactttcatcacagtgaaccaactcagaaatgcgcaaattgttgataacattttgtatagctggttgctttgctgaataaaacaggattgaaaaattagcaagcatctccatttttcagcacttctatttaattttgaggagactaacatcctggtgtagcagtcagagctaaaatccttaacggcacacgagctgcctccaactgtcaacaaagcagaaaagtagaaaaataacaagcaggtgtcagaacgactcattcatttacaccctaccgatatcatcttcttcaaatgagcttgatatggaggaaacccatgaaagataaccaacaaaagagattgcttgggtatcaaatatacctcacggactacaacacagtaagcataatttcgcgaggctcgatgagcttcatctatcaccaagcaaacgagttgattcaccatgcatatccctgccaaaagccaaattaacaatgtcaactcagagaaatggtagcattaaagatagtgggaacaagaagaaactactgtggtcggtccatttctgaagcgggcagtccaaacataaaattgaggtaataatacttaatgaaaggtggaagagaatggtgaagctagtgtcaaatgggagtaaattatatagctgagttgacacatgatttgcaggggcgatatgaactacaagtttggacatgacttcttgtcatgtgtgggcttttatatgcatctgttatgcacaaaatttctgccttcttttgtgctgactccatttcaatggaagctctagtgcaactgtgtttttactatgcgagaaaagaagtgatgctgtttcttccagaaataaatcaatatttggttgccacttgccattctaaactactcataaagcaacacatggaactttcaaagacaaagtacaattgtaaaatatccaataaaaatattaaaagcataggacaattggacaaacaagagaaataatcaccagattgtatatcattctgtagaacttgtggagtgacaaagaacactcttttagacttccaaaagcatgatcgctttgaggggcttagattccccttcaagtcaattgtccactcctgcaacaagtaaaaagcaatagttccaggtactggtagagaagaaaatttgatcttcaactgataccagataagcatgaacatctacagaaagaaattaatacctgtggtattcccactgtattatggcatgcctcaatttgctgagtaacaagaggacgtgtaggtgcagtaaatactattttccctttattttttcagatttacaagataagaagaccaactgtcagaaagggtttttcccaatttacaacagaagaggaaaaaagttccagcatggtacaaaaaattaccttcaggaaaccatctaaagtagttatacatcactactgctgcaataaaagttttgccaagccctgttggtaaagccactagtgtattggtaaataaagccttctctacaaattttttttggtactctcggacttgtacattagctgcaacacatgaacaaaagccacttaaattacacagctgacacattgataccttggttagagagctaagttattatgtgtaacctctaactatttacaaagcaaacatgattacagcagaagtgaactacaacaagaacagaaatgagcatttgagtggtgtttcagaagttattttttgtttcgcttatattggaatcgttacattattaatcactgaggaacagaatgtttgcacatctatgttggagagtggagacagggagtccaggagagttccctggggagttagaaggctatacaaaaaaaaaagattctgaggtccaaatgagcaatcaaaatacttagtacaccaatactgaaacatgcactaattaattgtgtctaaaccaggttattcttgcatgccaatgaaaatgctctagaaaactactgatgacggagtgattcttctcgaaatgcaggtagaaatggagaacactcacttggataaatccaagttcgcgctgcctcgtggtccagagcaacgccgcagggcttaggcacgacatcctcgtccgctctacgcgagcacccctcaccggcgcggtcactggggcgcccccagccgccactcggcgggaccggcgccgctgcgggcggcgaaccaggcacaggggggcccctggcgccactcggtaggatcggcgccgctgcgggcggcgaagcaggcacaggcggccccctctccatcgccgccatctgtctcctcctggtgaaggagtcgacgaatcggtcgagcgtcaactgccgcgtgccggccgccgccgagggctccggcggcggtgccgactccgacgcggcggaagaagacgcgagggcgcatcgcctgtcgatctcctgcacggccgcctcccagtcgaagtcctgcgggggggaggttagggtttcccggagcaaaggtgaaaacgcgagcggagggggggtgaccggaagaggagaaggaggcgcttacgtcgtcgtcgtcatcgatgatgatggcggggtgcagcggcggcggcggaggcggcgcggccattccgccgcgcgcgggagcttcgagaaggttgcgggttggggaattttgggagggggaggaggcggaggggatttgggcggggagacgaaaagttttcggaggcggtgcgcgcgtgcgatgctggtggtggtgatcgcgacgaaacgggcggcccgtgtgatttgggcctcaaagaacagtactgctagtaaaattacggcccatatgtatctgagaaatacggcccatataggataggatggaagaggattgtgggctacgtgacgcctaaataagaaaaagtacaccgaagatctctcaactttgtcgtcgggataaaaccgttctcgaaccacaaaaccggatatcacggatcccttaactatataaaaccggtcacaatttgttcctcgacaattttgatcctggttttgtcctacgtgactgctgagtcagcgtggaacccacgtagaccccaaatgtcaggatgccacgccaacacctttctctttcccctcttctctcccttctctctcacttctctacgctgcgcaggctagccgacgggaggggaggaggccggtggggcgcggtcccgcggcgccgcccgccgcgcgctccgcgaggtgggccgcgacggcgtcgtcgtcgtcgccggccgcgccgtctccacccagttcgccaccgctggtgcagacctttcctctggcgctgcggcgccggcgccggcggcgtcggcggcgggaggcgggtgtacgtgaggaggccggtggggcaaggcaccacatcattgcagccggcaagccaccgtccgacgccgaccaccgccacctcgccgccgccgtcggcccccaccacctccacgaatctcccggcgaacgggtggtactccacaagcgccttccccagcgcctccctcgccggctcgccaccgccgccgccgtttccgccgccggcctcgaacacgtgcagcgactgcaccaggtggcgccccgccacgcggtcgagcaccgacagcggcagcgtctccgccggcgtcggcgacgacggcgccaccagcgacctgctcgtcctcgtcaccgtgaatcccatatatactgtgataatctcgctagcttagctagcttagtttttgtatgtgaattgaatgtgtgtgtgtgtgtggagatgcaagagccagtgccatgtgtatatataggctagctagctcgagcttatcattagttaattaagctaagctatgctcgtcctcgccaatgtggttcctccattgaacaacgggatcaatgctgagcctgagaacctcgcttctgggtgttcaccatggtaacaaatcggtttgattgcccagtggcggcggtcctgcactcctgcctcgccccaccggtgaccgacctcctcacgtacacccgcctgcccgccgccgacgctgccgccgctgcggcgccagaggacgggtccgcgtcctcgccagcagtggcgaactggccggagacggcgcggccggcgacgacgacgatgccgtcgcggcccacctcgcggagcgcgcggcgggcggcgccgcgggaccgcgccccaccggcctcctcccctcccgtcggctagcctgcgcagcgtagagaagtgagagagagaagggagagaagaggagaaagagaaaggcgttgacgtggcatcctgacatgtgggacccacataaggtcccacgctgacttagcagccacgcaggataaaatcgggatcaaaaccaccgagggacctattgtaaccggttttctatagataagggacccacgatatccggttttgtggttcgatgacgttttttatcccgacgacaagttgagagaccttcggtgtacttttcccgcctaaatatgacgggctggaactgggagttcggctacgtgcggcccatacaggatggaatgggctcgtatgcaaagtgaggcccaagtgattcggtccggaaggcatcacgaagagaggtccatgtaatatgggctgaaatggtgctgtatccatgggaaacaatgtatcccgaggtcaaggtgcttcatggcttcatgtcccatgattttatcatgctcatattttaagtattgtagtataccgttactctaataaaaaataatattagttggttacatgcaacatatttaatgatgtgaatttactcttcgtttacataaataaacgaagatacatttattaaatgatgcccattttggaaaaacctcaataaccttaggccatgtttgacaaatgggatagagaaatgatttcccacccactaaaagacatctttaaatcctaaccattcattctccccctttcatttaatcctaacccttcattcatttcccaatcccaatcccacctctcatttcccattatccaaacacacccttagagaatgattaaaatgggatggaggaagtattttgatgttattgatcttgttaacctttactagaggatgatcaaattgggatctagggattgataataagcattcattcctagataaaaaaaactaacacttgtaatgcatgcaaacgagcacggatgcaggtcctctgcagtactgcatgtgcagtactactcactgacatgtgggcccgatgtgcagtactactcactgacatgtgggcccgagggcctgtggggcccacatgttagtgagcagtactgcacatgcagtactgcagaggatctcaattggacgagcacatatgcctctacaatctatatgtgtggtgggaccattctacattcgattggaccattcaacatatctacatagcagccatttactactccaactttatacactcttagggtatccacaatatagcattttagcaggtaataagcattaaatactcacttattacccggtagtaaccattgtaggactagtaagtagttgcagcccggtaacacggctacaatcgggtaacaggaattaaactatcttatttgcacggtgtttctgataaaatgcatggaaataagtcacggctagagattgccatcggtgattttttctgaagctggccctaccttgtttcctactgatatgctgatacattgtggagtgcatgattgcttactactacttgtagacctggcccatactactgacacactactaccaagttgggcaagtaacattgatgttgcccttaggatgggtcacatctcattttaggttgagttattttgggatggagggagtaagggtgtttagtggtagaagagtggttaaaaataatatatgaagaaatttaaattagagatgattgatgttaaagcagtatacattctaaaagaatgatagtactgaatgtgctccccaccatatcgataatttcttcatgtactttaatattacaaaataatcttgcacagttctatcttatttcatttctaaggctcccatttgtctcggatgaaggtgaagattttttttgcgcacataaaataaggcaagccattaacacatgattatttgagtattaattattgcaaacttaaaaatgggtttatttaatattttagagcaacttctatataggagtttttacacaaaacatatcgtttagcaatttaaaaaatgtgttaaccgaatccgatgtataatttgcatcttaataataaacaatcggggctttggcctacaataacgtattattctaaaatcagtaaaatcaaagtgtttgattgttattttgtaatgaacaattggcatatgatattatcggttttgatatttggagattattgacgaagtggatttagagatgattggaattttcaggtgatgaacaagaattactaacaaagtggttgcttatcagaccaacgtatgtgagcggtctgaccgaccgacgttgtgttggtttcagtttaggatcgattctttagatatccatggataattcatatttatgatttctagatagatactagtgtgtaatattgttatttgctattagtgagtcaagttggtgagaacttgcactcagatatggtttcttggttggtgcatgtgtaagtgatttgcctcagaagagcgttgccaatgatgaatcgggagtcaacttgggagaagatgacgtccagacgatcaagatataatgcaagatgcttaggctaacgattaatgcacgtggttagtgaagattccatatggcatatgatggagatattgtgtaacttttagttctgctaaaaatttcagttttttggtacttcaaccattcacctcttctggttaacttagttcttacagtccgatcctacaaaatcctcaaaactaatactccttctattctatatcaatcatcattcatcatataaccttggactcttcgtttgacatgtagcttatattgcatttaggcatgcatgtatgcagacattgataggtagttaagtcctcgttttctatgcatgtgggacttaaagtctgcgtgtttcttagttctcttccaccatatatgctcacattaaataaatactaggacttttaggcgcgcttcgcggcgccctaccgttcattaattaagagctatgtagcttatagatggtaatagggaaacatttcattaagagctatgtagcttcaaagcagagcaaatagcatgactatgagagagacgctgagagcacctaatctaaagcaatgaaaacatttgaccaatgtgaaggcttcgaacttcaggagtagcctgaacagtaaaaaacatttgcatacttcaaaaagctctactaagattatataaggcatattatcacatccgcaattgtatataattttactatcaccatctgtaatttttgacacgaaaatatttacagagttatgtacaaaagcttaaaaggaatttttttctttaatttacagagttatttaccaattcatatccataattatgggatggaaggttccatttgtacaacctacaaaatgcacaaatggttcatgaagtatttcatgtaatataaatgagcatttagatatgtggaatctgatatggaacctttggtggctataacttaactgaccaagtgaacttcacctcaaaatcagatgcaaaataagaacaatataatggtgtgtgccaaattcacttgagtttctagtttcaaaaaatcaattcgtccttacaaagcaaaccaaacctctgactgcacaggatctacagagcaacagatcacagctccaaagtatattgacctgcctgcaaccttgtggctccacgcattcagctcttttggtgtaactggcactcaacgtatgaaatttcagcatggaaaggaactgaaaggttcatttttctttcgaagaacaaataaaaaatgtaatgtcaatcaccaaagaaaattgtgtagaaagtgaaagagtatagcaattagcccacttagcagtttgtactgatttcaagttctactggagcaaattgcagtgtccctaagcagagcatgatgggtgtaggaatcttggtagatatttgcataggccatatcattaatctccgacctctaaccattatgtgttcaattcatggaaagaggattttgtgccatagctcaccacaacacgtttcagatccaatttatagtatttatatattaccaaacatgttcttaatttcatcattgtaacagaaacttccacacaatttcttcaccaattgctataggagcactaaatatatatcagtttaaatcagcatggcttagccctaaattagtagagttcattctgcatcttcaaagactaccaatgctgacttgcatcagcaccacagtgaatcatccaattacttagccagacctacagtttgtaattttagtcaatgatttttgcctctcaaatcctaaaggccaaatgaagaacagagttaccttcaagtgcttgtaatgatctcaccgagcccaacaacctaaatgctattggttggtctagtccaaaaacctcaccagaagcatcacaagtccaaaaacgtacttctattagtaaatgttgagcttctctgaaggtttttgttctaacacaatctgccacataacttcaattctgatgttaaggagcagaaatagagcctgaattctgcaatataaaatcctttagtgagcaagtatcaagtccagaaacctttagtaagcaagtatcaagtctagaaaccaatataagtgtatacttgaaaatgcaattaatggaatatatcaatgtatacgaaaataggtctagcccattcagtttctttaggaaaaaaaaagagccaattcagtttcattatgtgcaaggtaatctttatatgttgtcaaccatgtagctagaagcatcaacactaataaacatttgcttatgtaaatgaagcacaaaggcatttagaaaacaactcccccctaaacaatctctaataaacggggacattcatttctttgaaagaagcatatatgtaatgtgaatcaacaaataaaatgtgtagtaagtgagagtaaacatcaattacctcgatttgcactgatctcagttctctactgtactaaaataaagaatccctcagcagagcaggatagattcacagattccttgtagtcttgcagacatttacataggccatagcattacttgtaagaggcatgcaaaatatcatacctccgaccactgtaataagcaatttgagatagtggctgagatgatggtgagcaatcatatcagaacatgcagtgaaggtttcgttaaatatgattgtcatttagaaaaagagttcaaggtgaaccattgtggaactaaaatatcacctagtaaaattgaagtggaagtaggaaaaggcaaaaaaaaaaaggttcccaaaatacctatacatatggattctcaattaatgatgaagttgcatacatccattgcccctaagtaaattacaccataaataacaatggcaaggcaattgcaaatggcccttggctaggcgacgacagatggttcccagattacctgttgctggccagatctgcaattgcgaaacagtgtcggcgccgcacggcagcggagcttcaaacttgagcagaagggcgccaacccactgtggagatggagaaggattgcatcggctgaagagagcacaaagcaaaaggaatcaaatatgaattacagagacaaagaactactaaccaacggagaattcaacacaacaatagcccatggcaatgcaacatcactgatccagaccttcatggcgagcttgagtgcatgtacccaccggatctagcgataggccagcagatcgatcacctcgttgtcgttctccatcaccagcagccctggttgatctccatcaccaccacccctacttgaactgggaagagagaggagtagtattattatggtgtgtgtgtgtgttgggggaagggagggcgtcggcggcgaggagaagcgcaggagggggaggccggcgtctacccaccggatcgagtggcagggccagcagatcgaccctctcgccctcgttctgcatcatgaccactctccctgcttaactgggaagagagatggagagattgggcagggggagggcgacgaagcgacgacaggcgtcacggccaaacctcgccccgagccccacgtggtctggtccctccgcaggttcaccacggcgtcgacgattcaccaacgaccacagcagcgcctggacgaaggagaacgcgcagaggagtttgtgaggaggcggcgacttcggtgcggctagggtttttggatggcagtagagggcagccaaaagttaactcccccgtccaccctcgcgtgatggacggcaaaaaagctcgaggggcaagccgtcgtcgccggcgaggagaaggcaaagcggcggcggcgcaagggcaagggaaatgaagagaagggacgggggaacagtagtggctagggtttcgagggaatggggggattgggtgttctttttttttcataaaactcccttactttctctttttcagggcgctgtcctatacttggacagtcatatagagggcctaaggcagtgaacttacattgaggacttaagaaagattatcaaggtaagagaggatttttttgcaaaattaccagctccagcgctcttcatcgtagatgcttgatcggacgacgctgctggcgagtaaccagagcgcaccaaaatcaacagccttctagcgcgcggggggcgacgtggatacacgcgcgtgcgtccacgccgtcccaaattctctcgtgcgagcacttcgcccttgcttttaattaccccgattaccccgatatggtagttaaaatttgcttggttttgataaaaatttatatggggatcaatatggaatagacgaagtatattctaaacaatactatcatgtgggcaatttatatttatccgtaacaaagcataactatttagtaagttgtacaaaatctgatttctacccatacttatttttgcaaatataggctgtgttcggtggtgggtgttgggaacccatcacccacgcatgaaaaacggagcggtccattaacgcgtgattaattaagtattagtttttttttccaaaaatggatcaatatgattttttaagcaacttttgtatataaactttttacaaaaaatacaccgtttagtagtttgaaaagcgtgcgcgcggaaaacgagaggggagttgggaattcctgtatcaaacacaaccataagagcaagtttaatggtctatttgatgagcttctaactgctgcagcttctcatagaatcagaagctccccaaacagtccagcttttgatccaaattatgagaagatatagttatataatccagaaaatgaactagaagccagaagctcagaaacccagcttttccagtttctcagaagctggcttccaactagctgctttttataatcttaagctcctccaaataggctctaatactatagacaacaactattagcttcaagttatctataatcaatctaatagccaattcatacaatagttaactacaaatatatactacatcattaataattggtcccacatgtcatacacacgtaacgtttcagagttcgtgctgcagctggctacaaatttgtaacccgttttttttctttctcctctcttgtcttctccatataagtttatagctgacttatagtctattattgtacttgctttaaggtgtaatttaacttcaagaaaagtatgagcattcgtgtcgatacctcgaacgggtcggatatcaaacttggtgaacaggaaccaaacttcaacgcaaggttcttaatcaatacaagctgagctaggatgcaatccccacttcgcataatttgaattaatttgacgccaagaaagtttgaaatccaacttgcacacgttagagcagatgccaggctataagccagctataaatatattttaaagagataaaagaagagaaaaaaaagcatcgggctacagatctgtagtcagttgtagcacggactacaagacgtaatgtgtgtatgatagtatgacgaggtattaatagtatagtaatcaactattgtatgaattagctattacattgactatagatgatttgaagttagtagttgactatactattaaacttgctctcagtaacactcttaacttctaacttaaaatcactaaaaatagactagtagtactagttaataaacagtcttttgtcgtttagaattgaaaaatggctgggtctactgtagcattcctcttcttctttttttaaaaaaagagaaaaagttcaccgctcgaggagcgggcagttgtggactcttggagtttgtttgctaaatggctccgtctctttcttacaagttacatttgaattaacttttgttttgaagactgcaagagacggccatatattataattgcagttcacaatttgatttgacgacggaacggtcaatatatactatcttcattttaaattaaattgactataaaacagactagtgccccggtctatgttttgtgtcactcgaaatcaaaacaatggctagatccatcttgcgtaagcagtggttgagcaaaataaatgatgaatttaaaactatatgaacgcaattcacgtgttcgtttgacaaattagttggataaatggttcccgaagctaggggggttttcttataagtaatccatctagataatactctacatcttactgcaactccacgtatagtattcaacgaattaaaaaaaaccaatgaaccactgtcgccgctgtcatcgaatatacgcggccgtgggcaaccgcatcggtccacgccagcggcgaggcgcttaagcccgtctgcgaccatggcgtcctctgccacaggcacggaccgcacatcaagccatttgacgagattgaagaagaaaaaagaaaaggcaacgaagaagaagggaaacgggaaagcagctaacaacacaggatcgccccaccggtgcgccgtccgtcgcgctgccctcccgctacttaaagatacttacttcatcctagaataaatcaacctctcgtacaagatatgatatactctctctattctaaattgatctatatataattttttttagattattcctaaatgatctacgtatttgtgttgattcattaaatctattcgttatttatgcattggagtaaatggacattaacgtatgtatccatacacacacgtatttataacccatatgtaatatcttgattttctattggctaggaaatagtggagatggtgcatgcatgaagtttgttgctagagtgaatataacactataaaagagttattagcttttcttggtcttggtatacctataaaatatgtagatcaatttagaatggagagagtatcctgtaactatgaatctaaacatgcatttaagtcttataatgttttcacttcatcaatttttttattacacaacactaacatttactccctctgtccaaaaaaagacaaaccgtgggtttccgtgccaacgtttgactgtccgtcttatatgaatttttttataattagtattttcattattgttagatgataaaacatgattaatactttatacgtgacttatctttttaattcttttatattttttttaaataagatgaacggtcaaacgttgaacacgaaaatcagtgtttgttttttttttacggagggagtagtatataacaacactgttttacgacaatcccattgacttggttcgcggtcaatcacaaattcgcaatcataacagacgctccccaatccccagttccccaccccccacggccccacccacacacaacaaaaccaacaaaaaaaaatcccaaaaattcgaatagtatctgccaatcgtcctcatcgccggccatcgccgccgccgtcgccgccggccgaccaccgcgtccgccattacctcctccgcgaccggatctgctttccccaccccccctctctctctctctctcttcccctctgcacctgcatcgccatcacgattcgtcgattgctcgccaagtcaagtccactttgaaaattccatcccaactgcctccggcctctcccctcacccacctcgcggaagcgcccttatataccacgcgcttcgcccgccacggcgaccccgacgacccgccccgcctcgccccccaccgccaagcgccgccgcgtgctcgaccccgaccctgacccggacgccgccgccgccgcagccacggggaactcgccgctgggcggccgcggccgcggcggcggcggcggcggcggcggcggcccccgccaagccaacacctcggctccaccacgcggctcgcggctcccgctgccttcgtctggatcgcctccgcccgctccgtttgaccctttcgtcctcttcgcggatccggcgccgcggccggcgctcacgcgggaacaggtgaagtactgcaaggaggcgctcaaggtgttgaagaagaagctcaagcaaacagctgccattgacatttccaaggaattccatgctctcccggtaaaccaaaaaaaaaaaaaaatctccccccattttgcgctcgtcgtttatttcgtttactcgcttgataaacaattgcgaactggttcggcactaggttttattttagggtcgtttactcgtccttgggaattgtcgaattaaggaatgaactcagtagctagtcgaactgtatgatgataactacttaactagtgctattttgtcttacaagtttggttggtctgctgcatacttgcattgctttgaagtaaagcatcagggtagaggagaattcatgtgattgcatcatacggaaataagtgcattgtttcagtgccttttcagcgggataaaagatgattgcagtctatctttctcgtgggagaatggagatagctaacacgggccgttgtcttagcaatatcagtatgatccattcgatacgtatggactttagaacaatatacttttggttttgtggagtttttgttgctagtcctatgcttcacccaaactagtacgtgatgatgaaaaaggctatatttcattttgagtaatactttttatgtgtaattctagtcccgtggtctcttcaccaaaactggacatatttcttctcatttagttaactactgcatcacatgtaccttgatgcagtaaagtagttcattttgggggttgcgtaccgtgtaaagctattaagccatcattgttggaaccgattgtgatttgatattacaatcaacaatcacttatatggactagggatatgtatgctccatttcttacattatcttgggggtatataactgtattcttcatgtctctaaccccttacaatgatcatatacaggttatccaaatttatagtagtttttatgagacgagtagttatccaaatttatccaactatgaattattttttctagtggcatctcaaccatatcaaatgttgtatgaaccaactgattagacactcttttctgtacggagaacaaaactcatgaagatgagaagtcttatgacaatttcattcaaatctatatttgtgtcgtgttattgcacatttcaaaatccatactctacccaatgtaatggaaaactggctacactttcgtccatatatatgagaagaaacatgtattggactatgtattgttcagatgacctaatgtactgagaaatgttggaattgatttctcaattattattatttctttcaaacttcttatcaagtatgagaaatcttctgaatttcttttgaaattgagtgatataaagttgcaactcatttctccttaataaaacatttgaggcagcaagcattggttaaatttttgaatcctactattttttttttgtctaaacatgctctgcatttcttacaaagtctgtgaaagactgagagtagttcatatctggttctatatttcacaggacatacagacagcattccagacgggaaaatttactgctgctcaaaatcctgctaatagggaaaaaaaccgctacagtgatgtcatgccatgtgagcattatcaacttgtgttggctgctgtatgttagccaagagacctccatgacgtattattagtttgacttaacttctcttctttagttgatgaaacccgggtacgtttaaagccctcagcaagtgatcacccttcaagcaatgaatacatcaatgcaagccttatagaggtaaaaacacaggggcatatttcctggtgtttatgttatacacgagtttccatctttttcaatactgaatgtttcaaatcctagatgggacatgggacctctggatttgttatagccttataggttatttatgtggtataatatttacagactgatgaccaaggtcaaagtcatacaaagttcatttccactcaaggtcccttggtcaagacatttggggatttctggcagatggtctacgaaaaccagtgtcctgtgattgttatggtcactaaatttgatggtgccaaggtgctaatgttgtacactcctgaattctcagtttccaagttttatttacttgtctttacaacatattattgggttgctctttccctgcattatgttgaggctaccccaactccacttatccaactatgtcctacatgttttaatatttttattatcattatcattgtcatgctgaagtcttaatttcacatctccatggatccccctcttttgctttgttcaaatgggcatgaatttttttgttgactgttgcaaatctggatgcggctgttacatacttgcatgtatgcatcatctcagatggttttattatcatcatatattgatatgtaatctggccattggaagatgaaatagcttgcatctctatggagggcacatatacatcacctagattgtcatatgcaattgagaacataaaatgaacagaaaattaagatcttgaatctttatgcttgcgattgacacatacagctgtcaggttcagaggttctatgtaattcttaacccaaatacactcatgattgcttcgcatatgcatattttaacttgctaaaagccaattgcagtatgctgatctcaaccatgagttgatcctgcctgctcatattgcaatactttgatttctaccgaagtgcttagtgtaatctgatttggatttacaatttacttttggttgtctatttcatgtttggaattgatgtacagaaaatagcatggcatgtaagatgattgctgtgttaacaaattgtccttatgtaatcgattcaatattacagtagaatgagtactgtaaatacttgcatgacaattacagtatgatgattggatagtattttctgtcttagtttatgtttttgatataattgttttgagattatgactttgagaactactccctccttccctaaatgtttggcgccgttgacttttttaaacatgtttgaccgtttgtcttattcaaaaacttttgtgaaatatgtaaaactatatgtatacataaaagtatatttaacaatgaatcaaatggtaggaaaagaattaataattgcctaaattttttgaataagacgaacgatcaaacatgtttaaaaaagtcaacggtgtcaaacatttaggaatgtagggagtatttgtctattactggatgataccaaaaaatgtattaagttcattgatgtagacatacaacttgaatttccgactattttcaactaattactttaataaaattttattaaattattaactttgaaaaaatggcagtgtgacaggtatcttccaacgaacgaaggagaagaaagggattatggaaaattcagtgttaagatcacaaagttcaaatgcgatggtgtcttagaattgcgtggtttggaggtacagcagaatgaggtaaagattttcaaaggccatcagctacgttttcttgttgctattagtgaagtgtaaggtaggttatacttctgttcaaaaaacaggtaggttatactagcaaggcctattcctatgttttgcatcataggttatcaatttcaagattacagttgttcgtagatggatatatttaagctcctctttgcggcatatcttaaacaaatgaagaattacatctatatgcttgtatcatagctcagagatttccccaggttagggcctgcttggaagtccggtttttggcctaatgtgagtacaacacttctgaaaacttttacattctggacttggaagttgaaataggtgcttttatgggtcagtaacccattaactatccctatcttaggcccatacgactggaaaatggatgaccttggaaggccacactatttttcacacattttttctgagaaatctcaggcttgccttgagctcgagcttgctccaccctcctcgcctcagtgcctcattgccactgccacttctacagtaaccaccaacatcctcctggcttgaatgagcgacgcgggcctcctccagcttgaatccatgccactgcccccctcatattggtgatccaagttgtcatgtcgtctgttctcgatacagccctcctggagataggcagcaaacccattagcaggtgcagcagcggtcactctgttagttactctagagaacatgggcatcaacaacagatggcgatgccagtgacctctgccagtgctgagtggatttcctctgcctttgatagcatagcacacgcctcatcctcatcacccctgtccctgaatgtgcatagctttttcaatgattcggtctgaactttataccagtgagtataaattatgttgtgttgttgcatgtatagattcagaatttgctttccttgattctaaaacatttgttgtgtactcgcttctaaagcatgctattgggcaatacacagtaaattttgttcatctgtgctcgatgcattcaaagtgctccgtatatgactatgacttgtttgcttggttcccaaacagtattttacaaggtaaacaatcatgttaaggggggtgctactgcataggaaattacaactgtaatattttgtcaggtgtaaatatttaccaaacttccaagcaggcccttaggatgctcgtgtttaaatttgctgagtgagacgacaaattatccatggcatacaagctgtatttacctttagttgaatatattatcaagcttccttctgctatgtgtgttgcatattctatagctggaaacaggcaacccatcttattttcttactttttttttcttctcattgcttccatgttttctcctgtacttcttcctccatgtttgcttccctctctatttccttaagatgtcatcataagaaatgttccattgctatgctgaagagttatgaccagagtatctcctgactgctaatttctgacatttcagtcacttacagttcgccatgttctccacattctgtattctgactggcctgaccatggggtgccacatgacagtgcttttgtacgaaaaattttgaaaagattatatggcattccaaaagagcatccaatagtagcacattgcaggtttgattgaaattaatgccattcttccatgtgcacctatccctatacacaaactcaatactattgttttttctttctgcagtgcaggtattgggagaactggtgcttatatcaccatccacaacactatagagaggattttacttggtgacatgtctgctttggatctttctaaaactgtcaaaaaatttagatcccagcgacctggaatggtccaaacagaggtatgtgtggctctttatttctctgcctctgctacaaaatcctctgaatttgacaatagtttctgtatagtggagctggtatgtaccttagaagaagtatgttgttatttattttatgtactgcagttagtgaacatgtgactcgtgaaaagtgacaactgtaccctaaatctgacgcttagcctttttttttattacaaaatatggtgctccgttgatcttttgctttgtaaggacagtacgtataaagcagcaatcggtgactttcttgtctttaaggcttagttgggttttctggattacggatatgctttagttggattgtcagaatattatccatcgaaataacagtgcctgaggctacctaagagtagcacagaataaggatcactgcagatactgtcctaattcaacattttactctgcaggatcaatacaagttttgctatatggcaattgtctctgagctgaacgacctgctatcaaattcaaaacactgaatcatttctatggtatgtttcttgcacgagggccttactatacgcactatccattacgcggtatcacaagctgtacaaacatatgcttgtttgcatcagtaatctcgaaatgttgcatatctcaattctcgtctcatatcttctcctctgcaggaacaatcagtgccctgggtatctctgacagattgtcgcccttcaactccctcaattctttaagcctagctaacagcattcatgtatgctgatgatgtacagcatgaagactgaaaaattcatgcttcagcaggaagctttctctaacttctccacaccaagaaccacgtgtatgatcccaggttatgcctggttctgtatccaaagctgatgatgatgatacaaggtttggaaatttgcagcggcgcttctcctgcccacccacctaactttgtgattgtttggtagcttctcctgcatcatgcatatgatgaaatttttcggaagttttaagactcagctttgtcacttttcaagcagtagtgacgctgcccccatttgtttgtgtgtgtgaggtcaaatgtctggagaagattgaaacggctgttgctactgcaaatgcagccacttcttgatgatgctctgttctatctctagactgtctgtttctgggggttgaggagttgaaaccggtgttgccaagcagaatggcatcagacatctcgagatgattttgttgttatctgtcagtggagttttcgaggggaaaatggacggtagcggaatgggctattggggttccagcccaacgcgaaaaagaacacgagtttttcagaggtgaaaagaaaaatttaccatctaaacgccgtaattagtactaaaacgtaaggggacgaccgaaaagaaaaccattggatcctgtgctttacgctagattgacatccctattctaagtggtatggtcatattgcaatgtaaaataaagacatgttcctaatttgtgtattaaataataaagacatacacgcaaaaccatcaccgtgaatgtactcatctatgaatattcccgaccttgtcctggctatacgtttattgtgagtgaggggatggatggtctatatgttaacgaaagagaaaaacaagttagattggtctactagtttctaagggataatgtcaatatgtatcttagaagaatatttcatttcaagaatgatcccgttccacctgttctctaaccaaatactttcattcaaaagtagactcacctgttcatcttataaatcaaacacatgcttacatgcccatatcacaggagcgactttctaatgtttgtaggagtatgtacaaaaattgccaaggtcgttcatgtaatgcacagtgaatggagatatatataatgaggtttattttaggggtaattaaatttaatgagacgttccagagggcggcttctgcaaaggagcagcacatgcacattgttttgctcattatattttaccagtcccctgagttaaaaggcagtgacgtaatccagcatgtaaaattttaagctatggcgatcacttaagctaaaacgtcattatgcgagttgaagtttaacaaagacacgaaaaaactcaaggtatttaattaattagacccactgtccattttgtctaacagttgacgagaagcaaactagattagattgctagtaaaaaaatatttgacattcaaattgtgcaaaaggggaaattaatctagcatttgacttctgctcataatgtgaaaggttccgttcagatcagggggtgcaaaatttataatgaattcttcgtgaaaaggtgagagtaccttcacgaagggagtacatcacatcacaagatgtgtttaggcaagtaatacaaacatgatgacgcttatttaataactaagtccattgactgtgaaaagcacatgggaataattccctattgatccctacctagtttattttccctggtataagtaa

SEQ ID NO: 56827 - DNA, 18767 bp, Oryza sativa
tatgtgaccgccagccctttctcaaacatttaatatcattcaagtaaaaaatatttaatattattttttacttaatcgttaccctaccaagcattcggcgcatgcctattaactgtaacacacacccttcctcggtcccaccaccgcctccttcctcggtcccaccaccgcctccttcctcggtccccaccaccgtctcctaccccacctaccatcaagttgtccactccatcatatccccaccttcctacacaagtgtagctatctccaccgcgccgcacccctcgtccgacaatctttgccgtcgctttgaccacaagcttcgccgcccccgctcagagagaggtaagatctaggcttcacaaatcctagagggggtgtcgaagcactaatcccgaagaattcaccaatccacaggcgtggttttcacggggaaaacaaaaggtttcttcgatttttctaaatctagtatgcactctttcgcaatctagtatgtgtacctttgttttgcttagaaacatgccatgggtagtacaattttttttcagcagtgcatacttagctagctcttctggcatatgactaaccaaaactggaaatgatcagagaagtatgctcgatctactcatatatttttattcaggagaaaaatagagcagatctgatatgtgtgtgtgtgtgtgtgtgtttggggggggggggggggtgttgaccatgtcctgttctctgcctgatacaccagcagtcaaccattaaactaataagagagaagaacacatataataaacctggatttaatttttcgaattctttactgagtagacttttttgccaccaccctgttgctctacattaaatcgcctcttcaatcgcttcctcctttttgctagctgctccatttttcctccttcgatgttcatctctgaacatataaacacgttcttggcattattattcctggttcttgatataatcgatccgagctgtttttatgatcattttgcatgctctccatggccaacctctcgtgttcgtccatggtcagataggatctcgtccgcatcatcacacggtatagtttttgagttctttgtgatcagatcatgaagatgagtcgtttctgctctgtggttggcatcgtttgcggctccccgtcgtcttcaggcgatgaagcttttgcttcccatggcgagcagcagcaggcgacgacgacgacgacggcgcagtcttctgggaagagctcgagctcgaggaggaagacggcgccggaggcctccggcgagcacaaggcgggcggtgaagcgccgccaccggcatccaagaagacagcattgctcgacaagggcaaagagaaggtatgatatctataggttactactcatgttcgtcttcatcttcttgtttgaagagcagatgctactctttcttgatgcttgctaattttgtggttaaaaactggatttgatgcagtggttttatgcattgatttgatttctttgggatgaaagtttcagaaatggtggtgttccagggagaagaatatgctagggcatcatcatgcatatgctgggttgagataaaaagaaacatcataaatgtgggatttaggatctacgttttaaacatattcacattttttttttgcggggaagacacattcacagttttttaatttgtggggaagacatattcagctttgtgtgtgtgtgtgtgtgtggaagacatattaatagattttttttttatttgtggggaagacatattcacagtttggttatgtttttgcggatcattcatgaaaatgcaccatttccttttaaaaggaacctatctatttcaatatttgtgatgtggctaatcaagaacaatacatcgtgcatcaattagactaaatctttctttgatcatttaggtatcagaaatggacacttctgtcaggagaaccagcaaaggaatatcaggcaatccatcagaggattccaacgaaccagtggctaaatctccgacactgaagaccgtgatcggcagcataaggaactatattgctaccaaaaagggtagaaaaataaagatcctggcctttgaggtagccaacacaattgccatgggttccaacctgatgaacttcctctccgaggaaaacataaggtacctgaaacgtgttgtgcttcagaaccaaggcgtccaaagtctgatctcagatgatcagagccagttgcttgctcttgttggggatgaaattaggtaattaatgactttttctataaatttcaatgcttttactatttatataaattattacttatatgtgtttttcaagatttcttacattcattgggcttggtttatgcagacaacagttcaaagattttgcggcatctgttgctaggcttgggaacatgtgcagggatcccaaatggcacaatcttgaagggcatttctctgggtaaaattttagctgccaccacattactgttcttgtataattcatggctcaatcatattttattctatctgagtgttcatttgtgtgcctcttgtcactgcgcagattggagtatggtcccataactcaggagtattcccatgaaaaagcagcatccaagatggaggatctgatggaacttgtgactaagacaaaggtgtgttagtcacatattttctaatgtcattaccactgttggttcaacacattttctttttaggaaccactgaaatgatgttgctgttctattttcttctgtgcagatactgtttgaagcattgcgccgattgggagtctccgagaagatgtacagggaagccaagcagacaggtgcttcccaaaaccatttgtgtgatcagcacaactaatcagaaatatgtctatttatgttcttcacatcagttcttaacatttttttatatgtgcaggtatgccacttgagactttccaaaatgcggtgaacattgaaaaagaaatcgtgcaaagcgcaaagaagaaagcactttgggtcaagaagattgaaaaagtacgtaaaaactgtgtgatatgatgattaatgtttatcacatttttcaataacgaatttatgttaaatacacaaatgctgtttctgttgcagattgtggaggaacttgtgtacattgtgcattacttgccttctgagatcaattgtgtcttctacaaggaacatgaagaggatagatctgtgaaggctaatgggagccctcagcaaactttagggtctgctgatctccagctgaattacgcaaggatcgttatcgccatacaagttttggtaagattctttgacagtcattaggccattgttctaggatcttggtcattgatcaagtgtagtcgtgcatgatataaacatatttccggttttcagttgatttggcacactaactgaaatgtcgaaactgattttatttgttcataaagtttcaatcgcaggtatccgtcgcatcatcggttccgcaatgtgctgtagattcattgttccatgcactgccttatagaatcagatcagttttgctacctaggatgagacacggcgattttgacgaccaggtgaccactcttttctgtcaattccgattacctgacaaaaatgtgtatcctgtatatactgttcatcttcatttctttctgaactttgcatcttcttattgcagaggacagaaacgcagatcgccgatgagatgaccaggagacttgaatggctctatccaatggcagaatttacaataaggtactgtaatctcttgccatatacaccaggttcattcaatgaataataacctgatgctcaccttgtacatatctgaacatcaggctgtctcagcacactggaatgatcagagaatgcctggtatcagggtatataactatgactgtcgtgtctattttgtcatgaacaatatgcaaaagcacaattgctgatttcactaataattcctcatgaaattcttgtaggagcctcagtgaccgtgatcaacgtaagatgctcaaggttcagacactgtaccatgctgataagatgaagactgatggctgcatcattgacatggtgatggaccttcatcttctcataaaagccgcgagactgagggctgatgcgccgcaccatagcggtcctcttgatcaaccagtgagtaccagtggatcatcaaccagctcggctagcacaggcatcagtggatcgaccagcttcggtaacattagcaccacttggtcagatattgatgaagatttcatcgccgtgatcgattagattcaaggtgtagattccctgcaaattctgatgtagggagagggatgcctgaaaatagagagggttttagctgagaactgagataatgcagaaatttagtttatagctctttagatactagacaaggttggtttaatgttcgcgcaatatttgagttcatgaatctgtatttgaggagctcacatgtacattttgtgcaaatggttggaagagagaagaaaatgtgctgaacatttttcctccaaataatcagaatttcttctccaatatcatatatactagtgtgatcaataattaaagatcatgcttaagcagggaagcagggatgcttttttgggccacttcaccttaagatcatagtggggatggcagaaaggagcagtcatgcttaaagcaatagctagtgctcttttttttttctaaaaaatgtcaaataaccttgataagatttctgaacttttgtcatggatgttgcacgcgtgcagactatacgattacttgtttgcaggtaccatcattggcaaattatttttgagggtaacaccattggcaaatcgatgagtattttttcctcaaaattgacacttgcatcttgcaggggcttaaattagcatgaacactttctcaattgaatggtgatgaacaacataatgtgtctacaacacatgtgctgatgctttcttgtttactcttctactcaatgagatactagtatatgatttcaccattgtttagcaatgagctgactaaccaaaactgcatcaatgcagtctctgcagactgaacttagtttgtgaagtaaaaatgtgcatcacacattttcaggtaaggaaataaataaatgcattatgcatcacaaacaaagctcccactggtttaagaaatcaggattatatgacagaagtttgttaagcctgcaactaaaagttgtctgtgttcttcggtatagtgtgttactgcaaccaagaaagttattactgaaagactaaaccaagaagaaccaccttttatagagattctagaactccattttttttgtatcaagatcaacactgcagcaactaaactcccctgtgttcttgagtgaatcactttcaacaagggccattattttcagaggagaaggcaaaaacactcttgtgaaaaattcagagaaatgcaaacgctttgtgtgaagcatcatctccatcttgttgtgatcagtgcatgacgtagacgttgtactcgacaatggcgtcgccggtcttgaggtccagggtgtgcgtcctggcctgggcgtagccgcgggcgaagcggaaggcgccggtgccgccgatcaccggcatctcccggacgtcgtcgaaggggcagttgcggccgagcacggtgaccacgctgccgttgtaggtgccgtcggtgaacaccaggttcattgcctggaggaagcccagcttggcctggtctgagcccatgtacagcccctgggcccggcccatgggcttggactcgggctcgggcccctccgtcagcggatcgtccatgacgttgatcatcccaaagaaggaccgcgatgacgggtccaccgggtccaccacccgcactgccgtcggtgatggcttgctcaccttgtcgtggaagtagaagtgcaggtgagtcgtcggtgaggatgctgacccgcggcgggccaagcccggcctggtttcttctgggcgggccgccctcgcaaccgccgcaagtgtgaccacaagggtgatcaccaccactcccttggcctccattgttgagctcaatgtgagcaaccaagctagcttcttgctatcgtgtgagtgagtgtcactacttgatgtgttgttcaggtgaagctcatgagctacttatatagcagtgccaccatggtcttggtgtgatgagctctatggcgtgcaagggaaggcgacacgtggcgggcggcgattggtctcaaaggctggtgattccaggtgaccttgtagtactggaagcaagagaaaagatcacaagtggtagggttgatgagcacagatgcaatgttggctttacctttggaatggcacaaacggaggcatcgattggttgcctgtggttgtggagcaaacactggaaaaagttttgtggttggtcggcttctagattgtgtcaaagaaactgatcaccaagctaagatcattgtggatcatatggattattttactagtagaatttctttgccactaattgcagagggaccagatgatctgggttgaagctactggtgtacgaaatcaaatcaaatcagatagtttgcccttcttgttgacggagacatcttggacatgatgacttggatgttggtttcagatgttggtagaagtagtcgttgaagcttgaaagcagctaagctatactacctccgtaaaaaataaaaaatccaaactgtatgggatgaaatatttttctagtacaacgaacaatcttatgctagaaaatatcccatccaatattagttgttgtttttttttgacggagggaatagactatagggtgatctactactactgctctcctatctctgtcagacgctcttcatgcgctctgaggcgcatactagatcgatcactagatgaatttgttttcacaaaatagatgaaacataattgtactccggaccatcttggtttgaagccaagtcataccaaattggtgacccttttaatagtactttgttagtatttgttttgctatcaaaatgtgccaagaacacacattttgataaaaaaaatggtgttggagcaaatccaactagtgtattctagccttttctgttgcgttcctcctcttcaatttggggattatgtacacatttatagtctgtacaagacatgggaaattacattcataaccctacagacctaaacccttcccagtgagcagataggcccacctagggggtaactgagtcatttcctgggagacaaatgcagggatggcgcccattaaggcggcatcttggctcactttggggttcccctgatggcccggctacaggctattacttaggtaatatccctcccccagtccatggcgagctctggtctctgcctcaccagccgcaccagggtgtccgagggtggttggcggctactagtgcgctttaatgaacgcccatccttgctgatgcctcgggctccgtcaaggaagggagatgctccgaagctggtctccctcagagctgttgcgaagccctaatggagcctcacctccggctcggtgacaggggattcccctctggagccagtcagccaggccacaatccttagacttggctccggtggagagcccgaatcctccttttgggtcccctgaggatacctccgaagcggaggcccccctcgacgcattaggaggctctccggaagttgctgaggtcgaagctacttccccaacaatggcactaccaaaacataccacattgccatctttttggcatagtaccaaatcaaacaaaccctccctccgtaacacatgtcaggtattagctttttacacggtttccaacatatactatgactattaatttcaattctactatcatgatacttctatatatattatgcatcatatgaaaatgtatttttaaatacgaatctaatgatacatgcatgtacaacactattagtcaaaatttttaaacatagacattgttgaaaacatgactttttatattttaggatagaacgagttgaacggatcgcaacgaaggctgaggttgaagataaactttgaaggcaaccggattctgaaattctttgtgtacagatgtaactgatgcttttgaagtagtgtctgttactccttcccctatctgacaacaaacaggtcgatcacttgaggcatactctcaaatgatgctccagctacaacatcaagaattcagctctttcaggagtttgtcagtgtgacacaaaacttctctagagaaattcagctagctgcaaaatactccttgttgatatagttagacctagtactgaacttgtatcagctgaattctgaaatgtatcaacattcaacaacagtaatcaggttaaagagagtcgagcatgacgcatgggttacgtcgtgctgacctggttgccgacatatatctggtaaccatggccatatgggcccacacagacagtgacacctcctatctctcaacgccgtatatatctttttaaaagaagagtaaatttatatagccataaatacttagatttaacgtcaaatttattacagaactacagatttaaaacatcgtatcacaaaactatatatttagtgataaagttataaaaaatacatattttagagtttatatccatagtattattgaggttggaaaaaaattgtagtttatgataaaactgatgttttaaatttgtagttctctaatataatactttaaatttatttttttgtgaaaaaataatgtcaaatatgtagttttgtgattcaattcattaacactcatttagataaaaggaattacaaataaattttgaaggatttcgattcttaccaaaatttccctattagcttcttttggaaaaaaaaaccctttcttaccaataacccctttaactcctaagcaatatactcccttcgttccaaaacgtatgacgccacttacttttcacataacgtttgatcattcatcttattaaaaaataaaatattatttattttacatatatttttacatattatactaaattttttggacgaataagctatacgacatttttttctgaggaatcaatatgatattgtgctatttcattaaaatatagaggtaataaagtaaaacccctaagggttaaaagagaaaactatacatggctgagagcggtctatgctagcaaggtaggaggtctctaagcctctttgggcctgtttgagggagcttctagcagcagctgttagaagctcccccaaataatccagctttttatccagattcttagaatctgtagctgtggaatctgaaaaatgaactaacccagcttctccagattctcatcagctgcttctcagaatcttaaagctcccctaaatagactctttgtcctggctacaaccaagctatatgacaagatcttatatataccccatgtttttttccctttgagaagtcggatgtgttctcgtctttcctctctagtatatctcctacaaaacaagttcctctaaaattcatgtgttttatttcctatggaccaaccaaattcgcgatcttttaatgtggtttttggatcatagggactaattttagtcactgtcatatcggatgttgggacactaattaaaagtattaaccgtagactaatgacaaaacccattccataaccctggactaatccgcaagatgaatctattgagcctaattaatccatgattagcctatgtgatgctacagtaaacatgtgttaatcatggattaattaggcttaatagattcgtctcgcattagcctccatctatgtaattagttttgtaattagtctatgttcaatactctaaattagcgtccagtcatccgatgtgacagggattgtccctgtatccaaagtgccactaaattcatatgttttaaaaatcctaaaaaaccccgatgtgtgagatatctttgtatgttttccccttttctgtgtcttacaagccgtatggtgcaaaagaagcactaaagcagagcacaagacgacacaacccggggactggctgataataaccgcttgaagagaccagcggttaaggtatcttcgtcatcaccggtgagtactgtgaatatgtgcgtgagatgaattgaatgaggccatatatcgcacacaacaacggtgtgacatcgcgatcgaatttgttaggagttaggtggcaggaatttggagcaacttggagaaaaaaaaaggtgaaagaggacacaaggatagatatggtggctattggtcagataccccatattgtcttacaattatcgttcaggtattagccggtctacgggtgtcttaaaatgacctgcccatatgtgataaaaaaatcattgtggccagtggcggagcggcctggccccctccaacaaaaatagtttcacatataatcacctatctataattaggtaattaacctaattagtgtattaataattatataattaggtcccctgcaagacttttaggctcatcctatatatagccaaatcctggctttgtcactgattgtggctcatgagttttcgatgctgcccgaagcatagagtgccgccgggcctgggccgcccatgcatatattataattggttggcctacgcatataattgtgtgaattatgctatcactgaaccagaacgtttgccacaattcagatgtgttgagttgttgaaagtatatgcatgtgacaagttatattcatgatatatatgtgtaccactcttcatgattaagagcaatagtaatgcgtcccaaaattttaccgacctcacataccacatagactaagaaccatattagctatatactccacaatgcatgttacttatagtgggtcttacctatctctctcctcacttttatctctccccctctctctcctctcacttttcccaccagtctctctctctctcgggcggaggaagcgaagcggcacctgtggcgagcagggctccacacctccacctctcctcgtcagggccggaggcagcgatgtcatcgtccgagcccaaacctctccactgcctccttcgccgtgggtcaaagctgccggagccggagccattgctcaacctcccgctcctccgtgagtccatctccatccctgccgacgagccggacaccaccaagcacaagcgagcatcggggcactgcccccgcagctctagaagcccaaacaacatcggcagtggccgccgccacggccacaacgatggcagtgtagaggagaggtggtggcatggcccaagcggtgacgacgccgggcggggctccacgtcgggcaggcaaaagatgcggacgacggcgccgccgagttacggatctcgggaggctcttctccctctccgtcgcctcccttgtcggctccgaatcgacctcggcggcgcggcctctctctcttcgtcgactccttcttccaccttctatcttcctcattgctgctgccacgcagtggcagcctcctcgagctcacgctgtggcggcggcgacctccccgagcccacacgtcggatctggccgaagaggcggtctaggcggtggcgtccccaagccctcgcggtggttgcagaaaagttggaggagaggagcggcaacttcggatccattgtacccgcttcccaaggctcatctcccttgctttttttgacaatgttagctgaaaaataagtgcccttatttggacgcgtgggcttcaggtgggtagcgccagagatggatgtggtaccaaatctccaacgtgtcacacataggctgaatgcaaacaagaagctcggtgaatggcctaactactcccgccatcctataatataataaccttatatacattttttttatcaagagcctgacgggtcccatttcttttattagaaataaaacatcgagctacagtagtcttcaaaaagaaacaggaaataaaaacggaaccttccacagagaaatgggggttaagaattcaaaagctagccctattacaaggggttcctgactcttttcagaagttttgcctgaacagatatctaacagcaaaaaagaaggagagggaattacaaaacatcatcacttatatctatctcatccctcaatccttttattgttgattctccatccgaactgcgagttgtagacttcatttgccgccctatcttatgagtctggatcccagtagcagtcttcttcgacttgcctcctccttttgcagtagtgcccaggaatcaactcaatggcaagccaaaaagatcacatcagtggggtcttttggataaactttttcaaaacaagctttatttctagatttccagatggcccaaattatagcagccattcctaccataactaagtctttcatgttcttatcaagtttttccaaccaatctccaaaaatgttttgactatcaagggctgggttcagattcaggacacaaattgcagtgttccacattaatcttgccaggggacggtcaaaaaacaagtgttgcacagtctcctctctatcacagagctgacattttttatccccttttctccagcctctcttgtataaattgtcttttgttaagatcctatttttggtgaagagccacaaaaaaaccttaatcttcaaaggagttctgaacttccaaatttttttctgtgggaaatgcacttgttgtagcttcaaagctttgtagaaagagttcacggttccatccttagttaaattccatcgtagtttgttattgcagttatcttttaattgcacatcaccccaactagtacaaattttgtgccaatctctcaatctccctccactcaggtctctcgtaaacttgatgcaatttatccctttttgtttcagttttgccacagttatatgttttgtcaaagtgatgttgtaaaggttggggaattgttcatttaaaggtttgccccctatccagctgtcctcccagaaaagtgtcttttcaccattgcctatcaccttggagcagaatttcagaaagatgtttttgatctccatgagcccatgccagaaatgggagtctccatttttaaatttcaataaagatatgggtttgcaacccatgtatttactggtcaaaaagctttaccaccaaccttcctcattttccaatctccagatccatttccttaacaaagctttgttcattgtttccaaatctaggatccccaggcccctttgatctttgggtgaacataccaccggccattgtaccagatgataaccttgtatatatgatatgacacattttagtgctatgaatctgggcatgactcgattggtatattttacaaacgaggtagtaaaagcagtaccacatgaaggcaagaaacagcgatgactgttcagatgggcctctcaagctcattcattcaaatccattttctctatgggtttccggaccagtatatttcttccaattgggctcgcagggaaaccactactctcataagagaaaaaaagaaaaaaaagaaggccacagcccacagcaacacatcgtattccttcccccgttacacttacacaggaagaaaattttctgttaggagtaaattgcatcgccggtacacgaacttgttaggtggggcaatctagtgcacgaatttgtaaaacacttgttttggtgcatgaacttatctggtgcgtgcggaggaaggcaaaaaggacattacatggctaatcttattgatttaggggatgattaggatactatgtaaacatatatctgagaaggttactattagatatacacctcttcaataaaaaaaatagaataggatatagtgatagtagaaaaattttaaaaaagcaagcaataatataaatgttagaaatatatgaaattcatcatttccataatgagggataaagtagataccaaatttataaatatggcatgtcttatgcatgcttactacacgtatacacgtcacatcctaatcaacatcaacttcgtaaaattaacatttataagttattttggtccttgtccgcatgaagtagacaagttcatgtaatgaaacgagcgttttacaagtttatgtactaaattgtacccacctaacaagtttgtgtatcaccaatacaatttactctttctgttagtatataaaattaatataagccctccaagtcacaaaagctagcttaatggatacgattttttttcttttctttttgcgaaacatggcaggttatattaaaaagcaaataccttttgttttactaccaggaatgccattgttgagtaagccatattcaattacccgccagcaaaggagagggattgctgaagcgtacagtatcagccaatgaaccaattgggtagtagtatatcaatccatagatacagtagaatatcaaaataagacataggcactgtactcaacaatggcatccctggtgttgaagtccacaaaataggttgtaaaatcaaaggtgtttttgattattattctgtgatgaacaattgggcattggagattattggttttgttatttagaatttattcacgaagtggttttggagatgattggatttcacaggtgaatctataggatactgctgttatttcatgttaccgatcagaccgggcagtgtgtgccggtcagaccggtggtgatcgagcggtcggaccggccagcccgcggtctgaccggccgatgctgtgtcggtttcggtttctggttgtttatttggatatccgtgattatttcatgattatgacttctagatggatactatacgtatgtaatactgttgtttgctactaatgagtcaagttggagatagcttggtctcggaatatggtttctttgtttatttcatgtgtaggtgacttgatgtctcgggagagtatttgcggtgatggaccgggagtcggcttggggataagacgacatccgtggtggtcagagatcatgcgggatacttaggctagagttgatgcacgtggttgatagagattccatatggcatacgatggaggtattgtgtgcgtatgggatgcggagtcgaatttagaaggagtccaaatttggtacgattggttatgtaaagtttctttcttgtactagagggtttcctaaggtgtttaggactcttagtatgagtttggttcgtggctttaggctgcctacctcatgtataaatagagggggagcgtgaggcttcccggtatcgcttttgagagcaattgagttgagttttgagttagggtttcgagtttagttgaaatttttgtaaggagtgttgttggtgcactttgtaaacacagagagaatcaataaagtcatcatctactttaagagttcttcgatttgtgtttcaccgggtttcggcggtctaactggcaactcaccggcggtcagaccggcggcattgcggcggtcagaccggcgggagcacggcggtcagactggcggcggcgacaggcgcagcaggcgatctcggcggtcagaccggagattcaacaccggtcagaccggtggcatccactcggtcagaccggcagaacaacttcggtcaggccgacttccgtcgatttcgagggtaacttttatttccgctaaaagttttcggttttagggtataccaaccattcacccccctctggttggcttagttcttgtgattcgatcctacaagtggtatcagagccttgttttcttctttggatttttatcgatctagagtttttgccatggctactcccgctaggttttcaactaagcctcatgttttcgatggaactgatttttctcattggtgtagtaggatgcaattttatattatggctgaagattatgatatttggagaaaagtttctcatccttatgtgattcctgaagctattaatactgctgctgaaaaaaccgcttttgaacaaaattgcaaagctcgcaatattcttttgagtggtatttctcgttcggattatgatcgtgttgcccatcttcaaactgttcatgagatttggactactttgagtaattttcatcaaggaacaaataatattaaagaacttcgtcgtgatcttttcaaaaaggagtatattaaatttgagatgaaacctggagaagctttggatgactatctttctcagtttaataaaattttgagtaatcttagatccgttgattcttcttgtgatgctaattatccacaatctgagatttctcgccactttttgaatggtcttgacatgtctatttgggagatgaaagttacatctattcaggagtctgttaacatgtctactttgactttgaattcactttatacaaaattgaaaacacatgagatggatgttctttctcgaaaagttgattctaaatcgagtgctttagttttttcttcttcctctttggatgttgatgcttcttcatctaagccttcttttcttgctgtttttaatgccacatccgatgatcaactcgaacagatcgaggaggagaatttggctttggttgctaacagaattgctcgagctatgaataatgccaggaacaggaaaagaggtggtccaaattgttgctttgaatgtggttcaattgatcatctttgttcgcattgtcctaagcttgggagaggcaaaaagaagacaaagatggtgagaagaccaacaacaacaacaagccgaagggttcataccaagggaggaagatggagaatcttaggaaggcttttcaacaagtttgcgccgcgttcgagccactaagtgatgtagatggtgagagtggagatgatgataagggaaagaacatctccgatgtttgcttcatggcgcgtggtgaatctgacacagagtatgaagataatgaggtaagtgcttttgaggaagctattaatattttgagtgaaaaaaaataagaagtgtgagaagatgtatagaaaataggaatttatcattgaatctcttaaatctgaaattgctagattaaaatctcttattcctaatgatgatgattgctcaaattgtgaggttttaatgaatgagatttcaaaaattagagatattaatgctgcacatgatttgaaaaatagatattctcttgcttgtagttttgcgttacacacacgcactttggatgagttgtttttaaccaaaaagttgttgcaaaaatatcgaattgcttttcatgctagtttgatgtttaacatgatttctgctaagaagttaaaacaacctcatgatgttttggattgctcaacatgtaatttgaataagttgaaatcgaaagatgctttaggtcgtgttgagtacatggaagatgttgtgaaaaacaatgaagtgctttcttgccctaaatgtcgtaaaagcaaaggtgtcatggtagattgtgaaaattgtgctaatttggaaaaagaggtttcttatttgaaaaattctttgctaagattttctgatggtaaaaagaacctcaacatgattttggatcaatcaaaggttagcacacataatcgtggttcaggttttaatccttatgctcataattctagacatcctcctgttgtgttatgtgttggtgctagaaggggtgagattttggttaaacctgatactaacaaaactgtttttaaatctgctggtatcatgtctactatgagtgcatcttcttcaaaatccaatgttgtgcatgcaaaatctcatgttgttgcttgtgttgctaaatcttctaattctaccaatgtgtctaatcatcatgaaaaatatacttgttctttttgtggcaaagatggacatattgttggtttttgtttcagattagctcataaacagaaaaaggagagagagattgcttttgcaaaatcaaagtggcaaaaatctggttttccctcgaggaaactggtcagaccgtagtgggtcccgcggtcagaccgacgaccggtcagaccggctgaatagcctcggttagaccaaccaccggtcagaccggcggtgaagcctcagtcagaccggctgcacaccctcggtcagaccggcctcggaggaatttttctgaaaattctaaaattgattttgcatgtggatatatgcctattggatcttctggtcgtgtgtctcagtactggatttctaaaattttattgtcatctaatcccagtactgaggcttcgacttctgcttgtgtgtaggctttggtggcaaggaaggagaacgtgtggatcgtggattctggttgttcgcggcacatgaccggtgataaaaattggttctcctccctaaagaaggcatctaagactgaatcgattatttttggtgatgctgctacgagtgccgttctcgctacaggtatggttaaggtaaatgagaaatttgaattgaagaatgtagctttggttgagtacttaaagtataatttgctttcagtttcacaaaatgttgatgaaaattttgaggttcactttaagaaaactggaagtaaagtttttgattcttgtggtgattctatgttgaatatttctcgctatggaagagtgtttaaagctgattttgaaaatcctgtttcacctgtgataacatgtttggttgctaagtttgataaagatgtgatgttttggcatcgtagacttggacatgttggttttgatcatctcactaggttaagtggtttggatcttgtttgtggtttgcctaaacctaagaaagatcttgatttggtttgtacaccgtgtcgtcatgctaagatggttgcttcttcacatgctcctattgtttctgtgatgacggatgcaccgggacagttattacacatggacactattggtccggctagagtgca

SEQ ID NO: 56828 - DNA, 4565 bp, Oryza sativa
gcatgacttgccttgctctgctgctggaggaacctcggcgactatttcgaaatacaccggagcgtcggaggaaccggaatctagcgacatacaaagcaaacattgcaaacaggctataagactactgaaacagggaacaaaaccatttttaatggattctacacatttttcttgatttactgagacttgaatgggcttaaacggaactcggatgaattagttatgagttttagaagattcactgtgtttattactataaaagaaaaaccttaaatcatttattgtgcaataaatcccagggctgtcgtcggcacggagggggggggggggcggcgccgacatgcggggcccaccggtcagcggctcgggagagggaggaaggggcgccggcacacggggcccaccggtcagcggctcagggggggaggaaggggcggcggcgacccggctcggcttggctcaaggccgaccgaccggccgcggcgacggcgatggcacgcgcacacgcgaacgcgttaccggcgacggcaaccggcggacaggcttcggggtgccctaaggaaggaagagagagagattagagagagggagatgaaccacggcgaccggtattcatggccgaaagcggcggtagcggttgaactcaccggagcgcgaggggatgcgaattccggcgacgaaactcgacggggaaggggcggccggggtggagcttagcctcgcgaacccgacggcggcgacggcgcggtgcggcggcgaccctagcggcggctagcggcggccggagtagtggaaacggcggcggtgggtggttgcacggcgcgggagcgatggggagctcgggagagttcggcgaaatggggaaaaagcgagagggggcgacggggaagcctaaataggggaggggagccccggacgtggccggtaggggagggatttcgccggccaacgtggggagtgggggagaagagagaggcgggattcgaaaatcgaatcccggccatctcgggcgcgggcgcgggcgggagagagaggggagtgggcgcgggagatgcagcgcacgcgcggacgtggctgacgtggcccggagaaggcggaggcgtgggcgcggcggcggttgcgggcgcggcggcgccggctggaggaaggggacgggtccgacaggtggggcccacctatcggcgtcccggggagagagggaggggcggcttggctgggcctcggcctgcggccggcccagcagggaggagggagagaaaaggagagaatgggccagtggcccattcgaaaaagggagggaaaaataaaaagaaaaaggagaaaaggatttcctggaattaaaatattgcttgctcaattttaattggttaaaattatttctagggctctgaaaattccactaaaaatcctgttagtgaatttcgacatgtagaactcaagaaaaattccacatgccaattccgattattatttgcattgatttaaaagggtttactcttactttgcactggtattttcttagggtcgcttataaattaaatttttggcttgggaggagaacttcggggtgtgacaggtggtgagcatgatgttcgttgccatcaggagcccgatccaggtttggtctgacgagacgtacatgccctgggctcggcccacgggcttggatctcgaattgggccccacagttagtaggtcgtcgaggaccacaaccatcccgaacaaggtatttgacgtgttgtccggcgggttcaccatcgtgaccgccgatggggaagggcagctgaccttctcgtagaagtagaagtgtaggtgtgtcggctcggagccatggcctgaggggctaggcccaggcccaccatgtgtgtggcccttacaactggctcccagcacaaggaagatcataagcattagtgctaatctctttgccatttttgatcttagagtggttgtgctgagtgatataactcgaccatgagctatttatagaggcatggggagctctaagagctagagggttggacgatgatagatggaagttttctagttgacttgtaactattgtagatcgatcgagtgatatttaaatataaacctacaattagattgtatatacatgtggacagtattgaggcacatcgatccatacagtgttgactataggtaaaatactccgatacacttggtttggttacttaagtataggagtaatagtatgccgtctggcttttaatagttaacactattgacttttatacatatatttggagactcgacctattaaaaaaatataattaatcttattttgttacggtttattttattgttattgtactttaggtatgacttatacttttatatttttatatttgtacaaaattttttaaataagacgattaggtagtcaaaagtaagttaaaaaataagcgacgtcaaacattgaaaacagggagtatttgttttcctcgtcaaatattacatggacatggaaagcctctaagcaagttgctaatgagctgttaaccacacccaaagttaaatgcacgctgagccacagagagtctcagagagtataaaagaacttgcatacatcatacatgcatgtattagttagaacacaagattgatgcacaagataaagctagcaattgtcccagtactattaagaaaatcatatactataaaagaaatatttaagcaattacaagaaggaattattttatttaccgtgaattaaaatttggagatttgaccgcaagcattaattcagagtctttatctattggcaagttgctagtggctatggccacttataaattcctcataatatctattttttctcagattttgtttcattaatggtttttctttgcatatatatttgaacatgaaaaagaaacaaacacaagggtattacatcagacaccctatactgtcgatctgtcaaagactgagacctaagattgtaacagggtcaacctgtaaactcacttatagactaaatccagggttactacttatttagcctataagtggattcacgagttgacccacttataacctaactattgagatagaagctagtctagtagtacttctgtaccatatatgtggttcaatttgaaacaaaagttgtaccagtccatagaaaaggaaccaaatgtatatcctactatacacatcaaaccttggagaatagcaattaaatccaaccttgcatgaattctcccttattacacaagatatgtggtagaattaaataaagcttctctcttgacaccatcagtaattaactaagacaaacttaagcgtgcatcaagatcaatggaagacatagacgttgtactccacgatggcgtcaagtccatttgagtcaagaaagtaggtgcgggcttgggcatagccacgagcgaagcggaaagcactggtgccaccgacaaccggcatctcacggatactgtcggatatgtggttgctgccgagcacggttatcacgctgccattgtacggcccagcagtgagcacgatgttcatagcctgtaggaagcctatccggacttggtctgatgagaggtacatgccctgggctcgacccacgggcttggaccttgggtcaggcccctcggtcaatgggtcatccatgacatacaccgtcccgaaagaggttggtgatgttttgttcggtgggctgaccacctgcacagcggatggcgaggggccggtaatcttgtcatggaagtagaagtgtatgtgtgtcggcgctgaactattgcataaggagctacacccatgcccatacccgctttgcgtgtcggccttagtagtggcggccagcacaaaaaggagcacactcatcactactatttcctttgccattttttgatcttagagtttgtgttgagtgaataacactcgcatcctatttatagaggcatgggagctctagggctctatatatgagttggaggagggacacgtggcgagcagcgattggaggaattatggctatctattaattgttgctcatgaccaattggaagtacattttagttgacatgtccttgtagatcgactgaaccgaaagactagaataaaagattgtaatgcttacttaatttgcatttagattgtgtatgattaagtgtggttaacattgaggcacatataagaaatatatgtgttactttcagtaaagtaccccgaatctccaaactagttggttaattaatttttagttctccaaaccgaaggacgatgccttgtagtttgctgaaagcaagggcccaaccacgcccaaagtccacggtgcaatatcacttgtgcacaacaatgtgctcctagagaaaactaaattactccctccgatttgataatacttgtcgttttgaacaaggacacggtctctaaaaagtaactttgacaactattttctattataatataaatatatggttttattgaagtactttttaagactaatctacacatatgggttttatatttttaagataaatattttagaaattatttgtagtcaaagattttaaagtttgactttattcttg

SEQ ID NO: 56829 - DNA, 28877 bp, Oryza sativa
  unsure (1)..(28877): unsure at all n locations
gatgaattaagcttttaagcgccagcatcggacgctagaacagaatgtacatttctgatttctggagcataatatactcaagagcaagcaaaggtaaggagctaagcgcaaaaatatcatactgtaaaaaaaatgaagctcttgacaatcttgatgatatttgccataattagatactccctcctatcactttaatttgatgcggggaaagctaagcttaactctcccaacatgaagtaaaaatgactagagggagtaataacaaattaagatacacatgcattaaaacataccatcgacagtgagacatatgtcatatgactttatcgattttaagatatactaacccagtctttaaatgtgcttacagagatagaatatgtgcatgtgcatttattgaaatgagagtatgtgcgtgttataagcacctacatatatattgtgttaaaagaaaaaagaaatggcacatttgaggagtcttgaaggatctccaatgcctctcaatcgatctctttgccagcatttctgaagcagctcagccagcttggagtggatatctttcagcaactcaaccaatttgttctaattcatcttgttttcatgagaaagatggactaactaacttgcacctctaaacaggaaaacaaataattaagttgcacacgaaggaagggaaccaaatatataaaagatgattcggtgaaagaggaaggatggcatcaattttcgaagacactgaaacaaattgtatcaattccctcttcaaataattgttttctaaaaacacattaggcgctcacatacacacacttagccttataaaggcacatacacactctatcccttgaaggacctctgagagatttgactggtatatcttgaggttgatgaagtcgtcgtagacgcatcgctgtcatcgtctatcattcaaatctagaacttgaaaaaaaaccaaaccctcctctactctgatgacccaatgaatgttgctggttgtttttatatctgaaagaattaattaaggggatcctttgcttgtgaatgctctgtttttttaaagaattctgaatgctctattaatgttttcttttggagaatcgatggggatatggtataacgaacgccaatcatccgatttcacaaaacacacgatacgatctgaatagtgaatactggatgctcgtgaatatttcaaatattggagctgaagctgagctaagaaatactcctacacgatagttaagcatatcaattaaccctatttaatacggcaaactcgtaatcacatggatccaattaacccttttaaaaaatatttgttagacttaattcgatagattttttagaggaatctttgcagattctctgctgtcccattcgccacaagattcatgccggggtcttctcctcttactcaagaaattagcgacagcccaaccgatttaggtttagggttcgaagttggggtggaaggggacggggggggggggggacgggggacgggggaagttcacagggcttagcgagacggccgtgggtggcagaacatgtgggtggagctaaagccacgggatcgttagcaggtggttggccaacattggtagcgggggtgtgggttcctgaccagttaggaggtgtggaaaacaatggggtggggcaccttaccaccgcatgatgggaaggagagggagagagggggagatggggtgcatgatggctgacatggcctcactggcaccattggcgccttctgatgagggcaaggccggggaaggcgcaatcggcgagggaggcaacattatcgtcgagattaggcgcgatttgaagcattgtgtaaaggagaacgacagagaagatgataaagtagaagaactgtaatagtacgaatcttaaagcaatccagggcatccaaaagtgactgaaatgaggaagcattttcttgtgaatgttacatagtcagtccctttgcctcaagatcttgcatgtcgattaaagttgggaatttttttcttctaccacttattgaaaccgtatttttcgtcccgccatcaaaattttgcatttctctcttttaccactactccattagtgccccatcctcttttgccattctggtggtcaatgtcagttgaccatcatattgtccacaaaaaccaatatatgcccctgtgtagctaaaagttactataagagaaccaatgaaaatgtgatttatcttttaattttcagaagttgtataaaacaattgtaggaaaaatatttatgctgtaaaaaaattgttggaaaaaaattcaattcgtttggaaggtttatataactttgtaatatatttagagaaaaatcatttttcacagccacatataaataccttatagcttccaatatttcaaaattcctagtatagactattgttgggaaaaatatttttccgatggctgaagagagagaatacagcagtcgagtcccctccgatttgctgagtggcggagagctgccccaggagttgtgattgtgaacgagagcgacaaaagattttacccctccatgccgttatttgttaaaacgatttttccgttgataatttctgctaccgttaacgacttaatggaggtgttagtataataaaagtatctaaccttttcatatagaaaataaattaacggtttggatgaagttttactatcgatagagagcaccataaagaaaataagtttcgccaaataatcttataaatccctttttctaagtatattgcacatgttccttatttagaaaaaatatataaaattataacttaagaaatcaagatcaaatattgtagtttaatgggtttccttggaaacaatttactgtgagctaacttaagaacatgtacaatagcaggctataagccagttacaaacatattttaaagagatataaaagcgaagaaagaagagcagcggactacagatttgtagccagctgcagcgcggactccaagacataatgtgtgtatgacaggtgagactaagtattaatagtatagtaagcaacaattgtataaattggctatagataatttgaagctagtatttggctatactattagccttgctctaagaatataagaagagatgccacagttgcttcgcttgcttactacaatcgattttgctatatctcactcgaaagattttttcttatctctcactcgaaagattttttcttatctctcactcgattttctcactcaaatttacagtgtgttttcttgtaagttacaatgtaatttatgaaatttacactgtaacttttgtaatttacagtgtaatttttgaatcttcgcatataagttttgaaatttatattggatttggtcttttttttctgaagatatggaaatatagtgtccattatggtgtttcttagttgttttttgcattttactgtgtctattggattttaatccaaggattaaaaatctgtgtgatatgattataaaaatctttcgaaagatgcataggtactccctactacaattgctgcagcttggggccggcatggctaacccacatcagatgccacacattttgggctacgcatgcggcccaatcaaatatattccactttggcataagttcacattggcttcctcaaatatatatagttttaatctaattcttatctctcaatcgctcctctaattattaaaatcgatgcaaaatgacccccttgatggttttgagagcggtttttttgctaatgtagctcattgacttagtttgaccggctgattcagtgtgagacccatatgtcagtgcatcctcctcttctttctatttttctctctctcctccctcctcttctcttcttggtcttcttggaggcaggggacgatattgtacatgcatgggtggcagccgagcttagcgcctacggcgaggccgtgtgggtcctcgacgccaagcaagaggtgttgagcctgttggcaccggtgacaccatgtgcgtggtgcgatgtcatcggaagtgaggagccaaggagctcaatcacccgctccacggtggtgaagggaggcgaggagccaaggcgcatgggcggtgcccgagctctgcgtctatggcgaggccgcacgggtcgttctcgacgccaaacaagaggtgttgagctggtcggcgctagccacgccatatgtgcggcgtgatgtcatcggtaactaatataaatgaattaattactaatgatatcaatttttttttcagaacagatatcaattagagtagttaattgatggaaacccacctgagttcgtcgccgcggtatcgcagtgcgcgcgacgacaagcggcggtgtcgcggggctagcattaatttggtcccttttctatagtgtacaattcttgttccaaattaatctatacgctctagaaggatgattaaatttggaaatatattaggatgtaattttttttggcacaaatataccattgatatcgctaaatctttgcacgaatataacgatggcgtgacgagtcgacgaagagcgccacggtctcgtgggacgcgagatgggcggtgtcacagtgcgttggcccgaaatggacaacgttgtcgtagaccaatcttcaaactttgaagattagtaattaaagcaaaccttgcatgaattaagtcttccttattacacggggcacatatgtggtagaaatttagtactcccgacattccatatggcttgcactagtcaacacagtgcatgttaaactgttaagccatatggaatgtcgggactggtactttgataatagaatatttatacctttttttttcataaagatgagtggtccaagtttatacatgaatagtatcttatatcaagtaagagggaacggagggaataatagcatcaacaattaagccaacctagcatgaagatcaatggaagacataaacgttgtactcgacaatggcatcaagtccgtttgggtcgagaaagtaggtgcgggcttgggcatagccacgagcgaagcgaaagtggccggttccgcccaaaatcggcatctcatggataatgtcggatatgtggttgctgccaagcactatgaccacgcttccattatacgacccagcggtgagcacgatattcatggcctgcaagaagcctatccgggcttggtcagacgagacatacatgccctgggcatggcccacgagctttgatgcgggatcgggccgttcggtcaatgggtcatccatgacaaccaccatccccaagaaggtcaacgatgtgttgtttggcgggtttactaccctcaccgctgacggtgacggactggtcaccttgtcatggaagtagaagtgtaggtgtgtcggcactaaactgttgcctaaggcgttgggcctagacctgccttccatgtcagccttagtagtagtggccaacacaaataagagtacactcatcaccgccaatcctcttgccattttgatcttagaattgaatttgtgttaatttgtgttgagtggatgatatactcatgacctatttatggaggcaagggataggacaagtgtgaagcagtgattgagggaatcatggatatctattgtctcctcatgagcaatggatatttcattgacctgtccttgtagaccgagtgaacaaccgaaagagaataagagattgtaatgttttgcatttaaattgtgtatatgtgtggacagtattgaggtacatatatgaaaaatgttactatcactaaaataccccaaactagttggctatttttagttctccaaactgaaggatgcgttaagttaatttggcacattatacgtacaaggaaagactgaaagcaaggtcctaaccagcagcatcatagctagtcaatcaatgcccaaagtccacacggtgcaatatcagttgtgcacaaaaatatgctcctagagggaaaaaatatatgtttgaaccaaatcctagaaaaaaaaaatgaattgcgtgatgcattaagattttcagcgccaacaatgtagtataaatgaacaggaagcaatggtaaagaaattaagcacaaaaaaaacatgctgtaaaaaaatggaaacattgacaattgtgaagatattatttatgtggaatgtactacgttacacttctcacatagtattacctccatcccataataattacatttctagaaattagagatagattaacatcaaacacaatttatcacaataaccatatatatttaataactacactgcatgcgcatattctatatgtctatacttgattaaaaggaaagttgagcaacacattcgatatgtaaacttaattaaaatgaaggttgggggtacacattccatttgttgttgtgtcccatcttaccagaaatacaattttttaagataaaatttgaatggtagaaatacaattattatgggacggagataattcttctataaaaatcaagcaatataattatacttgcgtgtagtagtatgcagaggaaatagttaacatttggcaacaaacatccatgaaattgctgtataaggcccttaacaaacttgttgcctctgtagaaaaaaaaaaacttgtgttttcagactactcgagacaatcacaaaaacttctgtaatatggcatggttggcattatcgttctaaaaaaaacagtttgttcacattcaggtttcataattgtttacatatgcattttgtacccgtttctacaacgaggctttgatgaagtggcttaacaaaagtttgttctaatttatctcgttttcttgagaaagataaattaacttgcacatctaaccggggaaaaaattagcaggatggacataaattaacttgcacatataaaagatgattaaaaaaaatcaaaatctcttatactgtgaaacggaggcagtaccttaacattacaacttaattaaaatccaatggcaacatgatatagtttgaaaggttcgctcaagaaaagaattattgtgagttcacttacgaatttaagcatctattgcagctggttgcagtgactgcggcacatcacatggatctatcgagcttaattcagttggaaaccacctggcccgggtgaccgtctccaagaaactgtgaagcgacaaaagaaaatctcacaagaaaacagttcatcataagatgcaaacaaattttaaagtgtttgcttgcttggatttttttttcttgtattcatgcccccatctccggcggccgccagcgccacagccaccgacactagcatggccctcttccgcacggtctgtcttgctcgtcggtgcagaagaggccgtaaataggcccatcgagatatgggccgtttcatcggtactctctctgtttcacaatgtaagtcattttagcatttcctacattcatattgatgttaatgaatctaaatagatatatatatatgtttagattcattaacatcaatacgaatgtaaaaaatgctagaatgacttacattgtgaaacggaggaagtacgttttatatttgatctttaccttacccatgaattaagactcaaattaatttagagtaaatttcaactaaccccatgtactattatggtctaaattgtacagaaccacgtgggttttgacacgtaacacataaccttgattattatggccatgaagttttacaaaaccacactattgatcattttgaattataagctatttattccttatataagtgttacatacatgtaaacatacaattttgaattttgatataggagtatgtcgatttggttaacgccatgtgttgatggactatggtgcccacctacgatatttgtagagtatgaaaaacgttgagatcatatctagctagcagacaagggacaagtgtttatattggttcggggccttaagatgactaataaccctacttccatttatatgtatatcagggaaaaagtagattacaatcaacgactagggctttggcttcctccgaattgtatctcgatattgctcttgttatggcttgtaattcaatatcctccccttattgggaccctgtatttatagggatgatcatctttttctcaaagtagaaatcagagaacctgaattagatatggtccaagaagaccttattttctctgaatatgactttgacatcttctatccctagaaaacaatttcctttcggatcaccgtattaccttaattgactatatattcctgtatattattaggtatgtggtactttcatatagcacaaacccaaatataagaggtatgtcttatccttaacagttaacactaatagtgtggttttagaaaacttttggaccataattatgtgtcacatgctaaaatctatggttttatgtaaattggctcatgataagtggggttttataaaatttagataattttttacctagcttaatattactgttacaggaagatctgtgatcgagacaagagttgttggctggaatagacacaccacataataatctctatttggcaagcattacaacggcagcttaattttaaaccaaacaaaatcttgatctttttaaaaaaacaaaaaaaaagaagtaacgacagcacgtacgatgcatgagaaggtgagttgttataatcaagcccacagatatatcatatatagcggtatacccctgccgatcaatggaggcacgtgtagaagaggcatcaaaatttaaataactaaagcatgcatttccaccaagtatctccatccatcctaaaatataaggcagaagattttggtgaataaaacatatcctaataccatgaatatgaatagagagttgtccagattcataaggcttgtttgggggagcttaaaattttgagaagcagcaactgagaaactagctagtgagaatctggagaagctgggaaacccagcttctgtcttctagttcattttccagattctacaaccacaaattcttagaatttggataaaaagctggactgttttggtgagcttctggcaagtggtaagtactggagattctaggagaagctacagctgctaaaagctccccaaacagacccatagtagcagaatgtgtctcatcgaatatcatagtcctttttatattttgggatggagaaaataagtgttaaacaagattgaagaaatctaaaccaagccagctgatcttcacctactgcatctactacttctgtcagcttcctcagagtccatatatatcccaacttgcagcgtgtatgccgtaaaagtatctagtatggactatggattacttcattacaaattaacccattacccatcatatgcaagatcagtgtaatcatgtaatgtaaaggcacaatctcgtgctgttttcccttaaaagaattgtaatgtaaagtgaatactaaactgatgaacacacaagatcagctaaaatcaattaactaatcctccattgctagctagatgtattgcatgccgcatgtgcagatgtgctagcttgcagagctagttgtcttcgtcttcgtcttcgtctttgtctagagatttgtctagggagtagagacgacgatgacgacgacgaaatcatcgaactaaacacaaccaccaccacccccttgcctttttatgtagatcaccctatagctacctagctttaattatatcgataaattaactgtggagaatatggatattccatatctacatgacagttataatttaatcggatatacggtaccaaatatagatagaatatctttatgaagactcgggttagttttttacttgtatgtcaaggaaatacccgagatcttagtcggttacaattgtattttatctataatcccatattccgttacgataagagttgtattttgtaaagcggactccttcccctatataaggatggtccgtgtgtctctcggggcgcgattcttttttccaatttatacaatcaataacgtactcggcggaatcatccccggacatgagtagggtattacttcatgaatatgaaggcctgaacctgtataaaattcattgtctccaaaaccatcaactttcctagcttgatagccacccccttttattattgccgaaatcttgtttcgacagttggcgcgccaggtaggggcagcgtcaagtttttgccgactaagtgcgatgggttccgtttctggcatcgacaacttcgccttccctcccgggcaggcgttctggttcggcagcctcaacttcatcaccaacgacttcggcaagatctctctccttgactcggattcgaaccagtcggggagagaccaggtccccgtgccgtttggtattccgaactcggccgaggcctactccaagatcatatcttccgagtcggcttcaaaccactcggacgagatccaatctactcctccgcgaccagatcaagacgacgggtcctatccttcaatcttgatgaaacttcctgatgacttggctgccgtcttcacagccaaaacatctcccactcggagatctaggcgagctccggcatcggccccgatctagtctagatccagggaggttggcgttatactccaacctcttgggacagtctcgacggaagagatggatggctacctcagctcccccggcgtcagttcttgaccaaccaagatcctcgactacgacgacttcggctaccactatgaccacggcgacctcgacaacttcgacgacagctatgaggataactacacgcccctcttcttcggcgtattcatggctgccaacgaaacggaggaacagcgccgagcccgagaagcggaccaagatcgcgcacggcaagaagctgaacgtcgccgactggaggaagagcgacagcgacaggagcgagaacgactacagcgtgagcaacaagatcacgaaaggattgcaaaggaggctgaagatcgacggcaacgcgccttggaatccgggcggcgagcgagatagctcattgggcaacaagacgtcgacggaacagcggtctttcgcatcccccagcagaacgcggttgcagcaatcactctcctcgacaccctcctcaaggaagacgcactcaactaagctgatcatgttgtcaacatcttgaaccagacgaagaccatgatcgctgcctcggttccagccaactctgcaagcacccgcaccccgactagtagccaagtccctcatcttcgatctcaagactatcaccagccaagcctcagcattgccggcgccggatctagtcgcaggagcagaggacatgatgaacggtctgttcgttcgcctcccgaacgatatagggagcgtcgagttgaacgaccacactccccacatcgaaggcgccccatcgatcttcgcgacaccatcaaccagcgccgcgcagcaagaggccaccattcaccagatcgttatgacgatgatgtggacggcgttgctgccttcacaagcgatctgcgtcgagtggattggccagccggctttaagccgactgaaatcgagaaatatgacggcaccaccaaccctgagtcttggctcaccgtctatggtctcgcaatccacgcagcaggaggagatagcaaggccatggcaaactatctgcctgtggctctagcggattccgcccgatcctagctccacggactaccccgtggcatgatcggatcatgggcagaacttcgtgatcacttcatcgccaacttccagggcacctttgaacgccccggcacacagtttgatctctacaacgtcgttcagaagtctggagaatcccttcgagattacatccggcgcttctccgagcaacgcaacaagatctccgacatcaccgacgacgtcatcattgccgcctttactaaaggcattcgccacgaggacctagtcggcaagttcggacgcaaacctcccaagacggtcaagcagatgtttgaaaaagccaacgagtatgccaaagccgaagatgctattacggcgtccaagcagtcaggcaccacttggaagccaaagaaggacacgccgaccgcaggagggagtggaagtaacaaccgcaaggatcgcaagtgtaagcccgaagaacttgtggcaacaacctctccatcttcccgacaacgtccccgcgtcaacacattcgacaagataatgaactcccaatgtccgcatcatcctaactccaaccacgtggccaaagactgcttcgtctacaaacaatttgcggagcaatacgtcaagaatgcacttaagccttcaaacggagagcaaggcacatcaaagaagaaagacgatgaagacgatgccccgactggttttcaagatcatcgcaaagaactcaatcacatcttcggtggacctctggcttatgaatctaagagaaagcagaagctaacagaacgggagatcaatgtgattcagcccaacatgccccaataccttcggtggtcagaaatagcaatcaagtttgaccgctcggatcatcccgaccgagtggtccacccggggcggtaccccctggtactagacccagtggttcgcaatgtcaagctccgaagaactctcatcgatggtggcagtgcactcaacatccttttcgctaagaccctggacgatatgcagattcctcgcacggaattaaagccgagtaatgcatccttccacggtgttatcccaggattatcagctacaccactcggccagatcactcttccggtcactttcggcactcgggagaattttcgcatagaaaatgtttgtttcgaagtcgctgatttcgagacagcgtaccatgctatacttggatgaccggccctagccaaactcatggccgtcccacactacacctacatgatgatgaagatgcctggtcctcgaggagtcatatcactacgaagcgacatcaagcaagccgtcacatgtgacaaagaacgttgcgagatggcccagacccgcgagattacactcgaccgagaagagatccgactggctacgaccatggcaagcgaaggagaagtgcccgcaaccaagatgctcaaaagcggagaaagcaatgctaagacgaaaaagattcccttagatccctctaatcctgataagactgctgtaataggcgctgagttagattgtaaataggaatgcgcgctcatcacctttcttcaaaataataaagatatctttgcatggaaaccatccgatatgcctggtattcctagagaggtgattgagcactctttacatgttaaggaagacgccaaacccatcaagcaacgactccgccattttgcacaggacaggaaggatgcgatcaaggaggaattaaccaagctgttagcagcgggcttcatcaaggaagtccttcatccagactggctggctaacccagtcctggttcggaaaaagacggggcaatggcgcatgtgtgttgattacaccgacctcaacaagtcttgccccaaagacccttttgggttacctcgcattgactaggtggttgactcaacggcaggctgcgagttactcagtttcttggactgctactcgggatatcatcagattcgactgaaagaatccgactgcttgaagtcctcgtttattacacccttcggggcctactgctacatcaccatgccctttggattgaagaacgcaggagcaacctatcaacgcatgattcagagatatttctcgactcagatcggccgcaatgttgaagcttatgttgatgatgtagtcgtcaagaccaagcagaaggatgacctgatcacagatttagaggaaacttttacaagcattcatgctttcaggatgaaactaaaccctgaaaagtgcatcttcagagtaccgtcagggaagttgctcgaatttatgatatctcaaagaggcatacaggccaacccggagaaaatcaacgccatccttaacatgaaaccgccaagctcccaaaaagacgtccaaaagctgactggttgcatggcggcactcagccggttcgtctcacgactcggcgagcgggggatgccctttttcaagctgctgaagaagactgacaattttcagtggggacccgaagcacaaaaagcctttaaagacttcaagagacttctcaccactccaccagttttggcctcgccgcatccacaagagccgctactgttatatgtgttggcgacctcccaggttgtgagcacgatcctggttgttgagcatgaagaggaaggccatattcaaaaagtccaacgaccaatttattttgtcagcgaggttttagccgactccaagacaaggtatcctcaggttcaaaagttattatatggtgtcttaattaccgtcaggaaattatctcactactttcaaagtcactcggtcacggtggtcacatcgtttccactcggggatatacttcataatcgcgaagcaaacggacggattgcgaagttggccttagaattgatgtctttggacatatcgttcaaaccacgaacttcgaccaagtcacaagctttagctgatttccttgccgagtggaccgagtgccaagaagacatgccagaggaaaagatggaatattggactatgcattttgatgggtcgaagaggcttacaggcactggagctggggttgttttaatctccccgattggagaaagattgagctacgtattgtggatacatttttctgcgtcccataacgtggcggaatacgaggcgctactccatggattaaggattgccatctctctaggcattcgccgattaattgtccgaggggactctcagttggttgttaatcaagtcatgaaagagtggtcctgtctagatgatactatgaccgcttatcgacaagaggtacgcaagttggaagacaaattcgatggactcgagctcacccatgtccttcgacataacaatgaggcagccgacaggctggccaattttggttcaaaacgggaagcagctccttcagatcagatgtgttcgttgaacatctttacgaaccaaccgtgcccagaaaagagacaattgaagccatggatactcaaggcgtgagcatgatcgaagccgactggaaagaaccgttcataaaatttttgagcaaacaagaacttcctcaagacaaaaatgaagccgagcggatttctcggcgcagcagactttacattattcatgaaacttatctgtacaagaaaagtccatcaggaatactgcaacgatgtgtgtctttggaagaagaagacaattgttgaaggatatacattctggtatttgtggtaaccatgccgctgcacggactattgtcggcaaagcttaccggcaaggttttttctggcctatagctgtatctgatgctgacaagattgtgcggacgtgcgagggttgtcaattttttgccagacaaattcacctaccagcccaagagttgcaaaccatcccgttgtcctggccgtttgcggtctgggggcttgacatggtcggcccgtttaaaagggcagtcgggggttacatgcatctctttgtggctattgacaaattctccaaatggattgaggctaaaccggtcatcacgattacggcagataaagctagatattttttcattaacattgtgcatcggtttggggtacctaatcggatcatcactgataatggcactcaattcactggcggagcatttaaagacttttgtgaagacttcggtataaaaatttgctatgccaccgtggcacacaccatgagtaacggacaagtcgagcgtgctaatggcatgatacttcaagggataaaagcacgagttttcgaccgactacgtccctatgctggcaagtgggtcaatcagctgtcgtccgtactttggtctttacgcactactcccagtcgggctaccggccagtcgccgttctttttggtttatggtgcagaagcaatgttgccaagtgaagtggaatttgaatcactacgattttggaacttcaacgaggagcgttatgaagagggccgagtagacgacatcaatcgattagaagaagcccgtgaagcagctttaattcagtcgactcggtatttgcaagggttgcgccgttatcataatcggaatgttcgatcgcgagcctttttagtcggcgacctggttctgaggaaaattcaaaccacacaggatcggcataaattatctcccttatgggaaggaccgtttataattgctgaagttactcggccagtgtcacatcctgattttcgtttcaggatttataaattatttaataaattaataatagaatttatattaaatgttcattaatttacaagtgaagttaaatgtgggaaataaaatttcctaaatataaagcatggttggatttaatttttattaaattctccatggttaattatactctctggaattttctcggattcttcggagctcaattcttaattttaatcatacaaagagcatttcagtaattacccacatattaaattaatcattaaatggtctaattataatttttttaagtactttgagtgtccaagtattttcagaatttttcttgaaattatttgagcattggaagtatttttaacaattgaaagatcatttaagtgattattttaattggaaaaagtttttaaatccttccctaagtcgttgggccgatttcggcccaactctttctctctccgcgcggccgaatcggcccaatcggcccagctgccgccgcccgccccctcctctctctctctgtcaaagtctgttttgcctccctccttcaatcgggccgaggaaaatgaagcccgtcaaaagtctactttgcctccctgctacagtgtcgtccctaaccttcagccggctgcagccaggccgagcccgagccgccaccttgcgccgccttccgcctccaaatccgctccaatccgaccccgtttcttccggatttttgaggggttttgatcctctcatcctcctctatcttttcccccaagaatcggagcaaatcgttgggtattttatccgaatcaaactcgttttcgagtttatctccaaaaccgagttttgattttcccggatcgatttcttgcgggaggagtccgatctcttcaatccaaggctataaataggaccccctagtcctcctctttcgtttgccccctctcccgtcctctcccgtgacccgtagagccgtcgccaccgtgcaagccgagtcgccggccgtcgtcgttcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcgtttttctttttcctgtttttctaatagattaaatcttcggaaattcataactaaatcatggtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttacattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcatatggttttgatggttgtgctcatgacaattaaggaccggttcgcgagctactgttgtgaaacatttaccgtgccaaccacaagccagcatgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacgataattatggatgctataactggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggaatccttgtgcacttgcatatttgctgtgtggcttgttgagtatgtcatatgctcattcttgcaataatcaatcaacctcagttgaagataaaggatccagaaggagaagacgtttggcttataccccagttgagctgcctgtgggagtggagccggagcttcgctagattttatttttccgctgcagttttcttcatggtgaggactaagtgcctcttaagtaagtatttatcgttttagttaatgtgataaatctatatattaaattgtcagtttgtgtacctcggctgattcctggacgagggtttaatgcacaaataagttcggaaattactagtgaatttccgggcgtgacagccaggttcttatcgactcaagcgcgaagatggtactcccatcaacaattcttagaatattgaacaccttcatcaattttatgcttaggcattacgtttgtatctttcctctttgactgctaacctcaagtttttccttgaagttttcagtcggggggctactatgataataattgagtgtgatttttatcaattcaatttgcttacttgatttatcattgccctgtttggtctttcgacttagtcaatgaggactgaaggtttttaatagcttttgcgggttttaggctcaataaggctagataaaggcttttaagaaatcaaaagctaagtatggaacaccaagcatagcataaattcatcagtattgtacaaattgagcctccatcatcattaattatcaaaatcattgttatatcaatcagtatcagttttttcatcatcagacttatcagatccagtcggccgaaggtcgacttcttggaatctttcaaccacatcagcagcaatcttgtcagcggctttctgtgcatcgttaatgaggtcaagagcagcttcttcgctcgtcccgtctgcaaagccatcaatggcatccatatcaacccttggataaagggatttggtcatcgccaatgccagacttgctcccatacttccagcttctttgatattcttgaaataagtatctggagcgactctcagcttgtcgaagatttcggcagtatcaagtgtactcgaaccggcgttattgaagaacattgcctggatgagtggagtagcggcattagcgactttatccctggctccttcaagcttgttgatcttgtcaactaagacatcaaactgtgcttgagacttgatcttgcggtctgcatcaacagattcacattaatgaatcagcatatagaagataatggcttttgaggtattgattattggtaccttcaacctcctttaaagccgaatcccactgtcttgccagctctgccttgtcattttccagagtttggatctgcttctctagttgagatatcttggcagcttgcactacattaacttcggttaatcaagattacagagataacagcacaaatcagttgggcagagtttgcgcgaacctttggatgagccactcagttcaaaattggattcctggagcttagcaatccgatccctcagatcgtgttcattctttctggcaagttctctggcctcgtgcagttgactcctggtggtttcaagggttccaagatgaggaactagtttctcaagggttgcggttttcgcctcgtttctaagatgaatcctctgcagagcagtttaatcagcgctcgagccagacggcaaacatgatggctgaggtcaggtgtcaaggaacttacatttacaatgcaagtcgcttggttgagtgccttcttcagtaggcagacttcttcatcttctttttgccggtttattacaattccttgaggttgcaagttgtcatcccaccacttgaccagaatgggagagcacgaatcttcggcaaagtgtatccacttgaccacggtgaatttcttcttcatcaccaatcattggtcctaatgtatccactgacaaaggttagacaattgatcagagttatttgggtcaacatggtttcagacaaagtgtttacccgtaatgatttctggacgaggacgagtggattcggatgcccttaaaggagatccagatctccagtcattgctggcgtcttgtccgcgagggttgtctgcttgggtttcaacttctagaatctcttggcttggccctgcgtccgactggtttccagtcgggggctcctgattaactccggcttcggcttcggccgactggtttccagtcgggggttcgtcgctgggttctacattgttgctggcctacagattatcactcgggagatcttttgcagtcggcccggtttcttttgaggaactcgcctccatgttggtcgggtcagagtcttttccagatgggtctatatcagatggtttcctgcaagtttgattgtcagtactattatcgcaatgggtacgcatcaatgcaatgaagatcgtaatatgagttgcacctagaagacttcctgatctttggcacaagacgactggatgttttcttccttggagtagcctgcttcggcagtttattggttgcctctcggtctccaagctttctagcagtgtcgccttcgtcgtcacttagaaccagcttcctcttgcgagaatttggctggccgactggatcaggagcacttggttgagtttcagaccggattcttggtcctccgcttccctgaccagtttggcggtgaggtgattggcgttgagcgattggcggatccgatttcatcagagcaaattcctgggcgtgacatcctttattgttaactgattcaacaaacagataagaccgtattctgtgaaaagttgaagtgttcggttacataccggtggaggaggattaaaggcattgaatggcacgactggcagcaagtgtgaatagctgacaacgatagcattagagaagatcttatacatcctttccttcatgaccttgaagtcaagagaatctggatcttcacgatttgggtcgtgcttgccgtcaaattcgaaggctgtgcgagatctctctttgattggagctaaccgacacttgataaagtgccgtgtgatctgttctccctgaaggccttgttctttcagctttatcatgcgctccatcagttccactgcttgtgcagcttcgtctcccattggcagtgagttccaagtatcccgataaactggaggaagacaggagtactcggggagagcaggctcagggttttgaacataaaaccaatttgcatgccagcctttgtttgaggtcttgaagggcatggagaagtatttttggcttagcgttccccggagttggaaaccagcacccccaacaacacatggtttgcttttgtttggctggggcttgaggaagaagatgcggcagaacaaggcgaaatgaggcctaatgcccagaaaagcttcgcaggcatgaataaaattggcgatatgcactatagagtttggattcagatgatgcaagctaatcctgtagaagttcataattccccggaagaaccttgaggttggaagagaaaatccgccatagaagaaatgagcaaataccacgatttcgtgtgtatcgggggtcgggaatgcttcgccgaatgctggtcgccatccgatgatctcctttgctggaagaacgccgtgcgccaccatctcctttagattatcttccgtcacatcggaggacgcccactggctctcgaagctttctctctcttccgccatgaatgtggactggatggtttgatttggtccgagatacggctggaaagggatggggaattggagcggtggatgcgggtagaaattttgtggagtgtttgaggatggattggagcggattgctgaaccctagcttggccggcgcagtttgtactgtagcaggaaatggggaaaatggtgagagtctcggcggggaagacgaagagacatttttcacttcggtgatattagagtatcgggagcgctagcaggcctgggccggcacagtacttcagcccaattttatttccagcgtggcccattgtgatccttagggacttaggcactttttgctttggcaatttgtgctcacaatgatgtggtccaatgctgttaaaaccctttttaatgcggtttgataattctttggaattaacacgatgcaaacaaaaggtgcccgacagaaaggtgttataccatttttgtaagctttattaggctgcaaaagctgtttgggttgatttgagatgactggtttactaatagttattcttttagcatgttatatgcttattttggttattgtaagggtcacagcctaggctattagactcattaattaccgtgattttttatcatgtttggtgaatcattttaagagtttcttactcggattcctatcaaatatgtctatttttggaccttttgagtgtttatcactcggccctttcatatttttttatccttgatatgttcaaggagtgttgataaaaccactcggttcttgactacgtgtttagtttttcaactaattacatagtcgggggctatacctaattaggtgcatctactcgatgcaccatgttttattttcgcccttcgcagtctttgattttagcactcggcaaactggagcaagttgaattgaagcactcggattgctgttttttgtttcgagaaggttgttttgtcaactgcgaaggtctcgggggctactgtggagaatatggatatcccatttctacatgacagttataatttagtcggatatacggtaccaaatatagatagaatatctttatgaagactcgggttagttttttacttgtatgtcaaggaaatacccgagatcttagtcggttacgattgtattttatctataatcccatattccgttaggatatgggctgtattttgtaaagcggactccttcccctatataaggagggtccgtgtgcctctcggggcgcgattcttttttccaatttatacaatcaataacgtactcggcggaatcatctccggacaggagtaggatattacttgttgaataagaaggcctgaacctatataaaattccttgtctccaaactcatccactttcctagcttgatagccaccccttttattattgccgaaatcttgtttcgacattaatctagctaattaagcaatggcagcctcgtcgtccttcgtgctcgcggcggcggcgctactcctccaggccgtgacggcggcggcggaggcggcggggcagcagaaggagatgcggatgcgtgtgtactggcacgatgtggtgaccgggccgaactcgacggtggcgaaggtggcggaggcgccgacgtcgagggcctccgcgacggtgttcggcactgtgtacgtcatcgacgacccgctcaccgacgggcccagcctgacggcgccgtcgaggctggtcggccatgcgcaggggatgtacgtgagcgccgggaaggagacgatgtcgctgctgatggcgatgagcttcgtgttcgccgccgatgagccgtacaacggcagcagcgttgccatcttcgggcccaacccggcgaggccggtgagtgagatccccgtggtcggcggcaccggcgcgttccgcttcgcccgcggctactgccgcgccaccacgtactggtacaacgccgccggcgacgccaccgtcccgtacgatatccatatccgccacgattaactgattcattattattcctttgtgtcaaaatataagaacctaattaatatcggataggacgtatgaaatatctaatccgatcatagaagtttatattttaaaacggagggagtaattagttagccaggtagcgatacgttgtgtgtcaattactactgtatcatgtactacctctccatcccgtaataaagttcattttaattagcaccttctatttagcataaaataaatttatttttagagtaattattaaattagaatttattataataaaaattattattttaaaataaggtgaaaaatagttacattgcgatttgataaattaagagtaatttagctttcttggttttatattggtatacatgagatggatgaaaaatgaaattattttaggatgagaatagtattaggtacatggggaaaatgattttatctctcgagggatatccctagtttcgtgcataccacctaatagtcataaaaaatatgaaaagaaaattagcaacatagattaatataaaatatatcactccacaaacataagcaagttaaaatttaacttctacaagttataacaaaaataacaaatatagttgcgaatatacgataactatttttagtttaatttgttatttttgttacaacttgtagaagttgaatttggtcttgcatgtttgtggagtgatatattttgtattaatctatattataaatttttttaaaaaattttataaatatttagatggtatataaataacgaaggatgttccgtcgaggaatgaaaatccgtatcctagctacatgttgcatgcgggcatggaacccaaaacaaccatcaacattttaacaaaacaaattaagataatatgttacgttgtaatgagtactccttattaacatagacgtcacgtcagtcatacttcgagcttgatattattttgacattttatttaatgagaaaatatattatagttgactttaccgttgagtatcgtgattaaaactctggcctcaaataagatacgtcaagcgatatgggcggctgttaacagtgaaatttgataatcggtaaagacgccatccgcttagaatcattatcggctgcagcatctcggaatcagccgatgggagttatcaagtcgccaatagtcggattcctgctatattcggttaaggaaatcaatctattaaagggagcttatccctaagtgaccgagtttaaagaggatacggcatggcagtttatctattaattaggaatagtttgttagtttccttttatctttaggaaagtgtgtttagtgtccgataaggactttatattttccttttatatttaggttagtttctttcttatctttaggttagtttctttcttgtccgacaaggacttgtatcaacccctgggtataaatatgtacacccggggtctatgtaatctatctccacgatcaatacaattcggagcatcgccaccctttttatttctacttttgtttttacgtttcggcggaacttggcacccgacgcggggctgcatcgtcttcgatctccggtgaagggataagtccaatattccatcggcccaggcaattgtatcgtttacgtcggcgtcgttgaaggctgcatcagtacattcgacctcttggattgctctggtttggatgatatacttgcctatctatttatcatatatctctgttaatctagtcttagcatatcaatttagttctatcggctgcttctcattttagggtttctgccggtatcggctaaatcgcgttgctagattagattagcttagacatctaccaccctgaaaactcagtcaacggcttgattgtctagatattatatttcttttcatacttagtgctgcatcagttaagtttgatctactaagtcgtgcttagaactataatctctagcctgcttcttgattgccaataagtgtttcatcggggtttcagccggtgagttatctggacgttgcatcggctcataaggattgcatatacatataagttggatttagccgatgacaacaaaggcttcattgtttaagctaatcttgtggatttcatgacatcggacctccagccgatgtgtgctttgaccttcggatcgatgcttatttatcatatcattatttgctgattggtttatacttgattacattgttattttattacatcatcgtcagccgattgcctttatatcattatctacattggacatatagtcgattgcttaaaccctatcgctatcggctggtatcggcatcggctattatcggcatcggctggaactactccatcggcttgtcggccgatcggctgttttaatctactatttgcatatcttgtcagttgcaggatcaaactgactggcacgctcgcatctcaccaatctttggacctgcactggagttaagcagatctcccaggccgatgtgttcgattttttcgtcaacagctttagcagtccctgactccccctctcattttccacacgtatgtttttcaaactataaaacattacgttcttttttaaaaaaaattctatacgaaaattgattaaaaaatcatacttattcatttattttaaaaaatagctagtagtgcttaattaattacgtgctaacgaccgcccgttttcaccaacgaaggcagcccatggtgtctcacgttttatgtgggccaattaggcccatcaagtagccgtcatggtcaaagactcaaagttgaccacagccagccgttagatctaatctgaacggttcgcgttgtctcggaatcatcgcctgcatcacacttgacctgtggacctatggtgcgcgcggcggctagcgaaaccgccatggccgcggcgacgatcgagatcccgcgctcgccggcgttccggctgcttctcgtcaccgcggcgaggaagaatctccttccgggcggcgatcctcgcgctcgccgactcgattgccggccgacgtggggagcaacgcatcgctcgattacacttacacaatccgagtaggaatcgaagtaaacctctctgtatttaatttgcaaggtaaatttgcaaccgacccatcgagcgatcgatctccgaacgaattcgatggcttccacgtcgaggaaacgttcggcgcgtagcctgcaagaagatgagcagacctcatcggcggcagaggcgccggcggcggtgcgagaggacgaggagcgggttgcggtggcgggcatggaggcgtggaggttcgggttctcgagattctcctggtttcccgcgttcaagttcgaccccaccgacgccgacatcgtcgcctcctacctcctcccgcgcgcgctctacggccgcggccacgccgccgttatccaggacgacgtgtcgaggtgcgagccgtggacgctgatgcgggagcacggccacgccaccagcgcgcacgccttcttcgtccacgaccacgagagcgtcggcggcggcggcggcggcggcaggcgcaaggtgcagcgcgcagtcaagaacggcggcggcgtgtggcggatccagaagggcgaggtggcgatcctcaccatcgtccgcggcggcggcggaggcggaggcgagctcgacgtggtgtacaagcggcgcaacctgagcttccaccgccgcggcgagagctcctcctccggatgggtcatgcacgagtacgagatcacctcgccgccgctccccgccaccgtgctctcccggatcagggccacccccagggccaaggacaagaagctgtgcatcaaggaggagccctcctgctccacctccgccgccggcgagcgctctggccctaacccagaccacaccgccgccggcgccggtgacagcgccactgccaaccacaacaatacaacgtcggcggcgacaacaactatggcagcggcggtgtagtctaatattatccagaccagccgggtccgagccaccaatatggttacggcgagcaggtcgccggcaatggctttgtggccggcgacgggtggcggcggcgagccattgcacttgtgtgaggactgtgacggcaataacgtttatggctacggctctttgacagggaagagccgctgccgcgagctgactggacaatgtcgctggcctcgagagcagtcgatccacctccaatggcctcaggagtgacggatccaccgtcggcggcacaggaatggtgacctccatcgcctctccccgtccctcgcttcccacggttgagctttgggtagtggcagcacgcttcaggctcgttggatctggtggagctcgacgtgggggacaatgatgacagcttcatcgcctcttctcatacctcgctttgggcagctacgacgctagccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56830 - DNA, 9470 bp, Oryza sativa
aggagctggcgaagaggtgcggatgggcggctttcaactcatcctccctttcccaggttgcttcctcttctgaatgatgactccactgaactcggcaaaacctggtgaccttgtttctggttcctctttcgctggtatcaagtatacgaaccggcttctccacataggttaggtcctcctggatatcaatgtgttccgaatcagcttgttcttcaggtacccttaagcacttctttaattgggacacgtggaacacgtcatggatgccgatcatattggatggaagttctaactgataagcaacttctccccttcgttccaagattttgtagggtcccacgaagcgtggtgccaacttgcctttcgtctgaaaacggtgtactccccagagcggagtgacacgaagatacacgtaatctcctgcctcaaaagtgagctcccttcggcggttatccgcgtagctcttctgtcgagactgggcaatcctcaacctttccctgatgattctgactttctcttccgcttctgttaatacctctgtcccgaacagttgacgctcgcctgtctgatcccagaagagaggtgtgcggcacttccggccgtataaagcttcaaacggtgccatctgtagactggcctggtagctgttgttgtacgagaattccgcatatggcaagtttttgtcccaagctccaccaaaatcaagagcgcaagctctcaacatatcttccaggatttgattgactcgctcggtctgaccatcagtttgcgggtgataggccgtgctaaaatttaaacgggtccccaattcttcctgcagcttctgccagaattttgaggtgaactgactccctcgatcagatacaatctttttgggtactccatgtagacatatgattctcgagaggtaaagctccgccaaccttttgcccgtatacgtggtatgtactggtatgaagtgagcaaccttagtgagtcgatccacgactacccagatggaatcatgacccgatgatgtccggggcagtcctgttataaagtccattccaatctcctcccatttccattccgggatttgaagaggttggagtagacctgctggtctttggtgctctgccttcactcgttggcaaacatcgcagagtgcgacgaattcagctatttctctcctcatgctgacccaccaaaacttttctttgaggtcttgatacattttggtgctgcctggatgaatggagtactgggtctgatgagcctcggtgagtatcagatccttcagttccttgtcgtcaggtacacacaatctttctcccaaccagattgtgccgtgttcatcttcatggaaatcccgggcttttccgactctcatgttctttttcagctctgctatttcagaatcatttacttgagctgctctgacttgatccacgagcgtaggccgtgcctccagagcagctacgaacctgtgttcaacaattcccacgttgagatgctcaaactcctaccgcaattcctcacacatgccctcgatgcatagggcagtgcagtaacttttcctgcttaatgcgtctgccaccacattggctttacccgggtggtagtgaatgctcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaggtcatgagtcggataattcccttcgtgtggacgcaactgccgcgaggcatacgcaaccactctgccctcttgcattaggacacacccaagtccgtggcgggatgcatcgcaatagacttggaagtctttcatctggtcgggcagaatcaaaactggtgcggatactaacttctttttgagctcctcaaaactcttatcgcactcagctgtccatttaaacttctcatctttcttaagcaaccgagtcatgggtcgggcgatcctggagaagttttcgatgaatcggcggtaatatcccgcaagtccaagaaaacttcgaatctgtgacacggtcttcggtggggtccatttggtaactgactctacgttcgatgggtcaactgccacaccctgagctgtaatgacatgtcctagaaatttgacttccgtcaaccagaagtcacacttgctgaacttggcgtatagctggtgctccttcaacttctcgagtaccagacggagatgttgctcatgttcttcttcggtctttgaatagataagaatgtcgtcgatgaataccacaacaaacttgtccagaaattccatgaacactttattcatcagattcatgaagaatgcgggtgcgttggtaagtctgaaagacataaccgtgcactcatatagcccgtaccgagtggtgaaggccgtctttggaatatcctcttcccgaattctcaactggtggtagcctgatcgcaggtctatcttagaaaacactttagctcctttcagttgatcaaacaaatcatcgattcgcggcaaaggatatttgttcttgattgtgacctcgttgagtgcgcggtaatcaacgcacatcctcttcgtcttatcctttttctccacaaaaatgaccggagcaccccaaggtgaagtacttggtcgaatgtaccctttctgcagctgctcatcaacctgcttcttgacctctgctagttcgttggccgccattctgtatggtctcttgtaaattggagcgattcccggtgccaagtcaatccggaattcaatctctctcttgggtggcatggtagtaaggtcttcggggaacacttctggatactcgcagactatgggtatatcttccaatttcctcaacttcttctccacggtgtccactgggatttccgcctcaatctgattcaaagagaccccttgctttggtgagtctggtgatttgtacactactgtttctcccttctcgttggtcaaggtgactgtgcgattcgcacaatcgatgactcccttaaacttggtcagccaatccatcccaagaatgacatctaggtctttggattcgagaagaataaggttggctagaaatggtgatctttgaatttctattgttatagaagggctgaattgaaccgaagtggagctattccctggggtatgaacccgcatcagtgtgctaagttcctctcttattaacccatgcatcccgacaaacttctttgaaatgaacgaatgcgttgcaccagaatcaaaaagtactgttgcagggattgagttaacaggaaacgtacccagtacaacctctggtgctgtttgtgcctcctccgcagatacgtggttgacacgagcttggataaaccttggcccggcacgcctaggcttcgggcatttgtcagcgaaatggccaagctcgccacagttgaagcaggaccctggttttgctccagtctccttggcttgcgcggacgggcctgactgtgccggtgtcattggtgggcgtggagatacaccgcggttgggctgacctccatggtggttctgactgccactggcgccctgggaaaattgctagggttgaacgggcggtactggcggacgatcatggtggtaggtccaccctgctgtccaggagtgaagtgcggcctctggtgacttccctgatgtgccctgaactgagcggccttcctcttcctgtccatcttgttgcgttgatcctcctgacggattgccttgtcaaccagcctctcaaagtcgacgtagtccccagatattagttggttggtcagctcgtcatccagacctgccatgaacttttcctgcttctcggcgtcggtgcggacatcctctggtgcatatcgcgtgaggcgattgaactcatggagatactccgtcacagtcctgttgccctgatggagtgcccgaaattccctcttcttttgtgccacgaccccgtctggcacctgcgccttcctgaagctacggcagaactctgcccaagtgacttcagtacctggtgggcgggtggccatgtgattgtcccaccaagctgacgcaggaccttgaagctggtgtgtggcgaaagcaaccttctcctgatcattgcactgcaggagattcagctttttctctatggcatggagccagtcattcgcctccatagggttggtggtgttggagaaggtgggtggcctgacacgtagaaactctggcaacttggactgagggggagggggaccaaactgctgatgctgctgttcggcgtgctgcagcatccgctggtgcatctgctggtgctgctgctgcatctgctgcatcatggatgccatcatctgagtctgatgtgccatcacttggggtagcgtcggattctcgggaagtggtggcggaccattgccggaatcgctgtggggatgcaccccattagtgcgctcttcgccgttgctgccctcgcctgttgcgcggctaccattcttggtgtaaaccatctggagggaaaatcagacgggggaaaagaaggaaaacagatgctcaggaactaagctttattatataggaatttaaactgcaattgttcggatctgaattaaaacacttaaaaagcaagcaaaaatccttattaagacagccatatcataggcgcatgatatcgaccgtcgactgaccccaagcaagcaacctaaacacacaaactaacaagcagaaactagacagtcgataaactaatggaaagcgagcctaatgctcggaacggctcctgcggtcggtggagtcgaaggcgtcctcctgctcgtcaccaggtccctctgagcgactcctggagcctggcagataagtctcgccgccgcccggctctgagccactggagctactgctgctgagatcgcggctgccactgggagtagcagacaaccaacctccgttgccactggctggacccctggcggctgatgctggagcgaaggagagagcggacgcgggagctgacacgtgaacgggagctggagctggtactggagctgcaggaactaccggagctgcgggcggaactggaggtgctgcgggagctgctgatggaggtgggttcctgggcgcaagctggatgcgcacgggtgcagtcgtcgtcttgcggggcgtagtgcggatccggactcctcctggcgcgggaagaccctttaactgagcattctccttcttcaggcgcgctatctcgtccttcagagcgacgatcctcatgagcttcccatcattcaaggccttggacgccttgtgcaggtccgagtgcatcctatccaatcccctcatcatagcacacatgtgaccaaaggtggtgtcgttctcgccggctgtcgaacggaaagtactgacatcatcaccgctggctcgacaagggtgaaatcggtacgccgtgtcgtggaagataaagttgtggcgctcccgtagtctggccatcatcaggtatgctgcctcctgacaggcgtgatctgctgtgcctccggatgcctcaaccaccatattagctaggcaggtacccacgtagccgtggacctccaggcgaacacggtgaggaagcttgccactgagtggtggaacagtcgtgtactctggcgcgttggggtagcccaccaccagcgtcatacgtgccaactctgccacaaagtcaatcatgccttctccgcggtggttgggtgggtggccggccatctagagaagacaaaggagtaggatcaatgcatgctcaaatccaaatttaaataaagcaataaaagactcaaataagagaatcgaataagagcgaaattttatgcatagatcattttgcatgagagcgaataaataagacagactcacataacgataaaataatggggaaattagatacatactaataataacactaagagcataaataccttgcaacccattgtcacgccccgaactagtaccgaccggaactagcccgtgacgctccaaattaacctgttaatcgataccagtcccaggaaacagtgctggtatcacaggaagacagattatcacagcaatagaggtctctttattatagagtagaggtacagtcatgttgggctgcggacaggccccgagctcacaactgcattacaaaaggaaagcggaagccaggactaggaccaaacaacacaggcgcgacttgggaactaggccgaaaccctaaaactcatcgtagccggcttgctcctagaagaactcctcatcagcaggatccgcttcatcttcttcagcaactggggggggggattatttatatagagcaagggtgagtacgggagtactcagcaagccaggggaaataagtgtttaatgcaggcttcaaggagaggctgttgtttttgcaattgattttatttgaactcttttctaaaaacaactaagtgagtgcttctcaaacgacacggatgagacagtgcgtctcgtccggtcagagtatgtgtaatgtatcagtctttagaattgaaacaaggttggcacccggccaacagcttttcaaacggccacccgggccaacaactttcaaacggccacccaggcctagctgattctatcagctacagatttttcaaacatcgaacccctttccacaacagcaatttcacaagcagtagttaaacaaaactacgctaggaatcacctcacatccgcccatgaccgtgggcacggctgttcgaacagtttgttaacctctgcagagggggtacactttacccacatgacattactaacccggatcacccagcccgtggggatcagccacgtcgggagacctccaagctttcatgacaaggcatttccaaagccgtcataggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcggaaaaccgtacacccggtacgttccccggtccgcggttttggaaattcatttagttcgcaagcaccgacccaggtgtcaggttttccaagtcttttgtaaaacccaagttttacccaagttgttactcaaaattttaagtttgaaggcgtccgtcgatactcgtgcagggtgcacgaatatcgagacgcaactagatggttacaagggggacatggtatcacaattaacaaaggaaggatcaaatgcaacaaattgggtaggtccgccaatctgccttgcagatgggacaagcagcttaagtgcagtcctatcaatgcataatatttttcaagcaacataattaaatttcaaatataggctcaagatgttcaaaggtggcttgccttgctcgagatctggagcttgatcctcgaaatcagcgcactgcgggtcttcgggctccgaaactacacgcgaaacgggacaactcaacaaacggcgaaaataaagccctattaaagacctctaagcgtgccattagatagatctcgagatttgaggaattttggaagttgaacggagtcaaacggatttacggttgggaagatattgagtttctaagattattggatttttggtctaaaggaaaaggatttaattaaatcctttttgaaaaagaaaagaaaagaaaaggaaagagggagggaaaatagacttccctcgggcggctagggcgcggcctgagagaaagggtggctcggccgagcttaacgagccggccggcccaagaaggcggcccagagcggcccaagacgcgcgcgcgcgggagggaggagagagagagcctgtggaccgggctcaccacgcgcggtcccgggtgggacccgcttgtcagcggctcggctcaccgtgcggagggagcacgcggcacggcactagggtgggggagggacgcggtgcacgcgcgcggttcgcggtggacgcggatgcggcgggcccacgcgcagcctcacggctcgcggtggaatgcgcacacggggagggactgactggggtcggctcgacctggtcttggctgagctggcgccgatgtggcgcctacgtggctgccacgcgggccggcgggaggtagacgacgacgccggccggaacggacggcggacgacagcggcgagcggcggagcgaaccacggcgatacaggcaaaagcgagcacactgggtagttgcacgagacgaggggagacgagccaacggctcggattcgccggagggagtccgtcggcggcggattgcggcggcggattacggcggcggcaaccggcggagagaaaaggggaaaacggcgacgaggtcacgaggggccaattcccggcggagagagcatctacgcggctacgggaatccgttgctagcgtcggattgggcggagctacgccgagcgaggccggcgacgagcgggtgctacggagctcgggcggcgacggcggcgagcacacggcgagcgacggcaatggtcggggcggcgccggctagctacggggaggctactcgcgctaccaccgaaaactaagggggggaggtggagcgaggaggaagaacggagggaggcactaccgtgcgggcggggcgcagtgacgagaggccgacggcgcgggagtaatctctccggcctcgggccgaggaagaggaagaagagggtgcgcccggagtcctcttccgcgtccttgctcgtgccggctcctccgacatgcgcaacgacgaacggcgacggcgaacagagcacgggggcggcgacaatggcgtggaggcgaatgggagaggaagggaagggggaggcttgggtttatgggatggcaatgtcggtttgagaaccgacttagggtggtcaagacgcgagctagcgctccggctagcggccaaaacggcgacagaggtgacgccggcgagagggaaaaaggggaaaagagggagagaaaaggggagctcgccccttgcctctctgggaaaaggaggaggggagcgggggcgtcgcggcagtgggaggaggggctctgcctccgtcccttggcggcttgcgcgcggagaggcggggccgaggcgatgacgacggggatgacggcggggcggtttggagcggagcggcgacacgggcgacaggcgcgggcaggcgctgacgacggcggcgaccaggcggtcggccaccacggcacgcgcgcgcggaatgcaacgggaggcgcggcggtttgagtggcgcggctcgagcacgcgcgctggctgcggggccgagcggctgcaggcgtggcagggcagcggggccgggcggcgcagacggcgcaggcgcgacgcgggcaacgaccacg

SEQ ID NO: 56831 - DNA, 1372 bp, Oryza sativa
cccccggggtagatgggccgagagaaattcggcccatcgaccccgggggaggtaaaatagacttttgcggagggatttgatttggaaggatttggattcggaattgaactcgacgatagatcggggatttgagatcttgagatggcacggacactagacaacaagcaaagaaacaaatttcgcaattagggtttttaagagataattttcccgctaggtgccacgacggaacgggcgctacacccatgttcctgagctaggacctaatgcatttcacccatcaaatcccaactgactgacgaataaatctcaatagttttactaaaaccctagactgactcgttttgacaaatctcacttaaacgagcgaccaagatttttccccttgaaccacaagaacagatcccaattttcccgtaacaaatccaattgcaaagaacatatgcaatgaaaaggattcagagggctcttaggtttttccatttggcttgtcctacggtcaaggtcggctctgataccaacttgtcaggcccagaaattcccgaatagaattccaagcagaatgtgcattaaaatccccgtccaggaccggccgggtacacaaacgacaatgttgacattcagatccacgtcacagggcccgccccgctcctaaactatccaaaatcaaaagattacactagggtgagactaatcacggtgaatctggttgaccgcccataaccgcgggcacggctattcgaatagttttactctgatcagaggtgtacaactgtacccacaagacacagccccacgacacgttaccgtgcaccgacatgtcaccacgacataccggaaagaggccgtgacaggacccttcgcataaccccctctaaccaagcataccacacctcaggtttcacccccactcctcgcaaggcagcgggcagtcccctctcgtgcctaggtgaatccggaagcgacagaggccgtcacagggcccgccccgctccatcacgcccacccttgcctggatgagttgactagaggaaagctacactacaagcccagccgttgcccacgctggcttgtggtaagtatgataagttcttccagggcatcctgcgaaccggtccttaactgccatgggtgcgaccagcaaaaccatgcacccacagcccaccatgtgatttattttaattaaccaacaccaaagcggtggcactaatccaacaagaccattagaaccaacagtctaaacattaaaaggattctccccattgtgcactagttgaactaagcatggctaagcaatccctagtccaatctctagtcatgttataaccccaagctgacaaagaaacatggtacaacaatagggctgcaggaa

SEQ ID NO: 56832 - DNA, 2105 bp, Oryza sativa
  unsure (1)..(2105): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggcctctctagagttcatcaggtagacaaagcgaaaatgcagttaggttagtactactagctaatatcattgaccttgtccacactacagtcacatgccatgctctataaattatggtgcgaggatctccccatactgaacgtattaatgcataggctaaagaaatcctgatatacagcaaggatgtctttcctgcgcgttttagcctggaagccctgcatatcactgtagctgggcatgggcagcatctctggggggaacacaatttttgctgcagcagggtgtgcagaaatagaaataagatcagccaggtggaactaattggaccaagcagtcaaatctgccatcttgcattcatgccagtttaactactggaagtaactagaaaaatttaactttgggtaaggtttaagcagtaactatgatatccaccctctcagaaaaacaatctgatttccagggtatcagtttgtaaatatcagaaaatggaacaatactaaataaatactccgagcaaatacatttttatagagaaatggagcaaataatccgatcaagaaacccaggacaggggtggagtatggaggtgattccatttcagtgccatgcctaggataggacacaaccaacctccttccaatgccatactgtattaaatgactctagaacccgtcaactaaacaggtcagcgacactgagctgccataaagcatctctacctaggagtccagtggtactaacaagcgaagaacaaatcaaattaaattccatgacactgcgagcaacatcaccatgctgtggaccacgggccaccaaatcgggctgacaacgataggaacgccttggagtccccatggaagcccccctaaagaggttcttcaaatcgatactgttgtgtaccaccgattttccttgtgcagtacagcgatatattaatggagagtatggttccagagtacaagcttgaaggtatgaaggtcccagcaaatttaatgccggtgaaatgcggcgtcaaaaatgaatgtgaaagggactaactcgagctagtagcttcactttgcttgcaacggagaagccgtggtggagcaggtcgccagttcatacagtgaaaccgacctactgtatgctgcacgaatgattgaacggcgaagctgcaaatctttgcagcctgatctgaggcagcggcgagatgcagcggccatgcgcgtagggagagcgcgcgacacggacgaggatgaatctcacgattcctggcaccggtgccaaagccggcgacgaggaacggagacggcgcagaatttgagacaaaacccagacgaggcaagcaaaacgaagagaagaaaaaccgaatcctgggtaagagagacacgcattcatgccgcaacgtcgacgaaccccgaatcgccgcgccaatccggggacaggtgcaccggaaatccctacgcagcggcggcgaggcgtcgcccagagcaaaccgatgcatcgaacccaacccaacacacggggaaccaatcccgaacgcgacgaggtcgatagagagggattagaggagagtggcgagcggagcgggggcgagcttacttggtggagacggccccggacgcgacggcgtagaccctgacaccgccggcggcggcgcggcggttgcgccgcgcggcggcggcgaggggcggggtgaggcggagcgtgacgtcgttgggccggagcgccatcctcgacgccatcgatgaggcccccgccgccgagagtggaggaggtggcggtgcgagatggcgatgcgggtggcgaggcgaggcgcggagagaggggatgggggtgtgtttggctcgcgcgatctccacctcaggtttgggagtgcgaggaggtgggg

SEQ ID NO: 56833 - DNA, 28511 bp, Oryza sativa
ccccccccccccccccccccctgatttatgtcgccatctcatctctctctctcccccgtatactaccatcgagggtgaaaaaccggtcgggagcatctttttagaaataagataattaatatatttatcatttagtcccttcagatttattttaattgatgttttggataatgatatggtctaaaaatacacctttaaaaatacacctttggccttaatttttctattataatatatataataaataaatacatatttacttttattatagtgttttgaaagataaatctatgtattccatccatactaataaaggaagttgtttaggacaacgtttaagtcaaaacttgggaatataaatcataaataactctcaagttattgaatttaaaaaggtaaaaattatacgaaaagatttgtcttaaaaaatacttccataaaagtatacatatatcacttttaaataaatatttttataaaacaagaagtcaaagttgtgttttggagaccgtgtagctattctaaacgacttcctttatgagtactgaagtagtatgttgttatgtatgttgttctagtttctttaaactaaatatatttaaagttattggtggttaaagttataaaagtttgacttcaaccttatccaaaacgtcaattgttatagaaccggagggagtaaactactcaataacgatattaatatgataaaaaatttaaattcagaatttaatggtaggcaaaagggtacggtcgaaaatggtattatttatatggaaacaatgttaggtcgatcaggaattttcacgaccgttttcacccttacagtactctctgctttattttctttgattttacatccggatttttttccatttttatctgtaattagagactaggtccggactaaagctaagccgaattgttctttgcttatgaagcagcgtgtctaaatcgcctttttattttagtagatcacagggatcttttcgtgtttttgtaaaagactaaaaggtgattttgttcgaatcgtgtgtcatgtgaaggattatttgtgtgagcccccgatctttcccgagccaaccccacgccacgccacaccgcgtactacgtgcgtgccacccggccgctacgtcctcctcctctagctgctcgatcggcgtacgtggcgccaagattgcgtgcgttttcctcgtcccacctcgcgcgcgcgcgacgtcggcagcggagcgcgcgcggtgcaccgcaccgagcaagcggcagtgcacgacgaattcgaagcggcgccgccacgcggtgtgcatatgctttccgagagatgcgatgcgaggcgcggtcgatgataccgaggccggcggcagcggagatgctcctggagtgacggacggaggcatcagaaacaaggccgagaccgagttttttttttttaaaaaaaatggtcaagtgactatggtcctccctggcgcgattctgcgagaatgattcgattgttggcgtcagaattcagcccagcgtgccaggtgcaggtgcagtgcatgtaggacacgctgctccggcagcctagtgtacgtactcctacgcgtgggttgtttgtctcttgtcggttcggtctctctctctctctctctacacgcgtgtcaatgcgcggggtggcgtgccatatgccaccgcggcaccgctctgcccggacgcgaaccatcggcaaattttggattcgcaggtggatgagggaggcccgcctccgcgagtagctttcacgtgtactcggcccaacatgaacgcagggtggtcggaggcccaatggattccaccaaattcactcagcgccgcccaccacggcatcgccttgtcgagctctcgccatggcccaccacggctgtttacaccgatctcggccctcgccatggcccatggctggatcgagttcgtgggcttggcaatatgacaccatcatcaattgcttgttatattaaaattattttttcaaacttgtttaagagtattttatcgtagtttatttttatcattaaattttagaccataacaacacataaattattttatgttgctttgtttattgttcgacggcgcgatagggctttctgaaattggcaacttcagaacaaactagttagtggtaagacgtcagacttgagactaattaggtttctgatgatgaaagctatactatgcctatcaacaagttatacccttcagaacgaaaagaacaggttgacaagaaatggcagctgctgggttaattaccccatctctgatcccattgggccattggtaagggagcacagagaaacgatacattatacatatacgaatgagtagactatcattccaccgtaccaaagcacaagcctgagtctgccatagtagcaccgatccacaaggaattcacaatatacccttcagtttcagtctcatgcggacaaaaaactccccaactctcgaaagacaaaaaagaaccaaccaggcgcagtgtacagttcacggcacgcactagggccaaccaaggaaccaccaacggagcaaacggtacggatcaagcatccagagattcaagatgctgccggataaacgctcttggtgaccgcgttgaagatgtcggtgtaccccacgacgccgacgagcacgccatcctcctccgactccgcgtccgtcacccacacatgcgtggcacggtgggacagcatctgcgccatgaccgctgcgagtgagctcgtgctcttgcacatcagcggcgcgctcctcccgcggtacatgctcctcattcgaccgaacgccatctggtgcgcctggctgttcaggaacccgatgctcctgctgctgaacttctttgccctgggtgagcgcccaggtccgatctcttccactagtgatgagctgatgggaggcactgggatggctgagatcggtgttgattcgttatcgtcggcaccaatgacaaactgccccgccgataggtttatcagtgcccatgcagccgcaacatagtcacatttccacagcttgtaggcagagatatctcctaatatcttgcgagttccatctggtgtagtctcgactacagctacggcacttggatctggagggaccttctgaattgcttccatggctgggacagatgcatcaacatgacagtaatgtggattgatggctccaagggaagagattggagacagtggaatgggcgcaagggcaccgaggcatccaataaggaaccggagaatgtcttcccttgagaggcagcagaacttgtaggtggaactggtagaggaggaaagctctctactgctgctagctgaggttggagatgttgcttccatattcttcagccacttcccgttgtaaagcactgaaaacctcttggagatgcctctccaggcgccattttttcgaacaaggaagcgcttcactccttgcttcatcaaatcaagtgcgtcgatcaaccttgaagaaaaaacaataacactcatttagtaacagggtaaagacctagcagtgcatttggaaaagatgaactacctacaaagcgcaaaggcatatagtccaaagatgctgttacaataagtaagacattagattcttttttttattagggtatatattcttttttctgaagcacataaaacaattccacaaatgcagaaataattggcatgcaatcatttgcaaatctaaccatattagtctttccatattatattgagccatgattggtctgctctgcatgtgtttgtgtgggttgggttcatgtaaattattgtcttcacacatgatccattaatagcatgaagtacagcttcaacatagattttcaccttcctgattatggcattacattaccacgaaatagaacctcatccccactttgttcccttatcataacacaaccagaagggcaagccgcttgaaatctgatagcttgtttaagtctgggtcatcatcattttacaacatgatactaaaaggagaagactgctcagctcaccgccaatatgcatcaggataccaacaaccaagtactatcctctcgaggtgttactactgaaacatattcagttatactctttctgcacttctgctagtggaatgcacttttggagttcaattttcctaacaatattacttaacgaaaatgcagatagaggatgacatcaagaaaacagatccaaagaattttaattttcaggtgataactcagcaattcaacatcagaagacaaatgatgcaggccagctaactatattcttgtgtatataaacaaacaaagggggaaaagacctaatgatggtatgaacaacggaacataacaaaccagagttctcagtgcggcggtgcgggggtcttaaaatccaagttatgtgatgtcaactaaacaaatcaagaagtaggatatgtgcaatagaaatatctagagatagttcacgtcgaaactatttaagacattgatctcccagatctgtaaagttcaacaaaagattcttcaggaaatagagtgcaaatgaaagccccttcttaaagaaaagaggatcaaagttatccctccgttcacattttctttaaaatatacatgttgtaagatttactataagagctcaatgtcacattagatgggactgagacttttaaagtagactgaatgattccagtcatactcctggacaggcttgagaggaaccatgaagaagcataaatgccaataacctaacacatctgtactattgaatattgatagtgactattacctacaatgttgcagtaaatacgataactaagatgcaattttaccctatcaagcatggcactgctttggctaatgaaaaaatgatgcatactcctgaataatataggctgtctacaggaaatataacaaatcaaagtccatttagctgcatcattccataggaagtttcatctagatattaatttttttttgcatgcctacgtctttttctagcatcttttagttatacgtaacagtgaatcaattctacagtgccatcaaattacaaactgaagaaagttggaaaaacagttatatgcattcctttaaaattactttaatcctaagtgtacagaaaccaaataaaaggaatagaatttgcatacttgagcatatgttttaacttaaatatacacttgatcttgatccactattaaattccgtccagaaatcaatcagaccaattatgtatcgtggcctagcatgataagatgcaaaggactacctggcattcattatgcttccatctgaaagatcttgcgtgttaaatcaatgaatatgtttgtcttaatacattaaccctttttcaaacaaggtcccgtgcaacttcaggaacacaatcgatatttgcaatcagcaaaagcatcacatccaagattaaataaacaacaaacccatgtgatcaattaaaaattctagtggacctagtgatagctttcgacctgcttatacaatcaaacgtcaaactacaaagctacgtagaagacaaaatcaccaactagatcacattaaacaaaagggctgatgtagcatctgcgttttaagtagtgacggatccaagctaacacgaacaacagtgcataaatataaattatatagagttatcaatttaccgctgcatacgacatgaatcgctttaggatgcctacaaagcgcgtcgaaagtacatgttggacatgatttagcacccaaaacgcggaaaaggttctatttcgctcatggatcaattgaaacaaacgctatacctactgatcaatccaacaccgccgcatcacaattggttatagttatgataaaatagcccccaaacctcagtgggcagatcaatcgaaacaagcacagctgtgaccatactacagacgcggggagattggtagtcatcatgaaacgaagggcggagggcggagacctcacctcgtgcctggatcgacctcccggagcaggccagggttgggctgcacgacctccccgaccacggcggccatggcccggtcaccgacgccggaagcggccacgaacgtggcgatgtcgagcgcggagatcatcccgaggaacctggcgcccgacggcggctcgtcgggcgccgcccggggccgccacacgggcacggcgccctcggggctggccgcgatggcccgcgcggcggcgtcgagcgtgtcggtgtcgtgcagctccacgacctcgggcttcccgacggtgaggtcgccgacaacatggtggaagaacacggcggccatgggcgcgcggcggccggtggcggtgggctataagagggagtggaggaggaggaggtggaggaggagcctagaggggccgaggccgaggccacccccaactccaagcgcaaccgcggcggcggaaggggagggggagaaggagaaggaggaggaggagaggtcaccgggggcggcgcgggtgtggggatcgccggcatgtcggtgggaggaaagcccattaaaggcgggggcgtcgtcgcctgagctcggctgtgtctggtcggagggggggagggggggggggggatcagcgagcgattggagcagaggtgagagagagatgcgaggttggcgtgggtggtggcgacgacgatgtggatggaggcgacgaagaacccggagagaacggagaggagaaataggaaaaggtggaagtgggcctcgctttgtgattcgggcaaggtggtgctggtgcgttattggagtgaccctgacccttattttcctttttattattattattatttttctctattcttctcaataaaagctcatcacatttatattaatataaaagctcgtcacatttacttcaatagtattttttaacacagtacaatggcatgtgctcagttcacgtcaaaattaaaagtctggttgaaattaaaatgatgtgacggaaaaatttaaagtttatgtgtgtagaaaagttttgatgtgatggaaaagttggaagtttgaagaaaaagtttagaactaaacaaggcctatggccttataagtacaacatacacaccctaactctataaataactagcgcatcataaaatcggaaagttaccacaagtatcttgcgcatctatcactggaataatgagaaatatgggtaaatggattaatagacaaaatatatatgtggaattttaaatattgttttaagtttttttaaaaaattttatagcagttaattcgtttgtttcgttggtactttcgaataattatcacaagacattcatttattccaatattcaaacaaaaaaatatgtctttaagaaaatataaataattttcatggaatatattcacccaaaacatacattcacaatcttcataaagaaacaattgaacaatctttgttgagttattacacattctaaagggagatattcttccaagtaagttatatgtagggatgcaaacatgacgggcaagcgggatgtttttagcccgcttatgtcacttctagtttattttttcttctaaattttgtactaccatgtgggaaatgaactagcaagtgggtttttatttgggtagcggggctgcctatttacatccctaattatagaccaattattttgtttatacttacacttatccatagtactccctccatccttaaaaaaaggcaaaccctgggtttccgtgtccaattttgactgtgcgtcttatatgaaatttttttataattcgcattttcattgttgttagatgataaaacatgattaatattttatgtgtgacttgtctttttaatttttttcatatttttttcaaataagacggacggtcaaacgttgggcacagaaaccagagtttgtcttttttttggatagagagagtacttattaacaaataaaaaaatattttatatctttacgagtaaacttttttatacatactcttagcaatttaaagcaaatgttgtaaaataaactacgataaagtaaacccattaaataaacttgaaaattaagttttaaaatttaaagttccacttataaatataagcataagacaaaggatggatcattaatgttttattaactcgaaacactgtaacatgttatgattggtctcatctgtatccgatcacttactcaccgatggctgtttgatacgctgtcctgctgtattaatcacctataaaatgaaacctaccaacagaagtactggttacaaataaccccaaaaaacattttccccctaaaagacaataatagatttttaaaaatactaaagatagcgttgctctcacccgcaaatcccaggttagctcgattgatcgatggcttagcacacaattccagaattttcatgcttctctgcatgcttctattcgataaattcaatcgctgtcgttgcagcatttccctttctcccttccctgtcgatcagagcatccgtctgcccatgcatctcttctgctttcgtcgtgtggcaattggcatttggcaatcgccttcttccgtcgtagaactttttgtagccagctttctttttttcacaattgagttgacgtcgctgcaactgttgcgttgttgaatttgtttgtatacagatcaatacggatcgagtagacgagtactatactttgattcaaaacatcatgtatattaacatatgcatatgatgcgaactactcgctccgtcaaaaaaaaaaactcaacctcgtatccttatagaataatgaatctggaaaaaaggagggtcacattcgtttctaggttaagtttttttttaaggatagagggagtatgtgactgaattttaatttcctactgtgtaggtctgtccatacggcgcgatcgaacggaatagcggagcacgtgttaccacggaaaatactcatagaagatattgagtgattagggtcccgttcgtttcttgtataaaaaatagatgaaaatttagatactcgtgacacgcttttcaaacggctaaacagtgcgtttcgtgtaaaaactttccatatgaaagttgttttaaaatatcagattaatccatttttcaagtttgtaataattaaaactcaattaatcacacgttattaccaccttgttttgcgtgaatcacttaatctttttcttcgggtgtgttcagttcacactaaaattgaaagtttgattgaaattagaacgatgtgatggaaaagttgaaaatttgtgtgtgtagggaagttttgatgtgatggaaaagttagaagtttaaagaaaaagttgggaattaaaccaagccttcatcttaatatttaggagattcaaacaccacctaggttgtcaaaatgcttttatgatgatattgcttttttttttttcccgtgacctaatattacatggtagtcaatgaaatctctttgacttgtcaaatcattatcatcgatcatcttcatatatatgaccaatccaatcatgtggtggctaatccatctgctaaccagttggttgctggcaacgtgtttgaaggcaaatcgcattgtgcgtaagctgactcatggaggtctgaaagggcgctttcttagggagtgtgtgtgagtcaagatggttggaccatttatcttttatctcccgtcaccacagacaatcaactgtcacataagagcgagttagagaaggtgtttagtacggtggcgatcatcagagatcccatcaattagctgtgcttctttatcacccatttccactaaggtaaaagaaggtataatgcctaatgaaccttaatttgtctggggacaaattcgagagatgatctgagttggcagcatgggagagatgggacggtggttcctcgtacgatacctgtgttcgtcgcttgtcatatcaccgatcataccatgtacgtactgtactactactcctgcaacgcaattctagcctaccaatttatttggtagtactaaaatattttttgcattaccaattttttggtaaatgaaagttaactagtccatgtttgattcgatgctaatataaaactaaattttagtagtatagtgaaaaagtttttagaatgtgaccaaattaagtgtgggtactataaattttgtttggtttcattcctaactaacattctatttaaaattatgttctgattgatgccaaaataactttttcaaaatttggtaatgctaaaattttaataaattaccaagttttaataggatgtgctcaatataatgttgtcaaaattttatagatatcaccaaaatttggtaacaaacaaaatataaccatatgattatcaattttattaaataatgatatggtttaaaatgaaatcgatctgaacaagtcctaagctatgaaaattttggtggggcacattttgacttcaatcaaaaatggtccaaacacttcaccaacgcggtggcccaatcgaatcgaggctacgtgaacgcgcctaccctaggtggcccggtcacgacgcacacgccgcggtgcctcgcttgcgtgggccgtcgtgttggttgggtctccggctctccacagtgcccacgggcctcttccagctcgggccggtcgcacaagccacggaagtccatgggcctaatggaatcagtgggccgaaaaccgagacgaagcacaactcaagcttatcaacgtttcagaattcagatcgatattacaagtaccagtacattttttttttctgaaaagccttttcttttgaaaaagagattttgtacttttttttttctgaaaagccttttcttttgaaaaagagattctgaaaagtatggctcccatcggatggcctaatcagccaaaaaaaagccaaattttgaatttttaagcttaattttaagattgattttgagatattttcaatgtagtttctttttcaacattggtttttaagtcaccaagaacacatttataaaagtttcacctacaaattcatttttatttcctaataaaccgttttgacttattagaaaataagacaaacgatggggacctatcactttcaggtcggcaatcaccatgctgtgttgtgacttgcaagtagcaggcagcaactaggatcatctacaattctctttacctataatatacaagggtgacgatccagtgattcacaggaaaatggcacccaaatgcaggttgaccacaaccaacctgtaccagtggcacacttgcagatcgagataggatcatagcagtagttgctcatgaatgacccgatccgtaacatggagagagagataaatgaaatgcccggtgattcaaggctctaccttagctgtatcatgcttattgccagctcacagtagttggttagtactgctgactttcagtttagctaacaagtactactcttagtacaccagtacggttaaattatttggagattagcaaatatattaaaagctactgttctacttcggttcatccacaattcaaccgccaagccgttgtcgtggtcgtgttgcattgcctgcagggtttccagtgtttacttcaattccctgacgtgcaggacatgaattctctcgatgtctctctcgttcatgaaccttacatgacgatcagttacacttctactatctttgtttcagttttactactaaatcggtcactgcatttttcagaacatttaggcggtcgttttccatcagcttgacaggtcgtatctgtcgatctgaatttggccatgcaagtgtcatgcgaagtatggcaccgtttctgatctcaccgctgtgtacgctgcagatagatgccattcgatgtgctcccaaatataaatatatattttctaggatttaaatttatactaatgaaaaaaattgtatatcttcgaccaatcagacgtttatgagaaaattacttgtattttgagattaagggagacgtttatgagaaaattacttgtattttgagattaagggagtagtattataatttgaccactatttgatacgtgttataaaaatacttttatttttgaaactaagagagtaatattatctttgattagctcgatctgttgatatctttctcatatatttgccagtttgattgatgtcacgactcggtgaccttgccgacgtggcctgtatgtaacgactaacatacactgtgcttgctacgcgtattacttatgtctacatcgagagagcacgatcgatactcgattattgtccttctgaaaacaacttagctgggattatatgtactgttgcgtattaattatccatccaattatttatatatggtgttttctggaataacacaggtgcatgttatctagttgcttcgatttttgttattctaaaggatctcgtcatttggccaagagttaagcatatgactaacggtttattagtaataaaaaattaaatttcaactttatatatggtctttgattgcttaaatgccaatgctaaaaaactacgttcaaaatatcctaaaaaaattgaagttttaatatttaaaaattgataacggctgattttttaagggcaaacgatgaggctgatagtcattgaaatggtatataacatccatgcaaaatggtatataactttcaaattattcttattcatccagatggcatcttatatcgatgagaataaagaatacgtatgaattacccttgcaggagaatgtattcgagtttttagagtaacattgaagatcaatttcagtggcttacatggatattggaaaaattttccacctattggaatttacaaatataaaatgtaaaatatataataatgtcaccttttcttatcatcatctcgttgcgtctaccttttcgccgttgtttgacaaaaatttcaggtagagacaaaaggtaatcgtcaggagcaatattgtattgcgttactagccaattgagggtgtcgggcatgtaagttgtaacacgccaaagaagatattattgactcagtcaaatttataatggattgctactattggagacatcgacatgtctatcattgaggcatataaccttagtactccccccgtcacataatataagggattttaagtttttgtttataatgtttgaccactcgtcttatttaaaaaatttatgcaaatataaaaaataaaaagtattgcttaaagtactttggataataaaataagtcacaaagaaaataaataataattctaaaattttttaaataagacgaatggtcaaacagtgcaaacaaaaactcaaaatcccttatattatgagacggagggagtagttatttcatcaaagattgtagtataacgagatactagtacatttctatttgaaaatgaattatgattttgatctatacgtaaaatggaattaccccatccgttcaaatatagcgcgtattttggctatccaattttgagttttgaccggctattgatataataatgtttaggttttgaccaaagaaattattattgttggattcatattatctgaattaatcacccccatccgttcaaatatagtgtatatgcagtttgaaagcattttcttatggctatgattccgtaaccgaaagtgaaatagtgtaagagaaatttattatcaaaacttgttcagaatacgtcctagtatttttgaaagaaggagtactgattttagttagagtaaaatacaccagcggttcttatacttgtcaggaggtttcacttagatccacgaacttataaagtgcacatcgaggtccctaaacttagtttattgtatcatcccggtccaaagccgcgtttgactgtggtcttgcctacgtgtcacgccacgtggacaatgatatggaatttttttttatttttttatcccttcttccttctttttcctctttcttccttcttttttttcttggtggtgagaggcggcacgaggagaggggctgtcgcagtggtgaaaaaaagaaggaaaaaaggagaaaaaaaattccatgtcattgttcacatggcgtgccacataggcaagaccacggttaaacgtggctttggaccgggatgaaacaataaaccaagtttagggactttgatgtacgctttgcaagttcgtggacctaagtgaaaccttccgataagtttaaagaccgctggtgtattttactcttttagttatcagatatcaagtcatgcgatttagtagttgtaaatttgattgaaaacaaggtgcacgcttccgaactgtgctaagatgacgacaaattagagcctacatcaatttccactaggaatagtatgaatggtctaaaaagatcttgcatcgatcgacaaaatcacatgaggacacgagacggatggctgaatctttgaattgagcatggaagcatacttactatcaacggatgttgctatctgctattgaagaatatatgagaatgagagacttgtggtccaacacatgtacacgtctatggagtgtctgaggccttgttcagttaggaaaaaaaatttaagtttgattgtcatattggatatttggacacacatttaaagtattaaacgtagtctaataacaaaacaaattacagattccgccagaaaattgttaggcgaatttattaagcctaattaatcagtcattagcaaatgtttactgtagcaccatattgtcaaatcatagcgcaattaggcttaaaagattcgtctcgcaattttacacacaaactgtgtaattgattttttttttccacatttaatattccatgcatgtgtccgaacattcgatatgatgggtgaaaagtttttgttttgggaactaaacaaggcctgagtggagaagaaaaaagaaaattgagaagatacataaaacgaggtgagccattagcatataattaattaagtgttagttattttaaactaaaattgaattaatatgaatatttaaaataacttttatatagatttttttaaaaaaacattgtttaacagtttagaaagcgtgtacgtggagaacgagagaaacattgtttgtttagaaaagtttgtagcagctgtagattgcctcggaatctccagctcaactcaaacattcatacttcttttacctaagttcaaataattataagctatagattttaggaaacgaattaatagttagaaactaaaaacctagtttttttattctcatcaattggttactcactacctatttgttagaatctctagctctctagacagaacgtaaaaatcacacgtgtctctgccaagttttccaagatgaaagccacataggggggttgggcattgtactccgtagctatcacacgtaccaacacttcaagtgtcaaattctttgccttgtcaccgattgcttagtaggagtaggagagagaggggactagcagattaattaggtggtgtttggatcagggacttaactttagtctatgtatttagacattaatttagagtattaaatatagactatttacaaaactaattacataaataaaagctaatttacgagacacattttttaagcctaattaatccacaattagagaatgtttactgtagcatcacataagctaatcatggattaattaggcttaatagattcatctcgcaaattagtccaagattatggattggttttattaatagtccacgtttaatatttataattaatatccaaacatccgatgtgatagggacttaaaaagttttagttccatttaaacagggtataatgagaaagaaaacctataaacttcactttcgggtctatgtatactagctactctccaatttcaccactggaattttcaacttgttttgtgcaatttattgttttttctcaatggtggtattcaagtcatacagaactactatacatttcaaagtactaagtttcaacatggccatgttttttattagcggtaacgaaaattgtttatctataaactttcaccgctcatattttttttcaaataagaatgaatacctgaaaagataccatattgttaacgtttatcgatttattgaacctataatcttatattcctattggtccatttaaaaaaatattattgaaaactaaacaacaagtcagcattatcaattgtttgaaaatagagagggtgtaatttacgatttaatccggtgacgacaaagctataattttttttctcaccaatggtaccaaatcgttgagcaccatgaaaacacataaagttctatctggatttgatttttagtccgtgtttagatctcctattcccaactttccatcacatcatatcacattaaaaactttttctacacatataaatttgcaactttttttcaaacttccaactttcttcaaactttcaacttttttcagaaactgaacacacctttaggttaggacaacaaactttttctgaagtcatttctgttactactttctctcccatccattattatttcatttcacggcagtaggaaaattttaaacgtttgaacaatctgcataaagtattaaaatataggctaaaaaataactaattatacagattgtgactaatttgcgagacgaatctttcaagcttaattgctcagtgatttgacaatatggtgctaccgtaaatatttgctaataacagattaatcaggcttaataaattcgtctcgcgatttactgatggattctgtacttagtttttttattagtacccaaataccaatacaatactctatataatatccgatgtggcttgccaaaaacgccgctggaattaaaagccccaaaatgctgcaaaagccaaaaaccgtctctagttacacccgtggggcccgtccacatcccacaacggcccaaaatgagagcatgacagcccgggcccacgcgctactcccagtaaagaaacacactctcccactctctcctctcctctgtccctcttcttcctcttctcccaagaactctctcctctctctctctactcttctcttctctctccttttgttgcttccatttctcgttcttgcacggggaagaggagagaaagatgtgtgtcgctgtggtttgaaaaaggttgggtgtgagaggagagagaaagtggagtggaggggagagagagagagagagatgggttcttgcgcttcggttcacaaggacctcgggttccccaagaagctgtttcttgcgtcgtcgcctaccaaggagaagaaggccgcgaacgggaagggtggcggtggcggtgtgtctgttgatctcaagcgaaaggagcagcagcaggcggcggcggcaggggttggcgtcaggagccccggttctggtaggattcgttgatcttggctctcttgggtctttttctgaagtgagtttcagtttcagatggttgtttgattgatcagtttggttgcttagctaggtaagtctattcttgaaaggttaaagagggagatgagtagatgacttggctgatctttctgtggaaaaaaaagaagaagaaaagaggccttttgggtttgtttattgattgatttattgtttgggtctggatttaagaatttgaaagggaagttttatggtgttaaaagtagtttatgaagaataaaaagattgcttattggtattaacaatagcttccgaagatcaaacagactgattgtttcagtaggaattgatgatattaactgaaacggacctctgttcaagtgttcatacaagctggttttcgattcaggttcatccaaatcaggaacttgcttcatggccatttgattagcctgggggggggggggggttgcagtgtgtttgtatctagtattactttgtccaaaatcaactgcttgctctttgtgttaccaatcatcgacgagatgtgcaagttgactgttttgtgtattctaatgttcttgtttgtcaattgggcacttcgttgaatttgtgtgttcattaattaagcctgatcgaatttataccatggttacacatgcttgtctgacctgaatatgcagtttttaatggatagaggaacttaaagaacttaatttgcaggtagcaaggatgaaatgttctttgactcgcgggcatggttagattctgattgcgaggacgacttctacagtgtgaatggaggtaatctaatgatgcagagtaaataggttccttctcactggcatgtctgtagtgccagtgccttgttcatgctgtttccttttcaagtctatcctattattgtatcagtagcatactagcatgaggcctgttctttttgtttagtccaaattgcatgtgcgctgattgatttggtgatgatacagttttatctgtctctctggattctaaggggcttattttagccctttgattgcttgttgagacaaaaggttgaggcctttgatttcgtcttttggcattatcatgtttctagcatctaataatctgttagctgcattggaccccccacctttaacttcggttacctattccatggggtcctttatttcagaagtcttgctatacacttaaattataagaaactccatttcttctgcatcattctggaagttcaatgaacaagtagatattctactgtaccaagtgattttgattgttttcaattcatgtgtaatgtatgttttttcgtgtgcagattttactccgtctcgtggcagcactccaaactaccaacccagaacacaaacagttatgagcaatgtctttgtacctgataatgtacagaattccaaatcacctgaaccttctccaactggaaggagaaaactagccgagctcttgcaggaggcgatgcagaatggttccgaagatagcaccgatgcatctgttccagacatcagcaagaatgagaagcagcaattccagcctgtttctgcagctgtgaagccagtatctgagtccagctccacgtgtagcacagaaccgacgccgatcagagaagcgaagaatcgcaaggagaaggcgtggtacaccggtcgctgttgcttgccggcttttgttcataccctagacttagatgagaggaggcagaagatgacccctgggccttgtgctgtttgacatggctgcttcccttctatgagctgtatctacaatatactacctgatccggccctgagttcactgtaaagaagactagtattgagagcactatatccttgtaataatcaagtgaatagtcactcttgagaattcatgtgctgtatccatgttaaatcaactgtaaggtgaggatatctagctcaagaaatgatcattttgtgcatatctggatgaatctttatggatataaaattttctcagttgtcaattttgtaatcaatctgtgggaagtgcatgtgacatgtgggataccatgccaacttttttcaataggttagcaatgtgattgattggcaaattgtgatggccttttttgtttgggatagcttgattgacgccagacaattggattgctctacccaataccaattgtcccaaacttttaattttttttcctttcattgacaattcagcgtggctgtgtgtcgtaacatcttgcagaatttgtgatttggcatttgtgccatgaatcgaagcctgattcgtgtgggttggcattctgcttgatggcgccaacgtgtttgtgcagcgcttttgatcgagcttatgataatgacaagccaactgccccaggatatggatgattacaccgttgccttcgtcatttctgatatttctaactactacttgatcagtttagtgtcagcgatgcaatatatgtgcaaaaaactcgaattctacaccgttattttgggcttgcaaacctggctacgaactgcaaaaacgactaggtaaaaatgaatttgaatgctcgttttttgtttggatgaaaggaccaatggatatcagccaaaaaacccgtcagatatggcagcccatacgacccctgtacacaaaagcacctaacattatcctctcacgagtatcacaaacacaataaaaacatggtgtctattgactctatttctctctggcccaccatttaagatcactttaatcaatcaggtttgacatgtgacacatgaacactatcaagatatataatttttatgatttcgatcatccaggggcaaccaaagccaacacaacacagtgcagcataacaagctggaagcttccattcaaaatacatttttcaaggttcacatctaagcagggtaaagaggtgtacagactgagaacaggcccaactgcctgcctgacaagagaaacattgtcgacaacactataaatatcactcgatcgttttggtgttgatattacaggatgcattgtattcctgcatagctcctccccacatgatcagcttcgaaccttcatacctgcggctccagtgattacgacaaatggactaccgaagtgaggaagaagacatgagaaaggattggatgcgttgcaggagctctgccttcacagaatcaggcactgatgctgttccagagacaagagataatgagaataatacgagagatagatattttgaaaggaaaaaaaaagaacttccccacccagtactgtaaatttgtaataccaccagcaataaacattgagaaccgagtgatgaacagatgatatgaggcattgaggtgaggatgtaagcttagtaacatcacaaatccatttatgcattaaaaggtaatatccatttatttggccttaactcacaaatccaattttggtagcaaaatatgagaaaagatgacaaaacaaaatgtgtgacagtgctatgttagtatgttactataatataattatacttttatattgtatttggcagaccatttggtgtgccgtcgactcagtaaatagaattcctcacacatttgtaggagaaaaattggagaaacaaaaatagctttacctcttccttttggagtaatgacatgaataagatcatctactgtaacattatttcttcctttcttccttgcataggccctacagaaataaaacagctcatagaaccaatgatggtacaaaatctatttgatgctgaaaaaccttagtgacctattttaaaccgtggaatgtgtacaaattccaaaatgggctcagcatgacaacatcaggtagcacgtgtaggtcagcgacgatctgtaatgtggtctaagtctttgggttttctaatctctctagcaatggtctataacaacactgcatactagggttaagaagaatcgtactatatgtactacatggcctagccaccatggaaacctaacagttaaagtaacattctgcaggaaaagtttaaaagcaccccccataatgttcaatgagcagccaaaaagcatgtataaagacccatatgctgtctggtttacttataaacctccgggcaagtttcagaaacagcataccgagtaaaacaagtgattaattgcagaaattttagatattgactgaaacaacaatatgttgaagctaattattccttcattcattcattcatgttaaagccttacaaacgcttgtgctttgtacattaagcaaactggtagctatacgcactaggaaacagaagacacagatcattgttcacagaggcttaggcacggaatcgttgccggaattcaggatcaccaagcagaaactcatcacaaacgatacaagaatttggtgggacaaggaaccaaacctgcagagagctttcatctcgtccctccagccgcactcgacgagccgctcccggaggagctccatcagcttctccttctccccactctctaccaacttcacaaaaaccaaaaaaaccacctcactgtcagtcaccacactcgaacacaagagcagcaaagattaaaaaaaaaagcacccacccaaaaaagatccactaaaccaaaccctaatcaaatctaatcgaagattaccctcttcttgggtgattggacgtcaccggtagccggagagtccaccgccttttcggcaccaagtggcaagaacttcaattccgcagcaaattggaaggggaaaagaaaaaaacaaccactgtttcgcagattcctgcacggtttctgcaagaggatgaagagcaagccgtaccttgacgttgatgatttctctgagggaaagctccttctgcggatcctcctcccgattcggggtcggcggccgattaatcgacgcccacctgcaacaaaagcttcaaattcaacaaaaaaagaacaccgctggatttttcacacctaaagctacatgaactgacgaaaagtgcgaattcatcggtaatggctccgatttgttcgatcagatgaagaatttgtggaacaaatcccaggatgcgcgtaggaacagcttaggaaggatcgattaggcgggcttacatgattggattggattctcctccccttcctgcttgcttgcttccagcttcgtttcgtggctccctttctttctccatcgcttcgaccgagccggacttaagagctgacaggctgggactgtttgcgcttactgggcctgaattttgggccgtttcttaatttaagagatttaatcaaatatccactataatatacagtatatactcgtcgtccctaaatataaatatttttagctataaatctcgacagatatttaatcagatttatagctaaatattattatattttaggataaatatagtaagttgcaaagtagaatagcaaactgctctctgttggttctaatgaagtgcatatacagcattgcaatttgcaatagtaattaattaccctggtggtggcaagattagtcgagataaattgcaaaactgttaatgcccgcaccatggcttggaacactcatatgaccatcagtaagacataagcatcgtcctatcgatctaagttatttccccgtttttctgctcctaaatcacgagtttgatctgtcactatttctactgttaatggtcaaaatggtcttgtatagattcatctgtaggagtacttattatatggccgttcagtctcaacaaaattcttagatctgacactagctgtaagtatactcttgacacacgtttaaagaggctaacaccatcggccttaatcttattaaaatcctactaaaaatgacacctatgtgtgcataattttttgtatccatcaagatttaaggggatgtttggttgctgccctcacttgagcgttctcactcagacagatcaatccagccgcaggcgactaaaatcgaacaactgagatcgatgcctgagttaggcatgattctcaaggaagcaaccaaacaacccctaaattctagacccacaattgcatcatcacaccatcgatgcttccgcacatatagaaaaattttgacaaccgatttacttaaaaaaaacatccgaatgattcttaagacaaagaacccatgattttctaacctttagatcttgctcaaagatttatgcatcacctcgtcaatctatctctaacaaacttcgataagctcttgggtttctccagtgacgacatatgacagatttagaatataaggtatgatatagattggaggggaggttgggatggagagagggattagggagggaagaggaaaggggtgaagattacgagtatagagggaggctcatggatggtgtggtgccgtggatcaggagaggagtgtggttagcggtggaggaaacaaggagagagttatcgagaggcggcggtcggcagtgaaggcgaggggataggagcaatgtaaacctaggtggaggcgatgggaagactaagtgcaatgtgaatcgggtggcggcgacgatgatagcacgtggttatttttctcctagctattagtggtatggggaataatgtaaatggctagattttgatccaatggttgaaaaaaaatgtttcagagaaaaaaattcaaagggtggttagatcatcccttttggaatgtttccttgtgattgaattaaactaacatgtaattttatatagaattttttccttaaaataaagctaatctatagatttctcatgagtggcctagaaaacagttgggcaaatttaaacccatcctaatgcagtttgttttgatgctagttttttaataatagccacaactattacaggggttgcagccttgcatgataaaatactataaactaaaaaaaccataatatgattaaaaataagacaactatgtaaaacaccaatccagagacatagaaaaactaacttccgtctatgttggcaatggcaaggaattgcataacttttattttttgagcggctttacaagttgtttgatgccactgtttgtcagatcaattactattgagacccatttttgttacttccagtttcagtagtgcacacggtatatttggattgagacccatttttgtccaagtcaaaacaattgagtttacacccgtaacaagaagctcacttgtgcattttcgcttgcaaacaaaacatttcaaaaactgccatatttcggaggaaaagaaaaatcctcgtcatcatcactgagacttcatcagtcacatatatggtggtgttagaatattctgaagataaagatgaagatgaagataaaaattaagtatttcacaccaaatgagatggtaataacttgtgattaattgagttttaattattacaaacttgaaaaatgtattaaccttatattttataacaactttcatgtaaaaagttttcacacgaaacacaccatttagcagcttaaaaaatatgccacatgtatccaaacaacttttattggagaaaaagaacaagacctatattccgacaaaaagcgggaaaaaaatctctctcctcctcaccgccttatccccttcatttccctcttcccgcctcctcatccacctccttcctcgccgccggcgaatgcctccaccggcggggctgctcccctggccggcgccgtccgccgcgcgcctggccgccccgacccggacgcgccctcctcctcgcactcgcgttcgccctccaccccctcccgctcctcccccgccgccaccgcctcggctcgagcccgtcgtcgtcgtcgcgccgagcacaaccacggccaccgcgacgctgcctcccatcatcacccccaccttgtccccctccacctccacgtgcctcgaatgcgtccacttcaactcgtacggctctctctcctcgaatgcgtgtgcgcgtgtgtgagagacggcgaagtgatttttttgattttttttttctgatgcgcgatctctgcaggtgttcgggttgcacgcacgaggtggatctggacaagccgccggtgctgcaggaggtggagaatttcttcaagggtcacggagttggagatttcaccttcagcagaggcaggctggtacgtgtagcttctaaacaattttggccgtgcccaatgtatgcaatccgtgctgtttggttgtctaatttacttacctggtgccgagattagtttaaagggtcatgaactcacgatatctcaggttcggttcggtaattagcttagctattttggatatatatgtagtcgtgcatggttttgttcatttgggaatatgtttggcaaactgatgctggtgttttgaggacatcaaagcaatgcgtccaccagaaaattttatcatccaaatgtagcgagctagctagctgaatttcttattcaattgtgcagggatagatcatggttagttgaaagtagcatcggtgttttttgtatagctaattatgtttattttttaatgcaaaattgtagtaacagagatctaatagatgcccaatcaacctgattatatgtttgtttgatggcctatgtggctatgccatgtgatgcgttacttcttagagctgtgacgtctgaaggcatgcaaatcctgtactaagccacattgccgtatggatctctcagtaaatgttttaggttatctaagaattatgatggctttgcttctccactaaacatgagaatggtgcttttagagggagtggcggtgccgtgcaaagctagctatacgtggaacaccagagaacccgttgattggcctatatcaggaagggacacacgctgttgcagatattccagagtgcagaggttagttaccacgacatacctcctatattcaatgaacttggcacatcctgtgccagttcgttcaaaaaagaaagttatcatgacctatgaaattaagagaactacttacaaaggaagctgcaatgatctggttgagcttcattgtgatatgctttattttttcatgacagtttatgaatcctttttgttttacattttcttcagctcatcacccaagcatcaatgctactgtcaagcttctaagacaaggcatgttcctacaattacttgtttgttgcttcattgggatatgcaaaaaaaaatatcctttccattgccaaagaaacctaatatatagtaactatgttcttttagctatatctgagttgaatattgagccatttgatgaggatgcgagtaccggcgaactgagatatgtgcaggtaaactgtttcttaatagcatgcacataatacatattactatatgaatgacagcttatgcatctttttctggctaaaaacgtcaccttatcaatcatattctttttcttcaaaaactcccatgtcattatgttagtgatcctggtcatttgatttattttacatattctctagatggctgtgacaacgtataacacatctattccagttgctaaaagatatgagcaaggttagcctgattcctcatgcgctgaatgctctaagtttcttttcttgtctaatactaattccaaattaatttaaatgcgctatttgcttaaccaggaagagttcaagtttcgttggtttggaattcaagggatgagcgatccaaaaatgcagagaagttgagcttgttgtcagaagtaagttgatgaaattgaggttctgcagctacagcacatgtagctgctattttgctttcgcgtttccttggacgttttctatcagtacttcaactcctctttttcccattttatcctcaatctctgtgctccttgcgacagttcttatggagaaatgggggaccaagaagtaatgttcatctgattcactctatatgggctaattttcagacatcaaccagcaatgtaagatacacccttgcattttagtgtatacaactgaacttattgtacatttgttggctatgcacatactgtgtttaccattttcatgatggatacttgaaaaagttgatgttttatctgaagttggacattgtacaattcacttttagaggctcagatctactggtttaacatctcaacatatccattatatatggatgaaaacagtggcacttatataataagcttacttgtacattcatcaagtatgtacaatcagctccctctgattagctggtggtagccacgttgtcaagaggatgcacatatgcaaaactgtatgtctgtattcctgcccccatataaaagctactatgctaatgtcagcatttgtgcaacacaccagggaaaaattctagtggactagaattttaaaaaaatatccaaggctttctccatgttcacctttcttttcttacgctataactgttggcttacaagttaaaagagacataattgaacattaccttcaggatatatgatttattttattcaagaaaaatgttcttacatctgcagataatttttgggcataaatggagacatctcattggggagaacgacttatgggagcgttatggtggagttgatatttctctggatccttatagctttgggcaggctaatactttggtacgtgtgattgaagttatcgctgattcatgtagaacttaactatgcaaaggactagataaaaccaaaattctagacaattcaactttctaggacatagtgatcaattgtatacaagcatactccatatatccttttgctgcatgaatctttagatatagtcggagaagtttcacaggctatgttagtttatactaaattccataccatcaatgtcttacaaatgctgtgacctctttgcaatgtctttcagtcttttaatgcgttactgcatacgttgcacaaatatgtaccacgtgggtcaacagttgttgacctgtattctggtgctggtgttattggattatctcttgctgcttcgaagaaatgtaggtgagtttatccctgtatttcattttggggcttgtcaaatagcttcattacttgacaattaggctaccaaagagcaacagcctcatttggtttatacttcatatgttgaaaaaaaatcataacctaaatgctttgcttgattcacaaacaagagttgggagtttgcttcatgttcattatatttgttagtatctgttggaggcatcagctcggattgcggaacttatcttgtttgtaggatactaagtcagatgcagtagaatagtactggtatcaagggaggtacggtggatttattataatatggtttacacttcattacaaatctagagtattctggagcaaattttgccttatgatattgtgttgtttctgcttgacctgaccaaaccttatattgggg

SEQ ID NO: 56834 - DNA, 16412 bp, Oryza sativa
gtatttcatgattttttttttacttccaggtctgtgaaatgtgttgagattaacaaattgtcaaaaatgtcttttgaaaaatcagcaagccgacttcccccaaacctgggttgtaccataacttggcacaacactgatgcttcagttgtatgtaactaaacttgtattttctactatggttacatctcatattatgaggattcatttggaaccttcatcatcataccaggaacctgttcattggctcgaagggtcaagtgttgttattgtggatccacccaggaaaggattgcacccctctgttatctgtgctttacagaaagttgctttgtccgaacgcaaggcatataaggcgaaaaggtagagatagttggaaatatcattcccagttctgtgctctcatgcttttattatatgatccatctgagtcttcttaatttgagaatttcgtgtccgttatggtaaatttattgatagtgatatttggtacatggacacagtacacttacaaaggtcaaagatgagaagaggccatggatcctaagagcaagagaggcagctgttcaggttgatagtacaccattggaaggaagtagtgaaacgtggccagaaactcttatatacattagctgcggatgggacagttttaagaaggtaaaagttactccctccatcccaaattataacttttggctatgtatctggacatatttttgtccagataaatggccaaaagttgttatattttgggacggaggtagtacatatatatcacgcactcagctagttcgccgaacctgaattatgagctctctccaaaatatgtaccttggctgctggctatcctggtgcgattattatgtcgtttataaccatttcttcaacaggactgcaaaagcttgatgtccagtaaggcttggcatttgcagaatgctcatgcttttaatttcttccctggcactgataggtattctgggctctaaacttgaatttattccgttgcactagcatattgtgaggattgatcttgtgaaagtctgtttagggttaccatggatagtataaagttgtagggcatcgcaggaacataaaactcttccctgacgccacctaccttggattattatagacatgaatttattttcaagtttggcatactctgatactcagataggggaaatgaaacattactatacattcttttcagcaatcaagacataattggtgtgatttctcatttgcattctgtgtctgatcatcaagttggtttaaatgatcaaaataattagcttgccataagctattaactaacctgccctaagctatcttgattcaatgacttgcgtaaagaactttatgtatgccgccccttttgtttggccccatttgatccactcttggttttagtacattacttatcaagatgagtgatttgtgttatctgcttgatatgcccttgatcacattgattgaatggaattactgacgcagcatcgaagtgctggcaatcttcaaacgagaatcggaagcagttcaaaagaaaaagaagaaagctaagaagaagaaagccaagtagacacccgaaaagctaaccttacagaaacaattttgctagatctggaaggctggaagtgacaagatctggtatacgtttacctgtgtaattaacgtgggtcctgaagaatttaacaccctccaaccaggcatcaatttaatacccggaagattcatgtaattcaaagaacttgcccaattatctggtttagtttgtctcagtatctggaccttccattctgtgcttctatagtatagaagagaaaaggtccaaggttcatatctctaaggttgcaaacctcccaattaatgttgttagttgacaggacgaatgaaaattcaccaaaacatgcaacatgcctacaaacatccctgaacattggtctagttttcatcctccatctttgaaaccggacaaaatgcattcttcaactattaataccttctagtactactgtacacccttgtccctgtttgaaggcggttttgtctgacatgggggtgacacatctgtccagtactcccgtcatcatttttcttttaaaaaatgcatctcttatatcagcctcatactcccttcttcctaaatttataccatgaacaacttagtattttgttgatttaattttgaatttggaaatacataattaaaaagatgcaaatgatatgagcaatttgtttaattgaaaaaataaccatatattaatcatatgattaaaaaataatcttaatataatcgtaaaaatagcccgtgtagtacatggttagaggctagtgttttttttgaaaaaaaataatattttgttaattagattgtcatgtcagcgccacatatatgctaagtaggataaaacgacctttaaactggagtgaggatgtaaactggagttttaaagttgtggtagttgatggatgtaagttgtccagttttaaagttgaaggatgaaaactagaccaaaaggcgatagtttgcaggtaccctatctttatactcatgacccatgaggaagttaatgcatgttgtttagggccttaaaatgcctataaattggtattagtgatgttgctagcactcaaaactttgtgtaaacagggggcatatgctaggaggagctcaagatgaacactccctttgtgtaaacaaggggcattccagtgaggcgctcaatatgcacactccaagcagcgtagcgataccactcgattgaatatgagctgttctgctagtttgttcagaaatatagagattactgtacatacatgtattcatcttatgatcgggttattgcattgtgaaactatcgcgagggattgccacagtacgaggaaacccctcataattaaccaaagaaaaatagcatttttcatgatcaaccaaagaaaaatagcatttttaactttccaggatattgcatggtaaaagaacaaataaatgaacagagcttctctttgcaaatcaccagtgatcgactgaaatcaccaaacttatactggtacagaccaccaactttatgcaacacaaatttgttttgcgtatccttaccaaccaaccttgtcagattttgcaaggcaaaaccgtcttttaggatacaggcattcggacgctcgatactaacaccgagcaaccatagactcttccctgggcttaaactaaaactatacccatcactgatatatcattttatgatgaaacgattgggcagcgaaatatactgtacaaagggggcaaacgggcaaaactcgctccatgtcatggcttcattggggcgcaacactgagtgaaaagaatagtagtagaactagaaaagcatacatctatctggtgcaaacaaactgaatgcagaatgcgtgcaaccacggtacatcgcctggttcaaccactggttcgttcgggtgacggtcgtgaatggcgagatcaaaatccgttaccgcttgcatcgggattgaatggcagctgctcccctgagtggctagatttccttgaccttggttgctttggggtcgaatatggcgagcttccatcttggaaggatgaagaaagcccatgagcccttggtagacctgttgcatcggcatccagggaatagcctctctcaactgtgtccgcttcaagtggtatctcatccaaagtctgaagcatgtcacaaggccaataaataatttaatgttagatcaatcagtatgaaatgctattaaaatggaaaacttagttctgacaaaacataccttgtatgcttgctgaaggaccttgagggtgtcacgtatttgcctcctctttatggttatttcatcgggttctctgagcatgtccgcaaagaggtcgtctctgcaacgatacatacaaaaacatccagcgtttgaaatgttataacggatttatagggaaacatccagcgtttgaaacattataatgtatatgagtagaaaaggcttccctcacctataaagcttagttataaggtaattatgcagctcccgttttgtgtggttaacctgcaagcgaaacaaatccttaaagaacatgcaacagcaaccccaagaggaaatttacagacatggataattaggatttctggtcagcttccctgccactagaaatatgcatgaaactgaatcataactggagaagatataggcatatttatttgaatatactaatgtggccagaaaagaataaggaaccatttataattagtgatccatccaatgcaatgaaaatcaacgagtcgcatcaacataaaaatgctacgcaaaaaggaggaaatataatcaatactcaagcaaaacacacaaccacactaatagtaaattagtgatccacttgcacttgctttttaagaagcaatgcttgacaattgtggtaaaaaaattgagaaagtgtcctaggcacacaagccttctcgtgtacacaccaactaacaatcttcaccaaaaattctagaaaaaattgtacatgtacttttagtagtatcacatttaagtgtaaagtctcatcttcaaattcattatatatatgtggagcaccaaaaaagacaaaattctgactgatttatacccttaaaactgtaatgctattggaagtacatgtacaatgttttctagattttttggtgaaatttgttagttgatgtgcacggtgtgtacatggaaagcttgtgtgcacaggatacattgccccaaaaaatgttatgtcttaatatttgtttactgtcatctatgcttaccatgacactaaaaatagtacatagaaagtcatgttacatgtccagaaacattagttataatcgaaataatgtgccaaataaatcaccatcctatgcaaagcgagtaataatgagaaaagtgagacaacgatcacggaccagaaaatgcatgattgcctttggaacgaagtcctcaacatttttccgcactatattgtaatatgacttcagtagcaacttagttattgctatttcaagcgcctcctgctcagactggctttctgaaggtttcaagacaactggtggctgtttgacaattacctcaatcaatcactcaacaaattcaaataacactgatgagaaaatattaaggcattgataagatagctcacctctctcaactgtatcgtagagagtgaatgctccaggtgggaagtagaagctgtataagatttgttcgatgagttgtcttttgcagaagaatgtgtacgatcatcactagtagaagaaaatattgatattgatccccagaaagatgtgcttccactacctaaaagatggccaataaactgggcttacatcaaatcgctttatagtttccccccaaaaagaaagaatcaaagcagtaagagcaacactagagaagggtatactattagcattcacatatgttagcacaacagacttaagatatgacatttgtagcaaaattcaaacctgaagatcctggcctctcagcctcagcagcaggccgtaaaccctgatagtggatgacaaaatcaaaagaagaaatgccaggtgtaagtgcctaacaattatagacattgcaagggtaaaaaaaatggtaatgacaaaaacctggagatgatctgtgactactccatttacaccagttctacccaaaagcgcacgcggcttttgagttttatcagaagcttgtgacttatcagcatctactccctcctgcagtatagtacgttagatacttaagatagttgataatatgaggaatcaagagcggaaattgcaggtgaaggatatgaattcctaagtcacaccacctattttccaagagaacaaatatctaaatgtgcaaaaaaaatgataatgcaaattacagaattaaagtatctgtaaagattatccaaattaccaaagtagtgtgcagcaagtatagcacaagtcctaacatggtgtacaccatgagtttatttagccatgcctcttactaaatgaaaaaagaatggttgaatacaaacaaatggatatccattatggtatgggcataccagcggttatcatgaaatatgttaaaagtcatggagaggtactatttttagctgctaaacatttattatagaattacatgtactgctcacgtagctcttagttccaatggtcctcaaattgtggcaatcctcatgcaattaagtagaagcacatgtcacttatgaaaagatagttcatctgtacatcattcattaaatattgttcttgtttgacaatatgcaattgccacaaacacaatgtacttggcagtgattctaccatattgttattaaattgtttttagaaaatcagaacgaaaaggaaaaggtaatggtgcatatgatgtatacatactcttctagccacagctgccagtctagaagacctaacttgctgctgtgcttgctcaacagccttgctgccgccgatgaaatttggatgagatgtgtttatgtaatccgcctgaaccaaaatagagttgcaggttatgacaatgaaaaagattatagcatatctatgcaaagtcaagagtaaatcaggggaaaaaaaacatcagctatcaatggcccaaacactagcttagatgaaatagcttggtttctacatacttcataaattgtgggtctgggggtcagtaatcagcactatttatggaagactatattcaaatattgctagtggcatatttctaaactccaatggctaccaggaaatttgttaaccattaatatccaacatgatgaggaattattacctccatctcaatgatatgtgctatcatatcctgcgcaggcttaagcccatcccgtaaaaacctcccgatgacttcatccatgctcctacggagcagaggaaactgctgcagctcaacagcaagacagcgatggctcatctacacaaaaacttaaattgtcagttcaagaagtaacagagcaacaatacatcagaatgttagttgatgctgtgaggtgaaccagatagatgcatcaaaagtgcaagtggcatattaagaaaaagcatatccacaaagatatactaggcattagcatacggcaatgccagacaagtggcaaaaaaaggtgtcaggtctaaccttgactagctcatcgtatatgaaacctgcacactgaaggcttggatcaagcaatctgctgatctgcctgcgtacaaggacctcaaaaggtacctgagaaatgttagcgaaggaaaaattgtcagcttaactggccatcatccatgaattactcttacaatcgttcttcctaaagtgggatggtatacctcaggtacgaacaaagcactcctaggaccagttgcgttctgtatagccatacggatgtcttcatcggtaacatcttcacaagggtcaacatcctgtgtaaaaagttctataacttcattatagaacaatgatgtggtacaacataatgaaaaggttgtaattgaacatgcaacaaaatcacgaacctctaagctttttacatatatagattgaaaaatataatggatccttgctccaccacaaagctcaattgttgatatgtcctcattttttccctccaccattgaggagaaagctataacataaaaatgtttcaacttaaaatggcacaatttatcacatacagcttaaacaaaagaatagacacactccctccgtttcatattataagtcgctttggcttttttttcttagtcaaatttctttaggtttgaccaagttcataaaacaatagcaacattgataacaccaaattagtttcattaaatgtagcattcaatatattttgataatatgtttgttttgtgttggaaatattgctatatatttttataaacttggtcaaacttaaaagagtttgactagaaaaaaagtcaaaacgacttataatatgaaacagaggtagtatatgataagacttatacaaaaaataacacaggacttttaatcatacacagtattaaatggcacaattgaccattatttaaaaattgccagcacagttagtcatgattcaaaaattaccttcacagtactttgccagaatgttcaaaagcttagcaccttgaccagcctgcagtaaagaaacacagatggaccatcaacaaagaggacaaaaaattagctgagaacacagatgaattggcctgatttcattaagccctaaataaaaaaagtcaggtaatattgttgaaaaacatttcaaacaaattttatgcttctaacacttggacaaaatttcttttttaattcaaaccccaccttggactcgactggatcaccataaaaggaaagctccttagcagtagttgtcaattgagaacttatacgtgacttcaatcctggcagaacagtctttatatgctggaccaaaatctgaaacatacagatgtattttcgtttaaatcacaacagaaatatgaaagttatcagattgattacaactgataatttaattacataaatacctggtttaacttctttgctaattgtggtataccacagtactgagcaagaccattatacgcctaaaaagtcaaggaaagtgcatttcacaaacatgtaagaagaaaataagcactaaagtaataacaaaattcattgcagcctactggatgattacggaagaaactttcttcgcgcgccagagcttccttgatactgagatctgatttgatatcctgcatcgccgagaaaactatataatagaaatctaataacactaaacttagcactacaatggaaaagcatttgtccaggttatggaggattacatccttggtatgctacaaactactaggacaagtttgtaatcacaaggtagtatacacatctctatttgttacccattattttatgaacaatcagcaggctgatgctagacaactacaccatctggaagctatggttatcatacagacatacagaatgagttcgctcacgaagtcatgagaatgaccagaatgcagtacctgttgactgcggtttaccacaccaacatagcctagtcgtaatggaatcacatttcccaacagaaagttacgagcatctgtgcccctgtccattatgtccagctggaagataatagaagtgaagccaagatcaaactgggtcactggtatgaacacaatgcttatttaatccagacaaaaaactcaagaccagggtcaaacctttgttataacaccaattgttcgagaacctacaagaacaatgaatcaattattaataagaaacaaaatatattaacatgaattatctaatggattgagtctgtagtgaataccatcagggtcagcatttcgagcaatttgaagagcatcagaattcgataagtctgcatttgctggcgaaacagccaagatgatacatgtcttgtgcttgatatacgacaatatcatggtccttattctggcctcaatgtcagttggttggtcaccaactggcaccttagttatcccaggcaagtcaaccaacgtaatgtttagaacatttggtgagtagatcttcagtcgtatctgcttatctgacacacctttgttaccacccgcctctctgtctgtttcggcctgcattgattgggggaatgattaatagtgctctatgccctatggtacagtttgttcaacacttgcaggcattggcataactaaacaaaccagcataactgaatcaataaaagcataacacaacaaatggtacaatttttctagcatatactgaaaaaaaaattaaatcaaaggtactattgtgcacacttctccaataacagattttacataaccactaaactcagcgaccagttcattccggacaaataaaagcaatggtaattaatcagaataggataagcgtcaccaaatacacaggcatatacaatctccacattcaagcaaatcactaagtttaaactactgacaatataccaaaggctgaaagtacaaacatctcaaaggcaatgaacaaatcaaagagattttagataaggcaatacacccacacctttgaagaaacacaaatggacatcagcacaagtcaccataaaagcaactatgagaaaatatcgccacccctaaatctgaagatggaatataacccaaaagggttatcccccaatccaacctggtagtgttagaatgtacccaattgcactaaacctatagagcctaaccggcatcacatacatcataaaaccgaacaaattactaatgatccatccaaacctggtagaactactcgaatccctagcaagctgccattacacaacaacattagtacattaccagtagactcacgagcagtacaatactaattattcatccaaatcaccacaaactattcgaaaccctagcaagcagtcataacacaacattaccagtgaactctcgagcagtagaatacgctaagagcacaagcgaaggttccaaactagtacctctatcagttaatcaaccatcagaacgcctaaatcaacatcgatagaagatagagaatgcgaggggggaggggaacctggatctcgcggcggatttcgcggaagtcatagaagcggcggccggggaggtggaggaactcgccccactcatccgcctcggcgtcggcggggcggcggggctggtgcacgagctgcagcacgaggggtcgccgcgtgcatatgtcggagccccggggcaggaagtcgcggccgacgagcgcctcgaggacgctggacttgccgctgctctggctccccacgacggcgacctgcggcaggtcgatcgtggagctgctccccagctgcgagaagatgtcctgcagcttgttcacgatcgggatcaccgacgaccccaccgccgccgccgccgcggccgccgtcgccgtcgacggcggcgcggaggacgagtagatgccgtcctccatgggagcgaaggggtggaggagggggctccgccgctagacctagggttttgtgcggcggaggcggcgactctgcggcaacacgagggatccctagatcgagagctctcgcgtgaatttttttttttttttgggtatcgatttgaatcgggaggtgtcgaggggaaggagaggaggattcagaggtgggagagagaggaggaattgacctttataacccccccccccccccccccaaccttcttggcctagggaacaagaagaacgtgctgcttgatgcttctttctttctttcttttcgggcatgaaaacaacagaatcgatgcccgattgtgcctctactgttttataccagagtgtttctttctttctttcttgatcgacaagaagtcactgtaaattcatcatcagtagtaaaagttcattggtttattccgttaggactaggcccaattctttttcttgactctaaattttaaatttcttattttcatcaaaccgttaaatggtgtgatagatgttgtttaaataaataaataaagttatttttaaattttataatagtcaataattaattaatcatgtgtaaagaagttttctcgtttagtgcattataattcatctttatcatatcaaccgcatttgatttcaaggatgtaggaaataatcggatatgtgctgtaaaaatagcttgagcaataataaaactgtagtttggatcgggtaaaacggggtctcgtaggcaacccgtccggcgacgacgactttcttactcgtgccgcgcggggatttgactatttgcgtcgaaaggcgaaatcctgaccgtccgatcatgagcggtgacgatctgagccgtccgctttggagtcgagttcgtctcagtccccgcggaccagtgaaaccattgacttggcgtggccccaccagaagggccatggctgacgtggacagctgggctggcccacctgcattgagggaggcgacaacgataatttggagattagtggcctcggaaacagcgtgacggcgacgtccgtcacggcggcaaccccgtttggagttggaatgactgtgctcaacgcgctaatgttgcactactgtacttcgtctcatggttctgggccaagatagcccagctgatgcaaaatcttatactgggccgtgatgagcacgtgttgggcctaaactgctcgagtttcaggaaagtttttgacgggccagggccttagttgggcacctctgttttgttgttcaaaagttcatggctcttttctccattcagagcgtttgatgaatcaaggccaaaatttccattttgagttttgagtagtcacctcaatataactgtggagtggcatttcgttttcttgcttttctttttttctactggcacttgtctcacttccctgtcagattactgacctatgaggggaaaaaacacttgtggattacggacgggacaagtaatctactaacttcgtcaaaacatggacaggtggcagctatgattgtcatctgaattgaaaatcaatttggaaaaatactggatccatctcgcccattggaagacgaattattttgaaatattttgtgcgctttcatgagcaaggcccacgtgatatcattttgagagttgttggcgaaagcaactggcaatggttcaacgatggcatgtagccatgtactgtcatgacaacaagttttctcctgttaagcattcaaaaaaacagttgcatcggccacactgtatacttgtacaggacaattgatcattgatgtgtccatctgtgaaaaaaaatggaaaaaaaatcagagaatcatacacagatgattaccataagaaggaatgtacttgcacagaacatgtttacagtcagagaatctgaagaaaattatcaatgctgaccatgtaaactgtgtacaataagcacacaataagaagattctctgatatacacatggccccaacagtttacaaatgcatgcaaccctgcttctgaagagcacattcccatttccatatcaaaaaccccaagagggattgactttgtacaagagaagtagctagagacgcacatgccgagagggagaggagaaactgcggtcatatcatgcaccaatgctctagcaacgtgtgaccaagtagaattggtctcattggctactggcgacttattttgaagagatcaacgtccaaaaaaccgaagtgttaagtaacacgccgagcagtttccctcgcacgcttcttctccctcttctccttgaatcctttaatttgctccgtttcttggcagtggccagccaatgatgatgggtggccagcagagcgcgctcaaccagctggtgtcgtttctcctcggggtttcggcggcggccgtgttgatcttcttcttctcgtcggccggcggcggctggtcgacgacgacggacttgtcgagctgggcgaatgggactgtagcggcgacggccaaggagaccaacctgacgagcaccgctgctcatgtcgaggagaaggctaacctgacgaacagccaggtctggaattcagattagtatacaaaactgtagttttctgtgtgtttaatttgtctgaaattttcttggcttggcaaaagttgacttgaaaattttgaccgtgcaggcggcggcggcggaggcggcgaaggaggaggaggagaaggagctggagaagctgctggcggcggtggccgacgagcacaagaacatcatcatgacgtcggtgaacgaggcgtgggcggcgccggggtcgctgctggacctgttcctggaggggttccgcgccggcgaggggatcgcgcgcttcgtcgaccacctcctcatcgtggcgctcgacgacggcgccttccggcggtgccgggacgtgcacccgcactgctaccgcctcgccgtcgccggccgcaacttcaccgacgagaaggtgttcatgagcgaggactaccttgacctggtctggagcaaggtcaagctgcagcagcggatcctcgagctcggatacaacttcctcttcacggtacgttacaacacgctacgtagcagttggaacagtactactacatcttataaattcacaaaaggacaaaacaaaaattcgtactactaatttcatttcacaaaaaggtcctccacgtacataagcacattttctaaaagcatccttctaaagcatattctagatgcatactccctccacgccaaaatattacaacggacaatgaatctagatagaacatctatctagattcattgtactgaaagactcatattagattgtaacattttggaacagatggagtaatagattatgtaatattacgaattatcaccatatacgtgcttaattactaagcttctaaacgttgcaaaaatttctttgaaatttaaagtactaatttgtagtagtatgtatttcaaatagtgcctttttaattcaactcactaaatatataatggttaaacattgggtaatttatcgataacgcaccccttaaatatgcaaatatcgcaatatacacgcaggacgtggacatcctgtggttccgtgacccgttcgagcagatgtcgatggcggcgcacatggtgacctcgtcggacttcttcgtcggcggcgcctacaacccggccaacttccccaacacggggttcctgtacgtgcggtcgagccgccgcgcggtgggggtgatggaggcgtggcgcgccgcgcgggcgtcgtacccggggaggcacgagcagcaggtgctgaacgagatcaagcgggagctggtggagcggcgcggcgtgcggatccagttcctggacacggcgcacgtcgccgggttctgcagcaacacgcgcgacttcgccacgctctacaccatgcacgccaactgctgcgtcggcctcggcgccaagctgcacgacctccgcaaccttctcgaggagtggcgcgcgtaccggcggatgcccgacgagcagcgccgccaggggcccgtgcgctggaaggtccccggcatctgcattcactgaagaaaaaaacaaaaggcggttagcttgttagtgtagatgggtgtttttcacgaacacgtaaaaagattgtacgtgtatattcactgccacgcgtgctgtgaggaagacggatggaaaagaggaggggcggggggtctatacgtgttcttaaattagttcggtgttgcattatcaattgtttgcctggccaggtgtataactgagctgagatatatattccaattgttttttcgggtacccataattaaaatccatgttgagagattgaaactgtttgtcgggaaaagccagcatttctccttccatccaaatgtctcggacgtattttcttttatcaccaaaaaaaagaagcaatcaactcatcccgcgtacaacaaaaattaaggaactatacacatgtatgtaaccagtaagtattaagatggatgctcaagttctgatcaacgattcaatctagcaccacagataagaagtcttgggtgcatagaggctaccaatatacccatctcatttagaaagaccagaaaaccaaatatgcataagacttttggtgaaggagtagatagctgtgcacattttgtccgctactgaacaaagcaacaaatatagtatgtattaaatggcccgccagaaaagaaaaggtaagtattgaagtgcgaaaattcttatttttagaagtttcttattgaagactctttatgagcttgcactgtaaccgtttggtatatatagcctttttcctttttaacagctatttttttatttcatactgttgcctctattttctacctctaattattctctctcatcttttagaactccataattcaacttagggttcatgtcacacgaaagaatggttgtggccccttagcgcaagctagagaatttaagatcaaccttaaaaagttacatcgccactttagctcaatcattcatataacatatgaaaacttatgagactcggtggctttgtatatattaggaaaagaaaaggccataaaaacccttcttgatgagggcttaaatttgggtgttttaggtgtatatccatacccaatcaagtgagctagcctcaattcatgagtccaaataacgaatgatatatcttttcagacatttttgtgatgaccacgggcatgactcatatcttgtagcgatcttttagaggcgtccttgtaatttacttccttttttaagacatacctgtggacgggtgctagtgtgtagcgcccgttccgtcgtggcgcctagcgggaaaattatctcttaaaaaccctaattgcgaaatttgtttctttgcttgttgtctagtgtccgtgtcatctcaagatctcaatccctgatctatcgtcgggtccaattccgaatccaatccttccaaatcaattcctccgcaaaagtctattttgcctcccccgggggtcgatgggccgatttcctcccggcccatctccccctggggg

SEQ ID NO: 56835 - DNA, 28457 bp, Oryza sativa
  unsure (1)..(28457): unsure at all n locations
cgctccgcccgcgcgcgtgcgcgtgagccgccgcgccgagcgcccccttcccttctcctcgctctgccgcgcctgcgtaagccgcccgcgccgagccaagtcctccctctccgctccctcgctgccgcttcccgcacgccgtgttcgcgtgcgcgcgcccgcgcggacgccgcccgttgcaagccgcgcgcgcgtgccgagtggccgaccgcccggtcgccgccgccgtcagcctctgcacgcgtctgtcgcccgtgtcgtcgcgccgctccaaaccgcccgtcgtcatcgccgtcatcaccgcccggcccccgccactccgcgcgcaagccgccaagggacggaggcagcgcccctcctccctctgccgcgtcgcccccgctcccctcctcctttttcccgaatcggcaaaagggcaagcccctttctccccctcctttttcccctttttcccccgccggcgtcatcctccctgtcgccgctttggtcgcgaccgccgagcgccagctcgcgccttgaccgccctaagttggttcccaaaccgacattgccgccccctttaaaccccagctccttcccctccaatctccctcgttttcgcctcctcgccatagctgccgcccccgtgctctgttcgccgtcgccgttcgttgttgcgcgtgtcgaaggagtcggcacgagcaaggacgcggaaggggacttcggccgcgccctctccttcctcttccccagcccgaggccggagagattactcccgcgccgtcggcctctcgtcacagcgcccctcctcatctcggtgatgcctccctccattcttcctcctcgctccatctcctccccctagctttcggtagtagctcgagtagactccccgtagttagccggcgccgccccgaccgttgccgtcgctcgccgtgtgctcgccgccgtcgccgctcgagctccgtagcacccacacgtcgccagcctcgctcggcgtagctccgtccaatccgacgctagcatcgagttcccgaaaccgcgtagatgctctcaccgccgggaatcgacccctcgtggcctcgccgccgtttccctcttccctccccaccggttgtcgccgccgcgattcgccgccgtcaagcttcctccggcaaatccgagccgttggctcgtctcccctcatcacgaacaaccgcccggtgtgctagcttttgcccgtatcgccgtggttcgctccaccgctcgccgccgccgcccaccgtccattcgcggccgggtcgtcgtctacctcccgccggcccgcgtggcagccacgtaggcgccacgtcggagccagcttagcctagaccgggtcgagccgaccccggtcagtccctccccgtgcgcgcgttccaccgcgagccgtgaggctgcgcgtgggcccgccgcatccgcgtccaccgcgaaccgtgcgcgtgcaccgcgtccctcccccgcccgtgcgcatgagccgcgtactccctccgcacggtgagccgagccgctgacaagcgggtcccacccgggaccgcgcatggtgagcccggtccaccggctctctctctcctccctcccgcgcgcgcgcgtcttgggccgccttgggccaccttcttgggccggccggcccgttaagctcggccgagccgccctttctctcgggccgcgccctagctgccctttctatcgggccgcgccctagccgcccgagggaagtctatattccctccctctccctttttcttttcttttcttttccaacctttagaccaaaaatccaataatcttagaaattcaatatcttcccaaccgtaaatccgtttgactccgttcaaattccaaaatttctcaaatctcgagatctatctaatggcacgcttagaggtcattaatagggctttattttcgccgtttgttcagttgtcccgttttgcgtatagtttcggagcccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgcgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccgggaaacgtaccgggtgtacggtttcccgctctcgcacttaaggaccgattccttgtaatttcatccaaacataagacaagtacgaccacatgggtggaatgggacacccctggctgagtaactaacttatcaggggagccttgatgccgagagacatgtggattcgccggggtggtgtcggggaggacccctgggcttcctggcacaatatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctacagaggttaacaaactgttcgaacagccgtgcccacggtcatgggcggatgtgaggtgattcctagcgtagtttggtttgactactgcttgtgaaattgctgtgtgaaaaggggttcggtgtttgaaaaatctgcagctgatgggatcagctaggcccgggtggccgtttgaaaagttgttggcccgggtggccgtttgaaaagttgttggcccgggtggccgttgaaaaagctgttggccgggtgccaaccttgtttaaattctaaagactgatacattgcacatactccgaccggacgagacgcactgtctcacccgtgtcgtttgagaagcactcacttagttgtttttagaaaagagctcaaataaaatcaattgcaaaaacaacagcctttctttgaagcctgcattaaacacttacttcccttggcttactgagtactcccatactcacccttgctctatataaataatcccccccagttgctgaagaagatgaagcggatcctgctgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgtttcctgggactggtatcgattaacaggttaatttggagcgtcacgggctagtttcggtcgggactagttcggggcgtgacatagtgcatgcaaccctaatcgatggcaataaacgaccgcaatagctaagccaatgagatttattttttggttatcccaaaaatcgaagggggttgaagggaggaggcgaagggggttgggcttagagggatggtaggggaggcggtagagccaaagccatagcatcggagaaggcagggagagggagggcaaggtcggcggttgtgacatgagatcaaaagtggttagaacttatgagtggaggtggatgtggaggtaaaggtggtcgcggcggcatgagccaccaaagatgaggaagaaggcgggggcacctcaccaccactttggcttcgggaatagtggggaaggaggaagagtgggtcatctagcgggcctcatcggccctggcgtagggcgaggcacatggaagaggcactgcaaggtagggaggtggcctcatgcgcgagctcaagatctagtggtcggagacgtgcgctgcgaccatggaaaaaggaaaagaagaatattaggttaatatactttagtcgtgatctatattgtcaaaaagctttaaatttgtaaatatttttaggtgtctgaaaactagataaccttttttctatagtttgttcatgccgttataatataggggcatcagaataatcagagtagtcgtcttagatttttcttggactaatgataggtatcacacagtaattttcctaaaagaatgataggtgtcacgcacttgataattagcagaaaataatgttatagagaacaacggttttcaacttttcatcgaggaaaggtgtaaatatacaatgcattgaagaaaaaaaatcctgatcgataagcatttaaaagccagcttgattcacaatatgggacatacgttactacaaaccatagaagatagttgtaagtttctatcccatatatataattaacctgtatcatcattagctgtattctgccaagttcataaaaacgccctataaaaaaaatcccaggctttgcgcgtctattctgccctttctccaactcttttttgctgaagagttttgctctccgcggcgcgtcgccatggagatcaagggcaatctccgccgcttcttcgtcttcctcttcgagctgtggctcgcggccacccttgtcctggtcctgctatgcgtgctcgccaacacggggggatcgccggagatgccggcggcggcggaagtctgcaactgcagtcagattggaatcgcttcttctcgcatatcagaagaagttactggtaccagcggtaattccaacgaggtaataatgcttttgtactcgatctcgatatgtatggtgatgttttttttctttttctttgttctgtttaattttgtgctctgttgtatggttctgtacttctgtgttagttcatgacagtagcaatctgcaatcttcagtttcatataccatgtttcttacagccccaaatgattaaatcttatatcttgtctttgcttaagcagaaaaaatgtttatttatgaagaggaaccataagtacaatttttcgaaccattagatttgcgcggcaaaagaaaggctttctttaagaagggaaacacgaatctttgatcacatctaacggttagaaaattgtattatatcttcaaaagtaacggaaaagcccgcgcaatcgtacggctatattatagagcgtagctgtattgtttatgtctcatgatcggtatgattataatcatggtctattgatcatatttctgatacgactatagttaacacatattattataatctaggcctgttaaaacaagaggcgcatcatcgttttttctcgagataggtattgcgtatttgataattagcagaaaaatagaaaaacaaatggcatatgtgacaattgttgagtaggagaaaggagtaatgcaacatttatgtgcattgacaaaaagggaaaacaatgatgttattccgattaccattaaagatccagattttattccacagacaacattcacatgtgacaaaatcacagaaaaagaaaagatcaacgtacatatttagtccttaccttcttttagagcttatataatactgtataaataagtataaagtgaggttgatttcagttcagttttgcaggaacgtacggaaaccacttcaaatagtcatttttttgtgcttaataagaataatgatgctttcatcatatatatgtgaatatgccacctctcaaatagtgctgaaaagattcagtacagtacttcccttcacaaaacacagttagctagctcattaaaacagtcatgatcctacttcctagaaatgaactgttagccgtgtacattcatttaggatgaagaggtggggttatataatccattatcaagaaaacaaatagagatttactccgatccagcaaaacagtatcttgctccacgtagacatgatgcctatataatctgaacacacaagtactgttctgaagaaactctgaacactcaaatattgattcaaaaattgtactgcagttctcatttaggaagtgaatagctacacttcaaaagaatttatccttttttacatctccaatcgacacccttaatttggatttcaatattccagtcaagttttgcagatttagctgagcttctgcccaaggtggcaaccgacgacaggacggtgatcatcacgtcggtgaacgaggcgttcgcgcggccaaactccctcctcgtcctcttccgcgagagcttcgccgccggcgagaagatcgcccacctcctcgaccacgtcctcgtcgtcgccgtcgaccccgccgcgttccaccactgccgcgctgtgcaccctcactgctaccacctcaaggtggacaccatgaacctcagctcggccaacaacttcatgagcgaggcctacgtcgagctcgtctggaccaagctctccctccagcaacgcgtcctcgagctcggctacaacttcctcttcacggtaatgatcaaatcaacctcgctaagatgtatcgttttctaagcttcaactttttattttactttttctcctttcccctggcataagccggtttggctaattgcgttgtataattataactcttttcttctaatatattgacatgcaatcattttacgtgttcgtgaaaaattagcaagatgtatcagtttcctcttctaatcaggaactcaaagatcgatcgattcagctaatggtgcgatgatgatttcgtgttgtaggacgtggatatcttgtggttcagggacccgttccggcacatcggggtgtacgccgacatgacgacgtcgtgcgacgtgttcaacggcgatggcgacgacctgagcaactggcccaacaccgggttctaccacgtgaagtcgacgaaccggacagtggagatgctgcggcggtggcgggcggcgcgggcgaggtacccgccgaaccacgagcagaacatcttcaactacatcaagcacgagctcgccgccggcctcggcgtgcgcgtccgcttcctcgacaccgccgtgttcggcggcttctgccagctcttccgcaacgacatggcgagggcgtgcaccatgcacgccaactgctgcgtcggcctcggcaacaagctccatgacctgaggagcgcgctcgaccagtgggcgaactacacgagccctgcgccgccggaggggaggaagaagaagagcggcggcggtggcggcgaccgccgcgccgggtggagcgtcccggccaagtgcgggacgccggacaagaggggatgagtccgggccggcggccggtgtggcgcgccgccgcggcggcgcctgtaattcagggagactagcaaacgagaaggaattgatagctgttgcgctgtttgtagtattgaaaagatgacatatgatgcagctaatttgctgataaattgatttgtcatttgatagatctttcaaatatgaaaggtaagtccgcccatgccctcctccattttaaattactcaatcagttcatattataattcatttgattttttttcttaattaagcttttttaagttccatcaagtttataaaaaaaatatactaatatttttaataaaaacaaaacaactttttttaagtagacccatgccctcctctgtttttaaataacttacgccgaacattgattatttctaaaattctatcactctttttccgcaaaaaaataaaactacaaaattatactagtgtattgttaaagtttattccatcctatatggaacttttgttcgtcttagtttgatcatttaggagttactactaacatttatttgaaaatggaggataatatattgacgtgcgcgttccggataatactacagtctacatgtacatacttgggcactatttttttttcttaaggagatcttacgcttcaagcgctaggctccagaactacgcccgtgatccgggagatcgacgctgtatatacatgtaaactactcattttttttctttcacgcttagcttcgaagcgtttgttggcgaatccagggccacgtgtcagataattgtataaccggtttcagagtaagtcgagaccaccattgaaaaataccgagccgtgttacgggatcagcactcaaagatactgttcattctggagaaaacagattgacacttcactcaaaggcaaaatttccaagtcaaatgtgcactcgagaaattaagtccccgatctggtcgtcgtttggaaggaaccctgctctgtttttaattatacagcgatattgacctttggacgttatatttgacaattcatccgttttatagaaaagtaatgtataaatatgaaagaaattctgaatgtacagatatgaaagaaattctaagtcatgtttaaagtatctttaataataaaataaatcataacaagataaataatacttcatttaataaatttaattaaaacaaatgatcaaacgccatactttaaaattaatattgatgtacttgtatatctaataagtactacactctgtcttcgaatataagaggctttttatttaaaaaatataggaaaacataagagattttttaaaaaaaaacataggagattttgaccctgtaactagatgatcaaaattctctaaaattttagaacagagatatcagatgaataatagcatttgcttccgtatatattggagctctgttccccatgtacttccctcctgggttgttggcgcttggcaacatgagtggccattattaccatcacctgacctccttcctcctaggagctgttctgcccaccgtgctgctcttcttcctcgcctccgaccgggtgagcgagcggctgcccaccatatcgagcttgggcaatggagctctcgtgatcggtggccgtgctactgctcgagaaggtggtgacctcacaggcgtcgatggctcagcacctgccccagcagaaaaggtttgatcgattttatctctgctgttacagtggggaaaaaagctctgtgcagattagtattgttgctggaattttgtgatttcattctttttaacattattgatgttaacatgttacacttacggagttacggccttacgggcaatataatcatcctttgctacaccgtttgcactttacacccgtgttgtataaaagcatttcatacttcgcgctttatttcctgcaagatatgtgaatgaatgtgtgtcctgcaaaatagaacgtatatatttcatgaaaacaatgtagagatgatgatttgacatagctttggttatgggctaaactaggaatgtgtgatgagaacattaaactaataaaaactacacgtgtgagcgattattagctcgtgtttccttaagcttttgctggtgggttttttaagacttgtttatgtgcgctagtttgcgtgaatttggttgtacctcgttgagcaaagaccgggattttattctattacataatgttgagttctaaaaatacaagaaaattataaataatatgtcatatttatatgagatttaaaatacaatagataataattattagtgggtgataatatgccatacctgtatattgagcttagagttagtgggtaccaaataccaactataaatatggttatttgtaaaatccaattcttttcaacccaagtagaaaatgtttattcccctcgcaaaaaaaatgtttattcctacttgtcaaaaaaaaaggggggaaaccgatcttttttgtgttgtaattgaacaagcagagagtttgtgcgggccttgcatttagtccaggtttcttcggcagtgtaggctctaggtttatagggccacaactgggccgctactcgggatttcggttattttctaaaggaaaaaaattctccatattgcgttgacccaacttgaccatccgtgcgctacgtgtcgtcgtggcaaatctgcgacatgcgcaggagaaattccccggcctggcggagctgctgccggaggtggccatggaggacaagacggtgatcatcacgtcggtgaacgacgcgtgggcggcgccgggctccctcctcgacctcttccgtgacagcttccacaacggcgacggcatcgcccacctcctcgaccacgtcctcgtcgtcgccgtcgacgccggcggcttccgccgctgcaaggccgtccacccccactgctacctcctcgacgttcctggacacggcggtcttcgccggcttctgcgagtaccgccccgacgccggcagggtgtgcacggtgcacgccaactgctgcgtcgggctggagaacaaggtgctcgacctcaagaacgtgctcgccgactggaagaactacacggccggcctgacgtcgccggagaagaagggtgccaacaagttcaggtggacgttcccggccaagtgcaaggcgtcgttgaaacggcactgaccatgaagtccgggaatggtcaaagattaattattctatacataggttaataattagccgtggattatcaagggttttgctccaatctgtcaatgtggttgaatgtgtcacagttgcaggttttgactctttatgtacgcgtactttcccaacatttatattttttttgtcaaaataatatttagcacaagtctgaaccggaagctacttgtttcttcttctcagtggcggagccaggataaagttatagtgggggctcctcagccttttgggccttataacaatctcagataaagtctattttaacccccctacaatagatatatggatttaaattttaggatgtcttaaaggggattctaatagtttattgggagggggggcctccgccactgttcttctgatggtataaacagaccaaaatacacgtgcagaaaatagtactccaactcatatatatattgtttactctaaaaggaactactataattttttcttttgcttccaggataaatttagaaacttatatagtttaacgtcataaaatttatattcttaggttcacgtgtaagaaatactttcacaatatgtagtttataattaagctggtaaactatgtgcatttttagaaaataagggagtgatgttacaaatcttggacagttcgaataaatagaactccagcattttagaaaaaaaaagggataggaaatgtgtgcggccttgcttgggttaatgacgggtatatatattgtaatgaagaaatacatgcacacgctgacgcagttgcgtaacgtgccgcctagctagcgaaacggcatgcaggatgatggagtcgccttgttgatcaatcacaaaaatcttttgacaaagtaatccatggcctggtcaatcaacccagctaccatgcacgaaacagagacgaaacatatttgcagggagacaattgccaagcttcttattgcgccctctctctctctctctctctctctctctctctctctctctctctctctctctctctctctctctctctctctctctctctctctctcttatctgttcatcacgatcgatcagccagccacatttggttagagtttcaaagagagatcgagatatatatggggttgagattgggaggcagcatcatgacgatcaaccggagccacgtcgtgtcgttcctcgccggcgccgctctgccggcgttgctgctcttcttcctcgcctccgacagggtgggcgagcagctggcgatcgtgtccagatggggggtacaacgacggtgctgcccttactgatcacgaactgcaacaggtaacaacaagaacaaaaaaaaaaaaacgtattcttgctgatggatgcatatatatgcacgtgcatgatgcgtggacatatcgatcgcctttaattttacttgatggctcgcaagctcttcattatgcgttgccaaggttggtatatagtccacgttgtgtatggctgcacgtacgattataagtacggatggattgtgttggggaaaataaacagaagaaacgaacgatcagctagctagatttagttggcaaaatggaggttgaatgatcgaccagctattttagctctcattcgctcggaatcgctccgagaatggaaacttctcttttcatatcaccttctctcgagacgacaccaccttctcttttcatatcacttaaatagttataatattttataacaaaatagattaatataccatatatcacttcataaatataactcacattcaatatctacaaattatgacaagacgaataaattaaatttcaactaatagcatgtgtatattcgtagtaatttttttacaatgtgtggaggtgaaatttaaacttacttatttatgaaaagagtgatgctccgctgctttctaccagtattattatgggtaaattagtaatttactaatacaatgattagcaattactttatcatttttgtttgttctttgactaaatcgatctaacgttttaatcgaatcttattctaaacattaatgtttaaatatttaggcctctttgattgaaaggaaattcataggaattttaaaggattttattcctataggtatttttcctatatatccctttgaatcaaatgaatgaatcctatgtaatcccataaaattcctatggaatacctattcccatgcaagttttggaggaaatttaacatgaggttctacctcatgttaagaatccttttagggcccctttgaatcaaaggaattatacggaaacaacctgcggatataggaggagttccggataagaaaagacaactagagttctacatggaaacgataaggactacttagattgtatccatatttgtttctctagttctacttgtacaagggaacacctatgggtataaatacaaggccctatacgatgagatgggggacaatcaacacccaccataacatacacggaacaacataagccacaacatacaagccaacatacgccaagacaagtcgccggatatcgacatcagagatatgcctagatcgaccctatctggtaccttcagaggccggccgtagggatctagcgatgtctctgatctcgccgggcacggattcgagaaggaagactaccctgttgtcgaccacgagtcagaccttcagaccgccatgccgacaacagttagataggctaccccaaatattgtactggtgtgattatggtgaataagagcaataccggcttcggccaacgggatgtagggttattacctgacaattcaggggcccgaacattgtataaaaatccatgtctccatctcttttatctcagtctcacgtatatcctagtaccaacgatccccatactatgcaaataccggaattgtgacatcaaacgtcgacaatcttgataaatttttaattttttttgaataatttttaaatgttatacacaaaacgacgggtgcctccgggagagacaaaaatccacttccgtgatatctctactcttactgcatctgtaattctgcatgaattccggcaactagcttagctaacaaactggttaattggttaaatataatactactgagtcaatggttgtaattaacagactgattaattttcaccggaggtcaattgttgttttttcactccaacccaatctttagtcttgttgctactacctccgtcccaaaatacttgtcgctttaagtttttagtttgtaacttttgatcatttgtcttattaaaaaatcatgaaattattatttatttttttgacttgctttattatcaaaagcactttaagtatgacttatcttttttacatttgtactaatttatcaataaaacgaatggtcaaacgttaaaaaaaatcaaagcgacactaatttaggacgaatgcattatactgcttctcataaaataaaaaatattcatccaaatagttcagtttttaaaattttgagaaattgtcattgaacaatcaaaaaatgaactacggagtagaaattaatctttatgctttctcttgattctcacaagctgggttttcaccggcagcttaattagaatctaaagatctccaaacattccctttgtcatttttgttcatctatgcgtgattgtactcgtcgccctcgtgcatccagttgaatctctatatagcgcaggtgatctgcgcaaatacaagtccaaaccggaggctgcattggtgtatactcttcgtcgtgtacgacttaaacggattaagagaagtcttcacattgatcacctacaccattgactcttgacagaggtgaaaacaaattccacatgacctaatcaacactcaaaaggcagagcgcgctgagtcgtttaattaccgcgggcgggcacgaggaggaagaaagtgagaaaatacacgcaaatccagacatcgtagccatgatgattttgacgtcaaagccatcgagttaattagttagtgttaccgccttatcttttcgtttatactttgaattttaaatttaaagttgatttttgacttttttttatcgtagtttattttttaatatttttttgatagttaagaatatgtatataaaatttgtatttacaaattattttttatttgtaaacatatcgttttgttttttcctccgatgggctctcttgatcgtcctagctattggccaatcccactgtcgatccttttgacaaaatagattctcatatatccatcgttgaatcgagaaccgtacgtagtttaagtagtaggagtacgtggcaatgaaacagtagttagcttagctagctaagtacagctctgctgctaagctcttcataattcctctcttagcctttcacaagtactctagagagcagcagggagagcgagatggggttggggttgggaggcggcggcggcatggcgatgatcaaccggaaccacgtcgtgtcgttcctcgccggcgccgcgctgccgacgttgctgctcttcttcctcgcgtccgacagggtgagcgagaagctggcgatcgtgtcgagctgggggagtggtggatcatcgtcggcggcggcggcggatcatgatctcagaggcgccggtggcgacgctgctcctcctcctgctcaacaggtaagaaactaacaaattaaattgatggattagtccagcttcattagttacatgcatgcgcgatcaccttttccttttgtgtattttcacccgaatctatcttcgcccttgtgcccgggcaaaaccccttaatttggtgatttatggcttggctaattctggagagagtttatacgttgttcttttgctacaacaagtttcatatcgtatgaaattgttagttctcatatgaatttttttcagatgaaagtctttcggatatgtacgttgttataacgtgacgttgttgagcacgtacgtagtacgtaggatatgtcggcagattgcaccgtgcagtaacgggccaatttatcccgacctcaaactgctggttctagtgggctttttttgtctagctgttgagcccatcatccagaggcagattttgttcagcccatgtagattgaacgagcccatgggccatggcaccctgtgcaggagaaattcccgggcttgccggagttgctgccgaaggtggcgatggaggacaggacggtgatcatcacgtcggtgaacgaggcgtgggcggcgccggggtccctcctcgacctctaccgcgacagcttcaagaacggcgaggggatcgcccacctcctcgaccatgtcctcgtcgtcgccgtcgaccccgccggcttccgccgctgcaaggccgtccacccccactgctacctcctccacgtcaagtccatcaacctcacctccgccacccgcttcatgtccagggagtacctcgagctcgtctggaccaagctctccctccagcagcgcgtcctcgagctcggctacaacttcctcttcacggtaatgtacaaatctaatggaaaaaactattcatcctctaaggggtatccctcgtttttgcatgtcacttataaagtcatcaaaaaattaaaaaaaatagtatgatagatcaatatatgatatgccacttcacaaacatacatattcaaattcaacttataccaataaaaataaaattaacaaatttgactatgaaaagaacacgcaattttaacacggtcaaacttcttgttttttgttttgaattgtataagtcgaattttaacttgtatgtttgcaaaaagatatatcatatattgatatatcttgataatttttttcagtttttttaataactttttgaacgcaatgtacaaaatgagaggatgtttcttcgatggacaaaaatccacttccaaatctagcaaatcattgagctctggagatcatcaatggcgatcgatttgctgaattgattctgtaccatgttaattaggactgtgacatggtgttgttccgtgacccgttccggcacatcgcggtgtacgccgacatgagcacgtcgtcggacgactactccgcggcgcgggcgccgctggacaacccgctcaacacggggctctactacgtgaaggcgacgagccagagcgtggagatgctccgctactggcaggcggcgcggccgcggttccccggcgcgcacgaccaggcggtgttcggccacatcaagcacgagctcgtcgccaagctgcgggccaggatcgagccgctcgacacgctctacttcggcggcttctgcgagtaccacgacgacctcgcccgcgccgtcaccatgcacgccgactgctgcgtcggcctcgacaccaaggtgcacgacctcaccgacatcgccgccgactggaagaactacacgggcatgtcgccggaggagaggaagaaggggggtttcaagtggacgtaccccacccggtgccggaattcgattggatggcgtaaacctgttcatccctaaattgtcaagagaattaatggttgaagctaatttgatgtcactgaaattgcagcattctgttgttgtatgaactatatgtcaatcgacaatgaaccttaattatcaattgaattaacactaggacaatgtaagaactgagctattctggaataaatctgaataaatgagaggttgttcagatgaagggaaactatgatgcctctgatgtacttgtgctagtattgaactatactccctccatttcaaaaaaaacctcaacctacgaggaatgtaatccctcctaatactacgaatgaggtttatccgaattcattgtattagaagaggcgtaggttaagtttttttttggagagagaagatgcatgtgtattttatgtttggattgaagtctgtgaaggcatgtactactatcttttttccaaaagaaacagattctgaattctgatagtggtgctggctactttaatcattttatggaggcaaaaaaggtacagttttgaataatgggtcatcttccgattcttccagttccagggacctgttgccaattaaatggatgccaggaaatcaaataggctggtaatcaagcttctgtcaactctgtctcttgtgttgctttcttctccggatcgatgattgtgacgtgaagaaacgtacaataatacaaaaggcccaactcaacctcattttacttcctctgaactgatgaatgtgacgtgaagaaacaaaatgaatagaaaatgctcgactaaattattttgcgttatctccagaatctcgagtgtgatgtgaggctggaaaaataataagaaatggctcgatcaatttctcaacccagctgtattttcttacgcttcaattccagtgactttcagagggaccatctgacagttcagttggccttctaatatgtgcactgaaatgatttgttcttccatgattcgcctgctcttcaattacacaggtcaattcggttttcttagtgaccaacttgcccttttgccttatcccaccatgtgcagaactgcagcctgttactctatgtggtttgagcagtgtcgtctgttcatatacagagaaaagttcagttgtgaggtcacccaaaattcacactgcctatcaatggtcaatggggatagaggatctgtcccttgctgtgtcggttgtgttacttgtgtccacacaaataaaaagacgtgaatattagggaataaacttatatcaaataattacaaaaatgaggctttgaacccaaggcgtctagcccatcatcttatagagctagccggaagatctctatgcatttttcacttgtgtccacacaaatacttatgtgcattcctcttgcaacaatcaatagtagtaggatggtgcaacggctatcaagacataaacatctctttgatctctgttctttatgagttcttggcatacaaaaatgcccaacaaccatgcgtgcatgtcgatgtctgaatattttcgggtggcatatcctctgaagcttctgcagctacaaattaaaagaggatctctaggcctcaatgatgagaataatttgatcacgcacatcagctcatgatctcaatcctcgtctgttttttctcacgaaatctgaacggtccatcgcttgatcgacggctaggagacggcggtgatggtgcaggagacatgggagttggagggcgtccacgaactggcagctgtcagtttccatgaaaagtcaagctcttgcaacagagcagtgtacaaatacagattgcgacctcccggattacagagtttttgctcatgcgaggaagtgcaggcatggcgagctccaagaatggcctatctccggtggtcgtcttcctcctcggcgcggcgtcggccaccgcgctgatcgtcttcgtcttcacctcgaccgcgagtcccgcgtggccgacgccggaggcaactccggcgacaaggcaggagaagaaggctgccgccgtggcttgcgctccacgggcgaaagggatagattcagagacgcgcagagcagcaagaactaatcaggtaagctgttcttgatatgcgccattgttaaccagccgagtccaagaactgatgaactaatttgtgaattgtgatgatttcgcacgcagaccggcggtggggacgacgacgacgagttcgcgaggatggtgcggcgggcggcgatggaggacaggacggtgatcatgacgtcggtgaacgaggcgtgggcggcgccggggtcgctgatggactcgttcctggagagcttcagggtgggggagaacatctcgcatttcgtcgagcacatcgtggtggtggccatggacgagggcgcgctccggcggtgccgcgccatccacccgcactgctacctgctgctcccggaggtcgccggcctcgacctctccggcgccaagagctacatgaccaaggactacctcgacctcgtctggagcaagctcaagctgcagcagcgcgtcctcgagctcggctacaacctcctcttcacggcaagctccacccatacataaatcttttcgtcaattctagtaggcgtccatgattgtgggagaaacacgaggcgttgacgacgaggaacacgacgcgcgttggcattggcaggacgttgacctggcgtggttcaggaacccgatggtgcacatcacggcggcggcggacatcacgacgtcgagcgacttctacttcggcgacccggacgacctggggaactacccgaacaccgggttcatctacttcaaggccacgccgcgcaacgcgcgcgccatggcgtactggcacgcggcgcggcgccggttccccggggagcacgaccagttcgtcttcaacgagatcaagcgggagctcgccgccggcgcaggcgagggcggcggcgtcggcgtgaggatcaggttcatcgacacggcggcggtgagcgggttctgccagctggggcgggacctgaaccgcatcgcgaccgtgcacatgacgtgctgcatcgggctggagaacaagctgcacgacctgaggaacgtgatccgggactggaggaggtacgtggcgcggccgcggtgggagcggcagatgggcaagatcggctggacgttcgagggcggcaagtgcatacactgattcgtgctgacaaagctaagctaaataatcgctccgtttcaggttataagatgggttaaaccttcgttaaagtcaaactgctacaggcttaactaaatatatagataaatatagaaatatttcattatcaaattagtttcattaaattaataattaaatatatttttataataaatttatcttggatcgaaaatattactattttttttataaactcggttaatttgaagtcttataatctgaaatagaggtcgtagattttaatattgctcggggttatacttgaatcgtgctcgaggtttgattgccctggagaattgggatggcatgtgggacggacggtggaggatcgatggatggaaggaagaagcctctccccatgttgttcgttcaatttcatctctgtttgttcatatctcagggagtagtattagttctgaacacattaaattgatgtactatagtttgcacatgggggtgatttcgccaataatcaatatgacactctctggagactggagccattcatacagagtgtgtgatacagtgatactccttctgtcctataaaataaatgatttatagaatgagtatacgcgtttgtatatgagcgtttacttttatttcgtgttttgaaaaaaaatcattatactacgcatacacattattagtctgatgatttatttcctatgttttaattagctttggcgttgtgtggattaggataatctcattttgtgtttgcttttgtcatgggtgctcgattacctgaacttttaaccaagttagcaaacgaaatattgcattgcagaacatgtacttcctccgtttcacagtgtaagtcattctaacatttcccacattcatatctattatatacttaaaagtccattaaacttcctacaaacactcctaaaccgccacatgacgtctctacaaacgctcctaagccaccaagtggcactttaataaattataaagttttgaaaaaacatctagccattgattttcatttaattcggtgggtccatatttttaacggttagatctaaaataccaaatagatttatctttaaaaagctgcacgtccataacaatccctcccgaacctgtacgtgcacgtacgtacatacctcatacgtgcccacccccttcccttatttttttattttcttttttttctctctcatgagataaaaaccaaattaataatttcaactaatagttgtaaaaatatatgctattttgagttaaattctacaatacgcacgtcatcaaaacatccataaaaatctaaataaatgaataatatgcattatataattgtatgttgtatagtgaaattagacttacatttttaaaaataaaacaacttcagttgtgagtaacatttcccaaaattactctttcccaaaattactcactccctactataaaaataattgatatatcaaaataatattactaaatttatcattaatatattttcacgtattgtgagttatctttttttatatatcattagaaattaaggatcaaatatattcttttcaaatcgtgtcgatgtcttttatctcctacttaggtttaaatcgatttagctcattaggtggtttaaatcgatttagctcattaggtgtgcttatccaggacgtgcaagatgatacatgtcattagcataggattaattgggtattaaatattaaaaaatacaaatgaatctatttgatttattaaaaaacttttatataaaaagtttgtaaaacacgtactgtgtaatacaccgtatagtagtttgacaaacgtactcgctataaatagggagtagttaatcctataagcactttacaacactgccttaaatttattacttaggtattaaaaacttaatatgtagtacgcaatataattggtcaatatcctagcctaaaatatcaatcgcatgtcatcacttatccccatatatgtaagttttatatataggtcactctttactaatcactaagtcatatcacttacaagatattcgtatacaatgcacctaacagttaactgatatctaatgagcatgtatgtcgtcaagcaccgaagataaaggacaatactaagtgtgcaacgatcaacaaatgataggcaagtagaggttgcataatccaccataaacaatagttgactacaagtagattgtgactatgggtaatagaatttctatactccttcaaacgcttctaagatgttatgtgacgctctaattagagagtatctaggaaaactataaaataaaagaaaaacaactattcatctatttacacctcaaaattagcgattccattattttcaaccattaaattagatctatgacaataatctctctatctaaaaaccgtctaatctctccttacgtacatacacaacttctatgtacatacatacgctagatatatataaaaataataaaaaaagaagagtgcgtatatggctgtcccatatggtagttttctcattcgttctgactataaggtttattttctaaattgagcatagatgttgtgaccacttctagcaaggtggtaaaataagccacaccatgacaccacctcatgccacccgttgctccaccctcttcctgtcaaactttttaaagtattatttactaacaatgtaaaaggcgatcacatgagctcatataaatccatgcagatgcacactatgaatagaaaaatgtacatcatattcctatgattgacaaataatcatccaaaaagaaaaaaaaaaggaaaaataaacatccacacgagagactactgttctctagaaaaaaaaacatagatgtaactacattatatctctttttatgtctttctctacaaatagtgttaacaattagcacaaataattttaacaaatttcattgaatgttagtcccatgaatatgcataggtaaattagatgtataatagaagaaaaaaaatcaaaacctatattaacttgtatgttagcaaaagatcacaatttgaccaaatatttttttagtggtcatcaccactgaaactattggatttttcaaagtagagtccaatgatcaactctgctaatctttaaaagagaaaattatatatgtaccactaaaatttaaaatttagtagtatcgattaacaccataaataaattatgtatactctataaaataaattgattcaaaacatttaaaaaatattttcatcacctgtattttctcttactcataccctaaagggcgccaagcatggacctcaactggctacattatagtaactacggcaagagtacgcattattgagcagaagtggtccgagtaagaggtcaccattgataatagagctcaactagcctacttaccgatgcaatcctttataaaatagtgctccaagcttgtcttgaggagcacaactatatcaataagggacacatgaatcaaggcattggagaaaaaaggcttagcggctatagtcggcttcactggttattaaagggatattcatatataagttaatgattttatcatattaattaattattagatgtggtatttttaaatatttacatatagattcggatacctgtaaggtatgagtacttgcgtatgaagtacatatgaattttatatggtattaattatgtattgggtttatttgtggatagagatgcagttctaactattaaaaaatatctatatttcaagacaacgataataagtagtggtgatagatgagggcaaaaagatttttgtttggatatgatggacattattataatttagtatgtcaaaatttatggtttatttcttatagtgaatatggtgagataatgcttttttaggttttttttaaacaataaataaattgcccgcgcaactgcgcgggctttcttcctagtagatgttaatggatgtagatatatatatctatctagatttattaacatcaatataaatgtggaaaatgctagaattacttacattgtgaaacggaagaagtaggatgaaacatgatggatgcacattgataacaagcattgagaatcttcattttaacagcgattcattttttctaaaaaaaatcatcgaatatagtgaacagaaactagtactcagcagtcagcaccccgcaaaaaaaaaaaagaaactagtagtactcagcagtgaaggcctcgcttagataagaccattaaggcctatccacgtggtgccccaagaaggattgaggccacatgtggatgggccgagatactgaggcccattaaaacgaggcccgaacggctgaacatggtcaattttccctcacccgatgcgtggaaggcgtaatcccaaattacatttcaagctggaactactcgtatccatcaccggaaggcgtattttgatagttacgcctatcgaacggaaagacgggactagtgtagaaacaacccaaacccctcgtctcagtctccccaagtggcggcgagtcctcggaccaaaccaaccagagacgcggagatcgccgggatttttctccgatgagcggcggcggcggcagcagcagtgtccggcgacccgtagccgccgccaggagccgctcaggtccagagccggacgcgcgccgggcggccgccgccgccgccgccgccgccgcagcagcagcgcggcgccgtggccgcggcgaccatggccccctgcggctcatggaggtgagcccacggaacctcctccttgtagggactgcttccgtcgccctcctcgccgtcgccttcgtggtgtataccggcgtgtggcagggtaaggcggatggggaggtcgagacgcctctgcgcagggccgtgcgctccgtcacgccgcttgacgcgcccaggatgatggatctgcctcaggtgatgaccattaagttcgtcgcattgtttcttcaagcctccaatgctctgtgaaatagctttagattacaatctcgcgcggttgtagtctattagtgcgcttctgcttaatctgctgcaacagtagtagttaagaacttaattgaattgtgtaaaaatgctaggagaataacggaatcgaccactgcttgtttggattttacaagggctgctttatgtttgaaccacatagtggatacgactggtttgtcataggtaaaatgaatatgaattgtgcatagccgcaaatgtcatctgagctaggacagacgacctaaaatgtaccagtttctgttaaatatcctcctgtaagctagttctgattgatttatacgtaacatcatgttattccatactgttgagtttggatggtaattatggttagctttctgatggctcatagttgactgtttacagttccaaggagatcacaaggaaagcttgtattggggtacctacaggccgaatgtatatcttggaattcgtgcaaggtgcttaactttgatcttccccttgattcttatagcgtgctaatttaagcaattcagttctcttagtccaccatggcatgctagaaatatgcagggaagttcatattgctagcatcatatgttttttatgctttaaacacttctatggagttttgttcccatttgcttagtccatatgtgtcgagaacaaagatgttgttatatttcctgcttgattccttgaatgcgtattgtttttgtttctggtttagaatgttgccaccttaccacctcatagttggaattctattgctgtatgatgatgatatggtggcactctcaacttcttgctaatagtatttctatttcagaaccccgttgtctctaattgctgggataatgtggattggtgcaaagaatgggcaatactttcttcgtcatgtttgccaagattctgatgagcttagcacatatgggtggacagatcacaatgggagggattatggacatcaagtgttggttgatcatggcttgttgttgaccacgagtttcctgaaagagaaaggagagggtagcggttatggtggagattgggcagttcgattgaatgcgaagactgatgggtaagtgtatatttgtcagttacaaaactgaaaagttttttttactgaagagatgtaaacaattttccagttttaagtacaaggtgaaaagaccaataaattttactggattgactttttcattccctattcacaaaccaggatgatattaacaatcatttatttgctacctatataaagttaccaaaggaaccaaaagaaatttattccatgtagttatacttaatttaggccaagtttaagtgaagaccaagaaagcaccacacacctgtttttctacatcgcggatgaagcagggaactcaatcactatggattcgcatataccttcgtcaagaggtcatgttcttttggcatctggatcccgtgaggagattggtgattggaaagtctatttgagatctgaggtagcatatttcagtatgctcgtcacattgttgctactatttttttatttttctattttactcgctactggtatatagcattacaattccatataaactgatgttaatattgacatgtacagaactgtgtttttctcgcaggaaaatttggaaattcacagagctggattcaaatcaattagtatgcacaatctaagtgacctagtacagcaagcccttgcgactaatgtatgtcttagctccttacatttacctttttttttggggggggggtcaaaaacaagtctcagtttttttttatgaactcaagttgccatttagctgctcctgtgtacctttctaggcaatgcaaagtgggaaccttaaccttccagacatggcagaagattcttcaaatgtaatagtatatcaggtgcgtcaaagatgaaaaagaaagttattctgtcaatatgagaatccaatgagtcaacgtacacccagatttaaatagtgttctcttccggcattgtgatctatgctctctctcatcttcacaggtttccatgaaacgttctgccgaagtcgacatagtcttcttgtcaggggccgcctcagaaaacccaatgattgaagagcgcattaacaggctaacaggtgactctactgcatagctcatactgcatggagataggatatgtgattttccttttgttctattcattttgggatggcaatcatgccatagataccatgtcctccataatttggtatgcataggctcttgaccttttcttttgctgccttgcatttggtatccattccttttttttccttgcctgcatcttttccttctgttgaacctgaaattcagagatgttgaaagcaatatttcatcttgcttgttgattttatatcactaatgttgccaggtcctgttctgagcactcgtcttgaatcaaaacagaaggattttgaaaagagatatgaccaaattttcaatgcaaataataaggtgtgatctcttggatgagctttgtagttttgacaatcttcttttagcagtctatacagttgttttcttctcattatgctcctgttcctatgattatataaaattgctattgcgtataaatgatagtgtccttgccattttgttcaagtctgtacacttttcatagttgaaagaacctttaaaagctatttttcccctggaagataagtagtgtgactggctgcataatcagaagaaagtttgtgatggagcagttgatattattgtttcactgatgcagattaatcccaaagaattatctgttggtgttgctgctttatcaaatcttcttggtggaattggctatttctatgggcagtcaaaaattgcacttccaaaaggttttacagtaagttttagagtgttacctgataattagatccttttcctaatagctattgcagctgaactttatgctatctgatttagtcccccccccccttcttattactgtgctatcttttgtagatctgatataaatcctaggcgattacacatcacactcaaacaaaatctaatgcttcaagagtttccttgcagcaaaaaaatggggataaatatatcccatattggccagctgcactatatacagctgtgcctagtcgctcattcttcccaaggggatttctatgggatgagggcttccatcagttagtcatttggtaagcatttcatcgatcttgatgtgtagcgcagggcttctgccactatatcatcactcgctttttttttgaatctgtgctggtattattgctgcttgtttaacacatccttgatggtgatgtataggcgctgggatgtgcatatatcgatggatataattggtcactggttagatctaataaatgcggatggatggattcctcgggagcaaatattaggagctgnnnnnnnnnnnnnnnnnnnnnnnnnnnnnnnnnnnnnnnnnnnnnnnnnnnnnnnnnnnnnnnnn

SEQ ID NO: 56836 - DNA, 2685 bp, Oryza sativa
acactgaatttaatgctcacatctaaacggcacgagcaagattataaatagtaataagaaaagaattggttttaaaaaatactcggcacgatcaggtggtttatgaactggagcagcagcagctcctcttccctaccagcggcagcttgttagcagcagctcatcttccctaccagcggcagcttgttctgcatcacgggcgcttccttcagaaggaggagctgcctcaacctcaacaacgtgatttcaggcgccatcatgctcccgaagatgtggctcaagaacctcatcatgctcgcctacgtctcggcgatcaggctcgtctcttcggtcgcactgacggcgccgctagtctgggccggcatggccgatatgtgcttccacatggcgggcagcagcctgttgaacatgaaccgggttgcccatcgccctcatcctctacttcctctgcttcgccggccatggcttcttcctgacagtgtactcctcgatgaagtccaagaaggattttcccaaaatacacttattaaaatttatttatgtgttgttgatggtaagtttactaaaatttgtgataacaattaacaatgtaaatttagaattatggttaatgaaaaatgaaaagtcaatggtgaaattaaattagcaaccggtttggtaagaatacaaacagattgtttttttattatatgcgtgcatggaagacgcacacactcataattattttttacaactcgtatatcactaatcatgcacaacatactcgcacacctcctaatcatcatcgctactacgttctcattatactcaccactgcatggccctcatatgttttgttggcgctcccatcatataccaggtctatatacatcgtgcagataaaatttaagctaataaggttattttgatcgtccaattaaaagtaaaaattaggatcagacgaaatcaacattaaaataacttattttattaaaataagttgtaccatcccttaaaaaaagttgtactacttataaattttgtaaagttattttacactgatagagaatggcgagtgcaatacgaaattaatgccaagtgcaacatacacaatttagcattaatatttttttgcattatgacgaaatgcgcatccgcaaaattcgcccccaaattgcacaccacccccgaaaccctagaatccatcgggaggtaaaagggaaagatgggtacgagaatggggaaactcaccatcaacgccacaagtctccacccaacggcgcaagggactccgcggggggagccctcgccggggccggagtagtcacaactgacgatccaggggggtgagtatagacctcgcacccggctcgggagagggccgctcctggggaagttgaaggatatggcttgcgctggggtcgggagaggagggaaggaggggaaggggaggatcaccggaatcttctccagcggggggaggaggggaaagtgggtgtgggagggggggattgctggcggcgtcgccctcgcacgaatcgcggggaaagggaggagaggagggggtggggaatgatgggacggatccgtgaaatgttcgacgtggtgtggtgcggtagcgtaactgtgggcgatgggaaggcggggtaatttcgggcaaaagggtcgcgcccgcgcagggccgtacgtacacgagtgcgtgtaggtgtagggccgttagaggttgaccaccacgacatgcataaatatgctccggctgtgttcgggaggtgaggttggcaactcacacaaccttacctctcacgcacgcaaaacggtgcgacgtgttttcttatgcttaattaaggatttacttattttttttaaaaaaaatattaatatggttttttaaagcaacttttcaatataacttttttgaaaaaaaacacaccgtttagcagtttaaaaaatatgcacgcgaaaaacgaggaaggtgagttgggaaagtttgcggaaattaaccgtgtgctacccgccactcgctccgttttatattacaaatcgtttgatttttatccaatgagtaatatgtaatactgtagtatttttaatataaaataaacatattatcaaaatatattaataaaactaatttgatatggtaaatatcttattaaaaatatgaaaaaaaatcctagtactgataatagctcgagctcctttgcataaggagtcaggaccccgcgggctgtggacccgaggcccatcctgatagccaaagcacgaaataggagagtccatcacagacacgcaaagttggtgggcagcttcactctcgtgaaagaaaattaggttattgacagtgtggaatgtgtgcgtaggaaaatggtgaaaactatatgatccgctagcgcactattggccattggtatggctggttaggttactgcctcctataagagcaggtataataggaggttataagtcagttataaacatattttaaagagataaaataggagagagaagagcagcgggctacagatctgtagacagctccagcacggacttcaagacataatgtgtgtatataatgtgtgtatgacaggtgggatcaggtattaatagtatagtaagcactattgtatgaatcgactattaaggacctgtttggcatagctccaactcctaaatattgctccaggagttgagtctggagtggagttg

SEQ ID NO: 56837 - DNA, 3127 bp, Oryza sativa
aggccctaaattggctatagataaattggagcttgttgttggctatactattaaacttgctctaaatacgttacatgttaacatgtaagatgtataatatggtttatagttattagtagtagtttacaatttctttcaatatctctcaacttcttttccattttatgtgatttatttttatgagatagtggagtaaaccaaataaccatgattaaaaggagcgatacaatatcactaaatttgaagctcacatctaaaaggtgcaagcaaggttataaataataataagaaaatgattggtattaaattatactagtaagaagatatatggcacgatgaggtggtttacgatatggagcagcagccactcctctttactagcgacggctcgttctgcatcattggcacttccttcaggaggagctgcctcaacctcaacaacgtcatctcaggcatctgctctccgtgtcatatgcggtaagtggctcagccttgcactcttcaccatggtcggcgctatctgcttctacaccggcaaactcatcgatcgctgcatgtgcgctgaccactgcgtcagaagctatccggacatcagccacccagtgcgaattgtaaattgagatggggctgtgtaaaagctgtatgactgaaacaaactagaaatatatcgacaaaagtattttttaatgaaatccaaatacgcatatgaacgggagagaacacaattatttctccatttcaacttttgttgctataaaaaatatccttaacgatctataaataaataggtatggtctgcagagaatgatctacgaataaaatttatcttgcttaagaccattggtatggtctactttagctagtgaggtagcttgccttgccgccaactagtttttcactaatcaatggttaattatatgtgttaatcgctaattaggtgcatgaattagaggttaattatatgtgttaatcgctaattaggtggggttggtgtcccaaccagccccaagagtggatccgacactgtgtccatcttgcctacgatggccgtacctagccttcgccggctacggctagatggccatcggcctcgtcttataagtcgagctctaccttgtcgccatcagcttcctcatcctcgagggtgacaacatcgagaagctccttcctggcacggtggtgaagatcctgggggtaccaggtgtatgggaagcagctattcatgctcgcggtggggcgccatcatcctcctgacgacgtggctcaagaacctcagcatgcccgcctatgactcggcggtcgggctcatctcgttggtggtgctgattttgatttgtacccgattattgtattcgtgatttacaaaagaaaatgcaaaatttgaaataagggaatagaaccgtgagagactaccaccgggagttttaaatttgtatgttgtacggtggcataggcgagtctagagaagatacaattaaaaggtttttacatgggcttgatttaaagtttcagcttaggcttaaaaataaaacacatagccatctttttagttacttttgatacatgagaatattcttgcgccttctattgtatataacatcatgtaggaaggtaaaagaaattttgaagaaaagaataataaagcacctaaattaactcaagagagcatttcaggtaacttaattgatgttcaactagaccaaggtaggaataattgtgttatgctacaattgtccactagttatgctatgttagagcaacctctagtggaacgaatttctaatgtgcctttatcacaagctaaaaattcagattgtgttgatattgataatgcttgtaatgaggaagagttgtgcaatgcttaacttatatacatggcacaattagtgaaagaacatgctacttctatttctgaatatttgggttccactcaaaataaacgtgtctttgctattgctaatgactgagaagagctgcaattattgtcttctttatgtactttaggttatatcgaatttgacgttccttgtgatctaaataccttagagatgaaattttatgattttctatgtttttcttggaatagttatcatgtcattggtaaatataataatagaggagattatatggtgcatcgtgtttatatatgttcatatttgaatactcctttaaatatggaaaaaatgtgagaaactaaatggatcgtacagcgttgatgctattgggataaatttacttaaccttgttttgaagatcgatgacaatattcaagaaggggagtgctatgcaccattagattctatggtcaagtctcactatctttttaagacatgtccattaaggtgagttcgtttttcgtgatgtaaattggatttatatagaacaaatgatgctacacaatgattgcttgtttgctatttttttcatgtgatctctcctatgacgacaattgcaacaagaaatcgagaacggtttccagacaagaaggaggatgatgtgatcatcaagtatattcatacaaccaagcatgagaaatataaaacattgcaaaagaatacatcggatgaatggaggatctaaagatattaaagtccaatgagttttggaatccagttcagcctccggagacagcactgacttcaaacggacctagcgccttcatatggtcatgccaactccgatttggatgatgttggacttgatggaaagcttatctaatcaactttcaaatgcatccagtctcatatccaaattcattttgagttaacgggaatcgtcaaaacaagacagtgttgttgctaaaaccgaacttgggccttgggctttctaatagactaggcccatctcgaaagtgtctccctctacctccacgaatcagcactaaaccctatatctattttcctctataaatatttatgtacaccctctagaacaattgggttttgtttagttgaattttgctaagtgtcattcaccttgtttctagtccttgctcgattagttggcgactatagattcagagcccccaatgattaatacataaggtagtcatggttatctcgcttggttgctttctatctcgttcttgtttgtgttcttcgattggcaaatagggattagccttctc

SEQ ID NO: 56838 - DNA, 1943 bp, Oryza sativa
tctcggcgaggtcatccgcgtttcgacacgggtgataaccagaggagacgtgatactgcgattgcagggctcaagagcgtgcgcgttcaagaagccagatcgatttgtgtcgcgactccgcccaaatcgtcgtttatcagaaccttttggaagatcgggaaccctagtgtacatcaagaaatgttccgcacaggatgctgtgatagacaaagataaatacaatatgctccatgacaaggtgaaaccgaggacggtttccaatcaagaaggggaggatgatgaggacataactagctcggatataaccatgactaccttatgtattaatcaaataaaggtgcatatattctacattagatttacttgttatatatttgaacaaacgttactacacaatgaattttgtgtgttttcgattgcagaggtacttgcttgggcgaaggaaaagagaccgagcttaactaatacatggatgattaaagaagttgattggggaccaaaccaagaccttctccaagtctacttctacctcaccacatcacttttggcacatagaagacaagagatcaagttgtacacgttttggattcggattcgggcctcctgacagcatcaacttcaaacagacctagccactgatctagaaggtatttcggggcccatgagtacttattagaaagcttattgagtctactttcagatggttttagttccacgtcaaaattcctaccgagctgccgggaatctgcaaaacaattcacgtatctcatctagatccgaatctgatttgggttttgagccttgtaattgtgtcgtgggcttagcccaagggattgtgcaccctagggcaaccctaggacgtccctaatcacatttattcagtagccgtcatcgttttgagtcgggttttgcttagattattctgtcgagaacagtttcgtcgctagatcggtttgtaagaccccaactcgtgagcttaatcattcatctacaattttggttgttttctatctcgttcttgtttgtgttcttcgattggcaaacagggattagccttctcggcgatgtcatccgcatttcgacacggtgataaccagaggagatgtggtgctgcgattgcggggctcaagagcgtgcgtgttcaagaagctggattgatttgtgtctcgactccgcccaaatcgttgtttatcagaacctttcagaagatcgggaaccctagtgcacatcacccaatagttggtgtgttgatttgccgggtcgattggatctaccacttcaatcacaactattcctttgtgcttaatcccctattcgcaatattttgattgcatcttatcttattcttgcagtgttctctcgtttgcattgcagggatcatcaaccgtgcgtcacggttggtacgacatcgtttgcggtgtagcgattgcacggcgtcctagacttgttttggttgatagccacgtcgcaaacatcgcactcgatcaaagcgagagttatcccctcaccaggagatcgggccacgagagagagcatcatcagtagtccaatacaattttagttaaattaaaaggtagtgtatctaaatttggaaggtgttgcatcataaacttttttatgtcgagttaaaatagagatctctcgcaccggtcggttgtagcaatctctcacaccccgacttctaactgtcgagagatgcatactcctggttgtacactagtcgtttatagcgatctctcgcacctcaacttctaacggtcgcaagggactccgcggggggagccctcgccggggccggaatagtcacaaccggagtagttggggggagggggtatagacctcgcacccagctcggaagaggggcagctctgggtgagggggggggggtcggaggagatagctcgcactggggtcgggagaggcgaggatgagggggaggagga

SEQ ID NO: 56839 - DNA, 16450 bp, Oryza sativa
gacgaagggagtacgttggaggccttgtacgtctctgtatgcaattatcagactactttgttaagtatagctaatattaatatttttgatacgtatcatataaaaataattatatattaagagaatagttcacggtgactctgttttgtctagacttgaccatgcgagatgttgacggtccttacatcataatatctgactgtcaatatttgcatataataaaataaaatatggtatctaacttagtggtaagaattattactgatcatttccattagtcttattaaaaatatgaaaacaaaaataatcatgtactaatactagctcgagctcctttgcatcaggaccacccatgggccgtgggcccgaggccaatcctgctaaccgaagcacgaaataggagagcctatctcagagtcacgcaaggttggtggcaagaacagaaacaacttcggcttcactctcgtgaaagaaaaataggttactggcagagtggaatatgtgggtggaaagtgtatgatttgctaacgcagctattggccattggcatgactggttagattatggcctcctataaataaacctaataggttaacatttaagatgtataatatagtttattgttattagttaacaattctttcaatatctcaacttcttttttatttgatgtgatttgttttgttagatagtggagcaaactagatagccatgattagtaggagtgatacaataacactgaatttaatgctcacatataagagcatctccaatagaggactacaaaatagtccctataaaatagtcccaaaaaatattagattaggaccaacccataaatgattgggcacaaaaatcttcatctccaggagattctcaaaacttgaatcctaaaaataaaaatatggttgttggcctgtaggccgtgtgggtagctagggtcgtcgctctctaccgcttaccattgcagttctctgccacgtgcaatcgccgtacgcttctttttctagccgctctacttttgcgcccccgccaccactactgttgttcggattgaccgatcgtgtggagaaacggaagactaagtcatatggaaatcatgcattgagactaatccatgcaacctcccttttctgtagagatttttacgaaagcgtatcggtaaacatttgtttatgggagctactctagtctgcagtaccaaatgtattgcacatatccattattgtcacttctcatatagccataaaaaaaagctgccacattatcaacaagtttgatataatcagtaagtaacaagaaagaaaaacctgaatacaatgcacacacattgttctactgattcgacagtcacctagttcagtcagtttactctatatgacaacataacaaaatttccaaactgcagattggtgaataatacagcaaatgaagaaaaggggaaacagttcgataaaatggttctaaaagcgcgttttgaatgtagtactccctccgttttgaaatgtttgacaccgttgactttttagcacatgtttgaccgttcaccttattcaaaaacttttgtgagatatgtaaaattatatgcctacataaaaatatatttaacaatgaatcaaatgatagaaaaagaattaataattacttaaattttttaaataagacgaacggtcaaacatgtgataaaaagtcaacggcgtcaaacatttcgaaacggagggagtaattagctaggtccatcatcctatagtccaaattcaaaacacatgtacagagctgccaagttttccaggatttccatggcagaacagagcatagggttactaatatagttagtgttttgatatacgaagctagaccttaaaaacctaaccaaattaaattaggcttcatggtgaagcacttttaagatttgcagagaacaatagcaacaccaaaaacaaacgaatcatgaagtagacagtttacatttcagagcatagtgtgatgtggaataggctgttgcataatttctgaataaggtatagtacagtaggaaaccacacacaactcgtcttctgaaagatatatagatgcaccatttatcaactagctggaattcagtggacttgtaagcacattcattatttttaactgccaattcaatagaatgcccaccaaactttaggctgcagattcaagacaaatgattactcattacttttttatcacctacttggacgcctggagcatgacagcaagtagcaacaacaacctgaagtcgatcatattgcaatttcagtttgtcctactcagtttgcacaaagattttctggtaggagtccattccccctcaatcagcaaaagtagatttttcccacatgttaaaacggcatcaagcagtgcattcacttgacagctacactgagagtgcatcagtctatccattgaaaacatgcaatgcatcattcaacaagaaaatgctaacgagagagaccaagcgacgttcaggggatcgtcgtttacctgcaacacgggatccggtgaccgccaacgaaggggatgcagcaccataagatggagcgggcgaggcagcctggaaggaggtaaggccgtgcggtggcgcccttgagggtcctggatggaggtcaagctgtgtggtggtgccctcgatggccctgatcggaggggggcgtcggtgacataggttgtgacttccctttaaactttcaaaaaatgtcacattaaatgtttggaaacatacatggagcattaaatatggacagaaacaaaaccaattacacagtttgcatataaattgcgagacaaatcttttaagtttaattgcgccatgatttaacaatatagtgctatagtaaacatttgctaataacggattaattagacttaatagatttgtctcgcagtttacaagcgaaatctataatttgttttgttattaacctatgtttaatactttaaatgtgtgttcatatacgtcaaaaaaatttttataaggaactaaacacagccatggaaggaatggaggcgagcatggagttcaacaaaaaatgttgtgattcctcggattgggggcctctgcaccttggatgaaggactggcgctgccataggtgaggagacaattaatcagacaagtcaacgaaggcaagaacgcggcttcatccggagctatgaaggatatgacccaggaagcctacggcacgagaggaagagaaaaatggtgcgtacggaaaaaattggcgctggcggcccaaatctactgtggttgggaatgcgcagagcatcccaaaatctggttaggattggcaccgattttggatgtgggtgaatataagggccatataggtacgtaaaatctaaaccgagaggcttctcgctttagtcgtatcacgcgacacggctcacagccgttcgatcgtgcctgtcatcccgacgtacatctgcgtggctgcgctctaatggctcaataagaaggatcaacgtagtgcctgtttgcctttttttaatagatacgtatgtctttttctcctcaaataaagttttctctcaaattacttatccaatctataatccgattacaccattatgttcattacaattaaatcttcacaacaagatcttacatgattatattacgatgaaaaaatatttatatttataaattacttttattatatacgtaagttacttttatcatatatataagttacttttagatttgactaaattacttcttagacatataaaagtaaattcaataaagtctaaaagtaatttacatatattataaaagtaacttaaaaccaaacggaagtaactttatcacgatattagaagtaaattcattgtagggataaaaatatgattttatctcgaaattaaatttaatcagtacagattaacacaagtaagtttaacattttttaaaagtaacttcaatgttaattagaagtaacttttgcatggttgagaagtaactctctgtaaatccgtttaataaaaagaagataaaacctttcatggattgtaaataacattgatggaataacttttaggctttattgaattacttttttagtccaagaagtaatttagtgaaatttaaaagtaatttagatatattataaaagtaatttataatttttcatcaaaatataatcatgtgagaacttgtcataaagatttaattgttacgaacacaacggtgtaatcggatcgtatatcagatgagtagtttaagagaaaagtttatttgaagtataggtagatagtatctttaatagatggagtggtagctggtttctgtgtatccatgtcctaataaatagtagcgtatagcgggttgttagtggattagcgtctgtgtagagtgttgcggatagcgggcgctaagttccgatagcaaatataagaaaatagccataaatatatcaatattaacataaatttcacgtaaaaattagaattaataatacatttttaattactcctatatttcataacataaaaaaaaatatgaaatcacatatagatttataagataaataagataaacaatgtaaagttctacaatccatatatgaagaacaacatttaagcgttacaatggtccaacaaagtcaatagcgggctgttatagcggacacgaagcgctataacaggctgttatagcagtagcgaaatgctatagcgggcgctaagttacaacatgctatcttcagtctgctacctcgtagcggtagcggtagaggtccgcgctatagtgggtgctacgaacgctatttattagcttgttgtatatgttggatgtatggtttttcgctaaattccgaatctgattggaactttttttatctcttttgggaatctgattggaccttttttttatatgctctaaacagtgcgagcaagggagtaaatagtaacaggaaaatgattgatattaatactagcaagaatggcacgatgaggtggtttacaacgatgttggagcaggagcagctctcgtcctccctaccgccagcaggtcgttctgcatgtataagctgccttaacctcagcaacctgacatgtgcctcagcctcagcaacgtgatctcagttattgcatgctctccgtgccgtatgcgctgtcgtagggcaggtgctactacataagaaattttttgaggaccctggttaggctgcagacggatcataattgtccacgtctataaaaatcagccttcaaattcatatacggtttagtaagatgcccgcattcgaaaatcgattttcacaaacgaacctagacgcaagtgaaaataaacctatttttacgagatatttaactgtttactacttttagatgtggcaaataactatttgccactggacccaaatgtcattaagatagaggtggcaaatagttaaatgccaaatctaaaagtggcaaatagttaaaagctcctattttggcatgcggtcccttaaccacatgcaaaaatacattttcgtatacgatgccttaagtgatccgcatacaaaaatatctccttttttttctcccatcctctctctttccctcctcaccacttcaatttttttcacccatctcctctcaacatattttcaatcctctcctccactcctctcttcctctcctctcaaaatcctctcctcaatctctctatctctctccctccgagtgggcggcgatgggcggtcagcagtgccaccgtcatccccttcctcaccgccaccgacgacgacgaggaggaggcgatcggctccatcccccccgacgccgccgccaccgacgaggcggcagcagcggttgatgccatgcggcgggcctcctcctgcccatatctggtgatggcggcgggagcggtcggtggctcggcgatgggagcagtggcggtgggagcgaacgacggctcacctcctcccgcccacatctggcgacggcggcaggagtggtcgacggctcggcgacgggagcagcggtggtgggagaggacggcggctcacctcctcccttgcatatctggcgacggcggtgggagtggacggcagctcacctcctcctgcctagatccagtggcggcgggcctcctcccacccagctccgatagcaggaccggacggcggcggaagcagcggtggtgggagggccttttcccacgatggcggcttgcctcctcccgcctagatccagcgacgcagtgggaaaaacttttgttgctatataaaatatcctaaaagatccatgaataaataggtatgatcgtgagtgatctacgaataaaatctatattgccttgtcttgcacagtactactggtatggtctgctttagacagtgaggtagcttgccttgccccaaaccagtttttcactaattaatggctaattaggtgcatgaatcggaggtggggctggcgccctaaccagcccaacagatctcccactgtggccacctcgccttcgacggctacagccagatagccatcggcctcgtatatgttaatggctaattaggtgcatgaattggaggtggggctggtgccccaaccagccccaaccgtggatctcccactgtgaccacctcgcctttggcggctacagccagataaccatcggccttgtcatgtacatcaagctctacctccttgccatcagcttcctcatcctcgagggcgacatcctcgacaagctactccctagcacgtggtggagatcctacggtaccagatgtgtacgggaagcagttgttcatgctcgctgcgggtgccgtcatcctcccgacgacgtggctcaattacctcagcatgctcgcctatgtcttggcggtcaggctcatctcgtcggtggcgttacgacatcgctggtttgggtcggcatgtccgataagggcttcgacatagagggcaactgcctcttaacctgagagggtccctcagcctctacttcgtctgcttcgccggccatggcgtcttcccgaccatgtactcctcgatgatgtctaataagaattttgccaaggtacaccttttaaaatgtatttatgtgttgttgatagtaagtttgctaaaatttgtgataacaattaacaatgtaaatttagaattatggttaatgaaaattgaaaagtcaatggtggaattaagttagcaacaggtttagtaaggatacaaacatattttttttattatatggatgcatggaagacgcgcacactcataattactttttagatttcgtacatcactaatcatgcacactatactcgcacacctcttaatcatcatcgctgctatgttcccattatactcaccattgcatggcctcatatcatatgttttgttggcgctcccatctatatagattgtgcagataaagtttaagctaataagtttattttgatcgtctaattaaaagtaagaattaggatcatacgaaatcaacattaaaatcatttattaaaataagttgtaccatcccttaaaaaaatgttgtactacttataaattttataaattttgtaatgttaatttacaatgatacggaatggcgagtgcaatatggaattaatggcaagtgcaatattcagattttagcattaatatttttttttgcattatgacgtaaattaatggcaagggtaatgcctggttggcctttcgactagtttaacatgtgtagtgacatggaggcgtaatgtgccacagtatagcctatcaccccagcaggatgaacaggtgactgaaggcgatgaaggtcacctctcaactatatggttacctctaatccacccatttaaaagcattgtagcttaaagataaagctaatcatgagccgcctattatggattaatttatatgttaaacctgaacttagaagatgcgtctaacacttaaatgaaagaattatattagccatttgaaaacaaagtttatgaaatttgttttttaagtaattttatacatagtccaatacaattttagtgaaattaaaaggttgtgtatctaaatttgaaagatgtgttgcatcataaacttttctatgccgagttaaaatagagaactattgtgttgtatatattattgtactaagttagtcttaaccaatctactttcatgaaaggtaaatcccaccaagctaccagcatgctccacgcaatcaaaataataaagaccgtcggattagaaaatgagcattagccgtccgatgtttacttcaaacattacaggccatcggataatctcaatctctcgtcatttggaatcttctcgaatgttgttcgcagaacttcttaatgctgtattcggttctttaactttgggaactaatcctccggcgtgaaaaacgaagcaactcattaacgcataattaattacttattaactaaaaaatttgaaaaaatatattaatatgatttttttaaagtaactttcatacaaaaaaaatttttagcaaaaaaaacataccatctagcactttgaaaaacgtatgcgtgaaaaacaagtgaggggaggttggaaaagagagggaacgaacacagtcttaaagcaaggataatagtgagatataagagcatccccagcagctcctctatccggtcctccatcccgtttttggcgcatggaggggaaaaacaacgctccagcagaggctccatccgatgcgccaaaattggcggatcgccaaacacgaagagagaagtgtcaaatttggcgtttctctctcctcacgccatccccaaacgcccgctcccatccggttctcccgcccccatccggatcgagcataaagggtgaaggaagaggaaaagagaggacgcactggtggctaccttcgccgaccgaccgccgtcggccaacggagcagaggggaggagacttactggatctggccgcccgcgccgccgtccccgctgctcgcccgacaccgccgcccgctcgccgccacctgcctcctccgcggctcctccacccgcctccagtcgtccgccgccgcccctcgcccacctgcctccggtcgtccgccgccacggagtagagtgcgtagaggcagcggatctggctgcgacgccgctcctccgcatggcgatctcccgcgacgctgctcctccgcgccgctcctccgcatgcgaccgccgcgccgctccccgcccgcgacgccgccgtccctccccctcccccaggcgggcgcggatctggcgtccttcctgcctccgctgccttcccctccccctccccgcctccccacctccaccgccttcccctccccctcccgggaagaaggcggcctcgtgctccccgcgctccccggcctggaggatcttgtagacgcgcgggacgagcgggcccaacttatcggtggacgcgtagttccccgccacttggtgctctggcgggcgtaggtcggaggccatggcggcggtggtgggtggtggaggtgaaggggattcggcgagagaggagaagagttgagaaaagagtagatgagaggagaagagttgagaaagaatggaatgaatagaagagaaaaattaatataaaatagatggcagttgaaagataatagtaaaatataggatagataatgtaatatgaatgatttgttggagtaaaaagaaatatggagtgagaatccttttggaggactatccaaataggcatatggaggattgaatatgaatgagctgctgggaatgctctaagcactactacaaaacatggtacaccaccactcctccgttccgcccgagttctccctcttctttctctctgttgccgcctacgtggtggaggcgttctgctcgccgccggccacttgccctcatatacaaatccactggcaactgcaacagaatatggaaatggtgacaagcagaagccatggggcttggcgatgtggaaccggatccacatccacgtgacggctgtggtgctgtacgtcccgtggtgcaggggcggaggtagcatatgggcaggggtgtccagcaacccgatcaaaatttttttttaagttataactcatcgatatggtgattttcactatgtgtgtaaccttctcaatacaaacttagacacacgcattaaattgaacttgatctaaaatagaataaattaagcaagaagcaccatcctctatttcgttctgttctagttccgccctgccgtggtatgtggcaatcgttcgccgatccataacagcaaccatgaggctcggagcctcggagaggttggcgtcgaagaaatcatagtagctgcacatcctgcgccctctcacccaggcatcttccaggctaatacattggtacgtattgttgcaattgcaaacctactgataaagccagcaagcaaatttcccgtgaattttaattaatggagaaggtatcatcctgtttttcttcttttaatttgcagataatcctgggctttcagtactctggattttgatgtatctttgattctgtgatgaactaatcactgatacagctagaggccagatttctgttcactaggtaaaagtcactgatactactaaaaagaatatcagggatctcgatgctctgatgcttctctctctttcccaggctaacctggtagaaaaccctggagttgtacttttaacaaaaacagggcactcagccttgaaagtaggacacaaaattctttcttagatcactcggaagtggcatttgttttgtcatgacctttcccctttccaattacaagttgaaggagtatcgacacatatttatggactaaatgacaacctgtaactgtttgatcaaataatttataaataaattcgacaaaatctaatacaactggcgcaaaaatgacaggtcgcgccgaaatatttaaaatagataataggccaattttgatggcccaatcccaacgctacagactataaattttgactgtgtatacttggctcatctaataaattttcatacacatcacatataccgtgattgttagagtcgtgcaaatgcacgacttaataggccagtaggtatgagaattgttagggataatataccaaagtgtaggatattgactattggtcaaacagcttatgaaagtttattgaacaatcttggacctttcactatcttttactgatacttatctatgatctaatatcagatattttatcaactgtcgcatccaatggtccatattttcaaatgatgtggcttaatgatgttgcgttttaagttttaccttttacttagagggataatttagacatgttataaatagatagcataggtcaccaaacttatagatcatgttgtatgcttgcatgagattaaatatgtaattattgttagtgggtgataatgtgacatgattgcatgttgagctttagacttagtggactttaactttataggaagcatagataacacttccttgtcaagcattcaattcaactttttacaaattaataattatattttaatttagtttgttataagaacatgaagagttttggttggataggacatatcttagtaccacaaatttggacatgcagtctgtccatatttctagtactgggatatatccattctaaccaattatatttttcaactaaaactctttatattttgggacggaggaagtatgagttttaaatgcacccactccatgagttttaaaacttgacgtggtgcggtgcgtgtgctagcgtacttgggcgatggcaaaggcgaggtaatttcgggcaaaagggtcacgctcgcgcgacgatgttctgtacgcgagtgagtgtaggtgtagtgctgttagaggttgaccaccacgccgtgcatatgtgtatgctccgtgtgctaccagctagtactacaactttttattatttttttaaaatgttttttaaatttgttttcatcttctatagatttaggcggtgttttttctaactttcccaactcaccttcctcgttttctgcacataaacatctcttactgctaaacggtgtgtttttcaaaagttatatgtaaaaaaattgctttaaaaaatcatataagcaatttttttaaaaaaatagcgaaagcttaattaatcatacgctaatgtgtcgtaacattttgcgtgcgtgagaaatgagaaataagctctcaacaccgtgtaacaaatgcggccttataccccctaacacacattgggaaaaatcctctttcagacagcgttttacacgaagtagtatacaatctttgacgcatggtgatgatcgcccatcagggttggccattttggacatataatgattatattatgatgaaaaaatatttatatttataaattacttttattatatacgtaagttacttttatcatatatatatataagttacttttagatttaactaaattacttcttagacatataaaagtaaattcaataaaatctaaaagtaatttacatatattataaaagtaacttaaaacaacttggaagtaactttgtcacgacgttaaaagtaaattcgttataggaataaaaatatgactacatgtccaatgaaaaaaggcattcattaaagttattttctttttgtcataagttacttctataatatatgtaaattacttttaggctttattgaatttacttttatatgtctaagaagtaatttagtgaaatctaaaagtaatttagatatatgataaaagtaatttataatttttcattaaaatataatcatgtaagatcttgttataaacatttaattgttacgaatataacggtgcaatcggatcgtagatcggattagtagtttaagagaaaattgtatttaaagtataagtggatagtatctctcttatatggagtggtagctggtttagacaaaccagctaccactagctgtgtagtcacgtctaattttaaagccattatattttgtaaacattttattaaagaaatatgaaaacaaaagaaaatcctagtactaataccatctcagcgcctttgcgtcaggaccgacggtgggccgtggccccgaggcccatcctgctagccgagaaacagttacaggagagcccatcagagaacctcacgcaaagttggtgggcaagaactcaaacaacttctctcttgaaagaaaaatatgttactggcagtgtggaatgtgtgcatagaaagagggtgaaaactgtatgatccgctagcgccgttatatgactgggtaggttactgcctcctataaatacgtaatgggttaacatttaagaggtataatatggtttatatagttattagtttacaagttctttcgatatctcaacttctgttccattttacgtgatttgtttgtatgagatagtggagtaaaccaggtagccataattagaaggagcaaataataacactgaatttaatactaacatctaaacggtgcgagcaagattataaatagtaataagaaaaaaaatggtactaaataatattagcaaatatatctacgacacgatgaggtggtttacgacgtggagcagccgccgcccctccaccctactggtggatcactggcgcttcctttaggaagagctgcttcaatctgagcaacgtgatggcagccggcatggggatgctctccgtgcagtacgtgctgtcgtagagcatgtggcttagcctggcggtcgatctcccctatatttggcgccatctgcttctacaccggcaacctaaacaaccgctgcatgcgcgctgaccactgcgtcagaagctacccggacatcggccacctagtgatgaatctagaatgtaaatttaggtgggaatgtgtaaaagctttagtatgatggaaacaaactagaaatatattcttattttagttaaattttatctagaatctagaaataattttatccgtagtctaatacaactttagttaaattcaaaggtagtgtatctaaatttggaagatgtcttgcatcataaacttttatatgccgagttaaaatagagatatattgtgttgtatatattcttgtactaagtttagacttaaccaataggtatgagaattgtttcggataagatgccaaagtggtaggacattgactattgctcaaacagctcatggaagtttcttgaacaatcttggacttttcaccacttttactgatacttatttatgatctaatgtcagatattgtatcaactgttgcatccaatggtccatattttcaaatgatgtggtttaatgatgttgcattttaagttttaccttttacttagagagataggttatacaagttataaatagatagcacagttcacaattcttttcttaaagtaatactaatatagtgtgcttagtatcattatatactaggtaattccccacgttttgctgctggaattactaagcaattctcaatttttttttgacaatcaagcactaccacataaatgctaatagaagtcggcactataggtggcggaagatgtaaaaccgccacctatagtccctttctgcccacgcgcctgcccaaaccacaagaacaccagttcttaaacaaaaccgacacattttaccccagtcagagatagatgccggttttaatttaaaaccggcatcttttggttggcacagggcccaccttacaacccacatctttgtggtaaaaggaataggtgccggttttttaaaaaaaatcaccgcctataaaatattataggtgtccgacaccccataagacctagccaccacacgctctctctcgcatggtttttttaagccgttcttatccatgcatcaaccgatgctctctctctctctcacacacacacaccgacgctctcttatctcctcttctcctcctcatctctcgtacgcatcggcggtggcctggcggtgcagtcggcggcggcgcctcccctccgccagatccgctcggtatgagaggcggtggcgccctccgccacatctggccggtagcagaggtaggcggtggcgggagggaaggtcagatgagagatatgtgaattctgtgaataattttactatcactttgtcggatgaagaaatgaccaaaacaaaagttatagatcttgatgagttatacaaatttgttgttgatgacttttccaattgaaatcatttagtatttgaaaatgttgtttgaagttttcatattttcaaatttaaattcaaactgttcaaaaaataatatatagaaaaatgaacaaaataaagttgtaaatcttgataagttatacaactttgttgttgatgacttttcaatttggaatcatttagtatttgaaaatgttgtttgaagctgtcatatttttaaattcaaattcaaactgttcaaaaaatgttatatagaaaaatgaacaaaataaaagttatggattttgataagttatacaactctgttgttgacaacttttccatttgaatcattttctacctgaaaaatttatttgaatttcttatcttttaaaattcaaactttatatagttcaatcaaatccggatgtagaaatgaccaaaataaaattggtagatctcaatgagttctacaactttgtttttgacagctttttcatatgagttcatttagtatcataaaatttaatttgaaactcatttttgccttaaagtctgattcctcctcatcatgttaatacttgctaaatatatatttgatccaattaactcagtttggctggtgaaatatgtgaatggatgtgaaatatatgatcaaaatggatgttctttgagcgtggttgtgttaaatatattgatggttgtgtatgtgaataaatgtacaacttcttttccggaagccgatctccaaagaactatgaggttaagcgtgctgatattttggtgcacacgagtaaggcaatttcgggatgggtaaccgaccgttgttataaatgattatattttgaagatcataaccatatccgattgagaaattttttctggatgcacacgagcaattttaggataggtaaccgaccgttgttataaatgatgatattttagagatcataaccatatccgtgtctatccaattgttcaccatatccatgtcttttgaggggtagttaatgactgagctcgtttatataatagcaaacttttcaatcaacgtaatggtggaatacagattactatctacatgtttcatcgcttgttcatttattattcagaaaatatttttattttacaagaggatgtgtaccaaattatacctaaacactattctatttcatatacaaatcaatataataaaaaactatttttattttacaagaggatgtataccaaattatacctaaacactattctatttcatatacaaatcaacttttataatagtagagatatgaaagaaatgaagtgtgcgaaagtattaatttcgggaatagcgctataataatgaaatcggtgattaattatcactaatggcacaa

SEQ ID NO: 56840 - DNA, 3080 bp, Oryza sativa
ccactgtagcattgtcattagaggatgttaatcacggtgatttgccggcagttgatttgcatggaaacgtaggaaattaaaaggcaagatagctatctggatgaatattcctcgccatgagcatcacgaacgcgtatacgaatacaaagaaacaatttatccatatcacgcctaatcggaaaggagtcaccgacgcggtaggttcgaaaggaaaatacagtgagcaggatgtggatatcgataagaagaaatgttacatatggaggaatgatggtgcaaatcatagaatcatgttaattattggctagccactgcaagctggtaaatagcatgcgtataacagaatggaaatatatatcccattgatagtagaatttaaacgtatcgttgtttaatggaaacacaccatcacagtatcattgtgagatggaaaagtatcacacctttttctatattaatcaacaggaaacttcgtgatggatatgtatagaagtgaagcaaataaacatggcagctgttcctatcattccttgcattgctctgtgccgactgtgcatgcaccggctcctctctagtataaaatgctaagccatatcatttgcaaaggggacagcggagagagtacagaggcacgagccgagggcctgcagttcacgccgccgccgccggcaggcgctgcgccgtgcccagccttggcagtagtccatagagagacatacatagagacacaggagagaaacacagagaagcacaaggacaaggagagcggacacaggttgctcatcgtcatcgggaaccatcacgcacgtcgttttcgccggagtatctcggcgtccggcgggaacgtgcgtgctctgcggccggcgacatcggctgccgtatctcggcgtccggcgggaacttgtgcgctcggcggccggtgacgttggccgcagtgcctcggcgtctggcaaggaggcgcgcggaggaggagacgatcgccggagcacgtactcagccatcgccacgagtttaacttcttagttttcttttgttttccttctctttctgttcagatcagcatgcatgcacaagatggcgacatggagagtttccggtgctgcctggcccgctggatatagcgtcctctccgcttgtcggaggcaccgccagccggagatcgcgtcgctccctctcgtcggagacgccggtcgccggtgacacatctacctgctgccgcgacgtccttgcctcgccggccgcaacctctatcccacgacgtctttacctggcgatgtgatgtcgtcgagatgctggatcggacgtcgtcgccttgccggtcgcggcctcttctccgcaacatcgtcgacttccgctcgccctcatcaaagctgctatcctctacacacattgtcttgctgcttgaagagaacgccggccggagcgccactactcggtgcccgcaaggcgtcatcagctctggctgcgtcccgaaccatctcgctggagttgccgtggacaccgctgagccgcccaaatccatagacggcgaggcgttgccagctaacgctagcttgtccccgtcatcatccgctgcccgccggagaaggccattgccaggtcgccaaggtgctagttgccgatatccggaggtcgttaacatatcatccacaagtcgcgatgggtatcgtcggacccctgttgccagcacctgtcatgatgcgcccttggtgggcagggatgtcccactgagactctactaatcggccggtgacgccctccgtcccccacgctcgttgtagcctctgcgggtcgccgccaacgtctattgaatatcatcctcaccggcgctgcctatttccgcacgtgctcttcatcggcttcgctgccggcgtcactatgctgccgtggagctgccgaccaagccatcccaaggtcatcattccccggaggccatcacgtcgtttgcagccgccgcgctgaaattactcagatgcttgtattgtgcatgcgcactgtacgaatgcatgtatatgcatgctactgtacatgatgacaagcaagcaaacaagatgtgcatgcatgctaccgtacatggtgagaagttaaattgagttagcaaattcatactcatttgatgctgctctgtactaaaccttcgagccatgactaattcggctatcattcgtgttgatcattcctacctttataatctaattccgatgcaattgctatggggtcgagtcatcttagctacacaattccatgtatgtcttcaacaacaatatacaccaacacgttgttcaagaccgatgaggctgaacggcagggcaggcggagtctatatgaagactacgtcaccaacaccggcgcacggaccgacgaagccgtggaccactgtcggcgcccacacacatctactccaccatcactatcatgcatgggagaacatgaagcgaagactgacggcgcagtactcccaagtcaagccactacgatcagaggtgacccaacataatttgggttttggctccgattgtcggcgcatatacaagagagccacctagttcctggaacgcgtctcatcgttctcaggctaggctacgcccctaacgtcccctaaaaaccgctcaatactatgtgctgcagcgatcagaaggctaactcttgtaccatgaggatggtcggccagtgccgtggagactagaagggcgatgctaccctatcgccagtgacgacaagcttggcatctctaccgacgaccaatgccatgctagtctccattacaagcaccatctttacctccaccgacgaggctgaacggcagggcgggcggagtctatgtgaaggcgacgtcaccaacaccgacgcacggaccgatgaggccgtggactactgccggcgcctacacaaatctacatcatcactaccatcacaatcatgcatgggagaacgtgaagcgaagaccgacgacgacgaccagcgcagcttaatcggaggtgtctcgcgggtttaacccgcgagagtaattaaccgggtgttttccgagaccccgggaactaggagaacacaatccgcaagtcagatccacctcaccgatg

SEQ ID NO: 56841 - DNA, 1247 bp, Oryza sativa
cctttgtaagtgatttgtttttatgagatagtggaggaaacatatttagattcaataatcccttatctatcaaacaaatgtgtaagattgagcatatatagtcgtacccatagttccattcgccacaaatatatggcccggtgcgaagaatagcgtacatgctagcattctgtatcaccttgatgtcgtagttccccttaaagttgtactacatatcaaaaatttcatgaaggtcaggaacaagaacaatgctggaatagattaaaattatccaaaatgcacattttgtatgaggtggcgtatattcgtagtttgaactgtaattattattaactataactgaggctctcctataagatccctccataattttaagagcactaaaaatagctggaattttcacgtctgacatattaaaaaaaaagctaaaccgtccaaactacatgaaatttcgattaaactactttgtttcttacattggttagaaatcaagaatctggtttgcaaaataacctacatgcagggatactacgatctatacgcaaggaatataaggatgtataaactaagcttaatttatctaaataatatataattatactcgtcaattgagcaaatcccgtgattctatttcattatctaaaaatatactcatcaattagctaggcatataatcatttggataaattagcaacaagttcacaacaaatttcttataattaggttggttttcatggtatactttattaatcgttttgttgaatccctagtggcccaaaactcttcagtaggctaaaattgttttattcatgtcgataattaatgctaaaatataattttttcactcaatcatattgtgtgtcaaagtgccatgtctgctatccgactcagccaattaacattattgccagcccacccctgacacaatttttatcaattcttgtagcgattatatatataatataaaagattactgaaattgattgaaatggaaccgcatacccaacggtaggttacattctctctctcggtttgaaccatcaggcgggttgatgctactacctagttgtaaattaggaatacgctcgctgcattgcctggtggagaaaaccggaccggtgagtgacccagacaacccctcggttcaccggttcgacggactgactagggaactgtcggttgaaccgcggttcaataactataatatatatatatatatatatatatatatatatatatatatatat

SEQ ID NO: 56842 - DNA, 5683 bp, Oryza sativa
atatatatatatatatatatataatgtatatttcctctacttcacaagtgaaaaagcggtaggatggctagagccaagtgctctcagcctctcagtgcgcagaccagggttcgagtcctcacgccacaagcatttctctgatttcaggtacagtgtgtgttgcggctttagcttttggaaacatctctcacttacgaccgtttggttgatcgcagcagcttttggaaaagcagctacgagaaagtcaaaaaacccgtttggttgatcacctgtggtttttgggaaacatctctcacttacgaccgtttggttgatcgcagcacgggatgagagaacaggtggcggagtcgtcgccatcctctcctcgcgcgtcccaacccaaggcaagctggcgccgagcggggacgagcagggcggcgccgaacaaggacaggcggcgatcggccggggacgagcagcgtcagcgccgagcggggacgagtagggcggcgtcgggtgttgccagcgtcgagcaagcagcgaggtcgtaggacgacgagatggacgttgtcctctcctctacctccgccgcgctgggaggaggccggcgacgggagtcagggggcgcggtgggggagaagctcgccgtctcgccgggaggtcgccgccttgccgtttcgccgcgttgccgggaggtcgcctcgccgggaggagaaggggcgagaaggggtggggttggcgtcggacggggaggagaaagggcggcgtcgggcggggaggagcaggggcggcgccgccgtcgggcggggaatgaggtggccggccggccggagggcaggggcggcgccggccggagatgcgcctctcctcccacctgctgcgcgtggtgcggatgcgggatgacatgagacgagattatcgaaccgttttcttcgtaatggttgaggtggataattttttttcccaaaagcaggtgaaagtagggggtagaggtgcttttgatttatactataccaaaagttagctttgggcaaaagcagctgcagcttttaggccctttggttggcttttggcttttgcaaaagtaaaagcaggttgaaaagcctaaccaaacacacccttagtcggttcaatccgctcaaccgaactgtggagtcctctagttccagttttttccggtgaattgtcgtcccacctcatgatgtagtcatcggagacacacagcgggccaaaccatcgaccacacgtacacgatgtccagataggagcaaaacgctgcaggtttcccatcggagttgcgctaggtgatctggacttccgattctctcaacagttcggaaaattttgtgtcgtgattgtttagctacttaattgggttgttcacttctgtttagattaggcaagtggtcagctattaatgggctggttcagcccaactagctattaggtagatggttgtatggtgcgtaaacgtaatggcataattatgaggtgaggggaatgttgcccgttagctagagatgaaaacggtcaaaaatgatatcattttcttattaattttatagaaacattcaaaaaaatcttcatatattatgagtttagctatttagtggtaatttcaatacgatgctagcagaaattagaaaagctaattttttagaaatggtcatcatcggtaaagatttttttaagataatagaatagaatgccagcatttgctcaaagagttacagccaatcatcagtaaatatattattgttgtattagttttgtggaaaacgatatattaaaatggtcgggaaattttcgtactatgcccgtaattcgtatctgtattaatatagaaatgaggcgttcaccccttccaatcctatatctcaattcaacatgttaaatctctaccgttcattcgcagatcaagtgtaatcaccgattccgctcctccgcccaggtgattacacctgatggcgatgcccacgcgtccgctttaccactccctttgacaccgcccctcgatcctcgctgcgtgcagctccgccaagctccaggtagccctggagcgtggagacgacaaagctttgttacgacggccgacaggtggtcctgaattccaccgccaaaatcaggttagttcatccctaaatcatgtttccaatcccatatcatctgatccccattgtcccaacatcgatcaattgacttcttagtgcgtaccaagctttttcactcggctcacctcaggtcagtgtttttctggtttcttggttcagttggttgtctctaagttgatgcatcatatctagccatcaggaatataatgtagtgttattttccaaagaagctgtgatttgacactcaataagaataatttggatgtgaagaattgattcaagttaacagtgtgagtttggatggaatctctgaacccattttgggaaaacaagcacgggggactgtcgctagctacatagctgcatccaagatttgatatcacagtatgcatgagcatttatcagtctgtctgtgacaaacatcgtctcctcaagtctgcctgtagttgtatgttcgtccaaacatgcacaaattttgaatcttttgtcactgtggaaatcatattatttcacttttctgatgacctgatgtagatggccataaactcttgcaggaacaagaacaaccatgaactacttccttgatgggcgaataaagagggcataaattatttttctatgtgtagcacgcttcctcatcaccgtcttcctgggctctgttgtgcactcttctaacgccaaggacgtggaggagaagctaagtatgtcaagattaaatttgagcacaaccaatctgtattttctttgagaataaactccttctgatgtcaagaagtacaatctgtttgcgggggacagtagaggcacaaagctcagcactgatgttgctgacaaagatagtagtttcaccacctgaaagaggaccagattacacaatgcagaaggtaacaagtaatgaaattgctatcaatttttttcagaaaattgttgcctgatcaagaagaattcaaggacggcggagatgaagattttgacactggcaccgaagagttcatcatttagattaagaagagacgatcaatcaaggccaaaccacccaccctgtctgaagatttgtgcagcttaaaaagaactcatctaccaccagaaattcagaataaattacagagcacatctgctcttattttgttcatttccattttcggtagagcattgcacatgcatctcatgacaggaagatgattaaagtacttctctaggtttttccagcaaatgtgatacgtgatttaatgcaaattatttgtttagtttgaaggctttccgagaatcatttggaaatctgggaattaatcgttggtagctcgaaggaattagatgttgattgcgatgcataatctaatctatcttttgcctttctcagcagatattgcaacaatcaggatctccatacatgatgtagcctggtcatttgaaaagaggccataaagaaagctcggtgtagtgcattgtgtctcaatgaggatgtacaagcagcaaagcagtgatccaaatgtacttatatagtagaacttgtcccattttacaaataatgtgcaacgaattattgtctattgcaaaaataaaagtctgtggatggaaaatctacttccgatcttcaattatcgacaaaatgagaaaaaaaattgtgaaaaaatgtgatttagtttccttttattttgggcaaaattattacagtggtgatgaatcagcaagatgcctccctttaacaattaaataaaatatggttagatgtaactacatatatagttttattactgtttgcttcccaatatttagagttctatattagatgagattatcgttcttgtgataatctttattgattgattggtgcgtaaaaaccatgtaacgaagtgtactaatgtattatgataccagataatgtagtttttgttttacttccacaataggatgaatacatttatctaatttgagaactgtttgttgccattacggtactagctaatatcctcagagtagatgaagattaatgttgacgaagtacaatgggactagcaggttgatcaattgttttggtccctttttatgcgtttctaaagttaaaataactatgtagtgataacatgattacttttgctttttataggtttcgcaaggatgtcttataaatttaaatttagtcaaacagattacatatgtttcaataaaggtagtttgtaaattttgattgtgattgtccttataaagtatattataaaaatgtgcattccatgtgcacaattactagtgaggagaaaagcatgagaacgagaacttctattccaccacagcttagtcgttgaaaatggttatataggaatgatattccaccacagcttagtcgttgaaaatagttatataggaatgatagcaaaaggatagtatatgataccatgataattgcatgccctaccgcacttctctatataatatcaataccatacatgttatatttgttatctgcgtgataaatttagagcttttgaacctttgccttctaaatcatagttattatggagtgattaaagccttctaaatcatagttattatggagtgattaaaggtcagcatgagatattagagaaaaacaattaaccaagatatttttatgacacgaaatacatggctctagcaattagagcatcaccaacagtatattctcaaatccttcccaaaactgattatgagatattttagtcaaacaatcagatctaacatatcccatatagccctgtacatgatgttgagttagcattttaattttttcatttccttaatttgaggggaggctccaactctatttctggcatgtccctccttttcttcgccgcttctatcctctacttcattgctagcacattcctcctttatttctcctctttcatcatatacttcccgggccactggcatcgggacagggagtgcgtcgtgtaaggaaagaaacgaaaattttagtttagttggaagtttaacaaggctcattttagttgttggaattgaatttaggcttcatcttataacttcaaaaaattttacggatagattattgctaatctattggtaatgctattactcactccgttccatagtacaaagatgtgtccatttctacttgacccaaagtataagtgaatttggtatagtatttgtcacatatccatcaactccaattcaaatttctacttattttaaccccaactaccaactcacctacaaccaaaatcacatcgagtaaggatgttctagtcttttcttgctatccttaatattgcccaaaagagaataatcgtaatcacatctcataaccatattctagtcttttattgttatccttaatcttgcctaaaagagaataatcatataatagaggagtatcaaatagacaaacatataattgattaatgctccgatcccaattttgttttacattatatcccgtcgatatatactaaggacatatgtgattgaccatattatctagatcaacttataattcgcggatattcacatactactgcggcgaacacacaaatgggtgtaaatgtcgatctttagtacttgcatatatgaaataaagaataaagccatggtgt

SEQ ID NO: 56843 - DNA, 7516 bp, Oryza sativa
gatggtctgtttgctttatcctttttctgacgtgtttagtttgatgcttttacaattgtgattgtttgggcaggtgccgatgatccgtgataccagctgatttaatttggcttgaccatactaatgaacataattaaggttgtttaaagaggcccagttacacagtaggtgggtagcataccaaacaccatcagaactttaccctacaaaatgtgctttatctttttcttcacacaaatatagcgtgaattcaattcacgttcacacaaattgaacgccaaacgaaaacaaaccactccttttcagatagcgaatttttttttgggtaataaggcatcaaaacaaaaccggtcctaattggcagtgttttttttttgttttgttttttacggacttaaaatgagccgaagtaaacgaaatcctgaagaacttcaccatgtcattctagattcctagtacatcctcacacagataaacagattccaagtacatccttacacagataaactgcagataaactgttcccatgtgaccttgacatctcccacccttttgtatagcttaaagcaattactcccttcttccctaaatgtttgacgccgttaatttttccgttaatttttttaaacatgtttgaccgttcgtcttattcaaaaacttttgtgaatattattcaaaagattgagtagtagtagtatatttaacaatgaatcaaataatagaaaaagaattaataattacttaatttttttaataagacgaacggtcaaatatgtttaaaaaattcaacggcgttaaatatttagggacggagggagtacatatttacaacaagcgcggttgtgcatgcaacaaagattgcacaaagttgcatctaaagttagtaaattaccaacaaatatgggacacggtatgccaatgatccaagatgaattcaattcaatcagtacaacgccacagatatggaagcagaggattaagcacgaactaccaacacacatcaaatagcacaagcacaaaacaatttactatgcatgtcaaacaaaggcacagaaaacagagcatcaagtgtcaaagccagagtagacgccactccccctcagaagtcgcttctcttcttcaacgtagttcttccccctgctagcctggccacgatctctcttccgcttttccttctgtgagaaggaagcatctttattctctttctccatctgcctcggctgcgggtttcgcacaccaataagcttttctccctcagttactgcagttcttgtgcgctcccgttcttcataggattcagtttgatcttctttgtcgttgcgatctttcccggtggaccaagaccagttaggctcaacctttggagggggcaccgtcaagacagatgggccgccacgatacccatgccggctcaaagcattgaaatccacaccaccaggtttcttcttcttcgacatagctgttgttcagagagctaaaaccaatgttaaaatgaacactaacaatgagaggtaatactcagaaacatgcatcatctggaatccataaggctttgttaggatttaccaaaaccaaactgtgcaagcttactgattacagcaattaaaaagacaacaaaacagacaacccaaaccaacgtcttctactacaatttaattttttttttctcaaaaacgctctactgcaactttatgggagggaacactggatctatgtaggcatgatacattggagctgatgcccaaagactggctaaatgttgactagaggtggtcaacctatggacttcttcagtgatccaaataagggcctcagctttcacaggatggatgatagcatccagaggccggtgctcatcatcactcccaactctctgctgatcccactgtttcaagaggacattggtaaggtaatgtaaaggctgcttatataactgcttcaccgacctgccgagtcccagccatgttgtgcatgggattacagatccacggtgagcaggaactggaatatgcttcatatactcttgatacatttcagccttcctgatcagtgcacctgcatgatctcattatagtaagcatggaaatttgtatctctacgtagaaaggaaaaaaaccttaaaactacatgagccaatccaaagcagaacgctattgtccatgtctgaagggtataaaatccagctcaaagcctctattagtgcttgagaactaaaattatactccatccacaagagttagacctatttcatatttgagttttttttccaaataagttgttcctatttgtagtgtctatgcatccaaaacttaaatggagaggtaaattaaatgtttgattaaaacccaaggagccatcgtaatactcattggttgcatgcgtgcatacacttcttgatctttgttatatgcaagatgagttaatttctctttggtcttggtgacaaaagtaataggtgtaactttttgtggaagaaggagggagtactaatttgctaacttattttgtagtgttggtctctggctcatcccatagggtatatagagaaagcataggactcgactgttgaagctccaaggtaacgggcaactcatgataattctttgaatgacagagtattaattacatacttagttataagagataaatgaaacttagatagacttattatagtggtgttcataattagcacaaaatcatattaaaaactccaagaattttttggccaaatcagcatgtaaaaccaggtacagatataacctgcaagattgtctggatgcaggcactatgagcctgttaatataagtggtatagccagcagtaaataccattgtttgggagacaacttttcttaaaatgtccatcttttaataatggcaacaagtggacaactttcaaactcaaacctcaactgtgaaaataacatgtgggcaatattaacatacagggaaaacagggaattcctccatgacaattgcgataactcaaatatcaacaatatcacaataaattcatgtacttcaaaatactgaacattcacttggtcacatgaaatctatactctatatagaatgctaaaataacatatagcgcgtaaccttgtaagaatagaacactagctaaggtaatgttgcttagtttcaaaagaaaacccatgcttagtttgttctttagcaaagtctaagaaaaatgaatactaccactagagaaaaacacgtgagttcccccagtgtactgctatataatttactgttatatcaatcccaatcaatatgaaaagaacaagccccaaatttccatagatggctggccaaaataatcttaagataacgttaacgaatctacagtaatgctgattctctgatgtgaaaggtacgggtaaataaccactatggctttgcttgagtggaaggggactagatccaatccctttggatagatatagaaaactgcagttaaaatccctggccatccaaatggatagattctgatccctgcatatagaaacaagccctaatttcacaaatagactaaatttacagtccgaaacaacataagctagctaggaaacacagactaaaaatccatactccatgttgaactcatatctcacaggcaacacacaatacagacattcaaaacaatcttgtgagagcatagcgaggccatatagcatgctaacaaaccaaaaatatgaaaaatctcctcgtgagctaacaaaaagacagagacagatcactgggatagctctcaccgtctggtgcggcagctttggtggaattgggcagcccgaaggcgttgtcccctttccccttcccggcttcatcgtcggaatccgagctcagggagtcgtcggaggagacttccagcggctcctcccacggcgccgccctcttcatacctagccgcacccggccaccgccacatctaggggggttagcgtcacgccgttggcgaacggtggagtcgaggccgtggatgatgatgagcgagggggggcaatggacgggtcctcacctggatcacggagacgtcaccggcggcacggcgcgccgagggagaagcggcgcggcgcgcgagggagaaggtcgctggctcgctcgccgtcgcttgtcgccggcggcggggacgacgaggccgaaaccctcgattgctgtgttgggctttggatcgctggatgagggtggagacagaaggaaaaagtacacctaaggtacctcaacttgtccgcgaaaccatatatgggcaccatggtatcaaatgcataaaatcactcaactttttcaaaattttcaaattattagtatataccaagttataagaatttgatttatacctacacctatcaacaaaacaactcaaatttaactttatctcacaatccataattacatacctaactaattatatgtttggatgctatatacatagaatcaaaatctaatataacaaaaacaagtttaaattcagttcaaacttgctttgaactagttagtaaagttgttaatgttaatacctaaatatttgaaaaagtttcatactcatttgaattgggtatatactcaatttcaacaatggtgcccgggcaccatggagcaccaaacaaatttaatatatatatatatatatatatatatatatatatatatatatatatatatatataggaagcctatattctactcccaggagtagctactcctattgtaaccatcggacacctgtccaactcacatcagggtttcgggcttcaactcactaacggattgtgagaaaagatccattaaaccagcgatgcagaaacttgaatattcttttttttttgaaaattcggatcactgcgctgtgttctgcatggtgagtcattttgaatgttctgcatgcatggtttgttacccgcacgcatgcacgaccgagcgaccaggagagtagttagtgtggaggctgctgtattgatactctatttaagttgacggtgatggaggacagaaaatgaggaccacaattatctttcggatttgtgaggaagaagattttgttctacaggtttttgatggagcagaaactctccggtggaaagggcagaatgtcgtcggcgaggtctgttgcgtcgccttccgcggcgcgagtaggcggaggctcgtcggcgcctgatgtcgagcagcagaagtcggtggcggccgtaggcgcgtcgtcgccggtgagtagtagcaagcaccatcatatggcgaaggcagaagatggaaccattacagttaatggtgacaagcagcagaatcctgccgcagataggtacacattgaagtttagttttagtttatgttctgttgaaattttttctcttgtttgtttgtttggctctaactggttattgcgttatttggtcatcaggaatggttttgtgcgttgcatggatactgctgcccggagtgaagtgatgaaccactctctccagaaatatgtcattcatttcgatggatgtcatcctcttcccatgagaaatcctaggaagagatgcgcttggtgctcactccgtgatattcgcgcggcttgcgacatgaatttcagaagcaacgaaacaacccgggtcaacagtaatggttgcgaacatgtgtccaatgaaaatatgtagacaatagtgtgatgatcaggaaaattgtaataagggcttgctttctgcacggtcgtagattagtcgtacgaactgtctctaattttgtatggtattttctatgaggaaaaagcgagtagtatctaagtttagaaatctgtatcttctgctgtttgggaagtgaaataaaattgagatgttatcctttcatttatctatttaagttgtgtgtactgcaaactccctgttgtcatcgtgaatgcaatccttcaccaagatgaagttcttcgagcagaatattgtacaagaatggagcaaagatttcgaattggtttctgtgagtgtagcgttgcgtactcggaatgtttgttatagatgctatttttgtggcggtatggtttcatcagaattcgttaatgttgctagtggctgactttccggagtccaataacatgcttcgcacgtaggagccttgattttcggggaggttgttgaacagctaatggaaaataaaccggaattatttgtcagtatatatccaaccagctggaaaaaatgacgccctatagcaaattctttttgccaaaaggggtagctaccagaatccgtgctggacagaaacaatattcgcgaagatagctatggaggaagaaggctggccggagaaaggtggcgaggatcatagtggacaacccatggacgtagttccgttggaaaggtattttttatgtcagtgtgattgtagtgtacaatttccctttctgcattgttagctgaattctcatttttttgatcctaggatcgtggttgagggggaggaagagagtgatctgctgcctatttcactctctgacccagccattctgttgccgaaaattgggcagaccttcaatgaggactctgatggctatgcgttctacaatctgtactctaggttcactggttttggtataaggagatccaagaacagatacaaagatggaggcgtgaagtccatgcaagagttctgctgcattcgcgaggtaaaaatctttagtgtattcttttttttttgaaaaccatggtttcgtattctcgtaagattggcaaggttctatagtgtgatgcgtaggatcatcatttcataggttttacgtagtaaggtgttcctgtaatttatgcagggtagagataattccgtcactggtccgccgaccaggataggctgcaaggctatggtcaggttaaatcgttcttctgaaagtcaaaagtggagagtttctgcattcgttagtgagcacaaccatgaaatgaaacgggacctgcagcatactaaacacttccggtctcataatttcattgatgaagggacaaagaggaacataaaggaaatggtagataatgggatgacacctacagctatgtatggattactttcaggtatgcacggcgggccgtccttaaccccttttacaaggagggctgtgacaagaatggcgtatgccatcagaagggatgagtgtagcaatgatgtgcagaagacactgaatttttttagggaaatgcaatgccgtagtaagaatttcttttacaccatacagattgatggtgcttcaaggattaaaaatatattttggtgtcattctctttccagattaagttttgaccattttggggatgcaatcacttttgatactacatatcagactaataggtacaacatgccatttgggatttttgtcggtgtaaataaccattttcaaacagcaatttttggttgcgctttgttgagggaggagacaatcgaagcattcaagtggcttttccaaacatttactgatgcaatgcatgggaagaggcctgcagcaattttaacaggtatatgtttatttggatggatcaatggtgtgtttaatgatatgtctt

SEQ ID NO: 56844 - DNA, 6704 bp, Oryza sativa
  unsure (1)..(6704): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttgcttcctccactcaaatctagagcctatcttgtgagattgagagattagattagagtgtaggagtgttttggagatggcttgaagattaggtttaattgagcactttggatatcttgtgggctgtcacttggacttattactcttggagatcttctcttagactgttaggtgtcgcccgtgagcttccaaagatcttgtggatgtcccgggaaagtttgtgaaggttttcctcacctccgcaaggaaatgatgtaagtgagtaaagattcttgtgctgagttttcagaagttgtcctaggtagagcaacttgcacttgtggtcttttctagaatgaattgtgagttggatcttggtggtcactcaattctagaaaatgacctagaagtgttgagttgaaggctgtggactccttatgggatctttgcataagtgatgcaaggggttaatcgagacccggctctttgagcacccaatggagagtaggatccgtgtgatccgaacttcgggaaaaaatcgcctttgtctctcttgtgcatgatctgtgtttgaatctgctggtatcttgagatctacatcttgtgcaactctgtgcctgatcatctctagctaggacctgttttacttcccctaatttcgcttttctctgttgcccggaagttcctggctcaagaacttcggaagttccgggctactcatcctgcccggaagttccagtgtttatcaccaggaggttccgggccctgtcaatttaaccgctgcaattgttgacaaaatttcaggaaagcctattcaccccccctctaggctacatctctgcacattcaattggtatcagagcaaggtgctcttgattcaagcttcaccgctttgagtgatccacgatgtcggacttagggggaaaggacagggaaattggaaataaagatggagcgagcagcaagggaactccatcacccaagggagccactataccttttgattacagctaacttaccattccctctcacaatttcgtctctgtgccttccggacgtgctctcaatttgatgggacacattacgccgcttagaagcacaagatgaagttgcatctaatctctttgcatccaagtatttggaaagttgtttgtacacgaattgacgcacctcatgaggacatggagctcacttcagagcaagaacaactcatccaccgcaatgctcaagcttccaatgcaattctctcctccttgagtccggaggagttcaacaaggttgatggactagaggaggccaaggagatatgggatactttgcaattggctcatgtgggatctcccgctgttcgtgaggccaagattgaattattggaaggaaggctaggaagatttgtgatggatgacaaggagacaccacaagagatgtatgataggatgatgatcctcgtcaacaagattaaaggacttgggagtgaggacataacaaatcactttgttgtcaagagacttctccgtgcttttggtccaagaaatcccactcttgtatcaatgatacgggaaaggaaagacttcaagaggctcaccccaagtgacattcttggaagaattgtgtctcatgagatgcaataagaggaagcccgtgaagtgaggcaaatggtgaagaatgccgccatgatcaaaaatcaagaagttgctttgaaggcaaaacaagaagaacagtcaagttgtgaagaaagtgaagatgaataaatgacttttattgtcaaaagattcaatcactttcttcgcaagagtggctatggcaaagggaggaaggatgatgacaagggaaagaggcaatcaaagagagcgtgcttcaattgtggcgaatatggccatttcattgccgattgtcggagcgtgctcatgttgcggaggcacacatggtggaagtgtggtactccggcgatgaagaagatcccgaggtcaagcccaagcccaagtcaaaagacaaggttgaaggagaaggtggtgttgctaccgtcgccttcaagtcatcttcttcaagcaaggagcgtctcttcaacaacttgagtgatgacgacgacgactcctaccactactcttgcttcatggcccaaggctgcaaggtgatgactcaaaagccctctcaaacttctcttgatgttgattctagtgatgaggaaagtgataatgaatcagatggtgtgcttaagagctttagcaaacccgctatgcaacatttggctaagttaatgagagctttggatagtaaagaacaatcactcgaaaggcaagaagaattgcttactcttgagaagaaaagaaaccttgccttagaggagagcttagctaaagaatgtgctaaaaatgaacaacttgctaatgagcttaatttggctaatggttctttagctagccttagagatgtcaatgaaactcttcaagagaaatttgctagtttagacaaaagtcataaagatcttgaagttcaatttgacactctttggaatagcacctctcaaccaaatgtggtttccaattcttctaacccttctactagcaatggttgtgctaggtgttacaatattgatttgaactcttatgccactaatgttgatgctatgcaagctcttaagaaagagaatgaaaggtttggcactttggtgaaatatgggtgcatgaagacataccattcaaaagatgccctttacaagaccatcaccgctcatcctaacaaggatggacacgggcttgggttttcgggtggaagtcctgtgtctaagcgtgtgatggtaaatgggaaagaatgcttgatgtttgtgagagaaggtaaagctccacaagcaagtgaggtgactagtcttgtgagtagccagggacccggaacatccggacaaaccgggcgaaacttccgggtgggagtctatgtctctcaaaaattcccaccaggaagttccggccagtttgccaggaaattccgggccaatggccgtgcacaagacatgaccggaagttccgggcataatgccaggaggttccggtcagatggtcttcactatgattcatatgtaatttccaaaaattcagagggcaaagtggttgcttattttaatgggaattacaatgatgagtaccgcacttgtgtgtgggtgccaaaggctttggtaactaacatcaagggacccaaacttagacaagtttgggttcctaaatcctaagcttgatttcttttgtaggcatactcctccggtggttcaagttgggttgtggacagtggttgcaccaatcatatgactgtggagaggagtatgtttacaagtcttgatgaggagaacggaactcgtgagaatattgtgtttggagatgatggtaaaggaaaggtaattggtctaggtaaaattgccatctccaataatcaatctctctcatgttcttcttgtcaattcattaagctacaatttattatccgtttctcaattatgtaagttgggttacaattgctcgtttaccgatgaggatgtgaccgtctttagaagggatgactcctccgtagcattcaaaggcaagttaaagggtgatctctatcttgtcgatttcgatgtggatagagtgaatccggaagcttgtttgattgctaaatcctccatgggttggctatggcatcgtagactagcccatgttggaatgcagaatttggcaactcttctaaagggggaacacatcctcgggctcactaatgtcacatttgagaaaaatcgtgtgtgtagtgcttgccaagccgggaaacaagttgggaatccaaatcctatcaagaacatcatgactacaacacgccctcttgagcttctacatatggatttatttgggcccgttgcttacataagtattggaggtatcaagtatggttttgttattgttgatgatttttcccgcttcacttgggtgtattttctccatgacaagagtgaggctcaagatgtcttcaagcgcttcgctaagcaagcccaaaacctctatgatctcaccatcaagagggtgcgaagcgataatggaggagaattcaagaacactcaagtgnnnnattccttgatgaagtgggaatcaagcacgagttctccgccccctatgacccccctccccactcaaaatggcattgttgagaggaagaaccgaactcttattgaagccgcaagatcaatgcttgatgagtacaagacttcggatatcttttgggcggaggccgtgagtaccgcatatcatgccatcaaccgcttgtacctccacaagatcttaaagaaaacttcatatgagctcttgagtggtaagaaacctaatgtttcatattttcgtgtctttgggagcaaatgcttcattttaagtaagaggcctcgctcatctaagttctcacctaagatggatgagggattcttacttggctatgaatcaaatgcacatgcctatcgtgtcttcaacaagacctccggcattgttgaagtcactagggatatgacatttgatgaatctaatggctcccaaggagagcaagttgttgtacatgttgtaggtgatgtggatccaagtcaagctataggtactaaggctattggagacatacgaccagtcgagacacaggatgaccaagaagatagggatcaaccttcgtcatcgacatccaatagccctacagtgagtcaagtgttagttgacccggaagttccggaaccacagatggtcggaacctctggacctctccaggccaggaagttccgggtccatctgccaggaagttccgggcagaggacagtcaaggcgtgcctacggcacaagtggatgggattgatgccgagggcactgtagagcatcctgatcaggctcaggtcccctcggtgcaccatccaagaatacatcacactgtccaaagagatcatcccgtcgacaacatacttggtgacataagaaagggggtaactactcgttctcgtgtcgctaacttttgtcaacactattcgtttgtctcttctttggaaccaaccaggggtgaagatgcacttggtgatccggattgggtgatggctatgtaagaggagttgaataacttcactcgcaaccaagtatggacgttggtggagagacccgaccaaaatgtcatcggcaccaagtggatcttccacaagcaagatgaacatggagtggttgtaaggaacaaagcccggttagttgcgcaagggttcacccaagtcgagggtctcgattttggtgaaaccttcgcacccgttgctcgctttgagtcaatccgaatccttttagcctatgccgctcaccatgatttcaagttattccaaatggatgtcaagagtgcttttctcaatggatctatctcggagttggtctatgtggagcaaccaccggggttcgaggatccaaagttaccaaaccatgtgtacaagctccacaagacgctctacgggctcaaacaagccccaagagcttggtatgaatgtctccgagattttcttttgaaaaatggttttgaaattgggaaggcggatactactctcttcactaaaaaatctaagagtgatttattcatatgccaaatttatgtcgatgacataatatttggttctactaattcctctttttgtgaagaatttagtagtatcatgactaaaaggttcgagatgtctatgatgggcgagttgaccttcttcctcgggctacaagtgaagcaagcacaagagggcactttcatctctcaaaccaagtacgtgaaggacattctcaagaagtttgggatggaagatgccaaacccatcaagactcctatgcctactaatggccacctagacctcgatgataatggtaaatgtgtggaccaaaaggtatatcgctccatgataggatccttgctttacttatgtgcatctcgtcccgatatcatgcttagtgtatgcatgagtgctcgctttcaagcggagcctaaagagtgccatttgattgccgtcaagagaattctaagatatttagttcttactcctaatcttggcttgtgatatcctaagggttgtgactttgagcttttgggctattccgattcggattacgccgggtgtaaggttgatagaaaaagcagaaccgggacttgccaatttcttgggcggtcccttgtttcttggtcctccaagaagcaaaattccattccattatccatcgctaaagctgaatatgtcgccgccggttcttgttgtgctcaactcctttggatgaaacaaaccctaaaagacttcggctacaacttcaccaaaatcccactcctatgtgacaatgagagtgccatcaaaatagccaataatcccgttcaacactctcgaaccaaacacatagatattcgccaccagtttttgagagatcatcagaccaaagaagacatatgccttacacatgtgagaaccgagagccaattagccgacattttcaccaagcctttagatgagaaaagattttgcgagcttaggagtgagctcaatatcttagattctcgcaacattaggtgatgggtggttggctaatttatagtcaaacatgtatcactaaaatgtaaattaaaaaaaaattgagcttttgt

SEQ ID NO: 56845 - DNA, 24256 bp, Oryza sativa
  unsure (1)..(24256): unsure at all n locations
gagttagaaaccctagtctctctcctcatttcttctctctccccgacgccagccctagccaccgctacagtgctcctagtggcgatttcctcttccaaccatgaaaatttgattcttctccatggaatcaaccacattggtggctaggcggatcttcctgtgatcgttctacgatttactatcaaggtagcactttttgattccctctctcggttcattgtgttttttatcccgatctctaaatctgtgaacctagggagaaaaccacttggatagtcttgttcctgctaccttgtagatcaccgatctataggatttgttcacatgcactggctatttttgagacctctgttcttcatttttgccggccggaagttccggtgctcttgcacccggaacctccgggcgctgtccagccagcctgcaattcttgattctctcaaattttgcctaactattgcactccaatttgttgattcctgttgcagtaagcactatgcctcatgagaaaagacagaaagcctctcaggatttgtccggtgatgagagtcctcctattcggtttcctcatggtcgtttgggtaaagagaaagtggttgaaggtggcagtggcagcggcacccgtacttctcctaggtttaccaggcaatccagcaaccgtccagttcagattcgagatattgacagtggtcaaggaagtgatgctccatcttcaagaggtcatgggagaggtggtggtcgcacttctggggctggaagggcctctcatgatttccctgttggatctcgcgagaatcccgttcggctctacaagactcttggatttgacaccactcctttgcaccacattggaagacccaagtccaactaccttcatcagcttgctaagtacagaagggaccgtttgattgatccagagacatagcctgaggagtcacaggatcctcgtttcaggacgttcacccaattggattggtataactcagtgattatggctagagacaatccagtggttgagatgaagtggattgattggacttacatgaggaagaagaacaatgaagtgttcaaccaagcaatgcaagtttgccacaacaagaatcttggagatattcttgccttggagtatgattggaatgaggaggtcattgcacaattctatgcgacagcattctttggtactactaagaagggaactccttatgtaaagtggatgactgagggtgttaggcataagatttccatagcacagtttgctgagatattgggcttagaggatgaggatctcaataggcctaatattcatagtgaagcacccctccccatgatcaagactaagttcatgtatactaaggatgctcctcggacttgtatgggaactactcatggtttgcatccaaactacaaggtgctttactccatctttcgttggtctctgcttccaaaggttggagatgctactgctttgccatccaagcatgctcatcttctcagtcgcatgcgctagnnnnnncctcctttcagtgtgatgaagttgatttggtatgagattgccaacaccattcttgagcataagcgaggttgcatttatgctcctttcattatgaagatgattgagacagtcaccggagtgttctacatctgtttgatggtattttggcgattatatgtgtacacaagacttactcatgatggacaaagcaaacaagcagtttataagttggctagcttatcatttctacgcaatgcttggccatgtatatacacgcaaattcatgcatgcacaggcagctgggatatatatacttggattagtatatgtgcatgtatagttaaccaataactagccgtgtgaagattggctggtgaggcaatcacgtgcatgcatgcatgtactacagtagacggtcgtatgtgtgtgcatgcctgggtgattaagcaacctatgcatatccgagtgattaatcatgggctcggcccatggccgaagacgatagctgcctacgcgcgggtggctggacctctatcccgccaagatttcataagttaatatgtggaagagataaaaccagatgagttaagagataactaacaaaccaattgattttatctctataacaaacttgatcgagttagttacttcgcgcgatcgctggcaaggcgcttatcaccggactgtggcccagcagcagagaaacaaagcgaattacaaataagatatttgacgccaggagaagctaagagataaaatcaaagaaggatatgaacaaataacaaactgatcgatcaagccttatctgcaacgaacttgacgcggaggaaacagcgcgcgaacgcggcgagcaccgacctcaggcccctatataaggcgtcgacccctcggcagccgggggcattcacgaactcatccacacattgatccaccaatgcatccagtatccacaagccacccatcatcaacgcatctgcccatccagcatcaacacatccatccatcaactctcatcggtgatccatccatcgacgacacgcaccggcggcggcgagcgacttcggccggagtcccggcgtccggcaggagagggcgcgcgcggtgatccgatcatcagcaagcgcaggagaggagcttgatggctagtcaaggtaaaagctagcaagattgtttcgttttctttcatctacagcacgcacacatccatgcatagggatccatctgcacgtattgtcatcgccggggaagtcgcggtggccgattcatctatgcgtcacagaagcctcatcgatgccggcgtctgttcgagccgacacagtgctacttgtccctggactcgaacctgctaattcaagccgctggtgatgcatctactcgaagctgcgacctcgccgagatgccggacgtccttgatttgcaagcttcaccgcactggaacgggctaaccatggaggaggtcgtcgggaagccgccctgccggagtgcaccgaggatcgccggagctgccgccgactgccaagatttctatccgttcccatgccggaggtcaagcatcacgcatggcgtcgaaaccagcggatgacgatagaggcaagtatggctgcagtacagaggaaggacgacgggaggacggcgagctagtgctgttggatggcaactaatgcaatgttgattaagttaattattgtggcaacgtggccaaccaatcggaggacgacatgtcatcgctgctacagtgccatgcacaaaccaatgcgtgggctgaagaagtcctattggtttttcttatttgtcccaaatgagatgccgagctttgattaaatccggttgccgtctacatcaaccatcttcaataatttctccctttcctaatctaatctcgacgcaactgctatgacgtcaagtcgttcaagctacgcaacttcatgcatgtcttcactaacaatctacatccacacgttgttcaagaccgacgaggctagacgacagaggacgggcgaagccgatacgaaggccatgctaccaacaccggcgcatggaccgacgaggccgtggatcgctgccggcgctcacacatacacatctacatcatcatcacaaccatgcatggagaacgcgaagcgaagatgacgagacgaccacaagcaacttaatcggaggttctcttgcaggtctagacctacgaaggtaattaactgggagcttttcgaggccccaagaaccaggagaccacatcgcacaagtcagatctgtccaacgatagattgtggagcgcatatacatatatattacattgggaattcgtatttatgatcttttaagattagtaaagagcatgttccttatgttttgtttacattgtgtattttctctctaaacatagagggatacatatattcgtatttttctatcctaaacaacatcaaagatgggtgccacaatccttttcatcctcgtgttccaccttcctcttctccagtggtacctagatccatcccttctacctcagctggtccttcttctagtgccccaccgcaatcctcgagctcttctcccatcaagaaggcacttcaggcgatcttctgtatgtgtgctaagactgcaaagaaagtgaagaagatcgaaaggcgtcagaaggaagatagaagagaggctgggaaagaagtgtcagatgattctgaagatgaggtctatgtggatccttttgaggcttatgaggcagcccgcaacgttgccggtgaaggtccatccacctatttcaatgaagagtcttcccgatcagatgatgatgatgatgaggatgacgccgaggcagctgctgaggatgctcccactaatgttgacaccgctgcacagtccgatgagtctcatctctccagcgataccgaaattgttccctctgatggagatggagatgagtgatcctcttcttctcttcatggtttcttgctttttggtgccttgatgccaaagggggagaaattgtgaattgaagggggtcatttaaatcattttgctgccttaactgctgtctggtcatttggccggaagttccgggtcctgtgatccggaggttccggccaggcagattccctccctattatctctctctatggacatgtaatcgtattcttttatggttggatgtaatgaatgttagatgctttattatcctttatgtcagtaagttagaccatatgaatgttgcattttgatgtgatgtagtgttcttttcatctttttgagtgattgccatgtcatctagtctttcttcttgcgtatcacacatcttttaagcactcacatctgcatcttatttgatgagggtagtgtgaagtttcttttgaggtttccttcatcttatgcatattgtattcatctcatttcattatatgcatatctttagggggagctacatacttctctcatcattccaaatttaaattctattatctttttgtgtgctttaaccatgttgtcatcaatcaccaaaaagggggagattgaagatgcacttaaaccccctagtgggttttggtgattaatgacaaggtggttaaaggggactaacgtgtttgtcaagtttattcacaggagtttagttccaaagcaagttgtgatggctaagaatgcaaggagaccccccaatttgaatgttcctaagtgcgaaaaacatcgaaggtgattagactaggtttttcactttcgaaattgagtgtaggaaaaaccatactattaagaggggtttcaagtgtggttctagggtatacaaagtgctcttagtcatatccatgagtctaaaggtttttggaatcatttttggaaatgattttccctgggacagagaggcctacccggaggttctggccggaacctccggacaccatagtttattttctccccgggacagagagggctacccggaggttctggccagaacttccgggcaccgaagtttagctagatttttcctaagtattgcccagaagttcctggcacttttgcccggaacctcctggcaggtttctagttcaaacttgtgagtaacggctagatgacgtcacctagccgttatatatatggatttcgtccccagatcaccctttggccattccacttcagctctttcatgttctagggttttctagccactccccagcttcctttgcttcctccactcaaatctagagcctatcttgtgagattgagagattagattagagtttaggagtgttttggagatggcttgaaaattaggtttgattgagcactttggatatcttgtgggctgtcacttgggcttattactcttggagatcttctcctagacggttaggtgtcgcccgtgagcttcaaaagatcttgtggatgtcccgggaaagtttgtgaaggttttcctcacctccgcaaggaaatgaggtaagtgagtaaagattcttgtgctgagttttcagaggttgtcctaggtagagcaacttgcacttgtggtcttttctagaaggaattgtgagttggatcttggtggtcactcaattctagaaaatgacctagaagtgttgagttgaaggctgtggactccttctgggatctttgcataagtgaggcaaggggttaatcgagacccggctctttgagcacctcaacggagagtaggatccgtgtgatccgaacttcgggaaaaaaatcgcctttgtctctcttgtgcatgatctgtgtttgaatctactggtatcttgagatctacatcttgtgcaactctgtgcctgatcatctctagctaggacctgttttacttcccctaatttcgcttttctctgttgcctggaagttcctggctcaagaactccagaagttccgggctactcatcctacccggaagttccggtgttcatcaccaggaggttccgggccctgtcaatttaaccgctgcaattgttgagaaaatttcaagaaagcctattcactcccccccctctaggctacatctctgcacattcaattatatgtacttagtctagttttcctttaaccagaaacataatatctgaaatcagcagccaataattgtgtcgcttgaattttcgcacacatcaccaccggcgataggcgtcgaaccaaaacagaatataatgttgaacagtaattgagctgtatatcagtaattcgcacagatcttgccaccgccatagccattgaagacaatttgacggagacatagatagatagatgagaaaatatctcgtcaaaacgatcaaataagtgaatctgtaaaaagaatagacataaaagttttctgaatacatgaaaaaatctcgagataagaaggaatgaactacattttaccaaaaaatattaagtccaaacttattttcatctggttgaaagaaaaaaattcacatgaatatggttatgattttgatgccacaaacattgcagtacatcggaaattaaaaacaaagattaattttgtagactgtatcatgcttaaccatgtcttatacagtaggacagatggtgtagttatatcgtaggcaccagttcgcctcgtacccctttaaattgtaaatggatcggaataattcttattcatggacggattctagagagagcaaatgatccatatattctgatagctgcaatgtatgagaacaacaaaaaacaatgctccaagaactgcaccgtttttaaatattgaacttacgtaagacatatttggtatgctctctccactcctaacatgtgaatcggaaaatttgtgtgaaagcacatcgacaaaagcatgagagcccagcatgagaaagatgatccgatggtcatttgcaaatataaatggcaccaatgtatatggttaaccattattgcttctctatatctaaattcaagacatgggaggaaaccaaaagtatttcattaaagttagtgtttcagctttagctatgatataatcatttccatgttatttgttttttcttagttttaacacttaccaacttaattgtctactactaaagattgtcgagcacatctagctggagtggagaataggaatgttaaacggataaaaaacttaacccaaagagttttgcttaataatatgtattggctaattggggctggtgtagtaggccaatatgagatctatgcatacagaagttatagtgggaaatgtgaagctataaaacactgtacacaggtgagtatcaaacacgtagttgataagttcgatcattgaactaattaagcacatgacattgctaattatgctttaatttgtttcaattcaaaaaatttaattttgctatagatagtcaaatattaaattgcatagatggaaaggaaccgctagttttcatgttaattagattagccaacgtccgtaaacatcagcacaatatgtgacaatgaaatattaaatgtcatcattcattcattgtttctcatagcaagtttaatagtatagccaactactaacttcaaatcatctatagtcaacttaatagccaattcatataatagttagttacaacactattaatatctgatcccacctgtcatacatatattgcattttggagctgcaactgactacaaatctatagtatgttgttcttctttatcatcttttatctccttaaaatatatttatagctaacttatagtctgttattctacctgctctcgtacgtccttgtctgactcgtataaacctcatttgtaagtcctcactataaggctacaggacggggtaagtctgatgcatagatggatccacatgcctaagatgtgtgaatgtgtttggacttcgaagccgacgtgtgcttgacatgggggctcgggacagatcagagaaccaaatggtgtcattctgaagctgtttggatgattgtggtctcattgacctcggcttcacgggggccaagttcacttggtgcaacaaacaagatgcccaaagcaatgtcaaggtccgtcttgaccgtgcggtggcgaacggtgagttctcacatctttttgatgactattgtgtggagaatgtgaataccactacctccgatcaatatgcactcttaatattgctttcaggaagggccaatagaggtacgggagccccgatacagcagagctttcgctttgaggctgcgtggctccgtgcggaggactataggggtttcgtggagaatgcttggcctgagggaaggatcgattctccccctcttcaggcagcatggtctaatctccaacggatggccgactctctccggagatggagtaaattgtcggcaatgtccgtaagaacattcaaaaactggaaagaaggttaagttcgctgcacaccttacatcccaatgataactctgtcgaggaagagaaattgattgagaaacagctttgtgaactctttgaaagagaagaagtcattgaaagagaagaagtcatggcaaggcagcggtctcgagtggatgggctgaaagagggtgaccacaataccgctttctttcatgcccgagcatcggcaaggcaaagaacgaacaaaataagaatgctcaccagagaagatgggtccctatgcgaagatttggaaggaatgaaagggatggcggaacgtttctatgctgatctctttgcttctgagtgctgcgattcgatggaggaagtgttggagtccataccacgcaaagtggatgatttcattaatgaggagttgtgcaaaccttactccaattctgagattaaaatggctctcttccagatgggaccaacaaaagctccgggccctgatggcttcccagccctcttctaccaaacacattgggagtttattgaggaggagatttgcagtgcggttcgtagcttccttgctagggatttgattccggagggcttatgtgattcggtcattgttctcatccccaaggtcaacaatgcaactcacctctcaaagtttcgtcccataagcttgtgcaatgtcctttacaaaattgcttcaaaggttctgtcgaatcgtctaaagcctttcctgccaggagtggtttctgagttccaaagtgcttttgtaccgggacgactgataacagatagcgccctagtgtcatatgagtgccttcactccattaagaagcaacagtgcaagaagcctttctttgctctaaaggtggatatgatgaaagcctatgatcgtgttgaatggtctttcctgcatggatgtcttttgaagctgggcttcgctgatccttggattcaaactgtcatgcgatgtgtcacctctgtaaggtatgcagttaggatcaatggagagctaacgtatccggttactccgtcgaggggtttgagacaaggggatccaatcagcccttatctctttctgctctgcactgaagggctgtccagcatccttcaaaagaaggaatcaatgggggtgattcagggcattaggaacggtcatcttggcccaccaatctcacacctgctctttgcagacgacagcatcttctttgctaggagcgatctgcacagtgttcaagggctgaaagatgctctccaagcatactgcaaggcctcgggacagaaaattaatcttcagaaatcttccatcttctttggtcagaactgtcctgaggaaataaagaactcggtgaaggagacactccaggtttcggttgagatcctccaagacacgtatctaggcatgccaactgaaattggaagagcgtccattggctcttttcttttcctcccggaaagagtgtggagaagagtgaatggttggaacgataggccgatgtccagggctgggaaggagacgatgctcaaagctgttgcgcaggcgattcccacctatgttatgagctgcttcaagctgcctgtgacaacttgtgagaaaatgaaatcatgcatccttgaccattggtggggcttcgaggacgggaagaagaaaatgcattggcgttcctaggagtggatgacgacgccgaaatctctggggggggggggttgggtttcagagacctgggccttttcaaccaagctatgcttgctagacagggttggagaatcgtgactgatcctgattcgctctgtgctagggttctcaaaggaaggtacttcccgaactctgatttctggaatgctcccaaacccactgccgcttccttcacctggcgtagtattctctttggaagggatttgcttaggaaaggtgtgaggtggggcattgggaatggctcttcggtaaaaatcctcaaggatcattggataccgggaatcaaaccttcgatggtgagacctctcctccctatgcctgatgatgtcacggtggacttcttagtcaatgctgcgattggggagtgggatgaggataaggtgttctctttctttgatgaaactactgctcaacagatcctacaaatccctgttagtgcacatggaggagaggatttcatttcctggccacacgacaaaagaggggttttctcggtgcgttcagcttacaaccttgcaagatcagaaatctttatggctgcgcaaagtgaaaatggcaggggaatgttgtcgggtttacaagagagtgcaaacagatggaaggaactttggagaatcaatgccccagggaaaatgttaaccaatctttggagaattgtgcatgactgcttgccttcaggtttccagctgagaaggcggcatatcccagctactgatggctgttgcttctgtgaaagggatgacagaatcgagcacatttttctcctctgcccttttgctgtatgtatttgggatagcatcaagcaacattttgatttgaagctatgcatgactgatctgtcaaatatgaagcagtgggtttttgatttcctggggagaagttcaaacatccaaaagacggcgctggctgtcacgttgtggcatatatgggaggctagaaatcattccaggaataatcctaccttagctaatccaagacaggtcatccagaaaatcttggcttatgtcgagatgattgaacaacactgttgctgtgctgtgcaggcggttaggggtgatgctcttcgtccagttcccagatggaggcctccgcctgaaggtacgattcttattaatacagatgctgctgtcttccagtcagtcaattcttttgggttgggatttctatttcgggatcacagcgggctgtgcttgttcgctgctaatgagcgacactcggggtgtatccaacctgaaatggcagaagctttggctatccgctgtgcgttgcgcacggcgatggaggagggtcaccagaaaattgttttggcttcagattgcctagctatcatccaaaagattcagtctggagcacgtgaccgttcaatggttggcgctcttgtctctgacataaacttcctggcggctggttttttggattgctctttcattcatgttaatcgtgtaactaatgctgcggctcaccttttagctcaatgttctgagcaaacagtttgtaatacctaccgttctgtaatcccagagactcttcgggaggtactgctgtctgatcttaattaatctatgagaagctgcattatctcaaaaaaaaaaccttttgattttggcccaacgcaacacgttttccaaaagtgacaaccatgatcactacaacgcttcagattcattcacagatagtatgccaacacatggatggagactgccgctagaaagcatcgctatattggcggaaggaactacggatcggttcctgatccatgacaataaaaacagggcggtcaactatttcagttgactgcccacgaaacatcaaagttgaaaagaaaaaacatcaggtaacggaaacatcaacttagtacaacggaacaaagctagatatttttacaacgggaagaaaaaaatgatttcctttacaacggagtatacaaacaataacaacgaaaagaacagaacaagtaaaagatattactacgaacacagccatcgaaatccttatttctgcaacactgaaacattgttactgcggttattgcaacatcaaaatcgaattagtgcaacatgaaaaataatcgattacaacattgtgaagcaaattgcttctgtaggttaggactgtcattataaacaatccaatcatcccaggaagaaacacaaatccaagaaaaagcaatggccacgctgggcaccaccaacaactccacttctcaccgttggtcatagactcatagggcgcttagagctcgccgcgctgcacgagcagtatcaccacccggatgtgatgcagtcacggccggcagaaacaactggtacaaaggatgcggatatggcactgtggccggcgatgcccaccaccaccaactcctgcagacgctatgcaacaccactgcagctacgcgttcgccgccgctgcagccacgcatcgcctccgccgccgcatctcaacatttattttgcatgtctgtatggcaacagctaataaaatgcagaaatcatctctctcgtttaactagcaaaatgaagcactagcgacgaattgcccccacacgcatcttctcctccgttttctattccgtgctgagaatcaaggcatggatgcatgataggatggcggaaaatggatgggtgcaactactcgactgtgtttctcccttataaataatagagtaatagagtattatccatgacaaacatttcatattatctatgatagagtaatagagtattatccatgataaccatgcatattatctatgatagagtaatagagtaagaagttgccttcgtgcagagccatgttgctctttttttagattagttaatattttttctcaattgtagccaatattttattacgaataattccgctagaaattttggttctttcttatttttcttattacctattacaatatacccatgaaaagtgccttctccaacatttattgcccaagcggagagcggacggctttcgtggaaccatggagggagtctcaatcgatcttttctaagattccaactcacatcacgcgtgaagattaacattgatatgatttatatccttagttttgtgttccgtatgttctgtgttcgctgaggtcaagtgtgctgtgaaatttagcgagaggttcgtgccgtgatgggccctagctggtttgccacttttgcaatgctcctcggagaagagaccagatggtgataggccagttaggcctgaccagcacaactgggtataaaaacatggaataaggtcactttcgatctctcaatttgtcatttagtctgaaattcatccatgaaccaaaatactagatatagctaattgcccaactcacaataccatgttaaatttggtccctcggtagtatagtcatcggtttttgctgacgtggcgagtgggaccactactatgaaatatcaaataggtatcagcactataggtgccggaagtgctaaaaccgatatctataaaccttttcccactaccgcgggttgaaatcgcaaaaaacatgcacctttaaacaattataggtgccggttctaaataagaaccaacacatattctataggtgccgaaaaaccgacacccatagaaatcgagccgagccggcaggccccaccacaacgagtagataaggtgggtctcgcatctctctctcgtctcctcccttctctctcgctctcttctcctcctctccaactcccagtctcccacctctctctctctgaggaagcggcgggctagccgcggggaggcatctaccggcagcgggctcgcggaggggatgcgacggaggactcgctggcgggaggcggtgttctagccatggggaggagccctcctctccgccatatctggtgggaggggaggcggcggcaggggcagcgggctcactgggggtaggtggcgtcaggcgcgcgggctcgatgaggggaggcagcggagggctcaccggcgagagacggtgatcttccgcggggaggagccctcccctccgccagatctggcgggaggggaggcagcggcaggggcggcgggctcgccgggggtaggtggcggcaggcagtgggcttgcggaggagacgcggcgatgggctcgccggaaggaggcggcgggcccgcggaggagacacggcggtgggctcgccggtgggaggtggcaggctcaccggtgggagtcagcgggctcgtcgacgggaggtggcgcgacggctcgaagacgaccgaccgtgcgacggcaacgatggcggatcttaagaggtgtgattcttttttttattgcataaatttgagtgccaaaatttgtgttgtggatgaatgttggatgaatgttgtgtctctagatggacgaccgtacatttccatgaattcatcttctagctatcatttgccatgcttgtattagtgcatctttaagggtacgtacgtattaatctttatcaagtacgtcccctgtcttcttcttctggatattttattttctttgcacgttgggtaatctcgtcatttggaataaaatatcacctcttttgatccggaaattataaaatattgtcttcggtgtcctacagttaattacataatttttagagtgtccatcagccgtgtcatgtttttgcgttgtctctcagccaattacacattttttttagtgtcttgtagtaaattttgcatttcggtttagggatgaatttcaaactcagcgataaatagaaggatctaaagtgaacttttccttaaaacggaccttgtagaaccggaagttttgtatcctgcttgctcggcccatctacagatggaatacggccgtagcccgttagaggtaagaatttttttcgtttttagatttttttttaatatttatagaaataatctatcgaccaaaaaaattgcagaaatagcccctgccgccctaatggtgggcggcaagctgacgtggcagacggtgggtcgaccgcgccatctgccgccgtcggccaaaattgcgattaggcccttgccgcccatacagagggcggcaaggggctaattgcaattttggccgcccataaagagcttgcggccgtactttttcatctgggtctcttgccgccccaatagagggcggcaagggacccagatgaaaaaagtacggctaaaagatttttctatgttatgttaataataaataaagaagtatttattggtaaaacttgttaatattgttataaaaacgtattgaagttggttgttgctcaatttcatatgttaagtgaggtattattttgtaccttattcgacgtattagtactcggataatttatataggcctatcgcagtctgggtcgtagaaacattatatagacttaaacaaggagaattatgtaacatgaagaaatagtagtacaatttgaacatgatacgactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaatcaaaatattcttaacatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtattacgaagaataaagcgattgcccatacggaatgaataagcatatgcagataataaaatacctcacggtcatagttagggcacctaaaacagcgccttcctcgaatatcaggattcctcgaagccattagttggcatcgatcaccgcataggcagagaggacgctggcaccaaggtggtagtaggtatacacaaggatcgctacgccagtttggatcctcaacaccccggcgtctagccattgacgaaagcccgtcggatttgtaatgaagcaagtggggaagagagtactgaatgtgactgagttctgaaagattgtgaggcctcactcgttaaggcgacttatataggtgcaaaaaatcaagtgatacccctgacatgtgaacgtggtggggtatggtgggtacgcctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcacatataacaacaacgtagtcattacacaagcatacaatactggaaagtgaagcaagtaaacaaagagaagactgctctactggccctgccccgcgccgcgaccacgcttggtcctccgggcctgtgctcgcacgtggtcctgggagtaggtgaaacgatccggtagcacagcacgggtagcacgagtgtcccgcggaggagtggcctgcgcctggtcctgtgtctgcaccggcggtgcgcctcccagctgtgaggggccaatgacgtcctctgtcgagcctgaagcgaagtcgaagtcagtgatgtcgaagagcaaggtggaaggcagcaagcggtccgacgaggtcccagcatggtccagtggtggaccctgactcgacgtgccggctgcttgtgacgaagtcccggtgtactgccagaactgcgctgagtgcgaggttgacacagctgcctgagacgctgaccctgcagcctaggagaagtgggcggcctgcgtcatagcgaaccgtcctacacatcgacaacaggacccttgtaagctaagacataaaatgtatgtaaattgattgtcgaagtaatgttgtttttttaagtacctgtggggggcacaacagaaggcctagctgagaaaggcggggtgctgaacggtgcacgaaaccctgaagcaatcggcaagtgaaacggctcacttatatgtgcgaggcatgtacagaaatagtaataaaaatacttacctccgtgcggagggggagtcagcctaggaacgtgcgcagctggacggggaccagtcggtacgggtggccgctgtacagctgcatgtgcccgagcaacgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgatgacccggttgatgtcgtcgacctacatagttaatttgttcgtaaatattcgtaaaatttgacgaagagaaagacatgaaaacataaaggaatggtgcgatgcagggtactcacagcacgagcgaagtcctggtcgtggtgcctggcatagaggtctctagtgctcgcaacgtggggctgctgctccaagggagcgaaggtgaccctactacgggtgcgtggctggtaccagcgtaggtaggcctggtacgactcctcagtgtgtggctctccctcgtggtccacgacctcctcggttgtgagcaaccagtactcaacaaaagtcgccaacttggcgggccaggcgggccagtcgccagctgagtgctgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgacggaagccgaactgccgcatcacacggaaaggggcgtgaggctcaacgcagatgtcgaagaccatcggaaccgtagtcatccagtacgcctggtccctggtgcagagtgtggacagacccaacggcgcacgagcctgggtagccgctgcactgtagggctcccacacgacgtcagtcggcagaaggcggtcgaactccataacaaactcaggatacgactgcctaacctggacgtgagcccatcggcgctgcaatatgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtctacctcagggcggccgatcgcaatcctctcagctgcccagataaaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcagcgatgctcctggcgtagtgcacgagtcccttgtcgacggcgtgcccgtgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgctaacggctcgagcgggaggtgcggtgcgcgctgtactagtgcgaaacgtgccatcagattgtcctgccagtccacagccgtggtcactggcccaacagcgtctctcgcgagcggtagccccaacaagtacgatacgtcctgtagggtaggggctacctcaccgcacggcaagtgaaaagtgtgcgtctctggcctccatcgatcgaccaaagctgctaggagggacctgtccacagtccatcgtctggccgggtccgcgtcgccggccgcagcctccaccagccgacacatcggtacgaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtaccatctctgaaaaatatagtgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagatcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagtctccgactcgtccatatcattgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttggttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactacagctcgatgtttcatggcctttttacgcaactcctctagctttttctgcatgaaagctccaaacaaaatgctgttgttcggcatagagggaagaactgcctggaaccgatccgtaaaatacctgcatgtcccatgtaaaatgaactccactatgccaactagtggcagtccacggacaccgcgcatcacccagttgtaaacttctgtcaaatttgttgtcatattccatatctagcaccacctatgtcatacgccttgccccatttctcttttggttcatgcagaatccactgagaaaatttccgaatctccaatccagtttttctaaccaatgttggactatccgttgggagaggtccaagagcttgaggaggctcagcaacggcggtcgatggagccgctgcacgctgatcactgcatttggctgtcaactcatctaatctcttccaaagctcattgaattttttctcctggttttgattgcacagcctcttgaacatgttcatgagctctttgttcttgaattgcttgaagaaattagctcccatatgacgcatgcaccacctactctgtacatcttcccaaacaccggggtatactcgttccatactcccaaactgcaactcttctatcgctcgcagaatgccagcgtgcctatcatgtatcaggcacacatttggcctcataccaacaacttttgttttaaccaatttcaggagccagtaccagctgtcggtattctcactctcaacagaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgctaggatgttcaattgaggggaatttcttcacttcgtaagagctcccagggtttctttcctcgataacaccaagcaggcgtggcaaattgtcatacgaggcttcgtaagttcaaaatctcatctctattattttctgtttggccctccagaccttggcatagctaatagtatacttgtatgtctcttcgatgtgtcggattattgaccttggttcatatgtgagattatcgatgacatgcacatacatctcagatgcaacaaatgcacaagtaatgttcctgtggtatttctgaacaccaggtagaaaacatgtatgcttggtaacgactgacactgtccaataatccttccatttccccttatacgcgtacactctctagggacaaccatctttttccttaacacaccgaacttcatattgcgaccagttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgccaactggagctactagcccccgtcctctcgtgcgttgaccttctccacataagtctcgtttacttcagcacttggtccctcgccatcatccatgttcatctacacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagccctttattaaccatccttttatagaaggtacactcctctcagccggtctatcaattcccctttctgatacaataaaatctgacagatctaccccagttggcccgtaacggacgtttcctggtccatggtaaacttggaatacttgtttgttcgacatatctgtcaacgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaacactaaaaatataatgcatttattcaaacaaatttttaaagaatacacgctatttaacttaatagtcacatatatgatctatgaatattacctgaaattggcgtctgaatccggcagggcttcgccccttcttctcttctcctcccctctcttcttttttttttcactggaattgaggagagaagaatgagggctgggggctgggcagcaggccttttataggcagcgaggcctgccgcccggccagagggcggcaaggggccgcctgcaaaataaccggccccgactggcttttttgcattcgggccccttgccgccccaccagagggcggcaagggttttcctgcaaaaaaaccctccctctgtcaccgcccgttcctcccccgtttgccacgtcatcttgccgccccagaggtgggcggcagggtctatttttataatttttttggccgatagattatttctgtaaatatttttttaaaaaaatctaaaaccgaaaaaaattcttagaggtaatgccgctacgcaaagaaagcgaacagaattgcgagcaactgagacttcagtttttcttctcactagcacatgattatcggatgatatgcatgttactcgatactgctagcatgcatacatacatacatacatacatacatacatacatacatacatatatatatatatatatatatatatatatatatatatatatatatatatatatatatatatatatatatatatatatggcaacatatcctatgcacacaggccctcacgtgtatacacgtgcacaccaactaaaaaatattaccaaaaaatatagaaaaaaccatacacatactttcaattgtattacacctagggttaaaatct

SEQ ID NO: 56846 - DNA, 1882 bp, Oryza sativa
gatctagacatgaaatttgtttgacatgtgaggatgtcagcctacttttgggaatcccttgtggacggaaggagattttgcctgcaataaaaaatgaggtaaaagatgttaaggcttatatgtgtgaaatctttgagaaagattcctttgatggacttaccattgtaacaattcagaggatattggagaaaaaatttaacaggacgatgactgttcacgaacagattgtattcaagactgcttttataatcttcgttgtaaccaaattcttggctcctcaatctgttaacaatcacatatctataaggtatatgaaggctttggttgatgtagaaaatattcacaagtacaactgggcggaatttgttttgcatgacatcaaagatgcagcagcagcattgcaacacaaaatacgccatcgaaaaagcattggttacatcaatggctgcattatactacctcaggtgagattatcctattattcgttcgaattatttgccttttactttctaatatactcgcaacatcttttcacatgctataatttatactgctcagcttttttatctggacaatctggatttcgggacggacactcccgagcaggaaaacattccaaggattggcgtgtacaatgactccatgatagcagaattcattgagagggatgtaattctcaagaaccggaatcctttccccgcgtatggaaagatgaaggtaaaatcaactctcctgccggtagagtattcttgttgaaatttcccttgtgcagaaacttcagactattgacattttttttgggtttcagctgcgaaacaaacatgatgaaaaatacaatcttggccatcatacgggtgcaatagaggtgcaatctcatgtagtttgtcaatctattcaatataaaaagaatccatttttccataagaattgttgatatatctgtacacaggctatccatgtggatcgtacctacgatgccaggtctgacatcgagcccccaagctttaatctaggaataacacaagatatcgaagaagcaaacatggtggcatgtaccccaggtcatgacatctccaatgtggctgaagactctgacaaagaacaagaactcaactttttagcacgtaccccagatcagccaatctcaaagtcagtagatgcctctgacaaatccggagaaggtaatgcagtgcacaaaactccctcttcgcatggaggtaatgatacccacaagcctgtatcagtttttcattttcattcataaccaaccacatgcacataatatgtctcactcttactgttctgtctcataataggttaccaacaaactaaacttagtagtttctctccgtactctatgttgaaagagacgagtggggcgaggattttcatgcgtgaggagtacgcatgtacaaagctcccacctaaatccaagaggagaattatcggcggtccttctgatatcctattcgatcggccaaagaggtcgattaaaccaagccattcggtgaaatcaccatttctgagcaagcaacactctttcgtcaggcatgaccagaaggcacttgatgatttatacacatatgcaatttcaatcactgatgcagaagctcttaagtaagccacctatctgaaacacttgatgatttatacacatatacaacttcaatcgcttatgcagaagctctaatgtaagccacctacctgaaatgttcctttctttcaccactaattgtaaagatatcacatttaacaggaaaatctgggttcacatctcccaacctgtccctatgtcattaagcctacatgacatacaacaggctattcggctagacactcaaatgcaagaagaaacattcaatgttgcaggggctgcaggaat

SEQ ID NO: 56847 - DNA, 791 bp, Oryza sativa
tgcatttccaaattgggacgaggatataccaaactgggtttctgagttcccttcggccatcccagctataaacaataggttccagttcatgctcccaatttgatccaaattaatttttccattcaactcatttatggtcattacaataataacaattttggtaggctggaatgtgcctttcacgtgctctactacatgcggaactgggatggaactcgccttgtgaaccccccaaaatctgtgagttttatgtacacactaggttcaacttaagtttcattgaagtagcttccttttataataaatatttttctatattaacaacaggatcaacgagatcttcgaaaggaatttctgtccaacttattgtcattcaaaggcaacgaagctattctgccggacttcgtcgttcactgcctgaagttatctaacaagatctgagcatgttatgcaagcatgccaaaataaagattacattcagttacatcattattatctaaaatttgttaggtcccaataatatttgtcttgttcttattcaacatttttcaaggcttcatgttctctgctattctcttcccaaattaatgaatttgtcatttaccttccaaatatcataaatttagatgttcccaacatcaaatccatgatgttcacctatggcaaattaaatactacaaactaattacatcttctgttgccgtacattacgtgatcagctctcctccacccttagagagcagatcatgacacgatccaaatcagtgcatgcccggcgaaaaaaagacaag

SEQ ID NO: 56848 - DNA, 5080 bp, Oryza sativa
  unsure (1)..(5080): unsure at all n locations
nnnnnnnnnnnnnnnnnnnnnnnnnnnnnnnnnnnnnnnnnagccacatcgagcaattcttgtagtaatcctgcagaaagagtatacaaggaatccaagaaacctgcaagcatctatctagccatggccgccgcgagagcgggcaacgccgtccggttaaccttcgccgaggaggcggcgccgccggtggcagctacttcgccgggccgccgctcgctgcctcgaccccattgccggggagaccgacggcgacgacgacgtcccttgcagccggtccaactgcgtctcctgcagctgggttatcgtctgaggacagttcagttttctcgggcgtttcttgatatgttcttttcaggtttaatcagcgagttttatgggagtttgatgagtagaaaaaagagggggcttaattagcgtgttctatggctggattaactaatcctcgatccaaattcttcatctaccaactcttctaaatcaatcataatttttctctattgaattccacatactttcttaaccatgtccaagagttttaggagatattagcaaataactagcttttatctcccctgttgctactcgaatttgaagtaagctttaattaacttatcggttttgagcgaatcagcgagtcgtactactctggtagatagataatcttctagtacctatgtaatgcgaactgttaagttataaatctttccctttttttgagaaagagaggatcacctctcccatttcaatacagaaatgagaataatactgtcagttattacaataccaaaaggaagaaccttctaccgtgatgcagcaaacaaccttctacatcatacatccaatctaacggtaagcaactatcagcggattccatacaacatcaagagacaaaaaaggcaagttaaatctacatgaatacatcaaatcaagtgggaattaattcttttgtttatgccatttcacattggattctaataagtacaattacttcagcacatgctacaagattgggtatacttaattacattaaggaacccagttaagacaacaaaaaaaaaaggacaaactggaagcatttcatctattaattataagttctacaatgatatacataaattcagctttccgtacagtggtttggctatatgaagactactaaaagaagctacgttcacaaagaaccaaatctgcacaaggtattcagctgccaacaatgtccatggcaagtcaacatctctgaaatctaactagtagctggccttattcagttctctgtggtatgtcttccaacctaatagaactgggacctatttttaggtgccaaaaatactccagaatgtccaaggtaccacagcaagcggtacattgaacaaaccaaataaataaaacaacaaaaatcgattacaattgcgacaaacatcatacctagcgacgtgggtacagatcccaacctaagtctggctcttttcgcttcaatactggcaccccagagctgccaccctgtgacatgttacccatgcgctcgtccacaaacatggtctgaccttggaaagacacaggccaatagcttgcaccttccctacgtgcaccttcatatgaccttccatagttgagatccatgctgggatgaaaatagctcaattcactagagggtgggattgctctgctgccgagagatggatgagatgtgcccactcctaagtttggcaccgttggtacaccgaaacctggcaatggaggtataactggcgtgccctttgcatcaaccatataaggaacagtccctggtgcatagaaaggtgacgggaaagacaaagcagaatgagacgaatagctgacaacactataatcagggggtgtatgcccgtaagattgcatagaccttgcaggatctcttgattccacacttggcccaagaaagttatgctcattttgatggctatgttccttctgtccaagaactattctcttgcccagaattgtcactgcagaatggtctgacacatccctcccagaagtcttgacagaggactcatctgcacctcgtaaaaagccatccacgattggtgtgttgtcattcaagtcaaagttccttactgcaggttgccttgaagatgaagaggaagaagggtgactccaatcgccattacattgttgtcgattccaaaatgatggtacattacttgtggtgattgcagcttcctcatcgtcacatggacaattaaggtcaagttcaaggctattcaggccaacagttgcagaggcatcctttcgcactatgtcagaagaaagcggaaggatggctgctgaaagtggttcaccagcagtagcattgtcactttcagaaacattcaagtcaaacagagcattgcctgttctctgtgaagaggcagatactgatttctctccatcgggagtacaccgaggagaagccggtcgaaaagcactggtggctgcagaacctttccatcccagttcaccttcaaagtgcaatcgagctgggaatacagatgaggttcttgaggcagccacagctataggtgttgataaattaattgaattactaagcgtggacttcgtatgacaatcaacttcctcagtgcactggttttcattaagatcaatgcctcccagcttcatgcttcgcgtatgttttctactgaaagtaccactgtcatccgtgatgcctgaaccatcctccttcatagatgaggaacttcctgaatcctcccctgtagtggaggatttattatcattatccggttcatccatgggcggttcaggctgccggcgtgcttctaagtcgggactatcagaccgtctggaattaatatcaggggaaccacaaaatggtcccctgtagtcaatgacttcccgctctacctcaatagcaaccagacgagctacttccagtgcatcagtatcatcatactcagctaatggtgttgatgtatctcccttttctgctttcgatttcttgtctgctgcctttgaggaatccccaaagctcgtcatgcatctcttcaacctcaattcattgacagcgccctttacatctgtatcagatgatgatgtaggcccctcctctttccttgtactttcatcatctgatgaatcttgcatgtcaaggggggctaggtcccagcctcccactgtattcttctcagagtgtggcatatcttccaaaaaggattcacctttcttgatatccacgctaatagaaacattttggtcctgcacatccattttgttactaacaaatggatttcggattattagtcccagaagacttggcctctgcagttccatctggcagtgagacttgtgcagcaccactttttgcatcattgttagcagaagactcctccgtcacaggtacattttctaaaccattacgacatgcaagtgatggtactgaggggttcccatcaccaataatggcatttccatcggagtttgggggtatcatcaccagcgactgcttcactatatcacagttatcattggtctgggagtgattaggcaaaggaacactcgagcagaccatcacctcagacttcgacttatctcctgcaattgcagcttcatttgccccaccagactcaggtttaggttctgggagtttgagttgatctgggttccgctcttttgctaccatgtcatggacatcagaagtgcatttcggtacacttctccatttatgacaaagcactcctgcctttttgttgatatcagtattgctatgagaaagtagatgctcaacagtatgcagaacaccacaagaagtaatttgtgcattttcaactggaagacactccagtgcagacaatactgcaactattaggtcttctgctgcattgctgatatcctcaccacagttctgagcatcctgaagccattgatggaggaaaccgacaccatttagctgaacaaaatgctgaagacactcttcatttttggtggacgctagagtgtttgcagccgttgcacactgccttatcaagtcagcggtgttaagttcagcagcacttttgagcttcttgatctcagataccagttctccaattcgtgctacagttgaaatgccatccttcatctcagtaagagtaaagaaatcctcaagcatcgtgcttcttgcactaagtcactatacggctgcttgagtgctaaactgagtgttatctggtttgatggttatataacatcctgaaatatggaaagcagcttggccattaaaaagtattttggatcaacttaccacaattcaaataacagtatgaatcatggtgaagaaaacagctaaaaaagataatatcgaaagtgtatctaggcaaaagaagaaaaaagaatatatgagcagaagtgcaagcagcagcaccctttatctctaggaataattgcatgtgcataacccaataaggcattagttttagttaattgcataggatataatgaatggcttagatccttatttggtcaagacaatacaagtattgactttgagtgtgtccgtatatgccactgacaaaaagatgcctaacatttcttaatttacagaactacgtccactgctcagagctcagtaattctttatcagcaaattctaaagagtcatctaatcggtgcgttctacaggcggagtaagaagtgcaaattatgccacaattacacatgaatcacacataaatctaagtgtagtgtactagtgcagtaagccactaataaggaagaaacacgcatccaccagaatcaaccgcaatttccccgcttataacgaatagcgcatccaatcagtaaatcatacacacaggagtaaatcgtacacatcggcaagtgaactgcaaaaggaataagcacagatcaacacaaatcccataggcacacgcgcgcgcaccgtctcgaaaccagcacgaaatgcgcatccgcaaaattcgcccccaaatcacacaccacccccgaaggcctaaaccctataatccatcgtggaggggaaaggtgcgtacgaaaaaggggaaactcaccgtctacgccacaagtctccaccacccgacggggcatgggactccgcggggatgagccc

SEQ ID NO: 56849 - DNA, 957 bp, Oryza sativa
tttgctgatcaccaaaacctgagaatagatctgagagaatagtaggagtgcacctggtgtaaattttttcttgtactacctttttacccttgatgccacttatttttttggaatttgatactgcagaaccaggtagctgcttccgctgatgcatctttcttgcttgagcagcatgaagggctctagtgaaaacagaactagagccaccaccacctgaaacattcgcacctgctgcaggactgcaaaggtgctgcaaatgcaaaaacataaacaaaacaaattagtaagagatacgatcaaaaaaagactcaaagattaggaaaaaaaatccatcaatggctgccgcgagcttcgacggcgccggcgttggggcgctcctctccggcagcctgcagcctgacactgctataccgtaccaatgtcgggttggtgctgttcatcgtcgccatggccggcaccacattcactgcaaaataacagatgaatatggcaacaaaccttggaactagagttctccatgctagacctttcaacgttatctgcaacgcagccgccggcgaggctactaatctgagtttagatgggttaagaactctcaaaacgcaaagaacggttttagatcgataatgttctgctcaacgggataatcatcctgctttctcgctttggataagcaaactgaagagcgaaaaaaccaccctgaaatatatctggtcagctgtctccgaacaaaattctatctacaacaaactcaggaatcttgattcaattttcgaatctgctacagaacagaaacaatcttgttgaccccaagggaaaaaaaatacgggtaaaagaaaacgggtaaaagtattcgattcaataaacctgttaatagtcattaccattatctgggcaaacgaattgaattggtggcggacagggagggagtagctactcccggtagtagtatataat

SEQ ID NO: 56850 - DNA, 1288 bp, Oryza sativa
ttacacttgagaaagcaccatgagaatatgcaagtccctccagcctgattggaaattaacatcacaagaaccaacaatgttctgaatcttgaagtcctggtatagtgcaaatgagttaaacatttaggtacaatcttacagaatgaaaatggtaggcatttgcacagatgaaaattaatcaagcctgaaatagttaccttaaacttagcagcaaagccaagcttttggataatacgagcatactggcaataaaaaagtgttagacttcacgtagcaaaataaaatgaaataaaataaatactccccatacctttcttgctgcaagctttgattgttgttcgctctttgccccagtacatacctggtaaaggacaacaaaagatttataaacatgcttttaattccaccacaaatgctagcaggtcatggtgcccacagagaaattttggttaacaagcaaatttgatttttataaaaaagaagcaaagacgcagcaaatcggtgcatcaaacccaagacaaccccttcttaagtccactgcctaatagtcaggccccatacagcgtactagtaagcctaggctgtgaactccttcgttctcatgcttaaaatgtgaatttattatcagaaaaatgtattactttaagtctgtaacacagatattatccctcctgatgagaaccagcaaagcaacttttaatgaagattttatcccaaaaatgctgaccaccaattatccttcaacaagctattcggatcaagacattgatccaaaaggaaaatcaagtgaattttcataaacaagccttttaaaattaagatattgacgcgacatgaagtccatgtgatgtgtcattgctgattatccatcaacaaataaatatgacaggttcaatttattgtcaattctgattatgctttaagacaataaaaaagttaacaaggacaaactatacatttacagaaagagcactacttatctgttattatgtaacagcaatgcaacagcaaacatgtcagaaaatcagagcaaacttaaatttacagattcagcattgaactacaggctgcatggatcaggtatggatgtgatagctgttaaaaaaacaaagaaaaactaaaaagatagtaggctaatagaaagcagttacacatcagcaaaaagagttcatcaatcaatatgcgttataatagctacaagagcaacaaagacaggtgataaagcaattcacaagtcaataagaagatgaacaaacagaatatttgcagtcttagctatacaaagagg

SEQ ID NO: 56851 - DNA, 1096 bp, Oryza sativa
gtgtttatatgtcggtgacatattgatttttggaaccagcctcaatgtgattgaggaggttaaggactttttgtccaaaagctttgaaatgaaggatttgggagtggctgatgttgttcttaacattaagctactgagaggagatgagggtgggattacacttgtgcaatctcactatgtggacaaggttttgagtcgctttggttatagtgactgcaagccagctccaactccttatgactccagtgtgctattaaggaaaaaccgaagaatagcaagggatcaattgagatactcccaaatcattggttcattgatgtacttggctagtgcaacgaggcctgacatctcatttgctgtgagcaagctgagccggtttgtttcaaatccgggagatgatcattggcaagctctggaaagggtcatgcgctatctaaagggtacaatgagctatgaaattcactatactggttacccaaaagtactggaagggtatagtgactcaaactggatatctgatgctgatgagataaaggccacaagtagatatgtgttcacacttggaggtggcgctgtttcctggaagtcttgcaagcagaccatcttaacgaggtcaacaatggaagcagaactcacagcactagatactgccacagttgaggccgagtggcttcgtgaactcctgatggatttgccggtggttgaaaaaccagtgccagctatcctaatgaactgtgataatcaaatagtgattattaaggtgaacagttcgaaagacaacatgaagtcatctaggcatgtaaagagaagactgaaatctgtcagaaagcagaaaaactccagagtgatagcactggactatgtccagacagctaaaaatctggcagatcagtttaccaaggggctaccacgtaatgtgatagacaatgcatcgagggaaatgggcttgagacccacttagagttgcacaatagtggaaacctgtccattgtgatcggagatcccgtgaatttggatggcgaaacaaactattgtgtaaccgagagaagagacccttaaatgggctcattttcatgatgtacttctcttctattct

SEQ ID NO: 56852 - DNA, 12337 bp, Oryza sativa
  unsure (1)..(12337): unsure at all n locations
aattcctgcagcccggctttcattaagcagcgatgttgacctgcagaacatcttagaagtcacagtctatgagatttgagtgatctctagatactcatgaaaggcctggagtatgacttataagctccaacccgagggaatactaacggttgcctagtatcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtgtggattgatagatttaattgggtaattgatccatttaaaacaattaaatcaaataaattccaaggctcattatgctaggaattcatgtgtattcattcttttatggtatatcaatgggatgaagagttttgagaattaatccatttgattagggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctctattcctctttctattccatgactcttactcttcatcttccattcctcttataaaatgagaatggatttgatctcccgcgagaatagtgagacacactttcatccattttccaacgctgttgctgctacggtaatcccatcccgacgagtgtgtgcacacgcgttgggagagtaggcctccgaaactacgcgctgctgcgacgtttgcacggacgggcgggctatcaggtttttggggagcgcaacgcgcgactactcactgttcgtcaacatctacttcatcttcaccaatatgtcgaacactggagacaacggcaacactggatacaaggagaaggaggctcccgtcaacaccaacggaggcaatactgcctcaaactccagcggaggaccattcttggggtataaccttcttacattatttcaattagaagttttactgttaatgttcatcgcaatgtcaacattgtgttattatgtgattgttgatgcttattctacattaagcatgctcatgttgattacattcaccactatcactggatcaaatcccattgtaaatatcatatttattattttgttattttggattaaaatatgccgaattatgaccaaagttccaacataaactaccccttccatctaaaaaagaccaatcctacatatgaacttggacgcacatgtgtgtttaggctcgtagatagaaattcattttttttacagagtagtaagtatctgaataaaaaaagcatggtgtatcatgtaaatccatcgacatcaccacaccatggacactggacaaggtttctttgttggagataacctaatgattcccttgtccaatgtttgaacaaccaagcatccatcttatccctgttcacgttgattgtacctctggaattggggatggacggttgaggtgaaccggaggagcacagtgagcatcctgtgcctgccaaaaggccaaaaacaatactgtacaatcaaaatgaccaaagagatgatacttgatggacacttggacggtgctcaattaacaaaagaaaaacaacagacacatgccattttagaatataattgagctttgcatgaaaattatagatatatgatttatatatctatgtcggtcttgattacgtatatataaatatttttttactgtatctcacgatattcgaccaatcttaaaggttaccgcatttaaaaaagatacatcaagagtgtaaaaccatccagctttgcagcaagaataaaatactctatcactacattataggaaaattacctatttattataccgtgcgtctttttatcggtcacgtagcagaaaaaggccgaagcaagcatcactcgattcttaaactaagtgcatggattgaaaagtttgagtataattttcctttagcagagaaaggatttatggacaaaggtagccactgaccattctaacttaggcacgacaaaccttgaaaaccatgttctataatccatgattactcagcaaaatttgaccaaatttaacactggaaattcaactaaaataccacaaagctaaaacgtgctgaaccggtacactaataaattaatatatatattttccttctttggaccaaaacgagtttgtgatgatatttcctttttcttatggggagatcgcagccaagattacgtgcagctgaacaagtccaggtacacttaaacgccgccaccttctagtcgtatttttttttcagaattcaattcatacttatcagctaaaatttaaaatttcaatattaaatttagagttgattttaaagtttttttatcgaagtttatttttcaatctttgcttttagatttctaaagatacatatataaaaaaagttttattcacaaattattttcgtttgtaaatatgggtctgtttggggagcttctagctgcagcagtttcttacataatcataagctcctcatatagttcaacttttggtccagattataaaaagatgtagttattagaatccaaaaaatgaactggaagtcaaaagctgataaacccagcttttttaaattatcagaagctggctttcaatcagctgtttctcagaatcttaagctctccaaacaaattcaaagaataaacgaaacaatattgccgtaaaacgaacccaaacaaatctttgccaaaatatcaacgggcgggcgtacgacgtcacacgtgcacccacgcgccgtggggcccacatggaagtgagagagacagagacagcgtgggtccagctaagcgcagtcacgcgcatcgcctcctcacccctgccagcgaggcgcccaccaccaacccacatacccacccccgcgaggggggaaaggaaggagaaagcctcccgcccccctcgccgccggcgaacgcgacggcgggcgcgtcaccacatgccgatatcctccggcatactcgcgccgacgcggggggcctcctcgtcgtcgtccgcggtggggaggaagctcctcctcctcggggctcgtcatcctccctcgtccgtggcggtggcgggtcgtggcgtctggcgaagggggcttgccggggtcggggtggcggcggcggcggcgtcgtcgtcttcgcccgacgagcttcacgcgcgcgggaggcccctccgcggcggcgcctacgaggaggtgagcgagcgagcacagccgagggggttaaactccatgttcctcctccatgttatacgaaacagaagaatcgaggcgaaagtatgaaacgatagctttcagccttttgcaaatactcgattgagcagcagtaggtggtatgtatgatttgcgttagttggtgtgggatttggattggagcgaagtgatgggggattggaaggatttgaaccgtatatagatctgttcatttagagatgtaaatgttcctaaagtcggcaacacaaaagtaaacgatactagcgtcgatgcgcaaagctgcaactttatctttctcattggatagtttgtcatgctgggtactaatcttggcacacagtttgtcttaacccttgagcagtataaagcttcctaaaagtgcatccgagtgctaatatggttaacttttttgagtatgcatacacattatttagcctctcatagttggatggcagtgatggagaagtaattcagcatgcttgagcaacaacaaaagttagaatgtctctcctcacaagtgtgaggatgttatttagctttcaccaacaaagaatatatgcttgtcatccccctactgtcaaacttatctagatgagagcattagcatcttttggtcctatttgaatttctgtattgtcacttttcattatcgtgatgctcctgtgtttgcttgtagagatctgccctttggaacttgataaaagacatagaacctttggatctaagcataatccaaaaagatgttccttctgaaactgtggatgcaatgaagaggactgtttcaggcatgttgggccttcttccatccgatcagttccatgtggtcatagagtccctttggaatcctttcttcaagctgttggcatcttcaataatgacagggtatgcttttctgcccgaaacttagctttcatgttcatccactgtattgattattgttgattctagttggtcaaaagaagtcagatttaagcatgatcaccttttgaaatgtgcacaggaaagtagcaaatgacttagcgtgtagttttaggtcaatgcattaagataaataattatgtagcgtggccagctattggtggccagctgtagcatagctcttgtctatcatctatatgcatgaaatacaaatgctatttccctatgctgagttcgtcaggacaatcgcagcactttcgttcatgtatgtggtatgtcaaagcatgtcttgagggtgtgaattgtgaactccaaaccttttcctacagcatttctgccaatgagattttagtgtacagtgtctagtagttttggttttcctcgagcatatagtccaagtgtacacccttgtctggtctacctggaaattgttacccatacaatctaccactattgcttcagcactcacatagtcacatcccatttttctttggaactagctattcttccacccctgttaattgctcttaaagggtgcattccttttcataatttcacgaaggagatgacagatataagttgcttggtatcagcttggtgttcattcaaattaaacttgattcctcaaaatttcagattgaattgctaaccttcttcctcacaaaaaagtaagaagaaataaatattaacctttttgatggcatcaaattccttttcacccataattgttggtatggtgaaatagaatgctttcacttaacttagaagaaaggccagaccatttacatatttttttattttatttttctcattggcatttagcataaacacttgatggggtgatttgcatgtgccaaggaaaattaatttctaatgtcactttgcctttgttccaggtatactttattcaatgctcagtacagactctcccttgaaagaacgctggagttttctgaagaagaaactgaatgcaagaaaagagatagctgtgaagaaattcacagtgttggaaggccttctatgtttctcagcttaccagaagatgtaggcttgacaatcgaatcagaaatggcagatgaaaaattatgtggaaatatggatggactaggtagcttaagtattgaagcaaaaaaactcattctcggtatgcaatctcgcttggattccatggaaaaggtaataaccatctcttacagtcttacctgattggatgatcatagatgattggtagtgatggccatatgtatattgactgccctgcatatatctgccaatcttgtcatacctattatgcacagtgaaaatttcatggctcgttaatttcacacttttttctgtatcaagaatctctgcttagtgcaagcttggctagtgtaatattagaggtcaacttcaccttccctttgaactgtaggttaatcccattggtattctttaacatctttgcaggtttaagctttcacttgaaaactaccaattcagaatttgattgtattcttatattatttttaaccttgcaggagctacatgaacttaagaagaaaaattcttcccaacaaatgcagcaatttgctggagaagagaaaaacgagctgctgtattacttgagatcgctgtcacctgagaaggttgttctgtttctggccttttgagttccgcaactaatatatttcctcttgttggatgccatgtgaacaaaaacagcaaatagcaatcaaagcaagatgaagtttcccagtttcctggggcacctttttgtttcaatttgagctaataaccattttgaacaggttgttgaactctcggagtcttcctgccctggtgtggaagaagctgtttactccgtggtacatggtctgctagcaactctctcccccaaaatgcatacgaatcgctctccgacctcagagaacatggcgggtggagctgtaaattttgggatggaggaggacgatgaattcactgagctcgtggaggacgtgtccctcccatttcagcccctgatatctattcctcgcgaccgtcttgcccgtctattattctggtaataatagcagttccttacctgtgctgcctaccgatacttgacaacgttctgaccttgtgattccgcgatggctgttcaggtgcatgatgctgggccattacatccgaggtcaggagtgccggcttgagctgatgcacctcctggcagtctccagtgatgcacattcatgatctcccctagtctggtagcaacagcaaatgctctgcaaagcttctgtcagctgaacgaactacttctgcatgacaaagacggaaacaggaaactctcaagcatcatgcgaatcgatccaatttggatgctgcaacattagtatggggatacataggagagggagaagaggagcaaacccatggatggccaaggtagaggtcaggtcatggtccctgcagtagctcgaaccaggttgggttgctcagtagcgtcagatttccatataggattaaccatttcatcatggttaaatgtgcttttcaccttcttgttagtttgtgttgtgctatgtgtacaaatcctggagttagtatacagtatttcctcaccgatgtactggtattttggttgtagcaacgttggtgttgcatcctgtatatataacattatactagtagtatgtatgtaaaactcttatatttccttgtgtaaaaagatctcttaatttttccattctatttccttttgtaaaagaatctctttttttttcctttgtaaaagttgagttcgtctacctcagaaaaaaaatgttggattcttctgggctgtgtgggttggaattcctggggaatttaactatttgtcacttttaggttcgtcacttatccaaatgctcctcatttgtgcttaaaaatttgccactgaaaagaggtaattttttaactatttgccacttttgtctacgtgatgtgtccgcgtgaaaagtaacgtgggccccacctgtgagccactcccctctccttctacctacgaccgccgtatatgtatcgaagtctaaaagtacttatattttaggacggagtatgtcaaagttccaaaatacttaatacttatattttaggacggagggagtaaaagtgataaatatttaagaaattaccactctcaagtagaaaattattaaacgtggacctaagagagtcatttggataagtaaaatcttaaaagtgacaaatagttaaattccatggaattcccaatgcctaatacagtagtacagtactacagtaataacctgcaaaatcatttactactagctctgtaaaaaaaggttttggcgccgagtcatgggtaatttgagttttaaaccctacctcatcgagccccagatcccgcccgcgatccccagattcccccaaaaatccaaaatccaaaaccccaaaaaaaagcgaaacacgattccacgaaaccctcgtccccctcctcgtgagatcggattcgattcatctcgtaggcgcgtctcccctcctttcgaattctccatttcgcgctcttctctcccattcccccaatctacttaacctcctcctcctcctcgagctccgaatcccaaaaccctagccccacccgccgccgcacgccggaggaggaggagatggctgacaaggagaactccaccccggcctccgcggcgcggctcacccgctcgtctgcggcggctggggcgcaggccaagcgttcggccgccgcgggcgtcgccgacggtggcgcgccgccggcgaagaggaagcgcgtcgcgctcagcgacctcccgaccctctccaacgccgtcgtcgtcgccccccgccagccgcaccaccccgtcgtcatcaagccgtcgtccaagcagcccgagcccgccgcggaggcggcggcgcccagcggcggcggcggcggctcccccgtgtcatccgcgtcgacgtcgacggcgtcgccctcctccggttgggacccgcagtacgcctccgacatctacacctacctccgatccatggaggtacgcgcttcgatctgcattcgaatggattaggtttggtttggtttgggatctgacgacgatggtgggtgggcgcaggtggaggcgcggaggcagtcggcggcggactacatcgaggcggtgcaggtggacgtgacggcgaacatgcgggccatcctcgtggactggctggtggaggtcgccgacgagtacaagctcgtcgccgacacgctctacctcgccgtctcctacctcgaccgctacctctccgcccacccgctcaggcgcaacaggctgcagctcctcggcgtcggcgccatgctcatcgctgcgtaagccgccgccgccgccattttcttcctctagtctcctcacattgcatcagagattgggggattgagtttggttgttggatggtggtggtggtggttgcaggaagtacgaggagattagccctcctcatgtggaggatttctgctacatcactgataatacgtacactaggcaggaggttgtcaagatggagagcgacatactcaagcttctcgagttcgagatgggcaatcctaccatcaagacattcctcaggtgggcatactgacccccccaaatgatcataatcctctgcaaatgcttgctcccaatctgaattcgtggctgaatgactcattttgtgcatttcccctttgttccacttaaatttcaggcggttcacgagatcttgccaggaagacaaaaaggtaagcatcaatccgtgtgattcatcatattagtcatttaattcttgctcttttgcttctgtgggtgcataaattggtgtatctgacggattcttgtatactcgttgcagcgctccagcttgttattggagttcatggggagttatcttgctgagcttagtctacttgactacggctgtctccggttcttgccatcggtggttgctgcctcagtggtgtttgttgctaaactgaacattgatccgtacaccaatccttgggtaagaactaaaaactattcccctgtataaagtgctgctgtggatctatacctgaaggctaaaaactgtactgcatgtggttctagagcaagaagatgcagaagttgacaggatacaaggtgtctgaactgaaggattgcatcttggccattcatgacttgcagctcagaaaaaaatgttcaaacttaactgcaattcgcgacaagtacaagcaacacaaggtttgtgcacgtcctgcatcatgtagtcttaatcagattattgtcataattgtagcgttggtctaattctgcaattatttggaacagttcaagtgtgtctcaacattgcttccccctgttgatatccctgcgtcatacctccaagatttaacagagtagctgtttttggtctgcaactttgcgatgttaacagtctgagcttgtctcgagctcccggagataaaggaagaattacagttgcagggcagcttctcagctaagttagagtgctctaagcatttagatgctgaatggttttaaagcctgagccttagggggagatttcagagtctatttaggagccactgaatcgctagcaggctaacaggcattctcctgtttttgtaaaattgtagttctgtattataacttacaacatggtgtcttggtttgttgggagaaaaacttgtaatgtttgatatgctggtccattccctttgttaatctttttttatgaaattgtcggttacagtctcagtaccttcttttccctatttaagggtagaatcacaaatggacttgaataacactggtgacttgaacagttatgctcgacaagttgacacctcttgtgctatttaccgtgacaattttgtatcaacatattttgttcaatctaacatatagatgcatgcgcctttgctaatgaatcatcagaaatatttgatgcggttggcttatgaagactactgtgttgagggacttggtgtggtactgtggtgtattcacaaacttgattttctttcagggcaactaatgcagcagaaatgacctcctacttttgtttctgtcttataagtgatgcctacatttgtgttacgtgcaatacagtagcctagagtagttcagatgccatttctaattttctacttataaatatgtgcaacttgaaacttgaaaggtacataaagttttctcctttcgccccaccctttccatcatgaagtttttctacataagctgcactaccttttcttttccaaaacttttcttagcaatgtgtttcatatgagtgaaaattgataatctttcaccttcactaccatttccataaaaaaaagaggaactgtactgtcctttccaaccttaaattaccttcctcttagcttttggtgcgttggaatttcataggattttgctggaatttaaaattagtcagttcatttcctgtaggaattggacaagatcgccactgttctgaatgtttttttttttggaacttcagctacatgttgggaaataaaaattgagaacacttgcaatataactgaattactgataaagacgggatatattcttcgtgtaagaattgctgcggaatgcatgtctttcttcacagttgaatcaactatgatcatgctaataagtttctagctataaaattagtgcagtaacttgtctctgaatttttttttcaataattctgccaagaattccaaatgaacaacaataccttcgaagttcagtaccaccatatgattttgatctgatggtgagctgaacctattgattacttcaaactcatttattcagaaggacaagcttgaggagggacttatgtactggtcagagttgtacatcaacctatcaaagcctgagatttaagtctatcttactctgttctgatggttggtctgaaggctgtgatctcaatctgaagctccctggccatgtcgaattcggcacctcctcataagcaatcggtggccagctgatgctgccttcatgaaaccttggtgctgtcctgatctgtgcttgctggcttgccttctgaatcactgagctctggtttactctcagggagtgcacaaaggcagcatgtgcctcaagaggcagccccatcatcatcctctgcgcatggtaggagcgttttgcggcgctccgctctcgcttgtgagcgttctgatggccgcccagagcctgcgagctgaagaacttcctcatgcagaagttacatgagaacaccttgtgtggtgcagaagaaggcttgggagcctcagactccgagcagtttgctgcttctgtttcttctgcttcggctgttgcttcttctggtgatccctgtgtggcaagagtgaggctcagccatgtcgcgccgtcatcatcttgctcgctggtaagctgctgctgctctgagctctctttgttcaccgacgactcgtctgcctgctccatctcctaccatgtaagtggttcaagctttctggctctcaggtttgcaactcatgtatggtgcatcttctttcagttttcagatggcttttataaaggatgacgaggtaggagaaggcagaggggaattttttttttcgggaggtaataattgaggcttgtggagggtctttgtgaggaatcaggaggtaaaagagttttgtctggagttagtggatctctcttttagttgcttatctctccttcctttcttgcctggcccttgcatacattgtagtggtgctatgctaccctggttgtacatatcccaggggcaaggcacaatgcatatgcttctgtcatcttttcctgtacacatctcactagttgatgtgtgtacccctgctctttttcctaaaagaaaacaagaatcatgatacaaggcatgaaatttccatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56853 - DNA, 5960 bp, Oryza sativa
  unsure (1)..(5960): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgaacaagctttcgaagaaatgcgtccattcaataagatgatttttttttctctacagctaattcaggccgacaacaatgttgaaatgatttttgtaagcaggaaatcaatgtcagcaagctgaattgacagcccgctcctcccgtttacagaactcaccaacaagtaagagtattcataattctttcttctatgtttaaattggagtttcgctctctctcttatatatgtaacacatgaaaatttgaaactattcctatgctgaatgaaaaagatatcaatgttatacatgatgccattgtatccttatatttactttttctatgtgctcggaaaaatgatctgtcaattttatattgttgcgcattgttgaggcacgaagcctaaaacaattttaaagtcattgttgttggcaggcttgccaggtaaaaaagatagaaaccacacgtcatgacttcaatttagtttgtataggcagtaataagtcccataaaagacaatactaagaatttttttgggtaaaaatgcatgttttttccacataaagttccctgtaatagtaatatgatcgaatttgatatggattttcacttgcaacttttcttctttttgcagcaaacttatttgcaaagcactcaattcactactttgcaattgcttcacaagttaaattcgtgctttgaaatttatacaactcattcataaatagcccaccatccagctgcaatagtttcgatgttgaaatgcttcaatataacattggaacactggggaaactttgattggaggttggaaagtgtgaggaaaaaatttttatggcatcaacatttaatcctacatgtgctaatgacggattaattaggcttaaaaattcgtctcgcggtttccatgcaagctataaaattagttttttcattcatgtccgaaaacatcttccgacatccggtcaaatatccgatgtgacatccataaattttcttttcacgaactaaacatgcccctaatcaggaaaaggttagcgcaaaaggtatgcgtgttgtgaaacaaatatgtaggagataagtcacggacgaacgacatcacagatccgcatggtgacctcggcctgatgagacgatcgacgacgacttttgatgatggtggcgcaacaacggcgtgcgggcaccgggcagcggcgctccgactggcaatctcctctagcggcttgacgatgagcgtgataaaagtagcaaagccgacaggggcgagcggtagggcgtcgccgacgagatgatctcccagttgatagtggcttctctccatcgggacggcgccatcttgcttcgtgttgagatatcgaccgacgcgggcgccgggcagaaaggggagaatatgcatggcaggcatcacggacggatggtctgcatacgcaggcgcgatcccaggccgtccggctcatatgcacgtacatctgttgatctcttgttaattggtttagcaccggtctacttctgctggtcttgctagctagtgaagcatgcatatatatatgcgtacgcatacatggccgaattcacatcacacatctaccctcccaaatgtcaggccacctctgtacgcacatgcatgcctgaatcatttaattagcttgctaattaacctgtttcctgctgcaatcaaccattaacacacaatatacaagtgattatattttataaatatgtacaaaataccatcaaacatatgcattgtgatattaaattgtagtgctgtaagagcaaaaagaaagatggagatattgcatctcctttttcgaaaacacacaacaaaggagaatgcttctaaattgccttctttcccgtcgtgattgaggagcacactcaacaataaaatgttgaagaagatgtctcgccaccaccagtgcctcagctttaaaaagttaagttgtatggtaatctttttaaacttttataaccatataagcttcttcgctagttttatatgttttaagaagctatatattaatatatcatgatacacttttgatgatttggtatattatattatttacatttgcattgtatatattaccgtcactgcgtatgcccgccgtgacgccatctgcaagaacgccggcattgcatgtactcaggaccgttgcatgtacacccgtgcatggatggaattgaatctccatcagctagaagtagcacaaggcggtggcggccagccggacgcggcagagagatccattgcgtgccctcaacttcatcagctcgggctaatcatggtaattagtaagcttagtttgtaaactaatttactaattcatagatacatcccggcacgtatctattaaggtacgcggtctatatatgtttttatagattgattatattttctcgtttttatcatattatctagatgctttgcatgcagtagatgtgatcctgctattgatctggtggtaaattaatttcctgcttttatctacatgcgtctattttatttgatgaaaattagagaaaatcgtgtgagagaaatcactaaaattgatgggaaaccctggactagagacgtatctaattcggttgggccgaatcggtcgtctcgcccaccctcccatctctctatttctgatgacgccacgccaggaacacagcgacatattctcagttcatatagtcggacttggagacatgtccatcgttcgccgtcatcactgttgggtgcgccgtctcagaaaaagccctgttgggtgaagattgacgatgacgggaggagcagtagggccacgctggagatcaaaacgcggcggcgagctcggtattcacggcgacgaaggtcttcccggggtcttcggtttcggcgagatggctgccgggctttctcttgtccttgcagagccgagggaggtggtggcgcggagcggcgacgaccgaggcggcagctaggggcggctggagcggctaccggcgacggagagagggcgctcgcggggaaaaggtttccggcgacggcggagagagggagaggtggcgcccgaaagaggagagggagggggctctatatatagccatgggagggagagatcgggcccaagacgaacatggcgacgccgggaaaagctaaggttttcgccgggaaaaaaaaaaggaatgacttgatccgcgaaattggaaaggatttccatagaaacttttggggatttattggggaaattgtagaggggattgagaggattccattcccgcaactaatttgggatgaggagcaacgaggaggccggatttggtgagaggtggtggcggcagtgcacgcgcacgggctctggacggctggctggaggttgaagatgcactgtagtgaaagggagaagaaacagacttccggctgggcttctattcctcggcccgattgaaggaggactcaggctagactttggaaagaaaaggccgaccagacagaggaaggaaggacagccaaggactgaaagagaacttttcctatttcggcccgaaaaggaaaagaggatttgatttatttttccaattaaattaatcaccgaaatgatatttgaattgttaaaaataattccaatgctctaataatttcaataaaaattctaaaaataattagacactcaaaatatataaaaataattaaaaccagatcatttaatgattaatttattatttaaataattacttaaatgtttcctaatttattaaaattagtaattgagctctgaaaaatccgagaaaattccagagagtataattgatcatggagaatttaataaaaattaaatccaaccattctttacacttagaaaattttatttcccatatttaacttcacttgtaaattaataaacatttaatataaaatttattaataatttattaaataatttataaatcctgaaacggaaattcaggttgtgacaaattccccacaatgtgtgtatgtatagagtgaggaaaggaataaatttaccgcaggtccctcaacttaacagcgcgattttttgagatcccttaaccataaaatcagaaatgtatacccctaatctcactcaaaccgttcaaagaaggtcccatgctagtatatatgggtggtttcgctgatgtggcatcctagtctgcaaaataaaaaataaaaagttatgagacccacatgtaagtgagaagggaaaaaatgtgggacccacatatcttctttctctctttttttttctcctctcttctcctttctttcctctctcatcttttggttcttctgtttgccacagaagaggggggagcggcagcgagcgaggacgagcgaccagagcaggcgggcgagcgcgtggcgaccggcggagtggagtggggtgacagcggtagcgggcgagcgcgcatccagagcagtgtggcagcagcgagcaggagctggcgagtgagcgcggggaggggggtcggcaggctcagcgtctcccccggtggtgaaacaccaaaaactgtcgcggctgccattgatgccatgtcgagctccaccccgttgatctctttctagggtaagtttctcgcataacctaccgcgtcacaacgtgttccccgtggttagtagtctttactctcaacaatggtggtgattccctttcacttccatagtggtcttctttggtcggcccactcatttcactctcaagctctctgagaagattcaagatgtttcatatgtgtccggatagcccaaagtctcgatagttagctctaggtcttccagtcaataggcagttcaaaatgttgacctatttgggaatctccggatctatgattattttcaactccccaaagcatttcgtctcttgctacgtccttcctcgtctctgggtacctaggtatccaccgcaagcctttcctctataagggacaggcttactgaaactagcactagcaacgcgtcttgtccttagtcaaatccaattcaataaagaacaagaaaatgtaggtgaacaaagaaagaaggcaactgcatttgtcgggaacacgagcttcttttcgtgtagtgtgttgacctttgaccatcgcgttccgcgccaaccagagcaccttcgtcgtcatcgatttctttgttggattcgcacaaccgcgatctacttacaggacattgtgccctcgctggattccatcgagttgccgtcatgccatacgcctgccttacgagctgacctccggcctaccttaggcacagcggtgtcaggcaccggagtcgcgcgccaagttcctcggcaactctgccgctccagcgcccacccgccagccggccacctcacgccgtcgtcgctactcgaggccccgccccgccggcaccggatgaagataagagaaaggggagagagagataagggaggcagagagaggaggaagaaggaaaggagagagagcatgacatgtgggccccataaattattgaccctacattttttttctcacttacacgtgggtcctatatatttatttattttattttatttgttgactaggatgccacgttaacaaaatcgggcgaaaatatagtcaatactaccatgtgacctcctttgaacggtttaagtaagtttaggggtacacatttctagttttgtggttaagagacaaaaaattatcgtgttaagctaacgaacctcggtgaacttatttcgtgaggaaatatggtgaaactcatctaaaaaaaagactaaccgttgtataacgtgaac

SEQ ID NO: 56854 - DNA, 2241 bp, Oryza sativa
attcctgcagcccttgcagtcaacctcgatttcatcgatcatcggatcgggagaaaggaaagaagtcaagactgctccttttattttcgttaggagtcattctttccaatttctaggacctctgtgtaatttgaccattttaagggtctttctataaatgtatcgatgctattaatctcatcgctctttctatgagaaatgtgattctcgctgatgtatgttatacgagtactatgtaatcttttatattggataaatgcatgagtctaaaaggaaccataaacgagcaaaaagaatgctgccgtacagtacaggtgccactgccacatgtgtcgatgatccggacaaaatcagttgcaacaaaatgccacgtgtacaacgatgcgtggcacgtgtcactgaccagtgggcccaaccgcggtgatagcgtgaccctagtccatcaacgccttttttttattagtgcctggctcaccgattagggccattctgacacttgtttaaaatgtgctaatcaactcctcgctaatgacgtttttggtagtaaatcacgtcaaattcttggacggttagcgtacttcgcattcacgcgcctctcgtgttgaattttttttcttttacaaccgaaactgatgcagtgacagtaaactgtggaagaaacggagtgtcagtttcacatcacatgtggagtgcttaattagttgttttatactatgtactactccctccgttttataatataaaacttcttaacattacccatacatacatatatatatatatatatatatatatatatatatatatatatatatatatatatatatatatgttaataaatatagacacacttatatatttagagtaattaatatatatattaatgcgggtaatgctaaaagtttatatattatgaaacagaggaagtactcaaattatgccatgttgctgtaatctcacttgatagttactcgaagtttggccatatgcttagctactttgagctgatctttataatactcaatgtacatttggcaacatttaatttggtcttccagagttggttctggattaatgaccttgcaggtcaccaaaaggcgcactaatttccatcatgtctaaagtgatcaacttggagatatggccatcatcaagcccccacatatgatccacgcagaataaaattgttctacataccaataattttcattcagatttagttccattttgattctgatttagtgcgcctaagtttgtttacacagctaaatacggagacatgtcgacactatatctcaaataaccgtttcttcatcactgaagtagtgtgaaaagattgcgtttttaaagattgcaatttttttcctctcctgttttgtgcccttgatattatgtcgttttcatcagtagtttagagcaagtttaatagtatatccaactattggcttcaattcatctatagccaacctaatagctcattcatacaatatttacatactacactattaatacctggtcctacttgttatacacaccctgcgtcttgaagtccgtattacagctggctataaatttatagcccgctgctattctctcttcttatttatcttattaaaatatgtttgcagttggcttatagccaggtattgtacctgcttttagagcacccataatggtaaaataagatgctctctataaaacatgtacatctcagcaatagattagattaatagtaaaccacctcaatagtatgtctacatgtgtatctatagctctctaatccattgcctcgtttttatctatagactatctctaggttagtatatagctttgttctctctcttcatttagtctcttccaagtaggataatatgctgacatggatatcttatggatatcttatagagagcctataaataaccattgcgggcgcccttatcacgcttctagcttcatttaagccgtccaaaacccttaactgcgatggcgcacaacacaacaaatcatcttttcgaggattttgcgaagaatcgatacaaaaaagcaacgttgacgtgagcgagaaaattcagaaactttcagaggaaaaaagaagaagaaaggtttcaactttcaagaggtagtagtagtagtagtgcagagatatctgaagaaaagtgcagagaaaaaagaagcagccgaggtaatataaaagttggagagaaacaggtgaagctgcaatattccgccacatcttcttct

SEQ ID NO: 56855 - DNA, 5339 bp, Oryza sativa
ccaaagtgcaaaggcctatcctacatgggccaggaaactcacactgtactttgggccttacaaaaagcacagctacctaagctacccttttcacgaattttttttattaaaagttttacaaaaataattttccattttgaaaattgacggaagtagtcgcctaccgccctctgggagggcgatttttaaaaatcgccctcccagagggcggcgaaaatgacgtggcagccggccgttcgctctcgggcgacggccgtcaacgaaatttgcaggcggcccccttgccgccctccgctagggcgccgcctgcaaatgggcggcgagggggcatggaattttgcaggcggcacccttgccgccctccgctagggcgattttgtactgtgggggggccgcctgcaaatgggcggcgagggggcatggaattttgcaggcggcccccttgccgccctgggggagggcgattttatactgcgctctatatttttgtataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgtggtgtgctagtgggaaagaagatatgaagaggttgccttcagattgtcaattatatagcgtcattttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcgtacaagtatttaacagtagtaataaaaagtaaagtaccgtgtgggcgagggatcgacgctccgtgagaggaagagctggcgaacgcgcccgaagaggtggcgaacgcccctgtggagctcgcggaagcgccggtcgtgcctgcgaacgcgctcgaaggcagacgaggtcctgcgatgaggaaacgtgcagtaaaacatggtgacatattcgtgcaaaagctgaaacaaaaatgaactaatatctgggctgaactgtaccgtgcgaaaccggtgctgtaggtcgcactgctccgaagcttggggcgctcgaaggcaaacgaggtcctgcgaggatggaacatcaagttacgacggggtgatgttttcgtagaaaaacagaaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatacgcgtccgtgacagcgacaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagttgcgcctgctagctgtccccgtcgagtcaacctgtgaagagaggtaaattatatggctcgatgaagtaattcgcctaaaaatttagaaatgaacaatccgaactcacgagtggtcggcagggaggacggtcggctgcacgttgccaggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacaacattttatttcctaaatcgaaagcattgttacaccatggaatcgcctgctgcgcgacgacgccttggccttgcgcgcctgcttgttgttccttcaccaggtggtcgcctaccatcacttgcctgtccagattgactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctagaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcaacaagaacgtgtgagcaaggaaggtgatgaagcttcggcttcatacaactgcaggtacatccaccatccgccttcaagacacattcctgcatggcttgcttgcgatagataccacgcctgctcctatcaacacacattatttcataccgatgcacttgtgtgccttcagcaacaactcgatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtaaacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttgattctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgattatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctaacctcggtatttacctgtcataaaagttccatctatgcatagaacaggtcgacaatgcacaaaagcattgatgcaagcacccaatgagaaaaagactctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttg

SEQ ID NO: 56856 - DNA, 3641 bp, Oryza sativa
aattcctgcagccctagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctgtcacaccccgaagttttcctcccaagccaaaattgtaatttttataaatgaccctaagaaaatgcaggtgaaatcaggagaaaaccctaagaaagtaatgcaaataataatcggatttgacatgtggaattttttcttgagttctacatgtcgaaattcattaacaggatttttagtggaattttcagagctctagaaataattttaaccaattaaaattgagcaagcaatattttaattccagggaaaatcctttttcctttttccttttctttttcctctctttttcctcctttttttcgaatgggccgccggcccattccctccttcctcccctcctccttgctgggccggccgcaggccgaggcccagccaggccgccccgccgcctcctctctcggggtcgccgacaggtggggcccacctgtcgggtccttcccccacctcccgccgatctcgcccgcgccgccgcgccctcgtctccgcctcctccgggccacgtcgaccacgcccgcgcgtgcgccgcgtctcccgcgcccactcctctccctctcctgctcgcgcccgcgcccgagatggccgggattcgattttcgaatcccgcctctctctcctcccccactccccacgtcggccggcgattcccgcctctcccggccacgtccggttccctctccccctatttaagcatcgccgtcgtcccctctcactttttccccatttcgccgcactctctcgagcctcccatcgctcccgcgccgtgcaaccccttgccgccgccttttccgctactccggccgccgctagccgccgttagggtcgccgccaggccgcgccgtcgccgccgtcgggttcgcgtggccgagatccaccccgtccacccctcctccgtcgaggttcgtcgccggagccctcgttccctcgcattcgggtgagcaccacctccaccgccgccttcggccatggtttccggtcgccgtggtccatctccctctctctaatccctctcttctccttccttagggcaccccgaagctcgtccgcccgccgacgtcgtcctcccgtggcttgccgtcgccgttcgccatcgtcttcctccgcgccagccaccctcggtgaggcactccctccccacttatcccctccctctccctcctagccgccgctttagcgccgtcgcccgttagtcgtcgctttagcatcaccgcccttcggcgccgccgtctccgccggcggttgccgtcgtcggcaacgcgcgtgcgcgtgcgcgcgccgtcgccgtgaccggtcggccggttttgtgccgagccgagcctagcctggccgccgccgcaccgtccgatcggccccgggccgatccgggccgtcgatcccgtggaccggcggtggatcacccgcgtggtcccggtccacggtagaccggccacccgtgcgccgctgacatgcgggcccctcttgtcggcgccgcacccccccccccctccgtgctgacgtcagccctggaatatattgcgcaataaatgatttaaggtttttcttttatagtaataaacacagtgaatcttctaaaattcataactaattcatccgagctccgtttaagcccattcaagtctcagtaaatcaagaaaaatgtgtagaatacattaaaaatggttttgttccctgtttcagtagtcttatagcctgtttgcaatgtttgctttgtatgtcgctagattccgattcctccgacgctccggtgtactttgagatagtcgccgaggttcctccagcagcagagcaaggcaagtcatgcttgtcacttgaacatgttgatcctatagtgcaaatgctctattgttttctttcaaatattgcattgttttataatattactatgggatggttacctattgttacagccatgtttttggatatcatgctcctttgttagcttggggttataacatgattagagtttggactaggaattgcttagccatgcttagttcaactagttcacaatggggaaaatcatattaatgtttagactgttggttctaatgataatgttggattagtaccaccgctctggtgttggttaattaaaatgaatcacatggtgggctgtgggtgcatggttttgctggtcgcacccatggcagttaaggaccggttcgtgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccggtatgtcgtggtgacatgtcggcgcacggaaacgtgtcgtggggctgtgtcttgtgggtacagttgtacacctctgatcagagtaaaactattcgaatagccgtacccgcggttatgggcggtcaaccagattcaccgtgattagtttcaccttagtgtaatcctttaatttggatagtttaggtggatggttgggcctgtcgcaacgtgggttagcgttggacagtggatagttaatattaattaattgttacaactgtttaaatctttcaatctctgtttataaatgctcgctttatgcaaatgaaccacttcagctcttctttgatgatttccctgcatcatacccctattccggtatgacttgctgagtacagtgggtagtactcagtcttgctctacttttcccaaccccagagttcgagttcgggtcagatgaaggtttctctgaggagtaggcttcgtccgtgccgtcgaggatgcctgtggagtggtgttcccgctgcagtttagtcaaagtttagtcaaggcttagctcctgttgtctttcttttcttccgctgcatttatgtaagactttatgatgtttgtaagacgtggatttgtatgtcaacattgtcgtttgtgtaccccggctggtcctggacggggattttaatgcacattctgcttggaattctattcgggaatttctgggcgtgacacaccctcaattacctcgttctccttatactcccagggtacatgatcaccctctgatataacaagtccagagaagtcctcatttgcccaatcagtggccattacatcaccttcctcatcggatgatgcgtcgttgtccgcttcctcattatccgaatcttccctctccatttcatcaacaattataccgactctatccccctcatccgccatgcccatagcctgctcctaccttggttgattttcctcatgttgcatcgatggtccaacaacatccc

SEQ ID NO: 56857 - DNA, 2228 bp, Oryza sativa
tctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttataggggggaggcaaaaatcgccctcccccagggcggcaagggggccgcctgcaaaattccatgccccctcgccgcccatttgcaagcgcccccccccacagtacaaaatcgccctagcggagggcggcaagggggccgcctgcaaaattccatgcccccctcgccgcccatttgcaggcggccccccgcacagtataaaatcgccctagcggagggcggcaagggggccgcctgcaaatttcgttgacggccgtcgcccgagagtgaacggccgtctgccacgtcattttcgccgccctctgagagggcgattttcccagagggcggtaggcgactacttccgtcaattttcaaaatggaaaattatttttgtaaaacttttaataaaaaaaattataaataaaaaaaaattccccttttcaccgacttcacctcacctccaacattccttgcctcctcggcacttaagtgttaccatcaacttaaacaagaacaaagtaactaaaggaaaaaaaggttaaagccaaagcaagccgttaatagcatcatctcaatctagtgctaaacaatctagatttcaccttttttgatcgagtgctagatttcgtacccagtggtgtaagtgtataacatttttcgctaatctttttatcaaagcttactgtttcaaattcgaattctcaaaaaccatttgaaatttcacttagaatctactctcctgtaaaaaattagtctcacatctacagtaaaaaaattcgcagttctgaatgggctttcgtcgaaaatataaaccctgaataaaatctcccttctctcctggccacctgcattcttttctagcagaagaaaaaattaatttcaccagacaatgaactgcaaagccactgtaaggaaaaaaaaaaaaggaagtgagagactcagccttggtgtggcccacacacagtgagccagcgagtggctgacacagaggctagctgctgctgccagtgggccccactggtcagtgtgcttcttctctctcagttctccaccactcactagccagtgtttttattgctctccttcacttcttcacttcagctcagctttgctctctcctccttcactcctccacactgaaatctcactgccattgccaatggcggctcgccacctcctcctcccggtgctcctcctcgccgccgcctccgcggtgacctcccagtcgtctccggccggcgcgcccagctccggcgcggcgcactcaccggccgcctccgcaccttcgtcttcttccaagaaccgccaccgccacatctccacctcccccgccgcgtccccgtcccactccggcaacaagctcacctccccggcgacctccccggcgccgacgacgtcgcctccgcccgccgcggccacctccccgtcgcccgcattgccgcctcccgccgccgcgccggcgccgacgacggtgtcgccgtctcccccggcgccggccccggtgctcggcgcgccgccgcccacattgcccccgccggtggccgcgccgccggtagcgctcgccccggcgccggcattgtcgtcgtcgcc

SEQ ID NO: 56858 - DNA, 9311 bp, Oryza sativa
ccacctgagcccgcggaacacgcacccaccctctcgatggttcgtgggcccaccatacactcgccattacgatgacacgtggagcccacccagaggccaaatacgtagttttttctctggttcatttatactattcattccaaaatataataaaatataagtcatttttttaatgcttgctttctctattaaagtattatttattgaatcatctactcaagatatttaattctattagatacgtgcattatactatactcctcccaaaacataacaattttcggtgatatggccgttcactcgaaaattattatatttttagttggagaagtatttattagtgtgatcaataattatgtttttttaggttttagtatattttgtaatgtagggacgtactgtacttttttattttacgcggctgatttattgcatgcagtattattatgagactgatttattacagtaataataataattgcttgcgctctctctgactgaaacgtgggcccccatttgtgcagagcgacgcggcgcgagggtacagcgcggtgggaggaggcgcggccctgctgctgatgctgctgctgtggctgacggtgggcccggccttcgtctgagccggtgggggccacctgtcagagagccactgccgctgttactgtcacagtgtcactaccgatcattgcttctgtagagagagagagagagaggtgtagagtttgagagagacgctttgatagtgtcagtattattagtgcaactgctgcggctacttttgcctgagcttgtatgctagtagtattaatacttgctacagtagtattgtgttttggagtattacctgcattgatctgcagcacattgtttacctatccatatgatgatgattagtagtaccactattgcttatcaatgatccacattctgctgcaattgctgtaaaccttcttttcatgaggggttgtcactgacaagtggggcccgctcgaactaacagtaattgtcggtgacctctggttgactcctccatgtgagtgttcagggatgctgctctcctttgcttctcatttttgatactgtaaaatggagtgaacactgcccaagacttttatttaggcaaggattaggtgaaattacagtagctttgttcaatgaagaacaagtgagagtacagtagggagtagtggtgttaccaaaacagcctctggatttgcacttgcagacaggggtatttaatttcttttgtcctctgcaacagtggaagaagaggggtgttaatgtgattgattacagttggcaattttgttttcttgcagtaggagtaagctatagatgttgctgctgtagcatctgtggaggactggaccatgaaaagttgaaaactactacacacatgatatatgcaatgccttgtgagagttcttgttggaatgtttggaaggaatttctacatggacaaatgcataaggatctctaggatgctgacaatactggaaccagataatgacacccccaagtcacaatcacactctgcttggctcctgattgtagttagtggtgaccactgacctgtcctattatatggaaactggaaacattatgataaacctgttattccaatattttgagctagatgtatatgcatatgtttacatggaacatgagaacctgagtactgatgatcttcagaaaataatgttgctcttgtctgatcatgtctagtagatacaaccgttgggtcttcgaacttcacagaagattacaatatcggcagtgctctcctgtctactctagcattatagcaggagtagctgcctagcaagcagtgaaacaagaagaaaacaccaagcctgataaaagagaaagtcacaaaggctggaaaagcgcttcttttggtgacaactgacaagccccatgctactgctactgctgtactgcacacacacaaaagccaagcaatctcaggttgtatttatatatttttggaatcttgaatccattcacagtgttctacacatcttcaggatcaaagaaaaaacaatccttagcttgttagatatgcaaaggatccatgaggatttaggaacaatctttagattttcctttttctgttttgaggatcagtctttgatgattgatcccccacaaggccacaataatctccaaaaggaatgagactctttctccagaaacatcaacttgcttggagaagagacattcgtttggagtctaggacaactttatacaaacccactatgtaaaaaatgaaaagcaaaacctcaaacctctaaatgcatcccatattttgatatcttggtgaaagttgtgtttggctcaatctatgtgacagaaaagagaattcaccctttttgtcacttttcttttgactatatttggttttttatgcaaaaacacaaacctaacccacagcaccatccattgcaagattcagcctgagagggtggtgatccacctcttctgagctgccggagaagatgtcaaccggcgcattggtgaaccggaaactgtttctgttacccaaattaggccgcacaccatgcttgtgatggtcaagatagaccacaacgactgtgatatcgtcgtggaaattccgcctgctgcctctctctatatgtttgatatcagtgtatctcatctctcgtttcctcgccgcttcagtcagcgctgctcgcaccaatcgcttcgctatcccctatcaaacacaagttcacacaaatgcatcagattttgtatatacagttagtcgtgagattggagtaaaccatagcttactgctctgggattcttgaagacgatatcaaccgctgctttatcagttagctgctcccacagaccatccgatgcaaatatcaagaataagtcttgctgcctcaactgatgttctttgatcgatggttcagccgtcatgacaggtcgcttcaatggaatggaacaaacatattgccggaatatagggtctctagcaaattcaggcttcttcaggtatacatctccaattgatctggaaacctgagaatgaaacaaacagtgtccatatgttaaacagcatctcacatctcagatgcaagaaagcagatagtgagtgtaactgttgaaagttttgggaaacgtggtaaagcatactgatgattatggatgcaagtagccagtgtcattctttttatgtaatctaatattccgcaagatcgattaccgtgaggcttaagaaaatacaaaaaggagaaactttacacgagcatggcttagcataagggttagccacactgcacaagcaatcctacttactggctttttagaacaggatatattcctatgtttttatcggatgcaagaagtgctttacaaaagaatattagaacctaagtcacgatttcgagaacagatgcatcaatgtacattgaacatgaaatgaaagtgatgtccgaattttatctaggaaagaggaatattgcctttatccgagtaacaaattctgcacatcacggtataaagccagcaaatgagatgcaaggacataaatatgtaactttgctagaactttggattgcccatcaatttcagggtgtatttaaaagcagccattatgagttgcgatgataaacagctaaatcaaatttcattatattcccttaaaactactatctggtctcacttatgttttgcttgttcataatcatctgaaataacaggaggtaaatttgaattactatgtttctgaaacttaacgtcagaaacctgcaacatgtttgttgcgccttagcttctgcatgaagcttaatagtacaatccagatcacttggcggtgctacacatgactccaaatagtatgccacatacgacaaatataccgactaacagggttgaacggtacatacctgaatgatgcccttaatcctccaaactcctcgggtatagatgactatacgtgaatcatcaggatgctgctcagtgagctcctttctgacctcctcctctgcaacattgtggtcattggatagtctctcagccactacctcccgaccatcaggccccctacggccaaggacggccctcgagtcccctaaattggcgacatatagaacgttatcggtgattgctccgacgaggcagcatgaaccaaccgaggcaatctgtggctgcttgagccaggatcgcttgaccatgtgcaagaactcctcctccgtggcatggaatgccctcttgattgcatcggtggacatgccaccttgctcagatgcaaaccctgatccaattaattcagagcatggcatcgttagtacatcttaagttaatggtgagcacataacttgattgaattatgatgacatctttggtcagaataagtagtaaaccacaaaattcatctcatcaataatagacaacacaatctagagtctaccaagtaccagctggagctatcaaaagataaagcatatgcaaagttctaaatgagcaagtggtatatcaagcaaaaatatataatcatcacaatagaacactatccaggtatcaatagaactggacaaaacaaaggattgttatttcgacaaacaggttattaaattgcaactacacaaagaggagtataaactacattaattaagtaatcaacaaatccaccgaattctacgctaaacctgactaaaaagacgcagaaaactgaacggtcaagttaagcaaactcatataaggaaagaaaaaataaatattacgccaaacaaaaagaacgcattgttttttttgtcagaaatgaaaaatcttaaacctaccaagacattattacgaactgattggttctattctagatcaaatccacacgctaacaagcgaaaataatctcgttatcgaggcactaaactgtggaggtgggggaagaggcgggaggagatgaagcgggacgcctcggggccaccgtggccgtcgtagacgccgacgaaggtcgccgccggcgaggtcaccacctgcccctggtcctccagctccgcgttcgcctgcgccaccgcgatggagtactccccgctcgcgtgcggcttcagctccgcgtgccacagcaacccatcccctcctccccctccgccgccgccgccgcctcgccccaggcacctctccgccggccgcgccagccaccgcagcagcatcgtcgtcgccgcaaagatcgccgcgttccctctcttcctccacctcccgaaaattcccaccgaatttcctccgaaattcgcaccaaaactgcgctgtcgttgctgtctcttttgctcctattgttaggagctcgaaagcttcgctttttttttccccgtttttttctgtttttttaatgaaaaggcgcccaattaagaggcttgagacgacgattgaccgtccgattggctctcgatgggacacgtggacggcccacgttgtcgtatcgcgacgacagtgtggatggtggggccctgggagactgacaggtcaacgcaccggccatgcggtggtggggcccacgtggagtggggagacgagtcgccgtggcggtcgggttggcggcgaccgccggtcaagctagccagcaagtacagtgtactacacgtacccagctctctactacgcggctacgcccgagaaaatattaaaaaatatttcctctatttcaaattgatctacatatttcatagatatactctctcatactatatttactctagcaacaaactcaatacatgcaccatccccactattttctagccaatagcaaatcaagatattgcatgtgggttataaatgcttgtatgcatgtatcaatatccatttactccaatgcaaaaataacgaatagacctaatgaatgaacacaaatatgtagatcatttagaaataacctcaaaaaaaaactatatgtagatcaatttggaatggagggagtagatatataagatttagccatgccattctgagtgaatttttttttactttcggatttgaccatgagtaaaagttttatacaaataaactttcaacttttccgtcatatcattccaatttcaatcaaacttccaattttagcgtgaactaaacacacccaaaagtaaaagttttactacctttatgttataagctattttgacttttttagtcaaatttacttaaatttgatccaatttataaaaatattagcaatatctataatattaaattagtttcattaacaattaatatttaatctattttcaaaatatatttgttttatgtcgaaagggttattatatatttttttctataaacttagtcaaacgtttaacttgaaaaaaaaatcatataatatgagacagaagggtgcttagggggaagtttttagaatatatgaaacgtttaactgtatgtgtccaatttttttttattttctacgatatttgctagttggtgtgtacaaggtgtgcacggaaaaattgtgtgcataggatatgttcatgtactaagaatgacgtggataaatgttagacattcattttttttattattgtacagtagttttcatgtttacactaaggtttgcattatatatatttttctgtattctacgtgaatactgtcttgtatgtactatgtatttatacttatctacggaatctggtcttgtatgtacgtatttatacttatctacagaatctggagacaagtacgggtgatagagatgtcgaataggttatatagaaagttcgttgagaatgtgacttgtgtgatcaggacagagatctttgctcactgaatttcgtcaagtatcgattctgcctctgaaagtctgaagtctgaattccaattttccagatgacgaacaacatacttgcagaaggaacaaaaacgaatgaacgcgacacataacaaactgcaatgctcagctggattggcatcagcaagacgagagcaaaagcaatcactcactttcagattgcacaacatggaagagcaaacaaaagcttccatggaaaaacaggtagcagctcagctctcactctatatgcatggagagagcatgatccagttgcaaacaacccagtcaggttcaagacacattcatggtacagtaagatgctaactttctgaagcctcacacagtgacaaaagtatcacagatttcacagcctcatcagcaaaggggggaaaaaacttggtactggaagaagagcatgtgagcagtgacaaagttaagggcttaaagagaggttctacagagctgggtttagtttcatcctcaaattctcatccttctgctgttaggagcacgctggccctgcagtaggggcagtcgctgcgagagcgcagccatcgctcgaggcaggccgagtggaagatgtgcttgcaccgcagctcgaggagcccatctgcatccccacatctctccaggcatatagagcactccgttgaaggtcccgcgagttcgtcatcatctgttactctgcagcttgctacttcttgtgtaggagccggttcagaacaatgcgcgatgaacgtatgcttatctgcggtgttgaaggtttcagctgtgctctcttggagtttgcagggagcgatcgatacgtcagtgtggaagcaactggttagactgctgaatatgctatctgcggtggtggagacgcccggggctactccaccatgaatggtttctgatgacaacgatgtattttgcctgcaacaatgggatggaatttgtaaatgtagattctctgtagcttaagttctaagctggaggagggagtgcgaaaaagttgatgcggaccttcttcctgataagtccacgctgttaagcctctgaagtagccgttccctagcctgctgaacggaatcaggaagccggccatgatctgatacgctgcggtttagccttgagctggagcccgtgctgcctgcttgtcctgttatgtttccagcagatgcgacaccctttgaggtatctcttttgcttcctggaacatgttcctgaccctagtttcatcaatgacaaatgttagaaacagtggataattgctgaagaagatttcacaacaatcatcaatacatgaagaaacatggaaaaccatacttatttctgccgtgaaaatgatattgttgcatactaagaaagagtgcagataagcaaggggcacatgaaagcaatagtgttcagtaaaaagagatagtgtccatatgattatttggtgcatgagcacacttcacagttgtctgcacaccacaaaactagaacactggttcagcaggctactacgagggctgatacttaacctgctaaaacactagaactatgttctgactgtatatgtttagtaatgggaaatctagtccataattttggcgcgaagacaagcattagttagtcagaaacgattgctactaaacaatgggaatttccataaaaggttttgaaatagcagtttaccagcaattaacatctaattagtactagtatgaatgtaaagtactacaggcttaattgggctactaaatttgagataccaaccaaagaactgtctttgtcatttaaccataaatctacattgaaattagttgaacctctcagaaaaagatttcggtatatgctactagtattccacgagtaccttcttatcatggttgtagtaaatacccttcacgagttacagcacatgtacagatgtactctacctagtttgaaaaggattgtcaaactttctactagtaccactgtaccagctgatgaattccccagaacaccagcaaacacattaatgtttcttgaagaacaaaagatcaccgaacccatcatttacactcataatcatagatctcatcaacgaccaaatttactaacacataacttagattttgcgagaaccagacttgacatttttttttttgagaaaattcgatctatagcacagaagagaaagcggtaccaaaaaatagcacataaatttttcgctttcggcgagaagcacaggccaccgtttttccttcgacccgtagcacttccgtcacattatgaggtaacggcgttagatcgaagtggagaaaaatatcgttggactcatttgcccttcgtctcttctcccttattccccatttcctccctctttccaagtccctatacgaagtcccaccctctgctaccgccgctgcagccatgcgggcaagcgccactgcacgctccctgaagggcttccccttgtcgccgaccacggcggcgatcgccttcgccatctgcccagagtcaggcacggcgtccgcgccctccgccaggtgcatcgccacgccggcctccaccagcaaaatcttgttca

SEQ ID NO: 56859 - DNA, 813 bp, Oryza sativa
caagtccaaagaggcggcctccaaggatgcgaacgtgttgtcaacgacgcacttggtatccaagctccacagcaaaggaaccatcaaaagagaatgaacgggaaatagctgaggaaatagggaataagggagaagagatgaagggcaaatgagtccaatgacatttttctccactcagatctaacaccgttacctcaggatgcgacggaagtgctatggtacgaaggaaaaacggtggcctgtgcttctcgtcgaaagcgaaaaaattgtgtgctattttttggtaccgctttttttcttgtgctatggatcgaattttctcttttttttctatgagagccaaacatttggttactaacttgccatagatctgacaagggcatgcatatgaaagtgcagatgatctgattcactgatgcacgcctcagttcatctcaactgaccacaactaatcactctaccaaagcttccaacacaaatcttcactggggtgagccctacaaaacaaaagatgaaattctccacttctttagttcttacaagctgattgctgatccaagtaccagattggaactcccctggtgtctccttcctaggcaaatctctaaaaccatccatttccccttccaaatcagcaatcaaatctcaatctaaaccctcccttctaaaatcgtttcttactttctttggaacctcacccaaatcgccagcacttggccacaacgccacaaaaccatgaaccacaccatgattctcactagctactcctaagctgaaatccaataaacactggagacgaaatcctcctccgaa

SEQ ID NO: 56860 - DNA, 6096 bp, Oryza sativa
ttcctgcagcccattaacaccaccttgagagtgttaggtacggttagattcttgtttaacttgactttgcctcttcatggacagcctaatttggtgatttcttttttctcgataatttgcaaagagaacccgaacagcatcttcacactatataaatctgtaaatctgcttcatgaaacaccataattggtagaaggggtaaagaagaccagggtgtggcctctttttagctttgagtgatcaaagctaagcaaagctaattagaggcacttatgaaagctaattaaagtgctttgaatctaatctaatctaatctaagtacggatttcacaagtggaagctggaaacagggagcaaaagagaccctgtccggtccaggtgagccctgcgtgcgtgtcacgtgctgccgctaagctaacggcgttaattggtggcttttccgtccgcccggcatcagaagcttcgctaacggcgccgtcatgggacggcgagccccagtgtggggcccacggtggcaggtctggctagtgtgctatgctcacctcactagggtgatgggtaggctttggctccatcacctttgtcattttcttttatttaccttttgttttacaattcatatattggaaaattctaagctgcccttacatcactatctacagtagttggtgttaaaataataaaaaatatttatatatatagtttttttatgtaaggattgatttgaaaaatgtgtctcagcataaaggttaataggtttagttttgcttttaataggttaggttctattctagtattatgtaaagcaacatcatatctacatgtcattgttttgattttatacataacacagttaggacaataaaacacaaccagaagctaattagatgttacttttcgttttacaattcataatttggaaaattctaaccgccattagaacactgtctacagacgttaggtgttaaaatagtatggttgattatgaggatcgttataaaaaaatgtgtctcaacataaagattaataggtttagtttttcttttaagagtaggttggattcttcattttaatatgtatactaatgtcatatatacactgtcatccttttggttttatccaaaatataatttatatagtagaacagaatgacatgacaaaacattgattgagttgtgtgtcttattatccaatcgaagaagcgtgttctgaagcttaagcaaaccctacatttcttgtacggttgcatgtctaattaaaattctcataattcaagatttaaccccctccagaatccttccgcgcattcaatcaaagtcaaactagaaaccacaaccactccaaacaataccctatctaatctaagctagggtcgtaaaataagacaattcagtacgactattaatacaggttcagtgagcaacccattatgtaccgttgatatcgtcaacattactcgttccccgaccgcataaattccgtcattaccgattaatcgacatcgactcttttcaccccaagagtagaagaaggtgaaaaagaaaaattacagtgctaggtaaaataccaaaaatagtgtaggaccatttataaaaggggggtgagttcaccatgggaggtgaccagaatcactgcagcacactggcaaccgtataagcccaccgcagtctcctcgcttcacacactcctcgctccactgccatttcccgcgtagccccctcggcttctcttacatttacattcaggtcctccccccctcacggttcttcacgcgcgcgagggcccctttgttttctcgtatttacaaacaggtccctcccatggacaagaagcagggcttcttctccgcgctccgggaggaggtcgcccgcggcctctcgccggcgcgcgctcgccgccggtcgcaggcggccgccgcggcagaggtggccgcggcgctgcggtacgcgggaggtggtggtgggggggagatgctggcgccgctcatggagggcccggatccggagtcgggagacggcgggagatcgtcgtcgtcggcggcggcggcgaggagggaagggtgggggcggtgggtgcgcggccagctgtcgcgcgcgccgtcgacggccggcgcggcggtggtcgcggcgggtggtggcggcggcgcggcgaggcggaacgacctgaggctgctgctcggcgtcatgggcgcgccgctcgcgccggtgcacgtcgccgccggcgagccgctcccccacctcagcatcaaggacacccccattgtaagtgctcttgggtgaaatcctctcgagtgaaaatttcggtgaatttttttttgtggattttgagttcttggattaattaatttctaaagtcgccacctattcaattatttcttcttctagaaaaacctgctggttcgttaggaagaaacaatatgaaaaaaaaaagaaaaagaaagaagaagaactggttcttgatgtgatgtttggatgtgatacattttctcatatccactgtacaaacggtttattcctcatgtagtgttctaccatttcactttcagttacccatttactgaaagaaaaaagaaatcagcaactctttgatgtagttgtaaaaagtattttgttgtagctgtaagttttaccattacgatgtgttcttgcaggagacctcgtcggcgcagtacattctgcagcagtatctggctgcctccggggggcagaagctgctgtcatcggtgaggaactcgtacgccatgggcaaggtgaggatggtggcgacggagttcgagaccggcggccgcgtggtgaggaaccgcatggcggcgcgcgccacggagtccggccggttcgtgctgtggcagatggccccggagatgtggtacattgagctcgccgtcggcgggagcaaggtgcacgccggctgcaatggcaagctcgtgtggcgccacacgccgtggctcggcgcgcattccgccaagggccccgtccgccctctccgccgcgcactccaggtagcacaccggggagcctgccatgtcttgtagtttgatgtcgtctgaaatgtgccattgtgtgtatatggtggaagaaggtggtagtctaactgaaattgttgttggttcatattgtatcttcagggcttggatcctctgaccgcggcgagcatgtttgccggtgcgcggtgcattggcgagaggaaggtgaatggggaggattgcttcatcctgaagctgtgcgcggaccctgagacgctaagggcgcgcagcgaggggcttgcggagatcatccggcatgttctctttgggtatttcagccagaagactggcctccttgtgcatcttgaggattctcacctcaccaggattcagtccaccaccggaggggacgcagtttactgggagaccaccatcaattcgttcattgaggactaccgcccggtggagggtataatggttgcgcacgctggtcgctccgctgtgaccctcttccgtttcggagaggttgccatgagccacaccaagactcgcatggaggaggcatggagcatcgaggaggtcgcgttcaatgtccctggcctctccatcgattgcttcatcccgcccaccgacatcaagtctggatccatcagcgagaccgtcgagcttcctcatggcgagaagagcaaggttggtcttctccaatgccatagtgctaaggtggccgcgttggagaaggcagacgacaacgtcgcgtggagcggagcactgcagcgagatttcaagtgatttgctgtctgttcatagttgcttcttgcagtgccagtgctactgactcattttgatggttgtagggtagcaagaaagagccaagggaggatgatttggagctttgcaaattccaaatgtcctgtaaataggaagcttaaggaattcacatggtcttccatatccctgaggaggcctattgtgaagaacccttacctatcttattcagatatatggtagtaggtagttgttagtaacttctggcgtttttttttgtcggtgccttgtggaagaaccaggaggggtgtttctcatcctgcacccaaccacatggtaagggatcatggtggtggtgctgttctttctcttatagcgatactaatttatcggagcccagcgaggaagaagggtttcttctctggcaattgagagtgattttattctgattttagcagtccagtgtgcttttggttggtgatagtctccggtcaaaactaactttaggtgaaagattaagagttctgaattgctgttgctctttgtttagggttatcatgatgggtctctggttgtttttttccctgtccttccttcacatctctctttatttatatagatggtggttgtattctacagaagttgatgtaagccagaacttctaatgaatatcatggaatgaattgtttctttttgtggcttatggactcaatttgcccccacactcctgcatgctaaagcaaatgatgttagcttttgaatggtaatattgttagttgtataatgcaacatcaatgttagcttttgccactgcttgcattcagctttagtatgctgtatatgctggggagtatgattcattaatatgatggcatggtccccatgtgcttcagcctcaggtgctgtgatgaatacatgtatttctcttctttcttatgaggtgtaattagctttgccactatgatactatctttttgtgctccattccctgagaagcgttcagactttcatcagcacaatgggtgccaccactctgatgccattagcattgaatccattgatgatctttgcaacactctctttcctcctgtgagttggaatagttttattcttagggctgtgtgttcttcttgggaagaagagatcaatgtctctagtttaaaaaaaaattatcactgccctgcctcaagtctgaaccttctcagacccttctgacctgtcctctctggtcaaattcttgtagattggagctttgcagaagtttgtagcacttgttggagttttgaaccattcaaggccccttcgatttgtatggaaaacataggaaatttgtagggtatgactcctattgaaaaatttcctatttggttctttgagacaaaaagattgggacttcaacaatcctatgaaattcatgtgaaatggcacaagacaatacaatttcgatttgacatgaggaccaacctcatgaaaacctacattttgttttatctctgctctttttctttttttttgcaggagttttatctctgctctaattcgtatatttttttcggtctattcaaatggcccttcctgtatttttctttcttttaaatatttgttttacacttgcgttctcattaaaatcacatatttttcctattatcccgttttctcattacacatgctggaattgaataccaagaaagccacacattccaaaggaagcctagaaaagttcatacaaccatactagaatggaacaaagcaaactgaacatgccctcaagcatcactaccttagcctagtttgacaatgaagccgcctcctacacacaaaaggctacacaagaaaagcatgcaagaacaagctcaaccctactcagctactatccagcaagagcaaaattattgcaagccgtttaattgatccttcattttcacacatggttccaaaccggaccctacgtctccagaaaccgaagaaaaattgcgcaaaagatctcccaatgcattgctgaaatcaatcaaacacacatgaatccagcgagtttctgcagctttttctccttctgaaaaccgtttgctgcatttgtgtgttttaaaagttcagagatcgatcaggaccacacgcacacacacacactgctgtcactggagcactccaaggttgttaagagcagagagcacttttagacttggactttgaacagcaaaacacacaatcaattatggagagaggagatgtgtgtgtgtgtgtgtgtgtgtgtgtgtgtgtagggcattgcatattgctctctcttttgacttgggtgagctaaaggtgaagtcttgatcaaaaagttcagagggaaaagttgccctcacaagaaaaaaggaaacgttgcc

SEQ ID NO: 56861 - DNA, 2167 bp, Oryza sativa
tagagatgctgtaacctcagtgtgcagttatctctgtttctttcaaaatgtatccattattaaaataaacataatagcctagatttagattatgatattacatataattacaaaatcccccaatacatcatgctgtatctgatacgtgcagcacagattagaaagtgcataagcactaaatagagcaattttagaatcttaattgtaaagcaatttgcttatccatgggacaagctgagcgtgatgaatgtattcactctcttaactgagatttacaatataaaactggactgccagctatgcatttatccataccgacctctaaaattgcactcacacttgcgttatacacaaaggaagtatcatcctaggaacagaccataggattgtatggacttgtctacatattacatgctagcaggattaaaataggtaaaattttcacatgcaaagaagatatcctttcgagcaaaatcaaagacacaagaacacaccaaagccatcataatacctttggattatattctgcattgcgtgcttgcaaagctatagctttgaggtctaatttgcaatccaaattgaccgtcgacacgatgtttctgccatcaaaatagatgagaacacataatgaggacttcaatttccttggtgagagtatccaaaggaagcatgataagccaaaacagagtggaacacatgcagtctaccagctatgatcccaacgctgaaacataaacaacccagaaaggcagcaaaacaggcatgcgcacttgtgagaacacatggaagcaggtacactatgacaagcagcaatataagcatgctcgactttttctgcaatgcacaccagcatgcaaaatatacatgcctggtagcaatgtaggcaaaccccaaaaacgtttcgatgcacaccagcaagtacagcatgctaataaacagccaggtttgggcatattggcccgtacaaacaagtataaaacttagtggggttatacatggatcaagcctaaatatgtggttcacttgttcagagcttgatgctgtctaaaaacatgcattgacccattgtcaactgtatgtatcacatgagcaccataaactctccacagacacaatacctccctctaaggttgaaatacgtgatgaggggaaagaattaaatcctacaatttagatgcatgattgattgattgattatttatttatttataaaccttaatttttttttaaaaaaaagaacagctgacaagctgattctccaagactccaaccatatgaattcattcatgagaaaacaaacatctgtccagctaaaaagagttgttatgaagaccggacaatggatccgtcacagcacaagcacatcggctgcctctatttcttctcgtaccggactcgcggatctcagatcgcccccctttttcatcaatcaagcaaatcagaacctcaaacatgtagtaaccccccaagctaaacctaccaccaatcacatcatttgcaacaacaaataatatccccggcccccaaaacaaaaccaaatcaacagcgcgcgacgagttaaccgctccacctcaaactcaaccagctcgatgaacccgcacatacagatccgggcgggggcgggggggacttactggagcgtggggatgatgccggaggggtgcttgaccaggtccacgggctcgctcccctccagcgccgccgccgcctccgccgccgcctccgccgccgccatacacacccccaaaaaccagatccgcaccccacgaatcaatcccaccggtgaagaagaaggaaaaaaaaagggcgggaagagagcgcgcgcgcgaagggggagggggagggaaaaatttcgaaatcctaggtcttttatatagcgatcggaaatcggaagcgggagagggggggagagctagggttatcgcgaggagaggatgaggaggggaggggaggggagaaggtcgcggcgagatgtggatgcggatgggtggggtggggtggggcccagcggatgggtggacggggtgcggccggtcggcggtcgaggtcacctgctgcagccggtggccgtgtggcattttgtttttttttggtttctttttaaacctctttttatttttaggttttcttttcaaacctggaaaaaaaatgatagtagtatatttct

SEQ ID NO: 56862 - DNA, 974 bp, Oryza sativa
ttaccgcacacaaagcagtcgcccttggcctttcccttgcctttcttcttaaaattggttgtagcctttggtttgacatcaggcttgactttcttgttgttgttgttgttgtgggatgcgtgagggttcttctgttgcaccaaattggtgctagaacctccctcgatatttttgccccggttgtcctttgctctcgccttctcctcaacacccaaagagccaatgagatcagtaacactgaactcttgcctcttgtgttttagagaagtagcaaagtccaaccaagaaggtggcaatttggcaataatgccacccgccacaaacttgtccggcaactcacagttgttgttctcaagtttctttgccagcatctaaatctcatgagcctgttccactacagaacggtcatcgaccatcttgtagtcatataacatctccatgacatacagctcgctgccggcgtcggaaactccgaacttggcctcaagtgcatcccacatgtccttccctgaaggcatgtgcatgtacacgtccactatattgtcagcgagtacactgatcaatgctccacggaacaggcaatccgaagcctcgaacttagcctcctcctcaagagagagaggcggttcacttcgtttgccccgtgaaacatagaagcattgcatcgctgtcaaccacagtagtgcacgtgctttccatctcttataattagaaccatcaaaagcatgtggtttcagtgttgcagcaaagccaactaccgaaaatgacctatcaggtttttggattgttggaactttggtcataattcggcatattttaatccaaaataacaagataataaacatgatatttacaatgagatttgatctagtgatagtggtgaatgtaatcaacatgagcatgcttaatatagaataagtatcaacaatcacataataacacaatgttgacattgcgatgaacattaacagtaa

SEQ ID NO: 56863 - DNA, 1498 bp, Oryza sativa
aacacctagttggtgttctgtggtcttgccgacgttgtcatcgctcagctaaggctagtcgctgccgaaccgctagccctagctggtcaagggaggatgaattgtggggaagagagatagaacgagaggagaaggggtagttcaatgacatatcgcgtaaacacatgaaaaaaaaataaaggatagtaggtcttttagggtggagtggagcgggaaaaacccagctcaaccctcgtagtatgattttgtggagcaactctgctacctccgctcaaaaattgaaacacatctctaactatagggaagttggagttgagagctaaaaatgtgtcaaacgggcacttagttttctcttattttgagtggcttgatgtgtactctagatacgttgagtggtacccaccatcccatataaaaggccgtaaaagagacgagagactgtttgcacgtcacactcacaaaagcctatccccacgaatacgggtggacagaaaaagatcgaaccgaaaagactgagaccgagacgagaaattcggtcatcaattcggtactaggcagtgaaagaccgaattttgttcggtcaattcggttagtctctttggttaaccgaatataccgaattaacagaaaatgcctaaatgtaacctacagtccactaagttcaataggattaaactataactttcacatccctacttcttctaggcatgcaatctaataagagtctttactcatacttgcttacggattttcttttttgtgatttttgtgttgaaaatttccattatttctttgcacatatgaaaataatgctgaatttcggtcagaccgagaccaagaccgaaaagatcgagaccgaatttgtcggttctaacattttttgcgttgaaattctgttttcacttttcaagaccaaagatcgagatcgaaaatttcggtcagaccgaatgcccacccctacccaagaagatgaggcgggcgagtgtgcggtgctgtggagtggaggtggtgttgcctagtggagtcgtgcagaaggagaatagatggggattgggatttggggagggttgactagggttagaagatatatatatacttgttcattgggcttcaattctatgggtcaaatgacggataaattttagaattggtccctaactccaatgaatacatgtcaccatggaagatgggaatgggtcccgatggtgatgagttttgaatcattaaatttcccataaatgatagatatcaaccatccccatccctaaatatgaattcaccgtggggaatcagtgattgggtcccgttgccgtctctgtacggcagtagtacaagtgagaggaggtttttccggttgagtggtggtacccaccatcccttataaaaggcccgtaaaagagacaagagactgtttgcgcgtcacactcatcacacaaacacaagccccatccccgggaagacgaggcggtgtgtggcacgtcacgtgccccaccccgct

SEQ ID NO: 56864 - DNA, 13659 bp, Oryza sativa
aagctgcggctgttaacggggccggggatcctcatgagcatagcgttcgtcgacccggggaacctcgagggggacctgcaggccggggcggtggccggggacacgctgctgtggctgctcctgtgggcgacctccatgggctcctcgtccagctgctcgccgccagggtgggcgtcgccacggggaggcacctcgccgagctctgccgcgacgagtacccctcctgggcgcgccgcgcgctgtggctcatggccgaggtcgccatggtcggggccgacatccaggaggtgatcggcagcgccatcgccatcaagatcctcagccgcggcttcctccctctctgggccggcgtcgtcatcaccgccttggattggtcagtcttgtgaattttttttcttttttgttgggtcggtttcgattcctgattggtttggatctttcgcatggctttggtgattgtgattgacgaggtctagatcacacaccatagttccaaaagattagaagtttgcttttctttttccctatcaccaacttaacttgagatgcttccaaaagaaaaaaaaatgctgctgctttaagttcttgatacttagtatatttgagaaaaaaaaagaaatgtgttgttgctacttgctactaaagagtttgggtgtgatgttagatcatgagctggatttgggggaggttttgctgtgactgttataggctgctgattcgttgttttcgtttaatttgtagcttcacttttttgggcgttggttcagttcttctcatttcgctgtaaaccacagtacttcctttattaatttcataatttcgaggattgttcacttctcttaaaattggcggcgtacgatcactgtgttggagataactgtactgtatattgatagacttcatattcatggtaccctataacgtaggatggttgaatgcttgaggaattttagctttcgccccaattcattttacatgaacacagtctcagatctgttttggctgcgaattcatgagaaatgaaaaattaatgcccaagttccaaatatggataatcacggaacctgtacctccgaatttttcattttcacaattccaagctgctgattactcaatgatgtgatgtttttggtcaatttaacttaattttgtcaggagaggcttatgatagttttgggtttgtcctgaaggaatataaagtaccaagttactgtgctgaccttttcatgatggattgatgctgctgacagctatagactgtattttaatttaactccgtactcactgcttgtgcttatgcaattctttgacgggacttttggttctgataaaagtaggacatgttctgttgttgtccatcaagagttattttatatatctcgttctagacccttgctttgattaatgatatgattcagaagtctgtacaagtgctcacatgttcactagcactaaaaactactaattggattagaatattaatcacttgctagtttctgtgaggatttctgccttgtgctttgcacggtgctaagttaggtctgtttcaaaattagtattcaaagtcatgaaaattgtggaactatctttgtttggaccgtcacttacgagatgtttcttttttttttttcagtttcatttttttgtctcttgaaaactacggggtgaggaaattagaagctgtatttgcgattctaattgcgactatggctgtctcctttgcatggatgtttactgataccaagccaaacatgaagaacctgttcataggtaaagatcctaccgatcggcagcttttgacactacaaaattgtcccacactcttgacccattgattacgcataattttgtctgcaggtattttggtcccaaaattgagctccaggacaataagacaagcagttggggttgttggatgtgttatcatgccacacaatgtgtttctccattcagcgcttgttcagtcgagaaaaatagacccaaacaaggaacaccaagtccgtgaagcgttgagatactattcaatagagtcaaccatcgccttggctgtgtccttcatgataaatctctttgtaacaactgtttttgcgaaaggattttatggcacaaaagaagctggtaatattggccttgaaaatgctggacagtatctacaggagaagtttggtggagggtttttccctatcctctacatttggggaattggactattagctgcggggcagagtagtaccataacgggaacatatgctggacagtttataatgggtggatttttgaacttgaagttgaaaaaatggatcaggtcactcatcacccgaagctttgcgattgtgccaacgataattgtcgcactcttcttcgataaatcggattcgctggatgttctaaacgagtggctaaatgtgcttcaatcaattcagatcccttttgccctgattccgctgataactttggtttccaaggagaaagttatgggggtatttaaaataggtcgaaatactcaagtaagtcgtcattgatctgtgatataatgcctgtcctgttcttcaagcattctgcatccttcatttcatgagatggctatatcttccattgacagcataatccagccataaataattgtggtagtcaataatttggtgttctattacggaaattatagatcctacttgtgtttctgtctgctcatgattgcacacttcgctgcaagatgccactgccactgcaaagccttgagaaaaagccatccctgcatttaggatttgcattgaacatgatagatactaaatcagcaatgctgtaggacatatcccagattcccacctgtatctgtctgggttcttttaggatctgcattgaacattttatatcttcaaaccagcatgcctacgaactatttgacttattagttaaatgatggcgtattactgctctagtgacattcttgctttgatttgccattgttgaggtgtaaagccgatgatgttctgttctcactcagttgtgtcaaatttatgcaggctgtgacctggacagtggcgacactattgatcacgatcaatggctatctcttgctggatttcttctcttcagaaataagaggcctattatctggctcaattctctgcgtggcagtacttgcttatgcttcttttgtattgtatctcatcctgcggggtaccgagctgccaaatcagatcatcacaactatacgcaagagtttttcatgacaaagataaccaaaatttggccgttttaaacaccatcataacatctcaaacgtatagagaaatatggacttggggattggaggagatactcactgtacagtgacttccaaaagggttagctgtttgagaagaagtgcaactgatgtaatcttcatttcatttgttgtaacaccctgactgtgtcgtcctgaagcaaaggaaatacaaagagagattaatgaaatgatgatcaatgtcgttggcaaacttgctctcttttcttctgttttttttggttgcttttctttggacgtggagaacatttctatcttcacatcgtgaatttgtgatgcatatacttgtctgaaatgcgataatcccaaatcaagctgattttgtattgattttaatttgctgtcggtcggtcggagatgaacagacaggcgtctgttttacaagcatcagagcccaacaataacagtgggcctgacgtaccttgcaactaatgcaaatgggcccaataattacagatgggccggcccacgcttccatctggaccaaagtacccatcgtcttgaactctcgcggatatctggtgggccgcgacctggaaatgtacaaacgcgtccccgggccgcgcccccctcgctaagcagggcggttagcgcctaagtgcgactagtttagcgtgattagttacaaacaaataataaataaatagtggaatcaaaaagttttaaaatttaagttgaaagttttaaatttgaaattaaaagtttcaaaatttaaattgaaaatttcaaatttgacttgaaaactttcataatttaactttaattttttaatattgggtagactttttaaaaatttttgagataaagttttaaaaattgagttgaaagtaaatctgatttgaaaatttataaatttgagttgaaagtttttgtatttgattcaaaagttttgaattttgagttaaagttttgaaattggagtcaaaagtttttaaaatttgagttgaagtattaaaatttggtttgaaagtttttaaatttgagttgaaagtttaggttttaaaaccaagagcattaaaatgttggaaaatgaaaaaaaaaggaatgaaaacacatggccacgttgggtcgaaaaaaaggaaacacgacacgtggactagtgggccaggtgagccaaaaatcactcaaaaagggtaacacgacacgtggtctggtggcccgaaatgtgtgctcgacatggtgtactgacgcgtgtgcgccaaataggaatttcagttcgtcattgtggtcgctatcattgatgggagtggcgactggtaatttgctaaaagaacccgcattgtccgtacaatggaacatactcatcagcgtcgttcccttcgctaacaacggcttacgttggcgacggcaacctcccgtctcagtaatggtgcgaggctaaccaggattagatctactgttttatcgaaactgctaaatttaactaaaaaaaaaagaaaccgctaaattaatcatattccatagaaatttggcgttaaattttttgggttaattggatcgtgccattattattttggtgattttaaaaaataccactaatatttaactatttgaaatcatgccactacaatttaatgggttatttaatatgtgccactaaatttcctatcaccgcactaaaaatttcttttggaccaaactgcccatgccgtgttccttcttccccttctctttccactcctaccatctctctctaagggcctgtttgggggagcttttagctgctgcagcttctctcagaatcagaaactccctcaaacagtccagttttttttttcagatcctgataagctatagaattcagaaaataaactagaagccaaacccaatttttttaaattcttagaagctggctactaatgcttttcagaatattaagctcccctaaacaggcctgatcttgttcctgatgcttctccggttgagaggcccggtggcacgaaaaggtacgcggagacagaggctcacaaaggcccaggcacaaaagcagagctggtgcctgcatcgtcaagctcggccacggggagcatgcagcagcagcgctggaggagttgacgggcattgtgcaacaacacctgggaattgagggatccttgctttggtgagcattttcacaaacagttggcgtgcagcggaactgtgaagagattgattgaaagaatagacggcttgtttggcaacttgagggaatgggattgggtgtttacacgagggaattgatggtgagattaagatgagaatttgatttttcatcccagtaccttgtttagtagaggtggtggaaattgatagggagtttagttagagattaggttattaatgaaaacggatggctgagatttgtttaggcgaagtaaaggaccccctacccaggtattgaaaaggagggagttcattccttaattccccatccccatcccaccaaaatttccatgtctcctaaccaaacaaaatatttaatagcctcatccctctaaacttccaatccctcctaaaaactctccccaaccaaacgggccaagaggaggtgcgaaggtggtgtggtgggagatggtttccagcctcgtcagttgtgggaggaaggcttcctcatttggtggcgtggctaccacctccgctgatggttttggtccggcctcactaccaatacccgggaaaccatctctgtcggccgagcccacggtgagcgtcctcctcgccttgattgccgcttggggctaacgtctcctacgccaagttgatgcccgacggaggagatcgggacgaagaaatgttcctgcgtcatccgggtctagctccatcgatgggaaaagatgaatgggagaggagagcatctccaacagtctctctaaatctgactctccaaatatctatttggttaattctcgatttaattaacatgtcaaatttgttatttactccaatagtctctccattcatcctctctattttgagtgtatggcagtgggacccgtatgtcagcctcatctctttcttcctcattttctccccttttcccgagaatctacacgagcatgggtgagagcacggcggtgaggtagtcccccgtggcggcggaggaggggcagcgtggccgccgcccatggtgccaaggcttgtgcccccaccgccgctgcgatgctccgctcatcgggccactccgctcgccacctcttcctgtccccggcccctcccctatgccctcgtccgtctccgcctccgcctcggccctcgccgccgccaccaccaccaccacctcctccaagcaccgccgcccggaggtgctctctgtccttcctcgccaccccctccgcctcctcagccctcgctgtcgccgccgccaccgcccgaaggtgctccctatccttcctcgtcagaggtcgatgaggacgtcgaggacgcgctctcgctcgacgtccgcgcggcggcaacggctcgtccatgaccgtggtgcggcagcgacgaagatgacagtcgtggcggacggtggcctagatgacgacaccgcgacgggtggtggcccagacgtcggcagcgcgcttatggtcggcgtgccctccagttcgcccccggccgatgcgctagtgggtggacggcagagagaggaaggatggggttaggagtggtggtgggacccacctttggccagtggaggaggctggctacattcggccagcggtggagcaatttgaccatccagatagagagtctattggagcttgttttttctctacgttggccaaattttaacttgaagagccaaattgagattctgttggagatgctcttcggggtgcaggaggaagatatggacaattttgtcaaaaatattttctaagtgcaatgaaagggtatatagtggcgcatctcaaatacctattaaattgtaatggcatgatttcaaatagttaaatagtagtggtatttttcaaaaccgtgaaaataataatggcatggatccaattaaccttttttttttttgcaattatgacattgtagggtttgcttcatgctaggtctcctactctacatccaatgaccccagtcaaactttggctattgacaatggttcggcaagttaggttttagggttcagggtagggacgggcaagggaagggaggtgggtgggatgaggtgaggggaggtagttctttaaattagagggatggttgtgggaggaggcggagcgaggaggtgggggtggcgatggggagccgtcggaaatatggatcaaagacggtgtgcctggacatctcggcgccgctagcttgagaaggaggaggggcgggggaggtctggtggggcttgccgtgacaccactggggcaatggtggtggcctggtggcataaacgagggaagaaaaaaaaaacgagaatgctcgttatcgagcactcgggagggcgcagcaaaaattggccgccgccctgacgcgcgtgcgcacgcccctaggggccccaccacgttttccctgccacactgccacgtgtccccaccacgcacgatgttgcaacaaatcatccacatattttagaaaccctctattaagggaattcgttttattttttgttgcaaaaaaatgttttacctagtgtactcacaatgtttcactatgtatagatctaatgttgcaatgaacgaaacattcttttgcaacaaatcacccacatattttggaaaccctctattagagaattcgtttcattttttattccaccaaaaatgtttcacctagtgtactcacaatgtttcactatgtatagatctaatgctgtagggaattgaaatattctttcgctatttgctgaaacattgtttttatataaggtgaaacaacgcttgatttaaatgattgaaacattttcgatatatttggtggaacatcgtgcaacatttaaaaaattcaataataagctaaaaaaaatttcgccggaatatatcaatgtgtggtcttgttttgaagatttaattgcaacaaatttaatggtgcaatcaaatcaagatttggataagtaatttaagagaaaattagtttaaagtcattttgcacgcatgtgtgacgcgcccgatttttacacatttggatcggactaccgatccgtagtcccctcagaaaaaaaatatggaggacgggggagtttattgtgcgtaaatctcaacacgatggaatggttcgaattgacatgattttaatgttgacggcagtagcagtcctattttttacattacctaaaacctaagccgacgaccactacatattttacttccatttccatggataatcagactaatcacacagtgaccaccgtccaccggagcacagtaccggcgacatgccggcatccaccgccatgtccccgcgcctccgtctccaccacctcctcctctccatcctctccgctctcccaacctgccctctcgatcactccacccccacctccgccgccgccgccgccgccgccacggcgagccatcaccacgtcgtcaccacgctcccgggctacgacggcgagctcccgttccgcctcgagacgggctacgtcgccgtcgacgaggaggagcacggcgcggagctcttctactacttcgtcgagtccgagtccggcgacccgcgccgcgacccgctcctcctctggctcaccggcggcgcccgctgcagcgtgctcagcggcgtcttcttcgaggtcggcccggtgaggctggccttggagcaccaccgcccctacgacgccggcgagctcccgcggctgaggtaccacccccacggctggaccaaggcggcgagcgtcctcttcgtcgactcgccggtcggcgccggctggagcttctcccgccaccccgacggctacctcgtcggcgacgtctccgcctcgctgcagctcaagcacttcctcgcgaaggtaattaattaatctatacgtatactatacacaacatgtgatatcatatatatcatatatattagtactactacatctgtcacataaaaattgtatttctacatttaaatctttattcaaaaattatatttctactaatgtggaacccagcaaattgattacatcaaaatatatttccttctaatctccattccttccaatcacttctctaacttgttgtctcaaaattccttttaattaaataaggttattgtggtcatttattaattctacgaatttgtcctcaattctctataaatataatgtaatttttattagatcggaggtagtagtagtcttctggtagacgtctctttgatttttttcaattcaaacttatttaattttgttaggaaaaacttatttaaatttaactaaacttataaagagaatagtagtatttttaataaaaacaaatatattataaaaatatttatccagtgttatatttaatgaaactaatttggtgttctatatgttattaatttttttctataatttagtcaaatctaaataagtttgaaaaaaaaagttaaattgacttggactacgatgaaatggtgggaatagtaattaattttgatttagtcaatcgagttgagatgattaacctgcttaattggtgtgattaatatatagtggattagtgatcatccggagtatctcgcaaatcctttctacattggaggtgactcctacgcagggaagatcgtcccatttctcgcgcagaagatctctgaaggttaattatttacttaattgcaccattaattacgtgcaactaggagatttttgttagtttagtgtgcaaattaagcttaattaatctgcgcgcttacattttttctgacacgatcatgtggtgtgtacgtattcagatatcgaagctggggtgaggccaattgttgatctcaaggtacgtacaccaatactatatggtcaccacaatactatttatttaggtacattattatccacttcttatgttctaatatactccctcctcctttcctaaatgtttgacgccgttgatttttttaaacatgtttgatcgtttatcttattcagaaacttttgtgaaatgtgtaaaactatatatatacataaaagtatatttaacaataaatcaaatgataggaaaataattaattattacttaaatttttttaataagacgaacggtcaaatatttttaaaaaaatcaacggcgtcaaatattttaggatggagggagtatatatgtgccgttgttgtcgatagttaatttgctagtggcaatatgagaaagacccagagtcttacttatactattatatcctaagttagaggactagttagcctaagaccctgtttagatgagctatcacattggatatttggatactaattataaatattaaacgtagactattaataaaacccatccataatcttggactaattcgcgagacgaatctattgagcctaattaatacatgattagcctatgtgatgctacagtaaacattctctaattatagattaattaggcttaaaaaatttgtctcgcaaattagctttcatttatgtaattagttttgtaagtagtctatatttaatactctaaattagtgtctaaatacagagactaaagttaagtccctagatccaaacaccacctaagattcaagcatcaccacctcctaataaacatcaatatatagaaatcccgcatatcatatgtaggtttttttttctatatatgctaatggcaatataactaaggctgtgttcgggagagcctgctcccaacttccccctctcgttttccgcgcgcacgcttttcaaattgctaaacggtgcgattttttgctaaaagtttctatataaaagttgcttaaaaaatcatattgatctatttttcttaaaaaaagctaatacttaattaattacgtgctaatggaccgttccgttttccgtgtgcactgttctgtactgtatgctggcttgcgacgcatcctaagtcatgtcatttttttaattactactcccttcatttaaagcataagatgttatttgttatatggacttttagatgtatcatttcaccatggtcttaatataaaatttagtaaaaaaatacacattatgttttaagtactcttaatgtcaacgtaagtcacaacaaaataaataatacgtatcttttaataagatgaataggtcaaataccatttctaaagttcaacaaggccatatacatttaaaaaaaacgaatttattctcttctgtttcccgtcatatctctttgtctccttataagttttataagacaatccgataaccaaaagaacttggcccaattaacccatatgaactcataagctcatactcatcacaaactaaactaccgacccactaaccgatccaactccaccatgtcagaatagcacggagccaattgcgtagaacacacacccgttccatgtcttctatcttcatacaacaagctagagcatggccatctaatgacatctcttgaccgactctgatctcggaaaccgcatcctagtctcccgttcccttgtaactcattatgattgcttataattcgcttcctagcttcacatgcacatcaaataaaaagaaacatctttcggaaacaagttctgatcactatcttgatccacattagtctaaacaataacccattttgcctattattcatcacacatatcaaacatgatttcatcataaaggtagtatgtagttatatagtgtgatccttcgtgataaattttatttttgtatatatggtcatcaatttgtattttgtgataacaagcagggctatctagtaggtaatccggttacaggtgaaagcattgacttcgattcgagagtgccgtatgctcatggagttgggatcatttcagatcagttgtacgaggtaatcaaataattctttaacacgctattccaattaatctcgctaataagcctcacactaattaatcaaagatgacctcactagaaattaactgaacctatgctgactgctgtctcaatgtgcctacatgtgattgatcttaattaagacgataatggagcactgccaaggagaggattatagcaaccccaagaatgctatttgccgtcaagctttggataggtttaacgaagtatgttccaatatttctttctatatataatgcatatgccaaaaatattttgaaatatatatagcccttagtaaattgatgttacttactcgatctgcagctgcttggcgaaagttctggcggacatatcttgtacaactattgtatttacgatagtgatatagatggatcgatccaggaaaaacgaaagattccaccatttcctccaagagaatgtattgtaagtcagccttatgtattggcttcattcatatcactacaagtggctagataattgttatatagagtgcattattgttaacttatcaaacatcccttgtaatttatgaatcataatctgaggctaaaaggccatgcatggggatataaggataaagaaaagggtatgtcaatgagagagagagagagagagagagaggggcatgatgtaggtctttcacgagagccaagctcgttgggtcgtggatatagagtataattaagcatttttgaaaagagggcaaaagctttgcctcgtatgaactaatagagcagagaatagagtctaagcatcaattgaaaagaaagagctatttgaagaagaaaaaaaaatgagaggatgaaattacattatttggaccattttaaacattgtgcattgggtgagctaagcctaatattaataccagtgactaggtgatgcagtctggtattgggactgctctaacattgcatgcgcccttgttctccgaacatacataaacacttgtatatcacttcatttccatttagtatagttatgtgccactgccaccaaaagttgtatatgaatatccattaattcctaatttcttccagcaacagacatatggcaattatttaatatatttttgggctaacaacaacatcacacgagaagctcttgggataaagatggtaaaatttcatatacaacttactattcgccaggatacattttgcattaatgttaattctacctacttattttatctctttatgctaacaaataattagggaagtgtcgatgagtggttaaggtgccacaatggagatatgccttactcgatggacatcaacagcaacataaagtttcatcacaatgttacaacaaaaggttaccgtgccttggtatacaggtagtattgcgtactttttaatacacattttaattttgtatacatatatatgaaagtgtgttgttgcattaattattaccgatcaatcccaaactatttgggggatccactagttctagagcggccgccaccgcggtg

SEQ ID NO: 56865 - DNA, 1227 bp, Oryza sativa
atatttcgcaaaagtttttgaataagacgaacggtcaaacatatttaaaaaagtcaacggcgtcaaacatttgggacggagggagtatctctcaatcaatactactctcagcgcatcgccaccttcttttctgatgttttacttattaaccggcggaatttggcacctgacgcggggctgcatcggttcagttcgatctctggcgaaggggtaagtcctacgttccgtcggccctagtatatctatcagctacattggtgttgttcaaggctgcatcgcttcgatatcttagatcgctctggtttggttgatatatttgcctacatgatatctcaattctatctctaattgcattgtgtttagagacgcatcggtttagttgggactgtctcggttaagtctgatcttctgtcttagccaatatatctctacaatcacaattctattataaatagatttattatatccatcacattagacggatctatcggctcatcgagtactatattatcatatataatctcgtgctgcatcggttaggtccgacctactagattgttgttgataatataaatcttactaagctgataggttcatgctagtgttttatcggggtgctagccgataagttatctggacattgcatcagcttacaaagattacaaacaagttggatttagccgattgcaacaaggtttcactgtttatctaaatcgattggattttatgacatcgaacttttagccgatgtatgctttaaccatcggatcagtacttatcctatcatattaatattattattattagtcgattggtttttattggattatattattgttatattttattaccagccgattgtcattatatcattatctacattggacatataaccgattgctcaaaaccctatcggcatcggctgaaatcggcatcggctaatatcggctatcggttggaattactccatcggcttgtcaggtgattggctgttttatctgttgtttacctatcttatcagttgcatgatcaaactgactggtacgcccgtatctcatcaacctttggacctgcattggagctaaacagatctcctagaccagtgtgtgttttttgcatcaacacttatcagacgtaactctgaatttaaattttactagagatgattttaaggtttacctatggtagtatgattatatattcgctttaatattaagaacgcatgta

SEQ ID NO: 56866 - DNA, 1695 bp, Oryza sativa
caccttctatctttataaccattatcttcgtggatgtgtcagtgataacgatgataccattgtctttgcctgtatatatgaaaatttgcaagacatatataaagatggagccgatgtgagctcttagttaatactcccttcgtcccaaaatatagcaacttttattttaatgggatgtatatatatatatattctagtaatacgaatctggacatgcctagatacgtctcatctaaccaaattttgctatgttttaatatagaggaagaacatactacttcctacaatagtaaaggcaataataactctcaaacttaatgtaccaaaatattttttttattaccatttttttcttttgtccacaccttgcaacaaaatttcctttaatagtaaatgctaagaatctactttgagttgttatcatgagtatccatcatgtttcccttttctttcatcttcttcttccacgacaccaaatttgtttgcatgacaacgaagatagtctgttattaaataccgttgtacatgctctgatctatgcgcgttataaatgtccgcgtttgttttgtgtttctaaaaaaaagtctattatagtttatgacgaatgtaatatgtaatgctggtatcttttgctatgacctttgtgaaaagtaaattaatgggaaaaaaagttgggtaaaaacatgatctagaatttccacgagaatattcactttttatcctctcccactctcttttgtgtcgttcacaccacagttacgatgcaccccaaatcaacggaggttttaattagtggaaggtagaaagtaaaaaaaaattgggaggtcaaggtgagtgagacgtgacgtcgtgctcacgtcgtcttacgaacacgacctcttgggcttttcctttttgtgtctgtcatgggctaggcccggcaattagtgcggtccatgggctacaattcctcgcgtagcatgtagttgggctgggcctagggtaaatctgaatgctgcagaatgaaattatagattttcttttcctcttttttttggcaatacatcttcctgatttttgtctctaaaaacaaatatgccttcttatattgttccatctggttggtatcaaagtgtattgagcctttgattataccaaaatatgtcttaccaattaatagtagtatttggcaactaaactagtattagtgtgactggtttggattggagccaagtcatttgtaatgccacagtgctcaatttcgcaacacactgtaactttcttcaccatatcaagcatactggtagagaaccaaacatagagagtatttcatatgagctgtatcttactaaaaagaaaaagtaataatatcaaaatttatctagattttgacaccactataaaaatgacccaatatcacatcacacattacacagtccatgaaattcacaaaggattgtctttgcctctttgaggtggcatgttcttccacgaggtatctgcacatgaacagaacagtgccaacacagttcctgcttgtgctctggttgatcagacaatgagcatactgtgtactccatgtcatacatcggattaatcaagacagtttatagctcttccagccgctataaattatactagtgatggagaaaatagcaccaacactactgtttagatgtgttttcatttttaatgcatggaactcagaacgcaaca

SEQ ID NO: 56867 - DNA, 19843 bp, Oryza sativa
ttgcctgctccttactactctcctttgaaacttctttgcaaatgcttccacaatttctgaacataccttgcaatttctccctttaaagaattcttttgtttgcctctgatgacttgcttttgcaaagatggatgaatctatttccataaagaaagacaaatgaatccagatatgtatccagtacaggtcaactattttaattttatcctcttgtccacagcttccaaagatatcttggtcttgaattactgaagccaaagcaacaacgtgtgacaacagcttcattttatccatttgcatcttctgaaactttttttttttggtgttgttttttagttgcaatgatccccttttcttgcctgaaactctatcttgttggcatgcagaatgttcccttcaagagtcaatcatcatagataaaaaaaaggaatatccttttttcctaatggtgccatttgttctacttctcttaattcttctttttttaaaaaaaaaaatcattgatatttaaattctgaactgatctgaacttctggggacagcatgcctactggccatcagctgcaaccttttgcactgcaaagaatgcaacctcttttcacttcaatttccatgtagtagctacctatgctttctttctactactccctcagtttcactgcctgattatttaccttttcactgcaactccctttttccaggttacctttgcattcattcattcatccatgcatgcatgcaactgtgcaatcaataatgctccaatattgcattgcaaatcatgaacatgccatgatctagtaggaatagacacaaatcaatcagcatgcactcattaattagccaagatcgatcaaatgatgatcaatggacactttgggatcaggaattcaggattaggacttaatcccccctgcccaaactgcactgatcacctagctagaacaaataattgattaattaacagtgggagaggaaatgattaagctagtggctagcttcttcttgttcttcttctcttcttcttctacaaacacaagataattaagctagagtagtagtagcacagtgtgatcatggacagcttgagcttgagcttgagcttgctcttgctgttcatgtcatcctgaggctgagatactggcactgaaccagccatggcgactgctgctgcttcatggcgtcgcccatggcgaggtcgaacgccattgcacgctggcacggcggcggcatgggcggcggcgcgtggaggaacatggcggcgccgtcggagtactcggccgacgacggcgacgacgagaggccgctgccggagcagtcggaggcgaagggggaggagccacctgcggcggcggcggcggcggcaatggcggcgttgcacttgcgggagctgcggccgccgccgacggcgagagtgaggtccagctcggccgtgtcgtcgttgtcgtcggcggcgtcggcgctgacgatgtactcgtcggcggggagctgcaggttcagcgcgcggcgaggttgcttgctgctccggcgaggctgccggcggcggtggccggagctcagctcggccatggtcaggtcgctcatcagctgcctctgaattcggtacaggcgatgcagctcatgaacctgattaataattaattgaaacttaattagaagtagttcatatgtaggattcaagaaatttgcaatggccagtaattaactactagtagtaagtagttgataggattaatttcagtgagatttacctgctgcctgaaggtctcctcatgcttgagcatggccatcttcatcacctccatgtcacattgcctcacaagcttgtccatcctcatcatctgcttcagctaagcctcttggaattgattgattgatcctagtgattccctcaactttgattcaggattcagatcaccaattcttgcacttgcaccctgctgaaatgtgaagcaaagataccattaagtactttaaaaaaaacttcattttcattgatcctaatggttcagacttcagaaatgataaattacatcaaaagagctagtagcaagatgaacaaaaaactgaactttgagagcaggagctcagatcaagaaacatgatgatgtcatcagaacaatctctgagtgacacaaacaacatttcagacaaggatgctaattctaccacaaagaacaagtaactaaccaactaactaaccttgtatatgtatccaaaacaaccaccaagatgcttgcttgtttctgttgtctgttcctctcttcctctactcaacttccagaggacaaacaagataggttcagaaggaggagtatgagttgtgagagtgaggctggtgaatgtgtgaagctggaaatgggagttacaggggaggtggtgatttataaacactggcaatggtcactagacactaggtagagggtatatttttaccttggaccctcctcctttttggcatgccaagcaagaggcccagaggcctggggcaatggcactagtcagtttgcatgaggtgcccctcccagagcagacaaccctgcaggactctagtttaatcttcttctctattctctcttgtgtgggcccccacaaggaggagtagtcgtacatttcaaaggttttttttttaagtacatttcaaagttgaagcagtggcactttgtgtgtgatggatgcaatgcttaacacactaaacaagttagggcccctttgaaatggaggattagcaaaggaattttggaggattcattttcctaaggattttttcctatagagccctttgattcataggaagaggataggaaaactttcataggattgcattcctatgatcaattccataggaaaataagcaagaggttagacctcttgtgaaactttcctttgttgagtgtatcctgtggtataatcaaagggctcttctctccatttcctgtgttttcaattcctgtaggattggaaaaaaatacaacttcaattcctacgtttttcctattcctgtgttttttctatcctgcgtttcaaaggggcccttagcatgcatgatcattgcacaaatgcaggcaaatgcattgcacacatgtaggagtagtaccatctaccaatgccttgtgcagttgtgcaattctttactgaatgaatcagtttagttcttttttttttcttctgaaatgtatgcgcaagtcaggttgcaactaactggagcagtagtacctagtaagatggagctgtcagtgttgtcactgaaaacaagcaaaggtgcatttccatgtgtgaaatgtacctgatgatgatgaggggagagatgagatgagatgagatgagatgagatgagtgtcctcctgtacaatgaattattgccacagcattgcaacatatgctaatttccctttgcaatgcctgcatatatgcatatggatgcagggatctaatatctatccaaatggatgcatccaagagcacaacatatctttgaggagggagataagaagggcaggttcttgtctcattgttggcccatcctgacaaatcagagcactgttgtttgttgttaacagcagttgctgtggtatatgtttgcattgcaggaaaaccaagcaagcagagaaaagaggagaagcaaaggctgatgatgcagacacatccctttgagaggaagcatcagctaagcatgcatgtctgaactctgatcctgacacaagcacaaactatgtggggtctgcatagtttaatcaccggtgcttaattaattttgcttcactgaccaaattactcaacactgatgctactagtgtgccattgcagcaaacagctgactataagacgtaatacctattagtgataaaaaaaaaactgttcataaaacctttatgtatacgttcttcgcaacttaaaaatgaatgctgaaacttaaaaatcaattctgaaaaataaactacgatgaaaaaaatcatcaaaatcaacctaaaatcaagttttcaaatttaaattttagttgcggctgataagctgaaaagccttaatatacataggtcggtattctttgccgtcccagcgaaaaaaaaaagttgaaaagcaaacgatggagctaagtccacagcttcaagagctgaggaagagagctgtattgtgcagggacgaattgcttacaataatggagacttgaaaagaagaagagatcattttttaagtgattagtgcactaataagaaagcctaagcaaagggtgatggatgatagtccaagggacaagacaatggcgcacgctttgccggcgcagggaggcgcatccgtacggcgaggtgggccccacatctagagagagagaagcactcctgctttctcggctttcttttctttctttctttcagtcttcttcctactgcaatggctttttgcaaggatgattattattaatttattattatcatcactattttaccattaacaattactactactctactcactattgttatgattgttactagtgcctttagaattaacaagtacactcactgattagtactagctcaatgcaaacctaaaatttagctctagcagtagtagtaaattagtaatagtaatgtagtgtgcatcttttgtggataaaagattagtaaaaggtgaggaattggaacagtagaagctttgtagatagaggagaaagtgctaaagagagagggagcaagctctcacccatggtgagaaaagacacttttgtcaggaggttttagcctctcttcttccaattactccatgattttcaggacagctcatcgattgttttcttcaggaaaagcaaattgatctgtggtgacacacacaatgcagtataatcagtagtcagagtagcagagagtgttcttgtgcatctcaaaagcatactctgtactgaaaaaagaagggggttctgttgatctgttctattctgtttctagattcatggttataactagatgattcttgttcagaaaagtttcaagtttccaatctggttttatccatttcaagctctcgtcagaaattttccaggattagatgatgcttgctgttaataagtgatagtaacagacagcaattgtcatctctgatgtctgatggctgcctgacaaaacctgttcatgctgttactctaaagttgatgccattttggcctgaatgatttgtcagggtagctctcaaattttaaccaacagcagcatgcatgcaggagcatcgactgatcagtgaagtttttttttataaaaaaagctacttactagcaccgagcagataaacaaacacaagaattaacctgatagctattgcaatgataaagtaatcaggggagtaagcaaagcatgcagatgaactcgcacggggctagctaaaattcagtgctgaacttttcagaggggggaggaaaagtacattacatcggtgtctgtaaaaattcaggtcgcagcctccattctgtctccccacacacactgcatcctcaaagttgcagccttgctcatcatttcggctacctggaaccctgtgcagtgcagctctaacagctagttaatcgtaggatgtaaaagaaattggaggaggaacagaagaatgtccactaacctgaaagaaaaattcagaaaagagagctttgctgatgccaccaccaccatcatcatgatgatcacataagggtggtcagtgtgagccctcacctatttgtcaacacctaaaagaagatgatgaacaatgcactgatctagtctagtccactacaaagtgaagtaattttttgtggatggtgatgatgagtgcttgtgtgagccttttcccatctctgaattagatggtgtgggcatgagtttgttctgcataaaatggttttgttatgcttgtttgactatgtatatatgtaacctgaccaattaacatcatgctaatttcaatgacatatttaatcagctgcagatcaaactgaacaagatggtgtgtgtctgtgtgtgagagtttgttctgaattttctttttgttatgcctgttgaccttctctgcatatacaacctgactaattaacatcatgctaatccacaaactaataccataataaaatcagctgcagatcagactgaatatttaactgaacaagatgatgtgtgcttaaaatcttcctgttatgccatgttgaccttctctgcatatacatcctgaataatcaaacaccatactaatccataaaccataaactaacaccataattaatcagctccatacatcacatgagcacatgactaattacacatcacactgaaaccatgaaaaagctcatgcatatactacatcaaaactaatcaaaactgaagaacaggattagataatgagactaggataggacctgaacttttttgtgctcggctttcctcgaggccggagccagccggagccgacagcgccccgccatgcacgctcgccggccgttgccggccggcgagccgagacgagcaccgaaaggagaagtgatcagtggacacaggacagacagtggctgctgctactttgcaattgcatggtggaaatcttttcttcttcctcctcctcttcttctcaaaaggcgaggcgtggtgatgacctcacacacgcacacacagtcactaaccctaagcttctgtagcttcgaaggatgcgcctcatcatccaggcctcttgttcttgtctgaatttttgttactgttctgaatttatcagagcctctgggtatgaggttttgtttaaagaagggaaatgtcttctgaacccgagttttgtttgaagaaaaaacaaaagcatagagcctctgaattttttctgagtttctgactcatcagagcctctgaatctgagctcttttcagaagaaaatgcaactgaagccgagttttcttttcagaaaattttgcctctgaatctgagtttttctttaattaaaaaaattgatattgaatcttaattttttttcttgtcgttctgattcatcagagcctctgaatctgagtattttctgacaaagaaatgcatatgatctgagttttcttctcaagaaaaataggtgcatttgaatcttcttctaactagtaagcaaaaaagattgcctgtgattccgagtttttccatacaggaaattttggttttgaatcttagctgaacttcaatttttggatgtgcatggaagcagcatggacaggtctttgcgtgtctgatggaggacccatggacgtacgtgtgataaagtgctttgtttcagtgttatttttgcaacaagaagtacactacgcagctttgtcatcgtcgtttttctcagggcctagtatttatcatgtcttttcatggagctgaataaaagcgcttttaactgaaaaaaaaaaaaaagttagctgccatgctcatcgttgatgaaagaaatgcgtgtaagtttgaaaaagaaagactgatactatactcctgtagtcctgttggtactacatgtcgtttggacatgattgcctgcaaacaaacgaacagttcaggtcaaattcgtatcgagaagaactgatgaattgttgactgaaaaaaaaagaaggatttacatcaggttgtttcttccaaattttccctcaaagagtttcattccatgtcacaatctttcagggttctgactttgcatttcaattttgcatgcaaccaacccagcatggattgtgaatttgtgattgacagaaagtgagccctgttcttcagagatatcagataagatacatgtatgacagtatgagatcatataatataatcctccaattcttcagaggtttctgaatctcggcagtctgtaccaaccttaccagcgaaaaatttcagcaattcttctttgacctggagagaaggccagtcttgaagatgcgcttgaactcttatgatctaccccattcttgataagagggataactgactgtatcaggtaatatgtgctgttgtaccagattaaatcagacagcaccagaatacatatatattcagaagaacacagaaggagctgcataaaaaatgtgaatccccatggaacatagagatgtcagacactgaagatgcagaacaccaaatcttgttgggagatatgctgcattgctgggtgacatagatcatgtaaaaagttcagataccaaaccaaactctgaaggatcaacacaataaaccgggaacaagaacgatgctctgcgggcagagcagtgacaaatcaaagattatggcaacacatggtaaaacagttgagaagaaatatgccttcggtagaggaacaacaacaaatccaggcaacacaaccgaattctccatacaggtaaaggtaaactgtaacattgaccagtaaaatccagacaacaaaaccaaattctccatacaggtaaaggtaaactgtaacattgaccagtaaaatccaggcaacaagaccgaattctccatacaggtaaaggtaaactgtagcatttacctgtaagcgacgacaggatcaaaggcattgccagaatttttcattattgttgtgattaatcacaagtaatggaagttcactatcatgtaccctaagatgtatcatcctgaccaccaaaagccatgggtgtaccacccagccctatgacactaactctccctccgcctgaacctaactaaactgtagctttctacagcagaatgaatggcaatgcaacactgcgacaggttgcctacactggtcaacataagattcactaaaagaatccgagataactagccaccctcattcatccgtttaacagatgagcagaaatcttgtcacgtacccgagaggagttacctcccagtaactggggattacacactacagctgtctcaagatctagcaatgaagcttggtaggaatagtcagctgaacctgtagagcgttgatactgcacgccatttataacagcaacagtagtcacatttggatagttcatcatcactctctttccccttgatttcgccacgcccatacaagacttcagcagccgacttaagtatgcattcagcccagagttgagcacatcagcacactcctgagtcaagctaagaccttcagcttgcagcttattctcaagtagcttcaacaagcgctgagcttctggcaattcaccatttttgtagcatatcaacgaaggatgaggaatcgaaggccgagaattctgagccttcggatctccaaacgaaacacccaaaggagccctaatcgggcttctgctctgcgcatacactggactgcccccggcctggttaacctcctcgccatcctccacagacacaacctccaacggcgccttgctcccagccgacacaaactccccggtgccctgatgaccaagcggcgacttcccgagcgggctcggcctctcgaacctcgcctcccgggtagccaacgccggccctctcatcacacccgccatcacgccatggttggccacggccccgttggacacggacacggtgctcgtctgcgagttcccggtggttgcctgcctgctcggcggcggaggcgggggcggcgcggtcgccaagtaggcattgctgaggatcgacctgatgagaaaattgtgatacttgatgttatccctccccattgtagccacgcagatcttgtcgaactcctccttcccaagctgcccacccaggaacttcttcaggctatggaagtagtgctcggagcgctcggcgcccagcttcttcgcaatctgcgacttgatctccatcgtgtccacgcgagcagccaccttcttcgccaccggcggctgcatcttggagaccaaatgcagcagctcaccggcgaccaaaaccctagccgccgcggcgcgcggcgagattcgaagcggcaacctgcgaaaaccagatcaaaaaaaagaaaagaaaagaaagcaagcaatcaatctttagcagggatcaagaactccacaatccagcacaagaacacacgcatcccccaagctgctgatccaggagctcaccgaatagttggaacaaatctaaccctaaccccatctctgaagcagacctaaacagtaataacctaatcggaaaccggaagcaaaccaagctcgaattttagacaaaccccagccaaatccgggatgaacaccacccagaaaaaaaaagcccccgaatttcacggggtatagaactagattacgaaacacggaatggatttgggggaagaagaacagcaagatggagactaacctcgattgggaagagcgtgatgattccggatgtcaagaactcagaattagggtgaaaagaaaagaaaaaaatggatcttttttttttcggattgcggccgccgcaatcgcagtttatatttcccccaaattttggtttttttttcttttttttttctgggccgcgaggacgaactcgacctcacaaggcagtgtttgtcacggtggctcgtgcgctaatgtctctctgacaggtgggccccacgcacacgcgtcaggtgtgtgtgagacaggcaggagaggagataggcaggtttgcctctgcccctgacacgcacgtgccgaaatgcaaaactgacttattaaggctaatgatgagtacttgtggtctaatgcaagtgttaagtgtggtctctccgttttgtttgggtgtaaaagatggttaaatgaacaagatatggtagatttggttctttactctctatctctctctctataagtgtgatttctccttttatttgagttggagatagtaaaatgtagaagaactaaggtagtgtttggtttcgggactaagtgggatgggatggaaccatccctgatttttgggttgggatgattccactcacatgtttggtttgtaagatgggacgatcctaattttttgtttggttgaagggatgagagagggaagggatggacgccgtttgcaatcaccgtcaaccgatcgccagatctgccgccacattcctccccatcgctggaggaagagcaagaggatgagccggcggcgagcaagagcaagaggaaaagccgccgccgctccttcccatcgccggatccgccgccgtccctcgacttcctcctcgcacgccgccgccgctcctcccctgcgagctcctcgttgcaagccgccgcagctcctccccatcgccgaatccgccgccgcaccatcgccagatccgccgccgcccctagacctcctcctcgcacgccaccgccgctcctcccccgcgagctcctcctcgcaaccgccacagtccccatcgccggatttgctgccgcccctcgacctcctcctcgcatgccgccgccgctcctccccgtcgccgaatccgccgccgcagtcctccccatcgccggatccaccgccgccgccctccccaccactggatccgccgtcgccgtcgctgagccccccgccgccgtggtcgtcgtcgccgagccctgcatggtcgccgtcgccgagcctgcagctgtcgccatcgcacgagccgtatgctgctgctcccgagggcgagcagtgcgagcgcggtaggaaggcgtcgtcacgccgttcgctcgtcccaggtgggacgagttcgtcagccacatttttccggatcggttggtcccggatctaagaattcctctccagggaccaacccatcccactcacccctcaaccaaacacccctaaaagtgggttcgtctcatctcatcccatcccatcccttcaactaaacactacctaacagattggttctttactcctaaagagatgaggagagagatagtgagagatagagagattgagtggacaaagtaattggtagggagaaagtctatttttttaatagccattgtgagatgattgaactgtaaaatgagatttcataatgtgattctaaaacatagggatatttcccatttgtttgtgtcggaatagaacactagctaaattatagtcattagttttcacatggaaattctattgtattaacttgtggctttccacgctaaaatgaattaacatgcagtttcccgcgcaaaaataaaaagttgatgtgtaccattcccacgtaaaattaggtctacgtgtcacttcccatgctaaaatgaattaacatgtagtttcccgtgcaaaaataaaaagttggtgtacccttcccacgtaaaattaggtctacgtgtcgcttcctacgctaaaataaattaatatgcagcttcccgcgcaaaactaacgtgcagcttaaggtaagtttagggtttccttgtttaaatgctatataaggaaaaaaaaaagtgctatatatacttaggctgtgtttgagaagaagaaaatagataagattagaaagatacgtaaaacgaggtgagccattagtgcatgattaattgagtattaactattttaaactttaaaaatggattaatatgattttttttaaaataactttcctatagaaattttttacgaaaaacacaccatttaatagtttgaaaaacgtacgcgcgaaaaacgagggacaatctctcctatctcccctgaaagaacgcagccttatatgagtgcaaactttgtcgtatatggtcacgcttcagctcttggtgcatataggatgacgttgggttgtccgcctcttttctccaatccaatcaccgtcttgaatgcactacccccaacagaagatattgtctatctagaaattctcacaacaaaattcatacaacgataataaatttatcaaaaattaataaaaaataaactgagttcaactcagtaagagatgtcgatgtacatccccgctacccaaaaatcaaattttggtggaattatttatatgttggaaacaaagactctcccttcgtaaaagttgaggtagcatcattttcaattgttaggggagtgattaagttgaaaacaaaaatagtatcaaactgcaatattgtgcaaatcaagtgaccaaataagctaatatgcccaaccctttttttcgttcatatgttgcatctttttttagggatatttttaaggtacccttagaataatactggccgtccactcttatcgatctaatggacctgatcttcttctactgtcagtagtagtatgtgcagtagaaaccacgtggagggcaaaaccgtaaagaaaaaaacacagtaatattacgctttatcggtgattagatggaatgggcgcgaaatgtgcggtgagaaggcggcggcgaaggcaggatgtgatgagatcggcatctatgtcgccgtatggtggccgtcgctcttccggccaccatgagtgatggagttctattatggagtaccagttaattcgtctccgcgatggccaaaaattatcagacggcagctggaccagtcttcgatgcggcagtaattcgccggcagagcacacacaagaaatgtggccagcatcctcggcgatgccgacgccgtccaacgggccgcacaaatgggaggttgacccttccgggtttctcggcggctacaccggcgatataactttctctaatagataaatggtcagaaatacccttacaatttacaggataaagtaaaaattatcgtataaatcaacggtcagttttgatttatactaccctactgccatcgctcgtaaaggtactgtaaaatgacccttttttagtttaatcacttcaagcaatttatttatttcttaattaaactaagtacacgatctctttacagtaacagaaatagagagcaagttggaggctccatcttacccacgtccggcgtttacttcccaaatccgaaagcaattcggcaacatcgttttcagatgcaccaataagtcgcagatgacacttttctgaatatcacatctttctgattgagtagacaattaactttcttgtctaatcacctgatgtatttggcatcattaagctctgaaacctcagaaaaatccttttttaagtagctaatgttcacctctgatgcatgaattaaagaagaatcaagaaacagctactgaagaaggtgagaacaataatttacggataaaacttctacattatgtatctatgttagtgatttaaaaactaacgctgcaaaataaactacaataaaaacgtctaaaattaagttttaaaatttaaattttgacagcaatgtatgggtcagcaagcgtgcagtgtaaatttggctgcaatcggatttttagtgtagggtgtactttactgaaagatgaagtagtccgcaaaatctacaacaaaattgatgctctttgatgaaacggccataacatctagtagagtacttgttactacttcatttcttattgctctgatagtctgcatcacaggaggaatcttgcattatttctgtagtttactaactaggtttcactttggtcaaattaagatttcaaaagacaagatttgctcccatgtttcagggttcagaacttcagatataacaataatctactagtactgattagaacacatgacaagttcagaaactgacagcatattgactaaaacctgtaaacaacagatgcaaataattgtgcattttgcataattaactgcactgggagtttgatggggccttggggctacattgattagaggaatcagcagtttggctacagctaactcgaaaaaggatggatcattaacgcataactaataacatattaaatattataaattaaaaaaagatttatttatttatttattaaaaatatttttttcataaacacattattaacgtagttttagaaatgtgctaacaaataaacgagaagttgtgtttcaaactgctgaaaagaatgcccatggtaaaaaagacaaaaaaaagaggggcctttgcctcgccaattgtttgctctcttcatggtatgatcaagatcctctgtagtcaaagtctgacatgtgcgcccgataatttctgagtccacatgtcaacgataaaggtatcgtacatttgactgcagaggatctcaatcggtcgtggtgggggatggaatgggaagggtgagagtgtgatataaacaagtggaccccacttctctccaccaacgctatctaggaccgtgtatttgtgtgatccaacggcacgaaatacctcagggggttccagttttttccccccgacccccgaggggcgctcgaaataggcttgaaaatgagggctctttttggaaatttttgcgaacctcccgccgccgcctcaccgtcgccaccggcgatcgacggcggcggccggccagctgggtgatgcacatcatgaacttctctgttattttgcggcgtgagcttgctactgatgaagtgattaaccgcttgctgctatcttgagtcggttttcagaaatgtgttggatcaaaaagtgtctgcgttgtactatgtaattctataaaaaaaactatcagttttttttttgatgaactggatcgaaagagcaggaattgcactgcaagataaatgtaacattagctccgttttgcgctttgaagatgaatttgagttgcactgcaagattgatggtgtcattgggctttctagctacttgctgcagatgaacatgaaaaaggaagaaactatttttcaagctgaaagaccaagcttcttgatttgaatgtgatgagattaattgcaattgtaaaaagaatcagcttctcagctctgaaagctgaagctgttacactttactgaaagatgaatttgtgatgtaactctgcaacagaattggttgatgttcttcgctaaattgccacaatttctcctcaactaatttctgattgatctgccagtttgcatgacacagaggaatatctctgtacttaattaactaacctgtatttttcactttgacatatttgcaaaatgtgttcccaatgtttcagaacacaacaatctcctgacaagaacacatgatcatcaggagttcagaaaactcactgtactcttctgcatttctgttgatatttccagatgtgaatcactgtacactaattctccttgctgacactgaaaattctgcaacaaaacccatgtctctcaattcatttctgattgatctgctactctgcaattctgcatcacacaaacaggaatatctctgtacttaataaactaaactgtatttatcactttgggggcaaattaatctttgacatgtgcaagatttgctcccatgttttcaggattcagatcacataagacaacagttttttttcctgacaaaagctcatcaggagttcagaaaactaaactgtattcttctgcattttctgtagatatttactcaaactgaagagaagccactgtaataaattccaatcactgtacactaataattctccttgctgacactgacgccttctccggcgtgctcgccggcggcgaggaggagggcgcagacgtcctcgacgtcgtcgtcgccgccgttgtcggacgctgccgatgaggatgatgatgatgatgatccacggaggctgtcaggcggcaccggcgtcaagaactcgacgcagccggtggccttcatgtgctcgacgccgtagtacatggcgacgccggcgacggccacggcggcgctgacgacgagcgtcctggcggaggcgaggcacatgacggtggtgatgaggacgacgggcgggacgcacatggcggcggcgcccgcggcgccgacggggatccggtacgggcgggggaggtcggggtccttgacgcggagcttgacgaaggcggcgaacacggcgagcatcccgaggccgtagaggaagttgaggaactcgacgatctcctggaagctcatgaaggagaggatgacgacgccggtggccgagcagaggatgctgtacgtcggcgtgccgtggcgcgacctgcgcgcgaagatcgccgggatcatgcccatctccgccatgccgaggagctggaacgagtcgccgctcatctcggcctcgaagagccccatgttggacatggccgcggcggcctggatccacacgcgcagccacggcccgccgatccggtcgccgaccacggagaagaacccgtccgtccactcccccgccgtctccgacggcagcgcgcccgtcccggcgaggagcgggatgaggtacgcgcccacgacgagccccaccgcgccgaacaccgccttcgggaacgtcttcctcggctcctccacctcgccggcaagcgtgctcgccttgtcccagtagttgaggttccagaacatggagttgaagtaggcgcgcggctcaacggcggccacgttcacggcgagccaccgcgacgggcggatcttgggggcggcgagcacggcgagcgcgacgaacggggagagcgagaacgcggtgagcgccagcgcggagaggccgacgaggtggagcccccggaagttgaggtaggtgagcgcggcggtgagcgcgagcacggcgagggagcgggccggcggggagagcacgagccccccgccggagcggaggtagtcgaggaagagcaccgggtagagcgcgttgtcgagcgtccccgacgcccacttggagaacccgacgaggaacgccgcggcggggccgaacgcggcggagacccaggcgacgtagccggcgttggtggggaacgcggaggcgagctcggcggtgacgagcgcctcggggagggaccagagcacggggaggacgaggaaccccaggatcgggaggagcgcgccgccgccggcgcggaccgagtcctcgatgccgaaggggccccccgacacgtcgtagaagatgagcgcgacgagggggagcaccgtcagcccccgccgccgcgccggcgccgcctcgcaggctccggtcataggcgccgccgccgcccgcgcggggggttgggggttggtggggcgccggtgaggcgacggcgacggcgacggcgacaaggtgttcgacgaggtcgcgtgggcgtgggtgaggaggaggggaagatattgtggggggtgggtgggtgagtgaatgacaggtggggcccacggggtttctggtcccgcgggaatgggaggaatcgcgcggggtaatcgcgtcgggtcggtgggcccacgtggcagtgtcggatgctttaaattaatttttgccaataggccttctaattgtttcttttatggttgataaattaaagtttttatggttgacaaaaggcagcacatggcgcggctctgtcgctggttggttgcaggaattgtactccttcccaaataaaataaacaatgtctgactataagcaattttttttaagagtaaagtgtacgggcggtccttaaacttgtagcggtatgtcatctaggtccctaaactcttaaaatgcaaatccaagtctccgaacttgtcatagtgtgtcatctagatcccaaatcaccacaaccccttcaggatcctacgtggcgtgtatgtggcatgccacacggacatgacatggcattattttgactgacaaatgggacccatttaatttttttcctttttcttttttttcttatctttttcccctttcttctcctttctctgtgatccgtgcaagaaaaaaaggaaaaaaaagaagaatgagaagaaaacgaaaaagaaaaaaagagagaaggacacgtcacgtccatgtggcattgccacatcagcacaacgtaacatcctagaggggatgtgtcaatttaggacctagatgatacactttgacaagttctgggacctagatatgcattttgagagtttaaggacctacatgacacaaccttacaactttaaggaccgccaatgcactttactctttttttttaacgaatcgatatttatagtatgtcaatttcatagaatttagtaggagtaaaagttgtgcaaatacgaaaagaaaagaagtgtagagaaaaattaagctaagggatgagttcggatagccgtttcgttcctgctagggctcatgttttttgacctcctcgattttcgccactagggctaccgtcgaaagttcgttgtgttggaacactatttggtttctctccttccaaaattcctacgccgtaagtacgatgaggggtgcggataccttgttttggtagtacctcgctagtggccaatatcgtccatcattcatggaccgtcgtagttgtgcaccacattaccgatttgatttgcttgagcgaggtatatgttgatagcatgtcccatatatctattcgtgtatctatattccattaggaggtggaatgacattgtgggttgtgccagcaaagtgagcagtaggtaatatctaaactttaatcataagttaatttattttgtgatggagcgcataacaaggggcttagctattaatttttggttttatattgatacaaaccaaacaagagctagctaattttgcactactggtaggatagagtcatagagaaccaaacgagtctaaaagattcgagtaaaaattggtcaatgataatcccacgtcatatccacccttttgcaataatgtacacctaacgtttgtcacgttgttagttggaaaaacgcacaagatacattaaaatgtgtgacgtttgggatttagcatcaacatcagcgagacgtccgtgcgtgtgcccgatgggagaatcgatgctcgcttcttcatttcttcgcttccgtttttttttttccttttgcttgattcgattggtgattctttcatatctgtttttcttttcctcgattggattggtgattcctttggttgtttacagctgaagcacgctatagtattgcataatcaagcgtactaataattcttttaaagcaaaatggatcaaacaaaattgcttgtaactccatccatggcgattttatgataaaaaagaggatgggattgtaagtaatctttgtttccaaga

SEQ ID NO: 56868 - DNA, 1416 bp, Oryza sativa
ataatccttggccacaagccttgccttatacttttcaattgtaccatcaggcctaagctttttcttgaaaacccatttgcatcctacaggcttgcacccatatggacgctcaacgacttcccaagtaccattagacataattgagtccatctcactacgtaccgcttccttccaatagtcagcgtcaggagatgaatatgcctcttctatggttcttggagtgtcatccacgaggtatacaatgtagtcatctccaaaagactttgcagtcctttgtctcttactctttcgagttgctacaatgttatcctcctcaggattttcctcaggcgtttgatcattgtgttttatcggtgcaaagtgctcatggggtaaaacaggttcttgactagacgtgctaggtgtatttttcatgggaaattcattctcaaaaaatgtggcatctctgtactcagtaattgtaccaacacgcatgtcgggtactccagagtttactattaaggacctatagcccacactgtggatagcataaccaaggaacacacagtctacggtctttggtccaagtttacgctttttggctataggtacatttaccttggccaagcagccccatgtgcgtaggtatgagagatttaatttcttcctttcccattcttcgaatggtgttacttccttatgcttcactggaattttattcaggacatgacaagcagtaaaaattgcctcaccccaccattccttggaaagtcccgcagtgtctaacatggcattcaccatctcagttagagtgcggttctttctttcggctaccccatttgattggggtgaatagggaggtgttctctcatgaataattccaaactcttcgcaaaaggacgtaaactcattggaaaaatactctccacccctatcagacctcaaccgtttgattttcctttcaagttggttttctacctcagctttatagatcttaaagtaatgcaatgcctcatcctttgttttcaatagttacacatagcaatatctagtgcaatcatctatcagtgtcatgaaatatttctttcccccattagtcaacacgccgttcatttcgcacagatcggaatgaactagttctagtggtgccaaatttctcgcctcagatgccttgtgaggcttgcgaggttgtttcgattgaacacaagtatggcacttggaacctttgaccaaagtgaattttggaattaaactcatgttagccaaccgcgtcatacaaccgaaattcacatgacaaagtcgcgaatgccacacattggactcatcgttctcgctaatatggttcacaacattattattattattacacatgtcatccaaagaaaaacggaacagacctccgctatcataaccttttccaataaaagttccatattt

SEQ ID NO: 56869 - DNA, 5323 bp, Oryza sativa
aatcatgagagatgaaattagataaagttctcatgagatttactagaactcaggcccgggctatggtctaaattgctcaggacctggatctgttcgtgttaaaagttacttctttcactttttttttcatatatgacgctgctgagtttttgacaaacttttgactatttgtcttattcaatttttttataaataatcatgttaaagaacatttgataataaatcaagtcacgataaaataactaataattacataattttttttgataaggtgagtgatcacacgtatcttaaaaaaatttatggtgttatacattggaaacgaatgaagtaattctttttgaaaggagacacacaccaacatgctccctcatgcatatataggggcctcagccctcatgcatggtcggctgcatgcactctgcaaaagtacttttatgtatatatataaccaagattatattgttcatacacgggaggtttgttaattcgttagcatatggacactacatgcaggaggaccatggaaaatcgtctctctatctgtctcactctaccaaccgtccggctaggggcggattcaacgtgggtgcaggaggactcaagtcaagtcccccgcactcaccggatctatggatacccccttcaattttttcgtcatggttgataagatagaagatgctaaaaatctcttaatagcattttaatatagtttaatactgagatgatgtgtttataccggtgtactctggtatgttgagggacgtactctagtatgttgagtccctcaaactttttatttctggatccgcgcccctgcgtcggctgaatatatagttaaaaaatgtgttgggcttcttgaataagattgctacacgtactaccctcgagattaataggaccatatcacatgcattgcaaagcagatcaatgtaatgtaatgtacgtcgttgcaaatatgtatagccgacgaaattaattattagatcgatcatgatctgtatgcatgtacatgtgtacatgtctgcacatatatgttcatgcaggacagggacaaatcaagctagctagctagctatcgacacgatcgaaccactcaattggtagcacgtagtagtattaatttacgtgtgtcatgtgatgtatgcatgcatgcatgcatgaatgattgtgattttatacctatgaacgatttgtcgtatgtatgtatgtacttacgaatatgtaagttttgtttttaatcttaaaattctaagcacttagtatcttaaaatgcaaggtatttacttgtcggtcagcggacgaaataattatcctcggcggttttcatgctatatttggtggtttttaaccaccaaggacattctgttttcttttcttgtagagggaagttatcccacgtataaagaacaatctctacataaactttaatagaaaaaatataagagtattagagttattgggattcgtgtattaaagataatctattatatacatcacctcttaataatttatggatagatgatataaataaaattcaagtatacaacactactccataacagatttttccttacaactaaaatcaatttttcgcagacggctggatggcccgcgtgcacccaggtgtttacgaaaatcacatttcccatgcggccggcgcaaccgcatgcgaaaatctcatttttcacatgcggtcacctatacctaggtcgctcccgccgccatcgttctcagcgtccttcacgccagatccgttgtcgccgactccctgccattctagcccagtgtcggtcactcctgcccatcgtcggttgtcgaccctcccgccgctccagctacgttaccatccgcgtgcacgagagggatagggaaaggacgagtgagagagagagagagaggagggaggagaggataagagaggataggtggaggaattaatggagaggaattggtttttatacttagttcacaatgatttttgcaaactgaatctctataaggagggcaggaagcatatatgaaaatctgattttcgcaattctcatatgtggccgtttgaagaccctgggatagcgatttttataggcaaaaaaaacagttatggtttgcttacaatctaaagggcatctcgttcagaaaaatcaataaaaacttgctctcagtttacccatagctgctactccacaggcattaccaagctaactaaaatcgtgtcggtctgaaaatcaattaatcaatgagcttggacacaatgaattaattaaccagcggccactggagaccggtccactctacgtacctatcgatggctttcttggtccatccgtagactcgattgatcctagggtacaaattaatgtcaatcgtttgcttctctctccccaataaattaccaccggaaaattggtataattaccaatcgattcaatgggggttaatccggccaattaatccatactcgggggatacgtgagcgaggtagatatatagcatgcatttcttgatgaacgacaagaccggtggcttaattaatctgtactatagctgtgggtaaagtactgtggttgaaaattaatgacgcgatgtattgctaatggagtactccctccattccaaaatataagacacaaccattcttaacctaaaaatcaagaaacaattattattatctcttggtttggatcaccctaataaatataatgcatgcatctaataaaattagaaatattgagggtggaggatttaaaaaagtaataatttaatggagaagatgtcctaattaattgtatgcatgcatacatgccttatattatggaatataaaaaaagtagttgtgtcttatattatggaacggagggagtactatctatccccgaaagttactaatgccatatttgaaaagtttgaaattataagaaacaacttatgcgtatatagctggatggtaaaagtctctaaaaatgttgggtttctcgatcggtctcttgtttattttatagatattaaaattacgaattcttaaacctaagtgagaatccaatttctgtgaagctagaaactctagaataaactgcaaccgttatatatagtagatgattccccacgctttactgtgagaattaccaagcaattctcaatattatttttacaatcaagttagcagtaaaaagaaaaaaaataaaacatcagtgtttatcagtcaaatgatactcgtgctttagtgtgaaacatattgataagtatatgttaaatattttaaaagtgatagatatatttgttaaaatattgtgcaaaaatgatacgaggggtgatgattagatatgcttgtattttcatttgtagaattaaataaattgtagatcatgttttatatatgcttgcacgaggttaactatataattatagctagtgggtgatgatgtggtatggttgtatgcatgtttagctttaaattttatagaaaggataagctatatgaaacagagcctaattaaattactgttacgtactctgttgaacggttgtcaaaatattgttgatgactgggggagtactggtgtactagtgtactactacttcatgtgccctatgtctaccaccccatcccatagcctaattaatccctttgacaattaaatatactaaattaggaaccaataaatcacccatacaattaggtattgatataattatactatgtttgctgttaattagagtagatatatagcatccaagaatatatgtagtcaaacattaaaaatcttaaatcattaacagatcctataactccatttcaatttacatgggtattctagcatttaatttttttttcacaatacttgtcatgctcattttctaaagtatttttagaggtgactttcactgtctacctttagagcaaaggataataatgtgctataaatctactataaccttatttcgaggagagatgtaataaaaaataaagggtgttagctctcatacaagagttagcttaacacatgctctaagactacaaatacatcaaagtgagtgaaagaggtaggagaagaaaaattgaaaccaaccttatatatagctaatctattatactatatatgttagctttaagatgaacgaatagttgacaatgagctctactattagaaacttgctcttatcagtgaggcataatatagtactaatactttagagaagaactttttatgcttgctttataaaaatcgattgcgatgtaattaatgagggtaagggtaatttgccacacttacttatttggtgtgattttgctagaagcctagaatgacaaatagtaaaccatgaaaagaaggaaatataaaaatacttttactatgtgaaaatgtcactattagatttgctattaaagatactttcatattacttactccatccgtcccaaaatataagtatttttagcatagtgacaagtcaaacatttttaactttgactattaatagcaaataaataaaaaagatcaatcaggtaaaattgacattagtagatttatcgttagataaactatcacaatatgcaactctttttatttaaaacatcttacttttatagatattaatgatcaaattagcatctcagagaacgtgttagactttaaaaatgcttatattttgatacggaggaagtatattctcaataatatttataaatatacagtttgaaaaaaatatcgataaaacatgtgtattggagactattatgcatgcactgataagagcaagtctaaaactattagtttatcttaaaaccaacgtcaaaattaaaacacaagtaaggtagcagcttaaaacgccaatagtatgcatctgaacagtgacctcagtgacatttttcagatgtgcccctgccccctatatttgagacaagaaaccgtgtacctcgacagattagaaccccaccctcatgggctcaggactcctataggccagcttagtttcgatgatctattggcttcaccactgcatccactcacaaaccattacatttgccgtgcaaaattagcaagaaaattaagcatgcatgtgcagtagtaccctggactctgttcttgtggttgtacattcatacatatattatcagtactggctttagctatagggtgtacctccaacaaataatagtacatgaaatcaatcaatcaattaattcatgcatgcatatttagatcgatcaacagtgttcatgtactagctagctagagtacttcctatacaactgatcatatgctgctatgtcaagctttagatcgatcgatctgtattgttactcattaattacttcctc

SEQ ID NO: 56870 - DNA, 1424 bp, Oryza sativa
gtcttgagttcgactctcaacgaaagcaattcatttcaaatcatatttttatttgctggagaataaaatcattcgtaactttttttttgttgttgtcgaataaaatcattcatgatttttttcccatgactatcaagatgaaatcattcatatttttttttcttgaagatgaatcttctttgctggaagaaaacaataatttttaaatttttgctgaagatggactcattcataattcttaaaatcattttttcatttttgctgaaaaatttccatttcatgaatatgaatattctttgatggaagcaaacatattattgttgttgttgttgttgttgtttaagattaaatcgttcatattttttctgaagatgaaatcattcattttttttttcatgaagagggatcttctttcctgggaacaaacatttctttttatttccgaggatgaaatcgttcatacttttttctttcaggacaaatcttcttagcacatgtttatcgaaagcatgaacgaaaatatttcatcgtcttatgatatactctatctcagtttgtaattataagcatttctaaattgcttagcaaatattacagataaagagaaatatttgttaaagaaataaggattacaggaaatatttccttttactaagttatcacattggttaatttttaaattggttgtattctcttctcagcacctaattgtctggttgaatcccattcattggaataagtgttccccaaaaatatatattgtatacaaaatttgaatattataaatgtttgtatttggtagcaggattatccaactaaaagatactcctaacaccttttctattaaaggctacgttcatttcagccatttggcttattaagccttgtcttttcggaaaatatatcagtgtatgattaattaggtgctaactattataaacttaaaaatatatttatttaaatttcagtaaagtcttttttaaaaatataccttttagtggtttggaataaacatacattatataataattcgctactacatccgtcctaaaatatactaaatttctaaaatttctaggtggataagggtatatttacatacgtagggcctgtttggtttggttccaatttattaccctaccaaaattttggtaacttcaacagtagcaagtgtatgtttggtttgctatcaaattctacccacaattgttcaaattgaatactaatcaatttggtattgccaaaatttaccaatgttttggcactaccaagatttttgtaggataaaaattagctccaaaccaaacaagcccgtagacaaaagttactagtatattttgtgacggaagtagcaggctagcagctagtataactgtttaaaactgtgtctgaatgtcttgtaactacagagtgagtggcaataa

SEQ ID NO: 56871 - DNA, 8014 bp, Oryza sativa
  unsure (1)..(8014): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttggtcatacagagtgggtgcggaccagagctgaaacagcaagcgtccgaactgctcaagctgtgcaccatgaattgcacatcgacggtattcatctccaagtgcaagcttacgaagacaatccagtgagtggagtttggaattgtgctgttccgcttgtgatttggtcgatggtgaatggttcacctgttgggtctcacataatctgaagaaatggcagcaattagcaattggcagtcgacagcgtctatgtatagataaactttgcagttatgcagaatttgccatgtcatctgatggcataagggtggatgatatgagtagattgtgagacctgtggccatgttatcactgtccagcgagatgatgcgtatcgcagcattcaaaatgcagcatacacacagctaattcagtggcaagcaggtgggatgtacatgcaaattgatgaggattttggtcagctcaataagcactcgaggctgggaggtggtaagtacagccagttttgccattggtagtagaaaaattaagcaagaaacctgctgttttagattttcggcaatgtgggtctttcagggctgtagatgttcttcctttttctcatcttcggtgtaattgatggtataaactgggtagaattgtatacagtactgttgcttcataattgaaatacacattgccataggccatatcttggaaaaaattggaactctttgctgcatctttcattgctttgatcatccagtaaatttttcaaggataacctttgtcctgtagcatatactgaaaagcttcaggcggcgttcctggtgctgaaattgaaacagtagaaagacgaagtccagtgtcagcttgtgctggtgccacaagtactactgtaattaacaagtatagtatcagatggcccagtttgaatctagagagcataatcagtcaagcaattgtagtcttcttgtagatttagccgcacactatccttaaaaagggagaaaacagataatttggtttaagttcttttctgatgattcagcaaatagtcgagaattgccagtcaaggttgacaacaacaccaaacattcattttcctggattgcatctactagtactctcactggaaaagcgggtctttgtatatttcacatcagggggctgtcttatctaatctcagggaaaaaaaaccttggtcatcagcaaggacagataaagccatggcaacgcctagcatagggtcactcatctatgatcaggagtaggctatgctcagtactttttccctttatacgttgccaatcgtaaagcagatgatgggtgctggtgccgcacaattgacctgtggaatggaagcaggatgaggaagtgagcgcaccatgcatgccatgcctcgtcagtctcctgcttttgccatgatccgcgacgtgacgtaccgccctccatgcaccgcgccggcgcgcgcacgcacaaacgccacaaacccacccgtcgtccgtccccatttccacacgccattctccggtctcgcctcgcgagaaaaaggtggactcgcgggccagcccaaaccatgtggcgtgggcacccccacctctcctctcctcgcctccgcgcagtcgaacgcgaggtgaggtgatcgcctgcccaaaggctggatcgggagcgagcaggaccacgggcatgcgcgcctgcctcctcccgttgatggatggacgacgactactcactgattgggtggcgctactgtgccgagcacaactcgtacacgggagcgccaggattgtggtagtgctggtgcctgtgtacgcgtactctactcggacggacactggagtgagtgatcgagtcagctgctgctgctgctgcatgcatatgtgtgcgcgtacattttgcctgggggcagaggtcgccgggaacgaacgctgcaatctattcacaggacgtggcatgcattcgccacgacgcgagaggggggcccatggtcgatcggctgtacagtacgctgcactgcggtgctgcagccccgtcactaacggctgatcgatcgatgctagtagtagctccatgtgcaatgaatgctggtgaggtgttatctgaaggaaaattttctgccggcttggcccggcttgttcgctcgctcgctcactcggagctgaaggaaagaacacatggacgcagagggaagatgttggttttgaaatttccggcatcgtcgtcagttccccctgccccgccatctccgttcgccggtagagatcacatgagctcctacccccgaaccagataacctcgttgtgagcttgtcgattatttttagacagacaggcttcgaactttcaactttcaagcgcaagctgccgctaggatggagggtgcaccgtgcacgtcattgtcagcttgaacctcatcagggattttgtctgatactcttaaaagtagagcgtacgtgcgtatggtcatggtcacgtcaagagaggagtatagaggagacggatccctcgtgccatcgaccagagaccgatcaagccatcgaccgatcgatcagagggaaaacctgataagcgcgtgggcggcagatgcgaaatcattggcgttcccctgtgggcgtggactttggtctgatggatcggctctccccctgcaacgcttcctctttcgcttatacacgccgatgcatgcatatgccgatcgagctgtccctcactcactcactcactgatgggcaattctgggctcttgccgcgcgcatctggtgatcgatccgcgtcgcgtgctgctgctgctgctgctacagccttttcgtgatgtttgtacgcagcggccatttactccgggtctccggccgtccggcgatggcattggttggtgtacactcctaccctggtggtagggctggtagcagcagcgggtcatctttcagtcactgtgcggtgggccctgcacgacagaggggacgaggtgggggcgagtggctggttgcccccaagcggcagcggcagcggcagcggggcatggggtggtttcattgacctccagagtggcaatcgatcgaacgagacgagtgaagcttttgctgccagtttggcgtccggatcacggccagtatgcgtccgtcccaagtggcctcacctgaccggcaaaactgatcacatcacgcgacgtaggcatgcaagcatatcccctcagcttttttcagctctcgtgtccaggactccggacgcccgctgtttcagccaaaacagcaccaacgcgtttaattttaccctgttcatggtttgacacgcagaacggctaactttaaaacttataaagtgctggttagttaagggttaggggagcaacgtgttgcatgcattgtgaaatagatggccttgctagatatgccagtactactagcttgtcacttgtggacgtgtgacccaccggcgtgaggcaggccggcggggttaggggagcggcacgcgcagcaccggtgaaagtgaaacaccttctgtacgtgcatgcatggctgcctttctgttttctctgctcccggcttcaccgtggggcctgtaaactgtgccctctcgtagtctaaggagacagggctggtcaatcaagcaaactacacattatcaaagcgaaagcgatcatcccatgcaaaggacagcaaggccgagacatactatgcacagtgcacagtcacacacagccagtggaatctagatttacatcatcaaaattactagcagtgcttgttactgccatcatgaagtgtaaaaccatccaggccggcagtctgtcggatcgggcgacgaaatgtatgaaatgcacagtactagtagtagaatttttggcaataagtttcgtgccattgaatgcttacagtcctttgaatttcctaggctgccttcaccataactgttgtctagttccagatcgctccccctgccgccgcagaacctacgccgtaatgtttgcattcagaaattatgaaaagacttaattaacctaggtaggagtcaatttaagatagagtgagaatgcaacctgttaaatgtatacacctgagactctgaggaggggaaattacaagaagctccacatcgcaaagcctctcttagtatcccactataaaccaaagggtcatacaacagaatgagaaggaactggactaaaagctcatgtaattcaagatatatcggcaagggtcaaggactcgtggtttgtaattccctcttccctcttctaagcaaatcatggactcatggttgcttcattgtcccagtaattcctcaactgcgacatgtggaggagcagcccatctcggcctaatccagtaacgctactcgtcatgatccatggaggaggctctgggtacagggaactgatcgtctcctggaactctttgatgttctcctctggccggccccctttacctttcttggatttatcacactttgtgaacacataggtcaatccaatctgaaatagtacccaaacaacagaagtcagactgcaacaatatagttggagaacatgaaagatatgttattagatatcagtacatggcatagactgtcttatgttgccttacattgttacggccaagccaattggcacagtctatgtcaattttctgaggcggaatactggcatcaacaaggagcagtacgccaaccaaggtatctctgttcaagaagtaacccttggtaaatgaagaccaatctgttcgagcagattgagatgcagccgcaaacctacatttgtgaacagatttgattatcaccaggcgccaaatgagttccaacagtatgctggggttgtgtcccaatgggaatggaaaagcaacagtagttgacttataaagtttatttcgtacagaatgtgctcactgttacaatgtcagatactggcatgcagaaacagaaactacagccgaatagaagggaataattgaatctatgccatctaaagatcaccacttcagaaatatataaaactgaactgactaggttcactaatatgatcaaaagatcacagttcaagtttctaacactccgcctagtttcataagccttttcctcctcattaagtggtaatgaagtgaacaacatcgattcaatggtataccctggtggcatatacacaattgcctacttctaacatagtattttcaagtgaaaatttgctaccggacactcaaagtttgcgctctttgctactggacacccaaagaacgtgtatttgctgcaggacaccgtgggaatatggtgacactggccgtattattttattatatctgatccaaatggagagagaaattttcaaaaaaaaaacaagtttacccatacgacatatttctttttaactcgaccaggtctagtttgaatcagacctacaccatcagagtgagaatggactgtatcgagggagtgaaaatggactgggtctggttctaaccagaccgagttgtcttacaagccgatgaacacaagggcaaaattgtacttctcgctctgtttctctccatttgcaatgccatctatgattttgtcattgtgatacatcctagaaagtagcacatgcaaatcaagttacatatgaattgagggtagaaaaggtcaacatacccgtaaccaggcaaatccacaaggtaccaacttttgttaaccaagaaatgattaatcgtctgggtcttccctatgaaagcataagatattccatgtaacaacagaagtacacatttcaacaaaatgcagaagataacaacatgttggttttgtaatgccaaactacattatctgaattcgtgtgcaattacgcagctaaatgcattatatacatcattatatacaattacatttcttatacacctaaaataaccctaatatctctcactagtctacaattctacagtttcaaccatccaaaaccaattgtgtgcatataccttttctccagcaatttacatggtattttttaaccaacttttgttaaccaagagccaatatattcatgaagtttgatatgaaaataacatagagttagatggagcaaatcataaaacaaaggaatcagttcagttctgaaggttggcattttgttaagagttaagcaacgaataggatagaaagataaacaagttgaaaaaaccatgtattcggttctgaagggtgcacaaataccaaactcgtcctccataaaactgcataatcaatagatttataaggtttgcagcaatatcaaagttccccatcaaaaccggagcagtagcgtagcaccgtaagctaaattaatttcttctgttgctttaagcactgagctaacttcagctcccgaattgcgagcaaacgaatgtgtttgcagtctaggacatcgcactgacggttgacgctaccacagtcctaaactcacttgggagttgggagtctacctcagagctaaactagaaattgcatcatcaaacagatatgcagaaacagataaaagcttaaaaatcaccaggctttttggaggtgagcgcggcttccttgcggcggataagggcgttgatgagcgaggacttgccgacgttggagcgccccagcacggcgaactcggggcggtcgtccttggggcagtcccgcgcgcgcgcgctgctcttgacgaactccgcctccttcacccgcgagtcccccgcgtagggccctaccacgatgttcgacgccggtatcaccatctccgccgccaccgccgcgtcccgatccacccccggcgggaagaacagcgcggggttcacggacgaacccctgggaggcggcggcggtggcgcgctcttcctcccgcccttgagcccggttcgctgcgccggcggcggcgcatcgccggcggacgcggtcctcgccgctccggccggcgaggagagcgtgcgacggacggggagcgaggcgcggggtggtggtgggacggggcgcggcgcgacggctcggaggagggagaggcgtggccggagtagcatagcaaccgcagccgcgcgcgcggcggagaggtggcggatggccggatggggcgcggcgcgggtggctcacgcggccgtcgagtcctcgtcgtccctgtgtcgcgacctgcgcgaggccgtccgccaacatatgggcctattaggcccagagcatttattcggtaaaaccagagcccgttataatcacagactaggcccaatagactgcaaaagtggcccaaaacaactgtgcaaaagtgggttttgtacactactgaaaactgataaaaaaaacgcgaatatcaggaaggtatgggaggagactaccgcccggacgtccgatgcaacgcaaaatatcggacactacccgagtcctacgtcagcaagctgatcacataactgctacatgatgatactacatgcatgcattgattaacacatactagtagcgtttgagatgatttattttccaaaccatttatcttattgtcattctgattatatggttgtattcattgtaattaaatctttacaacaatatctcacaaggttatattttaattgaaaaattatatatgtttcaatcgttaagatttaatgtttcacgtgttaaaaataaaaatgtttcatctagaatttgattatgttgtacattttaagttttttatccattagatgttgttttactgttgcacacgggatcaataaatatattatgatgtttcattatttatttgtgaatgttgcacatcatattatttgaatgtttcatcaagtatattgtgtgcaacagttacaaagaattagtgaaacataagaaaatatctattaaaacatctaaataatactaacataatactatg

SEQ ID NO: 56872 - DNA, 3043 bp, Oryza sativa
ataattttttcatcagaaatataatcatatgagatcttattatagtgatcttgctagaacatagaaaacaccacatgcaacattacaaataactatgtgaaacatcaaccaatatttattgaaacattctaataacaccgtgtacaacactaaaaagagtcagaaaaaagtcatcagaatacaatgatgtgagatattgttccgaagatttaattataacaaatccaactacataatttattcatagtttggataaatagttggagaaaaaaatttgaattctcaaccattatgagctgttttcctaaatttgattgcatgcacgaatgcacttacaccaactgatgtgaatgttcgatttcttccttccttctgcccggacggctgatgtgaagcattttccgaaggtatgaggtttcgaacttaattcgtctagcccaccaccttatggagctagccggaagacccaataatatttctctactaaaaactgctgattgcaatcagattattactgaggaattatgttagttttagtctctacctaaaaagaaaaggttacggagtagttttactctttgacgagattaaatgtcgttgatattttgtggagatggcacaaggctccgttggtggcatcgtcgtttctgttgctggtcattgacaatctcgcatcgtcaatactgtacctgcgaatgtcctgaaggattccatatttccattagaatcagtcacttggaagttgggaagttcacttctatggggcgtgctaccgcgtcattattgatactcgatgagaaaacaagcagcagctttatttcccggcgcttaatgacaataaccgaccaaataaacgatccaacagatcgaactgcgattatagtaaatagtttgtactccctccgttcaaaaaaaaaataaataaataatataatatattctagcataacgaatttggatacatctaggatgtgtcatggagcggagggagtatactagatgtaaaaggtagatcgctgacaatgcaaattaaatattagcaagcatactacgacgaccaggcgtacataatagaagaaccagttgtatatttgccccccaaaaaaacgaacatgaggaaaatgaaatgtgtgaaaggttttattgacccaagacctaataactggtatggactcagcaaattctagttctttgcagcgaaccttctattggtttatagttgtggcatacaatttaaaatgttaattgcgtataacagcagattcttgagaatctaagaataccttaagcagcatgtactagtgtttgaactgttctaaagtactccagttaggtcacattttgttaaaccaatgagttataaaaaggagttgaacgcatactctataaaaaaaacacgaatattaggaaggatctaatattaaataattagaaagggtgaggcttggaattcagatcgtctagcccaccacttgtatagctagccggaagatccctgggcgtttctcacacgcatactctataacaaaattgactctatgcaaagccctctgcagctctactagctgcaagttgcgacttgacagataggagtgggagaagaattgaagaaagtagcaacaaccttacaaccccagtgaggatgcgactatgtaactaatggagtataatcatgagctagtttcagcgttgactatgtacgttggcaactatcccgtcagattcaacagctccgatcgttttatttgctgtttggtctagtacagttattaggcagaatacaatacgccgatttttttttcagaaaaatgatgatactaacaacaaagataagtgaagtcaactgcttataataattggctggtagaccgggtgcctaaattaatttgactgcatggctgacgattccatctaggagcccaatacgtcaagttggtcaaccggcctaactgtccgcgcgcaatgctaactgtgcgttcagatgtattgagaagcaatagtatgtctggtggtgtgcgctgcgagcaataggacgactgcatgaatgcttgccaatgaatgaaacatccttccattttttgttctacaacagctgaaataaagtttccaagcatcatctttggggattcgacaccatcgtaacgctagtaatctgaacaatttggagggagcgaaataatagggttttcaatctcgaagaaaaggtagctgggtcaaggtagcaaaagggatggtctaggaggtagcgtcatggtgtgcggctaatatggtgatatggactatcaataattagtttgcagggagttctttttatcgtggtagacagtcaatatcgtgataataggcttatgttcatttgccggttccagtttccgtctccttctgttttttgatttggggctcttggtctgtaaataatctttatttctctttatgaaaaaagtgtgctccttgcgtattccctaaaaaggcaagcaatggtatgcagaaaattatccactttgctgaaatctttaaatgcatgccactacatctaaaactgttagtttgtcaaattattcttctggttccaccggccggcatgccaaatcaaaaatcatacacataactcgtccactttggcccaagaaagattcgatagatattagaaactgtaattttattatagctgaggcaagatggatacataagttcagtatctacagtgcttacatcccaaagttccatgtactatctgaaggtgatggccggaagtcgagaatggatatacgggctgaagaacaaggagcgagaaatgtacagatagtccactacaaagttggtacaatccactccccgcaaaaaaaaaaaggggggggggggggggttggtacaatccacagaaatgaactgcagaagatcgatatccgtttgcctcatcaagcctttcttctttgcttgtttgaacgcaggaattcacagaagatcttgtagaaactgtgcgtcagagctagttcattcctccaagaatcgtggaaaattcccgtgttccaaactaccctgg

SEQ ID NO: 56873 - DNA, 1135 bp, Oryza sativa
tctctggcgccgtccccctgccgacgtggcggggcgatgctgaggtggctagggggagtgcgccagagtggctgccccctcccccgaatttttttatttttgttttatttgtttgatatttttttcacgcttagagacacacaagaaccaaccatagaaaaattgaactcaaatggacgtaatatgtgacctgtaaaatttttcctctcctctcctctcctctcctctctctccgaactagtgcagaggagagatgtgcaacttttttatttttattttatttttttgatatttttttcacacttaggaactcacagaaaccaaccatgtaaaaaataaactcaaacggacgaaatatgtggcatgtggaattttccaaagctccaccgaaaaacttctctcctcgaaaacacaatcttgcaagcggaatttggaggttttaatatcgccgaacccggcgaagcgaggagaatcggatgtaactttttctgtagatgtccgtgcatatattatttgcctgattccgagtccgtaagataaagttacgcctgttttaatagatgacatattttgtccgtttcgatagagttttggaaaattctacatgtcacatattttgtccgtttgagtttattttttatacggttagtttctatgttctcctaagtgtgaaaaaaatatcaaaaaatgaaataaaaataaaaaaaaatgcatctctatatactgtttaacttatatatgtcatttcatgtggttatattttgaattagattaagtaatttcatatagtggtagagtgcattatgtttaacatgctgatcaaagggttttacttaaggagttatggtctaattttagtgaaggtgcaaagtaaactaagtggtatgctagctattttcagatttagctaagtgatagttcgagtttaaattttttttgtggttggttgtatcgtgatcctgagtgtgaaaaaacatccgacaaaataaaataaaaatgacaccgttgcaactccatacagaaaaataggaatggaggcggcggcgccagccatgctggcgccctcctcctgccacgtcggttcgcgtgcgccacggtggcaggaggacagcgccagagaggctggcgccgccgc

SEQ ID NO: 56874 - DNA, 1212 bp, Oryza sativa
atttccacaccgattccagaactaccaacactcttctgatgggcaatactggaggcaacaacaccctagaaacaccaagaagaacgcggttagatagccagcaccgatagccaaactgctcagattggaagcaaaatgcaaatactgtgtagagttcgaccaggttatgcattacatggtgactgtacctgtgatttgtggccactggatcccggttcaggccttgctgcttggctcctcgtgcagatgaggcagagcagaattgccgtcaagaagagagcagacagtttggagctggatgccatgcctcgccctttttctctgagctctccctctctgggaagttcagggatgagggatcacaggctaattattgggtgatctacaagcttaaccaagtgctttatatagggtgaagaagaagagcgaggctgatatgccaagacaccacatgaaggacagcaatgtgccgtcgccgctaggtctactccgctgttcgcgttcacatgtggagtgtttatctgacgcggacgcgcgtgtggacgtgccagacgctcatggctctgcatgcaccgtgtcaccccctgtgcgtggatgcatatgctgccagattcaggggcatacggttgctcgtgttactgtgtcgatccatgttttctagtagtgtacagtatgtgcctagactatacggtgcccggtgtcctcccagtcacatgctccttcggttttcacgcctccccgcttccaaggaatccaacggatggttgaatcgcaatgtcaatggattacatgtacattaatcgataattatttttaaataatttaacagatttaatacagtataattctgataatttttacataactttcaaaaatcctcagtaatataaacctaaacgataattatatacgatttttaaaatatcatataccaatgacaataaagagaagagacagtggacggctgtagaagagtataatgataacatttgacggaacttatagaaattataaaaacaaaacccaacgggacaataaattataaaaactatgagatccaatttttaagagagaatctcttatatgccactgaaaattggcccgatctcttatatgccactgaaaatttgctcttcccctatatgccattggaccaaatttgcacactggatttttcacattttggtcctttagaaaaacttatttcgcaaa

SEQ ID NO: 56875 - DNA, 68369 bp, Oryza sativa
ctggcgccccaaaaaggaccatttttggataagtttttttaggggtctatttgcgaaataagttttttaaaaggaccaaaatgtgaaaaatccagatttgcacaccctattataccactaccgtcagttgactttgcgttgaccgttaactcaaaagtgaaaagacgtatttgtcccctctaagctgttaggcatgtagtaggttataatgtcagattttttaatttggttgacatatatatatgtatgtacaacatttcagctaggcattacacatattttgaatacatgaatatacagcattaatttatatattgaatatacggatatttttcagtcacataatttttagccactaccatcacgtatatttccacaaagacattatacatgtacaaaagcttcaacatgcagtaaacatatgtttccaaatcatacttagggacaacattgaagccatataatagatcgctaagaacaatatttctgtgtttcacagtataacaaacatatcttgtttgctggagcaagaacatatataaacagcggcacagaaaattgaacaaaaactagccgccgcccctccagcgaccgggcgccgccaccctcgcctgccgcctgcctgctccgacgcctcccctcccgcgaccgcgaccggccgtcgcacctccagtcgctagccctcccgtgaccgaccgccgccctccctggaccaagcgccttcgctgcgccgcctgctcaggggagccgcgccgcctgctcaggggagccgcgccaccccggaccgccgacctcgccgcgccgcctgctctcctccctctagggttttgtcgcgccgcatcctcactctgctcaggtcaatgcctcctccctgctagggtttttttgagaggattttgggcttgggccatttaggccaaaggctatttttgtcatttttgcaaaaatctgacaaggggttagttcctaacaactggcatataagggaagagccgattttcagtgacatataagggatcgggccaatttttagtggcatataagagattctctcaatttttaaaggttccaagaaaaataaataggaacagtggtagatcgagcaaacaaataaaggatgatatggtttgatctttcaaagtcttaagacaacatgataactatttaataaattttaagtaaaatcatattaaaaaatataattttgtatgttactagccccgcaactgcgcgggccacccaactagtttatcataaaataaagtctgtaggactgaaacatctcacatgtaagtgctctttgatttctttttcctcactttcatgaagcttaaagtaaatttaacggtttaaaattatataaaagctatatacaagtttttctgttgttacaacgtaattatatttatattaatattgtatttgttaaatttttaaaagaaaaattgtcgatagtttatagcaaaatcgatgccgattgaactttgcgtgcgtgattgcagggaatcacacgcaatctccggctaatcgtatgtctatcagtggtagacgggcaaatcaaccaactaacccccataattcccctcccgccgctgcgcgcaacggcaccgccaggccacgcatgaccacaaccgcaggtcatgcggccacgcgcacccgtacctcctagctaggcttgcggacggcgacaggcacgcgggggggcgtgggcgccggcggcaacttgagggggcggccgcggtggctggccagaggatcgatcgatcggtcagatatatctggatgcgacgggccgtgtcgtgcagcagctgcctctgccgagccgtgcgaacgctggcacggggcgagccgcgcgccaagcgatcgggcggcgcgcgcggtatacgcctggtcggaggaggaggcgtgtcgcgagtccgtttccgtgagacgcaggggggatatcatatccacgtatatagagtatagtactacgtgtagtagtagcgaccttagcgagccaaatattatctgggcactgtacggggcaggcgggcagccgtgcactgctacgattagtcggtacatcaatctgcatgcgaactgttgcgtgttccatccacggcgccgtggaacggtggaagcaagaacgaccggccggctgtacggtggagatcgatgggcacgcataaaactgcatttactcgaaagaggccggtggcatgggcgcacaggcaaagtttaatgatcgaaaagaatgtcggggcaagttgtacgtactgtgacgctgatactaggcggtggggatacaatacaggagcacacgaaagcggttttcggctgtggtaaatggtgacaggtttattgttttcgttttcttcctttattttgtcctgttagagggattcgggctagtttgatttgaggccggtttttctttaaaagttttggaataactactaaatttgttagagtagaatatttattagtataggcaaaatttttcatcaaacaaatattatacaatactgttaaagttgttaaaattttggttggataaaaaatagcttcaatctaaacaatcattggtgtttgattcttgtcattaagggattgtatcatactgttatcaataatcatttttgttttattatcgctgtacactacagtttttccaaatactaaggggagaaaaccctagctgccgcctaagcataccaccacggtgcaggcgcaaggaaggtggctatggggctttcaccgtcgcgtgtcttctatgtggtagccattagtagcggctagccacaaattatcgatggcctagcgtcgtccggttgaggaacgtgtggatggatacgatgacaacgggtagtttcgccaacatcaccgatcgatgaaaccacaaccccgtagcactatggtgatgtttcgggttgttgccgcagtggccgcctcgacctactttacattgctgactcctcctgttagattgttggtgccggtgccacttcaaaggacatgtctcccatactatagcgttccgagtcccttgttgtatgatcgcctatgttgtttctctatccatattcaatgcataatcgtttcatcctcgatctcgagagattgggtatggccttgaggtcgcgatggctctggcaacaaagaacctcaccagataagctgtggcagggactaaatatcccaattttgcagaaggaacacaaccttgtctcgattctatggtttgctcagtgggcgatgggaagttggtactgttctgggaggattgctggctacagggctcttcaattcggtcactcgcgccggctgtctacgcagctgttcccgctcggttccggaacaggcgaacggtggttgaggctttgcaagacaagaggtggactcgagacatctctgcggcgctggggatccaggcaatactggaatatctcaagctttgggaccttcttcgatcggttcagcttggggagggactggacacgatctcttggcgttgggagagttcggggatttactctgcacgctcggcgtatcgtcttctcttcttgggaagaaccaacctcaagcacaagccaatttggaagtctctagcgcctcctcgctatcggtacttcttgtggctggtcgccctcaatcgttgttggacagcggatcgccttcggagttgagggctgtcacacccggctcactgccttctttgcgatcaatgtgatgagacgattgatcacttattggacgcttgcccgaagtctcgctggctatggtggattgctctttcagctattggtcatctgagtgtctacctctcaatgagcactcttttcattcctgttgtgtgacagtcgcaaaagaatggcaaaggagcatcgtcgaggatttgacaccattgcaactttggtagcatggacgatttggaaggaaagaaacaatcgggtcttcaaccagaagagcaggacatgggcggaaattgctagggccattacgggcgaagcggatctttggcggttggctagagccacaataccggccatggcgattcctatgtcgggtgaaagctaaggtctccaaatccgttaggagattaggcttttgttttcttcctcttccccctcctgtatcttgtccccttcgtttttttgagttttcagcccgcactgtaaatacttttattccttcttaatacaaagatgcgcccctcgcgtattcccaaaaaataatcgttttgcgacatgtgcatgctttgggcgagacgttagttctccctccttgcgaggagagatgctatccgtaattcatttactctccgatgagatcttccgcttcgattcgatgtcagtcattaatggtgatgtgcacgtgaattgatttgcagaacgatcaagcgataatttcagagtctgttttcaacttcaagtttaatttcaaaatttgggaaatgatcatccaggttcaaggtaaggaggtcttcatggttagtagattttatccacaataccaagacttccattcctggatatggaggacagggttaattcgattgaagaaggatatggagttaacgactacatgcatcttacaagctgttgttgaagagacaatgattgtgtagactttcgtcacctatgaatagagattcaccgataagattttttattgataatgctatccatgtcttttagactggtgtttaattattaaaaatgttatggctttttcttttagtagaactcatatatcgtcgtgtatagtcttatgtgtacagcttcattaatcggaatttgatatttcactttagtggggttagaaaaaaaagacaagacaatagtaaaaggaattctaccgttcagaaattgaccaagtttgcccaaagtcccaaagtactggagtagaaggtaccaagatacatcaagtggatctgtggatgcctggcggatatacatctggtggatcttcagccttcaggagtactagccatcgctgttcacggcctatcacgctgggtgggccacgcggcaatttacgaggcccgcacaaacaaacccataaggcctagttgtctggctactccttttgcccacatgcagcccgcgtaccggcttcccaccgcattgggttgggctatcccggaccgcagcttgggagactgagaattggcagcctgcctgtgctgatgtggtggaagtatatacttcgtgaaaaaaaagtgaattgttgttttgtctagtccttcatccgtcagtgaatataatggattatatatttttttaagaactaagaaaatagtaaaaggacatgtgatgggtgaaaaaaataaagtagtataaaagttagtaggtgggagaagaaattagtataaaaatagatcatggaggaataaattagtataaaagttggtcggtgaagaatatagtatttgagattctaaaaccccttatattttaggataaattggatggagaaaatcttttctattcatggacggagggagtagtagactagtagtgagagtggattataaactctcaaatgacatcctttcatggtttacatatcatttaaatgattatgattttttttaaaaaaatatttaataagataaattaatactttctatgttcaaaaatatagtaacgtttagctatgaatttgaacaaacaattatccaatttcatagttaaaaatacttatattcaacttatccaagttaaaaataaataaattaaaccataactaggatgaggagggagatccttcttaggactggacccgcgaggtactcatacggcgtagactgctacgctgcggtccacgaggttcgaatacgcgaggacgacatgccggactggcaaaacgcgctgcatcctgcatgcattgtggtagcccggtaggctggttatgtgcgaaaagtgtagtgcaccaacgttcgcgattataatccggcaaatcagtcggaagggacacgcgaaataggaggacacgccattttctcccattttcatttttttctcttcttttacgtgattcttctttaatccgttgcaagtatcaagtatttctgttttttttctttcacttatgtttatttcttagatttcttttttcgttatacacagtatttttttatatcttcttaacagaaattttctatatataaataatttccatggaaactttctatataccgtgatattttatatatgtaaactttatatagaaattacatcatagctagaaagtttagtgcagaaataacaaaatactaacatggaatttttcaaatgaataatatccttggaaaatttctatacatagactttctatatagagagattttatatatgtaaactttatatatatggactttgaatatataaactttatatatagaaagatcttgttttctgttcgctaggttcgccgctagcgagctttcgcgcattagacatgcctggttatgtgagcctactccatcagagctcggcagctcgcagagaaaacgaatgctggagtactcgtgaaaacgtctagccccatcatttcacatataggagaaaaaaatcaaaacgatatatttgtaaattaaaaataatttttaaataaaactcttatatatatgtgttcttaaaaaatatctaaaaacaaatgttaaaaataaactatgatgaaaaaactctaaaatcaactctaaatttaatgttgaaaacacaaattttggttgataagcgtaacaatactgcttgcatactagggctatgttcggaatcatctgttcccagcatggacagtgcgcacggaaacggagcggtccattagggctaagtattagtttttttttcaaaaatggatcaatatgattttttaagtaattttcgcatagaaacttttttttaaaaaaacacaccgtttagcaatttgaaaagtgtgcgcacggaatacgatagagaggaattgggaacccaagcttccaaacacagcctacttgcagtcatttgcagtataaaacatcttttgtgccatttaattttgtcatcacacagtactcctacttggaaagttggaaacagggcaacacagcctgatactgcctgcggccaggccggtcttgatgtggctgtagagcctcagcaaaaccccagaaaaaacaaaccaaaaaggaaaagaaaaaagaaaaaccgaagcctataaattactacaacatttaatttgggacggacggagtattccacctaggaatagcaacaggtcgggtaggacacgggtagagcgattccatgcctgaccggagacccatgtgcccgcgcccaacccatgcccacaaggtctatcaggcaaaatcctatgcatgtgcccatgcccattgagcacgggcacgggcatatcgggcccgcctgcaccgtgcgccaccactgccgtcgtgcgacgccgcctgcgccgtgcgccaccagctgccgtggggattgaggtaggagaagagagtggggaattaggttagggtttctattagttgagtatatatatgtccctggttagtgggccaagagaaaagggtatgaggaataagagatgggccaaaattagcaaatacatatgtatcgggtcgggtatgggttatccgtgggcaaaaaataatgcccggctgctgtctgctatgttcttgggtctcgggctggcatggccacgggcaaaatattacacccatgcccatgcctatcgggccgggtattcgcggatacccggaccgatgggtaaaattaccatccctaattccacttgggagtaggggtgaaaatgatacgaaaactttccacttgtgttgtaccgttgagacttaacaattggacttatatgattgtgttttatgataaattgttgaccgttgagacttgagaattggatttatcagtttaaggggccttttattccgataaatttttgttactgtatttgcaccggttcgtttttgcgtcgttttcggtttcgataatatccggggtttccaattccgattcagattccgaaaaaaatataaaaacgaaaacgataaagatggtttccgtctattttcgtaccgttttcatccctactcgggagctaccggaggagcatggagctaccggtcttatgtggctgtagagcctgcagctaccggaggagcttaatgcaatgacgctaagctaggccctgccatgccatcctatgcctgtctctttttcttcggttacagttccaaggtctgaaccatgtgagatcgatgagggcgtcatgaagacttgctcatcctcgagaaccacatgagtacctcgcgggccatggggactggaccatcgagaaccacatgcaggcagtcggccggcctgctgtccatagtgaatgtgacaaaccggcctgtccatagtgaggagcctacatttgctcctcgccgtttgcgtgcgatgttctgcacaaccgagaaccgtgagagagaaagaggctgcgtgcgtgttgtaggctcctactacttctgtagtagccatgaaattcaaggcgactactaacgacgtgcaaaatacgggccgtgcatatatagactgtacgcggcgcacaacacgctgcgtctttgcgtaatgccccaccccgtacacgagtgatccacctccctcttattacagtcttactgttgggatcgacatctctcaatttgggatttagcgtgttgtcagcgacaaatagaacatgtatcttatatgctaaaggtacaccgatttaatttatgtactcgtacgtgaatatttacaagaattacagtgaggtacgtagtgatggcctcttaatatagttgagcagtggctaactaatatgttttcatttacttgtatttcagatctgcctgttcacggtttgggcacaaaccgttcaacccgtgaaaccaaaccaacccaaaccgtttttccatttattcacgggttggtttggaaccggcgtaacccgttgaacccgtgtctcgtccttccccctccgaacctgcgctgagcttccgcggcaacaagacgccatggcgagaaggcatctgcgtgatcgaggaaaccaagcaatagcatcggctatttagctcgcacgtaagtgcaaaacaccgtagacgttggtgccggcagcgccgatgctggcgacgacgccgaggcagccaaacggcggctcccatccgaggaggaaacaatcgctagatcgccgccgccgctggcgtgttggtgtcctgcttgttgcctgcctgcctccatcgcatggaaaggctatacgagccatggtgcaatcggctgctgttgagcttggaaggacagccatggctgtgttgctgttcttatgcttgatccccttctttcacgtacgccggaagaaagaaactttctacggtttaacccgtcaaacccattgaaaccaaaccatatgaaccggtatttctaggttggtttggtttttctgaccaaaccgccaaagttgatgaataccttgaatttcagatatacacaaccattcaaacattttaggatggtctatggatttctcatcttttgtgaatatattattgtattatttttaaaaaacaaccacacttaaatatttatcttcaaaactgaaaatatttagtcacgtgaaatagaaatatctgacataacattagagcatatacaaaagactagccattaagttagccatttcaaaatatagccaacaaaaaatgcttaaaaaaagtatgaataagaaaacacatgattcttgtttttcatgcacaagatgcttacgagttacaagaaagaggctaaagtggactttttttctataaaattatagatagagaataatgttcctatgaaaatcaagatagccaatcatttaaaacgaatgcatctattagtagctaattcaaaggaactagtatcaatctttcattttttccttcacatttccttcatgccgaatgagcccatagcttagttttgtgtattagagattactccgtatgtcatatatataatgaaaccgtggggtgtttcaaataagcgtaaacattgcatgccattccagtaggcatagaaaagcctgaattccggtttgctcttataggacctatgctatatgcatgaatgcagatcgacttcaatgcggtgtataagcataggactccatgtactgtagcactacacgtctgccctctacacactgtgtttagttcgtgaaaaaagttggaagtttagaaaaagttagaagtttataaaaaaagttaaaagcttatatgtgtatgaaagttttggatgtaatatgatgtgatagaaagttagaagttaggggtagttgggggtgaactgaaatggccggccaccatacgccaaactagtcgatcaactgtaaaaatgcagttctaaaaaaaactgtaaaaatgctctgtatataaagagttccaggtctgtaaaatggccaggtgccctcctctctctctctaaaagaacacgtgacgccttcaaagaaacaaacaccagttgacatagtactagtgtactccactccactacggaggagtactatactggctgtgcgcctatggctatgtatgcggctacagcgaaacatgggagctacaggtagaattttgtcgtcttcacttgtcgcctgcggcctcaccagacagcaggactgagccgacgctgctgtagacggagtaggactgtaggagtactcgtactagtagatgcgtacgcacatcgatacgcatttcctcccatctgcagagaatttttggtacttatgctatttatgacgggcttgccctatccaggagagccaacctgagagatttgctgaacgaacctgcaagtgcatagcctcgtttcttgctgccgcctccctggagtcttccctggcccggttaacctggttaactcgtgagccaacatcgaaccaccgaggtataacgatgacaaaacatcctcgatcgtcttgtaaaactaatatgccctttagttttctgctccttctctttagacagtactctttccgtttcacaatgtaagtcattctagcattttccacattcatatatatgtctagattcattaacatcaatatgaatgtggaaaatgctataatgacttacattgtgaaacggaggaagtattattctctttgaaaaagtgaaaacctaggtgctcttaagtctttgaacaagtgagagaatacaatttactcatctggccataaaaaagttgcatattacaatagtttaattaacgataaatctagtaacatctattttacatgattggtcttttttattttattgctattaatagttaaagttaaaaatggttgacttgatactatgttaaaaatgcttatgttttggaacggaggaagcaagtttttgttttgagagttttcgcttgatgtagcttcacaaacaatccttatttatatgaaataatacatattctcacgtaaactgtggctataaaatattaaaatatagaaaataaatcagaaactaactaaaagctagattctcatgcattatttctcagaatacttagctcggaaatactaggaccttcgtacgtgggcgagttgaatttgattgacatttcgcattggcagggaggcgcaagcagacagtaggacagttggagcttcttcctatgccttcccttgttactggtcgtgctaggtgtgaagagaaatagataattatctatataaatatataggattaactcatcatatacttaaatagttctgaaacgtaaatgtaaagtccgtttttcgtctgacgtaaacagagccgtccgtactctaacagcccgattcatcttccacggcaaacccaaatcggatccacaaaaatctatcgccatctgattttaaccaaacatccagcgcggcatgtggcggcggcggtgctcggggtcgaggccctcgcgtcgggaggggcagaccgcagacaggcaggacagccgtaacgacgtactacgccccatgggagtacggaggggatcagatcgatggcgttggtggcgaacgttgtacaccgcaacagtggcggcgtcgacggctcgacgctgcgctggccaggtcagttatctcgcttcttatttgagaaaagaaaaatgtaaggtgtggacagtttgcctcatattttcttctgttagaaacgtttgctctaatgcagtcatctttaaacacctaccattaccaacaacgcctctacttcgcccaaaaaaaggagaaaaaactctacttcacccgtagaggttaatccaattttgacatatggcccgcgttgaaataatacttttgctgaaaattatacaattcgtcatagtattgattagagtatgtgccttcgcccttcgctaaacaagtttggaagagctggcttgcggtttcgcacaatagccaatgcaatatttattggatttacacttttggactataggacatgtctcaagatttgtagtcggctccttctccgactaactccttttcttcaacactagcgacactccaaaatcaacagatgacttgtggattaggattgtggtcggggtaggaaaaagtttgaaggaatggccgtcgaggatggtacttatagtggacgattgccggagaagtgggaacccgggtccccacctctgattactcgggacatcaaagatctccggaacaggtcacgcggtactgcatcccgctagtcaccagtagactaaggctttgtctcttggtccaactaggtgtgccccaagctcatggccctgagcttggttttctgctcgttactcgggtcccctagtgaaccataagtccataacgatgatacgacctgaaccatcatttccctcacgtctcacggcgatctcacatttaatgcgaaggatacaaatcgaacgggcatgcgtgaagagcaacgaatgacaagatggcgcataccgaccataaacaagccatcattactcctaaaaacccaagggtatgggctagcacgcgacatggttgactgctatgtcacctcgtcgagccccccctcccccaaatgggcatgcctctgcccaacgtcaacacatgttaccaactccaagccatgcactgacacgaggacgaggtagttgtgcgaccccactgcatgcaagcgccatcgccatcttctctaggggagctcttagggggtctagcacaacccccatatgacagcatatgaaaatactcctcttacatgattcccctatgtgggctccatttgtaagtgacgatcaacgtagtatctagattcgggaagaacctatgcccgcaactccgcaaggatggggggtccgattccaaatcagtatccgacagggctagctagagaaagaaaactttgcacaccctgtaagattggcaaaaaagattgagagaataactcgagaatatggtattacgctttcgtgcggcttgaacttgtataaagtgcttgcctccatccatttcaccccatcgtgaacttatgtccgtacacctgctcccttgccgaatccagggggttgtgcttctacttgttattgaagcttgagctctggcagctggcaagcatggacagacggtggggatgatacggaaattgcgcagttgaaggagggtggtaggtgggggtgatggtggtgctagggcgctaggcaaatcatcgccacccaacttagagaagaggagaggtggggagaggggaagagaaggagaatggccaacagagcctcgtcggtgctgattagggggagggggggagagcgtgctacgcaagtgagactgtaacactggatgaggaggtgtcactttgataggagaacgaggagtgcagaggaaagataaggttatactgccgtttaatattgattgagattggtgatttacttgcaaattttccatagccagtcccaaaatttattacagtatatggaatcgaactgtttaaatgtgacccacaaaagaatgtcgggcatgagggagcctagaaaaagagaaggaaaaggaacatctctggtagggcacattcctctctccaatctccatggggcctatcacaaatccgaagaaaccacaaacagctggccagccgaagaacaaagtgattgatttggtagcagcaaatcaacaccatcattgcgcaggaggacaacgagagagattattcgacctcctggctcctgctgcgtgtccggcccgaactaactaaaactatacactaaacgcaacacagctgggaggaggataggagaacttatccagctactactggtcactgctggttcggtggttcccgggacaagaagctaggcacattctcctcccttttttcccgtggcgagacgaggggccctccgccattgccacgcccatgctgctcctcgagggaccagcgcgctagcgctcgcgtttgaaacctttgctgcgtgcttccatcagggagagaggatgatgcggcagctagcagcaatcagccaagcaagcatgcatgcttgcgcaggcaacttttgttttcgcgggcaaagcgcaacggatcgaccgatcgatccggtggtttcttgggtgcactactgcgtaggcttgggcagctgggctgggtatgcagcagtacgatcgtacgtagggcatgatctgaaggctgaagctgccatgcatcagacgagttcatcatggtgcggcatgccggcatgcagctcgttacggcgacggcaacttgggccgtgctaggtttcatgggctaatgtttagccttgaccttttagctttaaattagccctcagagcagactattagccagctataaacatattctaataagataaaagatgagagagaagagcagcgggctatagatttgtagccagctgcagcacggactccaagacacagtgtgtgtatgacaggtgagaccatatattaatagtatagtaagcaactattgtatgaattagctattagattggttatagatgaattggagccagtagtggcctatactattaaacttgctctcaaggatctaaacaggtgggctaattttgagctaatatgaattagcctccctcaaaacattaccctctccaagggacgctaatggggctaattttgtgttgggaccatcaaaatcagctctctctctctccttccctctcctatctttctactctctctctccaccttttagccttgaattagcccatggatccaaacatgccaccctaggctaatgtttagcctactaattcatgactaaacattagctctcaaaattagctctgggctaatcttccaaacagggccttaggcctgggttcagcacgtactcttctagtagtctagcactatactgtactaccaagggatttacagcttttctttttagggatttacagctttaattagaagctgcccaaacggttcagcttttgatttaggccgagtttagatccaaagtttttcttcaaactttcaactttttcatcacatctaaacttttctatacacaaacttccaacttttctgtcacatcgttccaatttcaaccaaattttcaattttggcgtgaactaaacacacacttagattctaagaagctagccagaagctaaaaaaaattagcttttccatattctcaaaagctagataccaaccagctacttctcataatcttaagctctcccaaataggccctctattacactaacacctcacttcccagcttcgagggcagcgacagaagacttctcaaattcttcgaaatagtaccaagcacattaattcaagggccatatttttcccttatcaaaatttaaatcttaaaacttacttttttagttaattttatttttttcatcacagtttcttttcaacattaacgtttaagtcactaaaaacacatatgtaaatattttaatcataaattatttttcatcgctattatcagtaattggccaaccgatggcaacccaaaacttcaccgagcatatatgcattgcacaattgtatcacttgtgttgttagggtttcctttggattattgaaggattttcagatgaaaaaatcttaggaatttttttctagggaagttgtttgttttgtagaatttggtttggcaaagtcctttggaattcatttcctatgccctaatttcaaaggattttaaacatgggtccaacctcatgttatccgtttcctataaaaattccaaagtaacatctctctttcactctctttatcttactcaatcaaagtaatacattaatttccctaaaaactaaagtagtacgcaatcttaaaattcctatatttttttctaggagccatccaaacatatgctatgtacaagcatgtgattttatttctcatagggtccaaccgccacaacatttcaatccttttttttattcatgtgtttttagaatgatgatgtgttcctaagaagcccttattgcttacttctagtactactaagagcactatctatttatagtaccgtcttatctgtctggtatttcctctatcctaaaatataacaacttatagcacatataatttattccaaaatacaacaacttctacaccaacattctttttccaatcaataacaacctttcaccattcacttttcttatatatctctacttctcaaccaatcataactcatccccatttaattatacataatttcttaataatcgtgttcaactctaaaacttcttaggccatccctaaccatccatgtcatctagtgtccataccgttaaatacattgtcacatagcaaaaatccgatgagataagagagttaatgacgatagatgtaaaaagatgaagaaatcattctcatgcaagaaatcatctatacacaagaatcaagaatgaaaacaaatggataggtggataaaaggagagagaacagaggtgattggataagaattttatttgaaggcaccatccattcagtggcggagccagaaaatctacacgtgtggggctgaattaacgggaagtcaaatattttcagaattacatggtatttttcaagattacaatgggaatcatggagctagtcatggggctcaagccctagctgccccatgcctgtttccagccctgcatccattggatatatagtttctatacatggtgtttatatgatacggtaatatggaactacttgatagtttctgagttggggatgaccttaatatagtattgtacagaagtgaccttaatatggtattaaataggagtatgttgttgggaacggtgatgaaggtagtgcaatgcaccaaaggatattggggagtcaggcaatactccctctgtaaaaaaaatcaaatctatttagattcatccataggatttgattgttttcgggagagagtgagtcgtcattagcaatagagttcaaaattgcaggcaataatcattcgtggtagagttcaaattgcaggaggaagaacagtgcacaaatataccaggaactcgtcctagccgttttattgaaatccgatccgattgcccataaggatagctacagtaacgacgctgcatgctatacatacatggatgcacaataaactcagagtattgctacattgcattgctacattgtctctgtagatttctgtcccatccgccacagacacactgttggcacactgcttctctgccgtcatagccagatccacgttccaaaccggcccttcacccccgaacaacaacaggaggtctggtgacatcgaatcacaaaacaatttcttcttcttctctctctctcttttgaaaattcacaacaatttcttcaatattgaatactcctactactactcctactgcattgcagtgaattttagtatattcagatcaagaagcacactttcagggagaaagaagaagacaaatgctgtttcctctttatggcaattgcgtgcactgatttccctcctaaattttaagcgatccgtatggaatcagaatgtttggcttgggcaaaagtgaagccgggctggcttttatcatgccagtgggtgactttggggccctttcctcatcattcctggaacatatgtgaaggctggctaccaaagacccacacaaacgcacagcacaggcattctttgtctgcatggctgccttgcgctgtgcttctttgaccaaactccaagccaaaaacaaacgcacacagcacactagtgtataatactagtagtaataccttgacaaagcacaagtgtttattacatgcatgccttgttcatccggttgatcagaggtgaagcgcgattaactaatgcacgtatcaaccgccgctaatacgtgccaatcttgctctttttgagctttctagaacacgtccaagttgagcattgtttcagtgaagcagtgtgctaaattgaatagcagtactccggttaagataattaataggcgggcttgattcgttcgttcgctcgcgggctttgctcgcatttgcgacacaagcagtgcagcccagctaagctagctgttactgttgcgaagtgactggctccttgtacagttgtcctgccgtttcaatctctgttagatacactctccccttgtctctctctctctctctctctttctctctccaatgtccatgaagtctgtggcaaaagcagccttctttcagccactctgggcagcatccagctacatcgtctaggcagcagtagcatatggtggaacagagagaggaagtcctggccatcctgtccaatggcaacttcacaattaaattcttgcatctttatgggggtgcttgtttgtgcttgtgtgctttgaacagcatggtgcttaattgcctcgataagaaaaggagagggggttaagcagctaggagtaccagtggtgttcgtggcttcatgtcatgcaagagagctcagctcacagatccctatggagtggatagctatcgtgggagaggccaagaacaaactgctctagattttgtatcgtatcctcgcgttgcattacggctactactgctgctgctgctacttatccaccgcttttttgctttggccctctcattccttttgcagtttttttctgctcagctcaccgggtcccctctctcatcttcctcgtcgtgcaccttgcatggatgtagaagtagcgagctagcgcgcggcgactgcgagccgagagagcaacgcaagaacggcacgagaggctggcagcgagcgagcgtgtgcatggttggtgcgagcaaatggccagcggcggcggcagcagcaactggttaggcttctcgctctccccgcacatgccggccatggaggtgccgtcctcctctgagccatcgactgctgctcatcatcatcatcatcatcatccacctgctgctgctgctgctgccggagccatgtcgtctcctcccgacagcgccacgacctgcaacttcctcttctcccctcctgcagcacagatggtcgctccttcacctggctactactacgtcggcggcgcctacggagacgggaccagcaccgccggcgtctactactcgcacctccctgtcatgcctatcaagtccgatggctccctctgcatcatggaaggtcactgttcacctctcccttctctctcgatcgatttatataatctttgtctctgacattgatcttcttggtgtgaagtaggcatgatgccgtcgtcatcgccaaagctcgaggacttcttggggtgtggcaatggcagtggccatgacccggccacctactatagccagggccaagaagcagaggatgcaagcagggcggcctaccagcaccaccagctagtcccctacaactaccagccattgacggaagcagagatgctgcaagaggccgcagcggcgccaatggaggacgcaatggcggcggccaagaacttcctcgtcaccagctacggcgcctgctacggcaaccaggagatgccgcagccgctcagcctctccatgagcccagggtcccagtccagcagctgcgtcagtgcagctccccagcagcatcagcagatggcggtggtcgctgcagctgctgctgctggtgatggccagggaagcaacagtaatgacggtggcgagcagcgtgtcgggaagaagaggggccccgggaaagggggccaaaagcagcctgttcaccggaagtccattgacacgtttgggcagaggacatcgcagtataggggcgtcaccaggtaatctgcttacaaagattcagcttttgtgtgcatcatgtatcatcagatcatcatctgtgagctgtttgcacatagggtgtagaggccggaaggttccttccttgttatctgaaaaaaagagaaaaaaaaactgttcttgccatggttcttgtactgactagttggcttaatgtgtttttagttctatctactgataggcatgtgtgatctcttctatgtggcatttgatagtttggttagtacacacttgtacattgctgtttttgagctaatcagttattgctcggttgccatttcttgttgtcactcctactatactagtagtaatagtactagtttccagcattgatgagttcttcattccttcttacggctctgctgctcttgttagtcagtggggcgtctactgtttcttgattactactactaataatcagtttaatgcataacgctgcaatggttggatttattctctagaagtacctcttattttggtcctttgcacaagattatggcttggggtggctctgttacatctgatgcctcttcagttccttgtattgatgaggcacctactcttttgtttttgagcaaatcatttgaccctttttatattgaatgacgaaggtttgtgtgtgtttgattcactggagcaggcacaggtggactggaagatatgaagcccacctctgggataacagttgcaaaaaggatggacagacaaggaagggaaggcaaggttgaaccttgaacatctagtactactacaacatcaaaatttgttcatcttaaaaatcttgttgacaatgtcattctgatttttatatttcatcatattgggcgttaccatgaccgaaatttgatcgcttgcagtatatctaggtaactgttgccccttacaatttctttgttctcattgtacttatattttgtatctgttgctgacctttttcttcgtgttcgttaggtggttatgacactgaagataaagctgcgagggcttatgatctggctgcgctgaaatactgggggctatctacgcatataaatttcccggtatggatgatgaaaccgtgtagtacggtgggatatgggactttgattggagtatccattttctgtaatgtggactaatttattgtgtttggcagttagaaaactaccgagatgagatcgaggagatggaaaggatgacaaggcaagaatatgttgcgcacttgagaaggtcagcagcatgctcattttgcctgaattctatgattagattattatcagattgatatgtactagtaacaagctgtttttttaaaaaactatatgtactaacaagctgttcctgctcacaggagaagcagcgggttctctcgcggtgcttccatctaccggggagtaacaaggtgtttcattttgtgctgaacaagcatatgcatttttcttgataattatttcaagaacacattcgcatcaagatacaatctcactgtgttaaatgttaactgcattgcaggcatcaccagcatggaagatggcaagctcggattggcagggttgctggcaacaaggacttgtatctcggcactttcagtaagaaagacagtgtactctatttgatcttagaatctaaacgctttcacaaagtaatgcaccataaccataagtcattgcagcttttagcactaacattaactaactagcgttcctttgggatgtgactatcgatgatctatggaaattgtcttgtcaaagtagatttgccaaagaagttagtagtagacatcaatcagcagcttttactgctaatctctagtattgtcttggagtactgtacatcgttgatgcatttctttcctgatcattctttgcttttccagatggttgttcttttcataaggctgtgacctctgaacaaagcaatcagttgactgttttaactctcctttggactaaaagatatcattatcatgatgcaaaaataaccagattgtaaattgtactttgcagtaggatctacattggtttttggatgtataaacaagatggccttattacaacggagcgtttccattggttaatctatttttatgcaatacaggcactcaagaagaagcagcagaggcatacgacattgctgccatcaagttccgtggcctgaacgcggtgacgaactttgacatcacaaggcacgacgtggacaagatcatggagagcagctcgctgctgcctggtgaggcagcgcgtaaggtgaaggcgatcgaggcagcgccggaccatgtgccaataggccgcgagctcggtgcgaccgaggaagcgagcgctgctactgtcacgggcaccgactggagaatggtgctccatggatcacagcagcagcaagctgcagcgtgcaccgaagcaacggcagatcttcagaagggcttcatgggtgacgcgcactcggctctccacggcattgtcgggttcgacgtcgagtcggcggcagctgacgagatcgatgtcccgggagggaagatcagtggcatcaacttctcgaactcgtcttcgctggtgactagcctgagcaactcgagggaggggagccctgagaggcttggcctcgccatgctctacgccaagcatcatcccaccgccgtcagcctcgccgccatgaacccctggatgccgatgccggcgccggccgcagctcacgtgatgaggccgccgagtgccattgctcatctccctgtttttgcagcctggacagatgcttaattagagccatgttgctgcttgctcgatcttgcttttgatcggctctttttgtaaactaaagcaagatcagcagcaatcaggtgcttatggtacttaaattagctggaagcctggagtagcatacttggttatgatggtaagcactaggctggtggtgtaagtgtttaaccagtaaacccataggtaggacattcaagcaaaatccaaatctctagagcatccactggtagtagtagtagtagacctttagtgttagaccggtagtgttctttgcttcttttgagcctctttttttgggggaaatttggttggaatgtatggctttttaacacgaaatcaggaatgtatggcttttaacacgaaatctggctgtggcattaaaaggaaaaggttcagtgagagctgacatggtgtctctctgctggttcgtttcgttcgttcattcattcattcatcagttaagttggttttgtaatcagtggggtcgtggggaattcactgcaggtatgatcttttgaccggagtcgtcgtcccagctctctgtctctctctctcgtgttgcattcttttgctttctctgcatggcacggcatctcttcatgatggtgacgagaatcataaacattcccttctttttggttggggaacgttgccacaaggcttcctacattccagccccaatcattccaaagggtttctcctgcagattcccacggcaatgtttccatgtcccagcctacagcttcatgatggcatggcctgtgaaggtgagactaggctgacatagtcctcgttttgcttatgttaattacttccaccctcccagaatgtaacaatctagggcccgtctcatgtctagatacattttcatcctattttggttgctatattctgggacacaggtaatataaaccgcaacaacttattgttgaagatgagactgacatagttatcgttttgattaggtttattataaaccataacagattatcaataacttgaaaagtaaataataaacgatacttatgtatgtttatagcaatttaaaagtaaaatgctgaaaaagattgtaaaattactttaaaatttagagttttaaaatttaaattttgcgatttgcttataagctgaggggttccccatcgtttacactctcttcgtatatttttttttcgcgctgtacgtacgtcgttgcatgaggataaggggcttaggggagtcggagttgcagcacgttgtgccgcaatgatgtcaatgatggcatgtaccggaatcttggcggtctcttttaccatgtcagtgtcgtggcggcacagggaggcgtttgacccttgtacattggctgcaaaccgagagcgggcgataccccgcaacagtgacgcgcactatctccccccctttgcctttggcgcttgcttgcaattgcctttgcctctccttacgcgacagcctgtgccgacaggcgacagccgcccgagatccagcaagcgccaagtcgaatttagccaaaagcagatgtacagcttcctccctagcgaaccatgttgctcgctcgcagagtcgcagtcgcaggctcgcagcggcgcacagtcacccgtaccgtgcgtcctcctagcgaaccatgtgcttgctcggccccggcgtcaggcgggcggcggggcgacgggccccgcgccgctcgctcgagcaggcgcgtgggtgcggtggtggcggggtcgggggggtcatcgtctcgatcgcgcgggcgtgtggttgcacgcatgtcatgtgatgggcgggcgcgggcacacggtcgcggtgttccgtttcgtcgttggcgtttgtagccgctcgcgaggtgacaagcgaagcgaggcgggttggtttggttcgaacgcgcgttttttgtttgccgcgcgaggggtggtagcagcatggcagggcagcgtgctcgccgtcagcagacagagcgcggtgtcgtcttgctgcgccccccgcctgttttgtcgcggcaggatttttgcaagttgcaacaacacggttgtgtgagggttgcaacgggagttgtgattttcacaggggggaacagcgttttgtttgttcggtgattgattcaagagtgcctcgtctgtcttcacagttcctgctcgttccgtggcaattgaaatctgccccaaaaactgagacaatcacgtgtcaccagttcggtcatcaatagttggcatctctatgcccgcactatagtagtagtagtacgatctgaaaactttgacaccgtaccaaaaactcgggggtgcccggttaatcgagcttagatttgcttatttacctggctcgtcctatcgaggctgaggaaacataaacacagcctgtgatgcatgatgcacgccagccgtacgtgtacgccaaccgtgtcgccatgcgtaaaagcgtttgctcgcgggcgagatggcgtctgggtccgccagcgaccagacggtcaaccactttgattacctctgcctttggcgttgctcgtgagaaacgaaggtttatccttctgcttcacgtcgcaccacacgtctatcaatgtccttctcgcgctggacagattcagtgacttgacacaaagtttcatctcttccttttttttccagtaaaacttttttctttttttctgtttcgagaggggcccccgtttgtcatgaccgaaaacagaagaacccggcttgaaagcccatcactgtttggctggtatagccgaggaacaagttccctttagttccctcaatttagcgtacagtctgattttcgtccttaaccaaaaccatataaaaatatacaacccgtcctctaactcacaaaagtaatgcaaacgagatccctcgataatactgtcttcgattttagttgacgtggtgcctacgtaggttctttgactatgtcttcatcgcacttggcatttacgtgacgcttacgtggtagtttgatccgaaaaaaaatagcaaaattgaatataaaaaatatacaaaacatatcatgttggatgaagacctagggttggtttggtttgtggcctaaatagaccttaccaaattttgttagtgctaaattttagcaagttttggcatgactaattttggtaaggcaaagttgtgtttggattgaagtcaaaataacctaaattcactattcaaatggcctattttcttagtcatgctaaaatttgacttcaaaccaaatagacaataaacactattgaaattgtcaaatattgataagcctaatttagaccttaaaccaaaccagcccctagtaaaaaaagcaacgtaagtgccacatgtcaatcaaatttggggacaaaaaagtagtgccgagcgacctcgtttggctggtgttgtaaattggagggtgcgttatcaagttttgttgttaaggaacgaatttcagacatagactaagacctaaagtgaacttattcctatagccgaagtcattagcttcataaatgggccattcggcccatcagatcagctagcccgtacgtaaccctacggcccaaagctacggttgcctcctcttcagaaccattattgggaaaattgtaaccattccataatatgccatcttaacccacgacttatggagtcctatatgtcattgagatactgatggcatatgtcgggtagacaccgcttcagcctctgcccatccaactcgcaaaaattccccacgattccacgaaagtaggaaccatgaagcttcggttgcgatccatggaccagcgcggcggcgccggcggcgccgccgagacccaccgcgtgcagctgccggacacggccacgctctccgacgtcaaggccttcctcgccaccaagctgtccgcggcgcagcccgtgcccgccgagtcggtgcgcctcaccctcaaccgctccgaggagctcctcacccccgacccctccgctaccctcccggccctcgggctcgcgtccggtgatctcctctacttcacgctctcccccctcccgtcgccctcgcctccgccgcagccgcagccacaggcccaacccctgccccgtaaccctaaccctgatgtcccctcgatcgcgggagctgctgacccgaccaaatctcctgtggagtctggtagctcctcgtcgatgccgcaagctttgtgcacgaatcctggcttacctgtcgcatccgatccgcatcatcctccaccggatgtggtgatggcggaggccttcgccgtgatcaagagcaagtcgagtctcgtcgtcggggatacgaagagagagatggagaatgtcggtggtgcggatggaaccgtcatctgtcgccttgtcgtggcgctgcatgcggccttgctcgatgccggcttcttatatgcaaacccggtggggtattgccttcagctgcctcagaattgggcgtcaggttcttttgtccccgtatcgatgaagtacaccctgccagagcttgtagaagcgttacctgtggttgaggaggggatggtggcagtgctgaactactccttgatggggaattttatgatggtgtatgggcatgtgcctggggcaacatcgggggtgcgaaggttgtgcttggagctgccggagcttgcgcctttgttgtacttggatagtgatgaggtgagcacagcagaggagagggaaattcatgagctgtggagggtcctgaaggatgagatgtgcttgcctctgatgatatcgttgtgtcaactgaacaatttgagcttgccaccgtgcttgatggcgctgccaggtgatgtcaaggcaaaggtcctggagtttgttcctggggtggatcttgcaagggttcaatgcacgtgcaaggaattgagggatcttgctgcagatgataatctttggaagaagaagtgtgagatggagttcaatactcaaggtgagagttctcaggtgggcaggaactggaaggaaaggtttggagcagcctggaaggtttctaacaataagggccagaagaggcccagtcctttttttaactatggctggggtaatccttatagtccacatggctttccggtgattggtggggattcagacatgctcccgtttatcgggcatcccaatctccttgggcgcagctttggaaatcagcgcaggaacatctcacccagctgcagttttggtggacaccatcgcaactttcttggttaagtcatttcgtgggttttgctagtatgttaagaatatttcatctgaaaagctacatataacatattgtacatattttatagttggcactttatgcatgttcagttgttaactgtattactgtactcgtaatcttttctttctttgttgatatatcctatattttcttgtagtaccagtgttatgcatgccttaatcatggtaaagtatcgtctgtttaattctctgtgctacaatatgcatttcaaacacttgtaacttgtaagtctcatttgttggatgcctttagtcaatctgattatttcatccatcaacggagaaacaagatactggtcatgttatataccatcatgatctgctgatgagattgaaactgtcacttgtttctaaagtttgcgtgaaataactggaagcaggtggtgtctttctttggtaaaagaaaagtattgtccttatcatctctttgttcttttcgttttatatgctatgaaaagatatattcatcccatattccgataatttggaatacttgcttgccttttgtgctatggcaacttatgcatattattttgttatttttatgttcgtggggggttgtagcctcacaggttgtagcctccatactgaatcgtgcaaaactgctatcctacaaagaaggacaaacaaactggataggctgtactcattaatcaatgtctaagctagtgcgattaacttgggcagcatatggtccgaaaacaaagaaggaaaaggtgaacatatatcaggaacagatcaatagacttatcacgagactataaccactggtgccaaacgaattagcaaacagataataccttagaatttttgtatttggcaataaaatctagtaagaatttgttgagctgcactacaaacatgtatagataagaaatagcatccaaggcgaggatgatatgttgttaagacatactatcgagcaaatcctgtggcaggtttctcttacaccaggttttacctatggtttgtaagtttctacctgattttcattgtatatattattttgtgattacacgaatcaattgtttccttctatatattgctgaaaccgagctgccctgtttaaatgcattagttaatgttatacgttatctgtgtttgataaaaagcttctatgaaactatgaccactgtttgcttttgttttgatcaagctttcagtgcaaggacttttggttgtgcacacgtatgtgacatttagtggattttttaaaatcaaatacattatcagtacttggggctggagcaatctgttccctggggatacttttagcaggaacatgactgaaacattatcagtttaaaacaatatgactgattgtcatttccttattattgtaattgtatttagcaggaacatgattctgaaacttgtgtcttgatgatcagatacatgcggttgtatgatgtgtaaatgcatttactctgaccaaaggaaggatatcgtactagctgataagtatacctgtggtaattatatgcagaagcccgtcacacaacctggtaggtgagtaatatatataagcactctggggaactatttatttctttctagaaatattctgaatagttgttatgttacctgcatgcctaagttaatttcttattccctttgtgtcctttttgtgtttgtctgttactttattttgtacaatgtttcgcagatcgtcaatattctcgtggcttgcatctcaattggatttctccaactgatgcttcctcctaacatatccatttttggttgcgcgtacttgttttatgataaaggagaataaaggagtcatccttttttttttcacttcgacttacgaatatggtttattttcttggttgtcgatgcaccactttatgaatctgactgtagtatttgcttttacttttatttttccttcgcaataggtggcttattatattagtctaccattccctactttgccagtacatcactattgggttgagtttgctgtggtatcatttggttgatttggttcaggtataattttttaagagattttagtcttttgtcctaagtgaatatgggttgcaggatctatatgacaataaagttcttgattttatacagaagcttcacatttacactgcagtcactacttgaattatcaacatttctcactatacatatataatcagctgaacgcctgaaccttttgagatatttgagttatgactagaggcaaaaatggatagtttctttgtaaaacgatatataacaatcaataatggtttttcatggacttctgaagcaactcgacattgatgttcccataccatatttttcttgaggctatgatggttgagtgaaccatatagctcttctctctccatagtccattggagtcttagacctggggggccaaagattgctccattttcttaaagtgggctttatattgaccgcagggagaaatatcacttttttggtgtaggcgtgcatctatctactttgcctacacatgttctattgactattggactcatctgtctttatgttgcataattaaaccatgaaatatctttcatgagatttaactttttgatcacttctctttggactgagactgaaccaccgttacgatactcaaatgggagctgtacggagtgtcacggagtccaagaaaagctacaactttcagtaaggggagtactctttgcttgtggcttggtgcactgaaaagattgtgggggaaggagtatgggaagaaagagtttataaatccaaatgggtaagaatttgagtgttttactgccaggatatctcaatgctatgattggtgatctaaattatggttaaacgttactctgtggttccatgaactttggctgctctatgaaaagtatttagtttcagttccgtgccaaatacagcatttgagtttcagttatgtggcaactaccgttcatacgcagccttatatattttcctcattgttccttttaccaatagtcctgtaaacccgaattcttctgtttcacattcaactttgtcctgcatacagtatgttttacgttctcagcctgtgctattattgaaaggctattgcattgcagtggaggacctgaagcgatactgcatcccagcgacccagctcaattcacgcatccagttctgttagcctcggaacaatagtactcctacagatagctggctgatactgcacaagctacaggcagcctcagcggagtaagtacaagaatccaattcgctgccaacacacgtctgcctgccgctggcaggatgctcctgcagcaggcattcactttgactgtattattccactgccaatcaatccttaccagcttcccccatctgctggtgcctgctgctcaacaactcaagcttcagcatcagcaaaagatggtggcaatgtactccagattccaaagcctcttgaagtgaaacagcacagtgatgaacttctatgattgacacttgggcaccctgctttgagctttgccttttgctctctcatctgctactagtagcatgctggaccttatccttatgcaacacaagtaatatactaacaggtattgcttgttggagaaggcctaaccaggaccgatttttaagccaaggtggataggataatcttgtggcaattgaaatctgcaaatgtgcaactagtcttcttcatgaagggaagttgtacttctgctatgcttacaccgaggtgtaatcaaataaagacactgggaagctggtggaagcagcagtggtggccttctagtatcttttatttcacccctcctgtcctagccacatgtctctgcatgcagccactacatggtgaacactattcgttctaccataggctggtgagtaactaacacctctgatcaagagaggtggagcagagaaagtggcagcagccctcacccccgactggtaataagaactctccccttccatcctaaatatatatcttgttcaatattttctacatcaattttatgcattttggcagaatagtttctttgtagacagtgcattgttttttcccttgatgaaactacagcacaagaacattattagctgtttgctcattaagtgccaacagcctttttactgaacggtttctgtgctccatccaagtccttttgcctctcctcaatctacacattaaagaaaggggagaagtttcaacgttgtactaacccttgtccttgcatctgggatcaatcaatttctcccttctgaatttcgagatagcccttaaactgtcatggtagaagctctgaattggtgagtagtacgaagtgtcgacagcctgtgtaaaatcgggcagtcattgtcgtgcttgacagatcatttacagtgccagcaccaaattcggatgatggtatgtacgatactcactgttgagagccgaagaatccctctgctttgctactgataacaatcagctctctttttaacttttatcgatcatagaacctaatcacttccctggtttctctgatgatttcatcgaagctttgcacattcttagctgttgctgtctttgttgttctgtggatctgattctacagaacgaacttctgacatttccattcagatttcagagcgacagtttgaactgtgtaacaactaaccttctgtccttgttacctctagcctcacatccaccccagtgaatacgcaatctgagtctttgtgttggagatttcgtttaattacaaattaaaaagagaggactaaggtttagtctgtaacattaattaccacacttgaaacgacgccttacatctaggcactgccactgaaaggtgggttcccttttctcctcttatgcaagaattgttgaacatgttaagaataagactttgaaactaaaaacttgtaagttgggtttatcagaaaaaaatggtgaagaagggtattaatccagtagtacaaaatttaagagggtttaaggctttaagcaaagatggatctggttcattaattaatcattaaccttattctgggctggcccatacagtggatgacaatagcatctgttctttggtttggtcttcattttacagtaccacctgcaatttatcttaattcagagaattttattctgattcatggatgtgatccagctggtgcatggttgttagcagtaccgacaattctattccaggactgtggtttccacctttgcccttgcgtttgtctattgcattaggcttacttaacttttcactttggacaatctttatgtaaggctgcaagggttagttgttccttgttgagccttgcaagaaattgactgccacagctcccgatctaccctaccctttaagtaaagcccattcacttgtcaaagctgacaatttagaaggccatcacgcatttcttaaaatgattgcaatatcaccctgagatcaagtatcaggcacaaggttggtggcttgtttaatttcttcatatgtatgttcttgggagttgggaactagcatctatctaatctagtacacactagatgacttatctcagagagttgtgatataatggtcatcatgtgattgatcatcgtttcttctgcagatgtattcccctccctgcagtgctgctgcaagcagccaagggcattgtttcgcggtcggagctaaccagcttgcttcgcttgaccttgccatggacttcgacgagcctatcctttttcctgtgcataatgcaagtttgcaagaggggattcagttttacaatcctaccggcggtatgtctctctcgttacctatgttctattttcaaggataaccacagtatcctcctctctttttttttttcaattagataaccacagtttcttaatttgtgaagttcctaactattacagtttccgtgttccaactccccagatactcagctaagtagaaacatgagcattgacaagtgtttgaagggcagtaaaaggaagggctcaggcgagggcagttcatcgctacattcccaagtaacaagttaattagaagctctctttgcttagcttcatcgggtgggagcacgtttcatcgtgaaaatcgtactactgcaggaggaaaccggtgaaatgcctcagagagaactcagcatggagcatgccggagagaaggcgggtgatgctgacgctagcagggaggagtacgtgcatgtccgggcaaaacgcggccaggcgaccaacagccacagccttgcagaaagagtaattgatctctccaacattaatggaagatctttctgtgtatagattttcttgctcacacagcttcaccatctgaatgcagtttcgaagggagaagataaacgaaaggatgaagcttctgcaggacctcgtcccaggatgcaacaaggtagcaacgaaatcaataactctttgagtctgtgatggtgtggtgtgctctaacctgtgtgaacatgttgctcttgacaaagcagattacagggaaggccatgatgctcgacgagatcataaactacgtccagtctctgcagcgacaggtggaggtaagtgtcccgaaattacacatcttgtcaacaagaatttacacttctcaatgccaatcactgactgaactatccatgaagtgcttatccgtgccgggttttgcagttcctctcgatgaagctctcgacaatcagtcctgagttgaactctgacctcgacctgcaagatgtaagatgaaaaaactccaactctgaagaacaaataactcatctatcaccattgctacaccttgatcctttctttttcactgccatacagatcctttgttcacaagatgctcgctccgcatttctgggatgcagcccgcaattgagcaatgcccatcctaacctttacagggcggctcagcaatgcctctcacctcctggcttgtacgggagtgtgtgtgtcccaaatcccgcagatgttcatttggcaagggccggtcacttggcttcgtttcctcaggtctacatctaactccagtgaatacagtagttcaaatccttcagaacagccgagagttattcatgttttctttgctgcagcagagaggcctcatctggaacgaggaacttcgcaacattgctccggccggtttcgcttcagacgccgctggcaccagtagcttagagaactctggtatttttcagagctccactgccctacttgctttttttaaatacatttcttctgcagctgaaattctggcgatcgtgatgctgcagattcgatgaaagtggagtagctagtcagcagctggtgatgaacaattgacacgcctgaaagtcctgaaatgatcgcgcgttggactgctaatggagggatgcactctttcaggtttgcaaaggctgcacacaggtttccattggggtgagcgaatttggtggtcgtcgaagttctcgaggaaaactctgtagcctaatcattgtacagtttgactaatcgaaaagatgaaagtttgagatttggtgtgttgtactgtttctgcttggattggttgtgtaactgggtttggtggcaaatgggtctacttggattattgccataaaatttttgctacgatttcttaaaaaaaaaaactttttacaacgaatttgtttagactacttgtgctaacctatttattattccctttatttcaaaatataggaactacaactggattaaacattactcctaagatcacgaatttggacctagattgtgtttaatctgatcgtaggttgctatttttaagacaggcggggtaggttataatatataatattcaatttatcattaaaaataaataagtagattgtccatcgatgtttatttacatttcatctgtttgctcaatttcaaattatttgtcattctggtttgtcttgagtcaaatgtttctatctttgatctctacttatagaaatatgtatattttaacaacatacaaaatgtatattatgaaagtatttttatagtgaatctaaaaaggtaaatgttatgatgttaaactataccatcaaagatacacttaaagacaaaactcctaaaaaacaaagtaatataaaacagcgagtgattcaaatgggggcttaggatagatcttgattgcttacgaattatggattattgcatacatgttctccaagctcctaaacaatacattttctgaaaaaagacatttttatcaacatttattggtaaacttcttttaaatcaaatcatcaacttttctaatatttaatttttttatttgtgccaccgaataatggtcataaactcgatcagattcacccattcatctaataatacctataagccgaaaaacatggccggagtaagataaaatatagggtaagacgtttgtagtttcactttcagtggtccaaatcttatggtaagaatcgaaagcgaggaaaatgatttaattctaaaattaggtttcaaaaattgaaataggacgtgattaaaacaagtaggtaccatttgctaatgaattgattatttgacatatagttattattgtatgtacaggttttttaggatttaggaggaaaaaaatgtttgttttcaagcctcaagtataaaagtttgggattgaaaaaaaaagggaaataagaaaacatagaatttggatagaaatatatgtgcaaaacatataaacatatagaaatgatcgtttgaatagaccatagaaaaaacataggaatagaattagagagataagtcttaaagaaaattcttcaagagttggaaatttttgctaacttcttccacaatcttcatagaattacccattctatagaaattttaaagaaaatgataatattttgtttcaaaggttttcttaggattttctttttaagattgaaattctttaatttttctatgttcccctataaatcaaatcaaaggagcctttaatctggcttcaacttagataaggatactggaaagttgttatctatactactagtaatggtggtgtccattctatcattcacccctaccactaatatttggatcccacaatttatattattactagaaaaaatgcccgtgcgttgcaacgggtaaatgctattttaattctattattgttataactaggataaaatttattgtgggaattcacttggatattttttcagaaaatcatgagctgcaattagaagtctgtatttcttctcaagttagcatgtgagttttttttttcaaaaaatttcttatatgactcattttatacttctaaaaggaaacaagcttaaaatccaactcaaatacaaatatgtatttcgaaaaacgaaagaaaattaaaaccgactcaaatacggataacgtaccaaaataccataaaacattttcaattaaaggaatcaagcttaaaatccaactcaaacatagatatatatatttccaaaaatgaaagaacttgaaaaccgactcaaatacgaatgacgtatcaaaataccggcaaaaatatttttaacttttataataggagagatatactatcctccaatgagtcatcctgtttcactgctagctctccctaaattttgaaatcacatacttattcaataagaaaaatcataaaggtactgcttgtactaaatacgtgcataactgacttgataaactacaagctcaatttgtttttcgttgcaacacacaggctcttggctagtaaaaacaaataatggtggtgtccgttttaaactgcttttcgatttagctgctttcttatctttttcgttagcacatattttaaacttttaatcgatgtgtttcatacggaaactttattatagcaaatactttaaaataaaaaataaatataattcttaagttttaaaattttgatacttaattaatcgtagcctaattatctctctcgtttttgcctacgaataatcagccgtttcaccacgcttactctctgagactgtgaccgagagtaactgtaaagaacctgaaaaaagtatagagataaaaaaaaggaagaaaaaaacacacctgctttccaatcgcagctgcctcccatggcgaccaccgcctccctcctccctcctctcctcccggccccttcctcctccccccgccacctccacccctcccctcgccacctccgccccttgccaccgatccgcctcctccgcgccgcccgccgccgccaccccgacgccgtcgtcgtcgtcccggacgcccgcccctgggtcggcgacctctcgggcgccgccgcgtcctaccgggacggcagggaagaggacgacgacgacgcgggggaggaggatgacgaaaacgacgacgacgacgaggaccgcagcctggacctcctggtccgcttcctgcactcggtgttcaggaaggtctcccgccgcgcgcgccgcgccgccaggtccgtgctgccgccttccgtccccgctgagctggtccgttcaacccttccgtttctcccctttggtttcaatcttcttcttgttcaaattgagcggatccttctctgtattgtgtgatctggccttgatatgtttagtttatgcttgtgcaggtgaagttctcggtcaacggcgtgcttgttctcacgtttctatgggtcctaaaggggctacttgaggtgagcaattcatttgtctgaggcttgtttcaaaattgtgagctgattgtgatcatgcccttgatatgaactactaagtgttacactgtgatactatccagtggaggattcaggaattttcttgagcctggtcaaacctagtgatgtataacaagtacataaaaaatcagtatagctccatacttccatagaccatatactatgaacgcaagcaaaaccgacagctgccaagttgtgatttaggaagagcaaaaccagtacgtacgagagattatatcgttgagatgatggctgtctattgccaatgggctagactatggggctattatcatcctgacaaatgtggtgatgagtgctagcttagagttgtgtcggtttgaccctcgtgcagcaaacattcaaaccggcatatcaagtagtttgcttggttggtttggctcccattcgaaccagcagatcaagtagtaattgatggagtgctgtcttgctcatgtgctgatcgcagagcctggagaccagccacagttgctggggcttggctcctccgctgatactaacagtgacatataatggaataacattatatgtccagagaacaaacattgtgcatgcttctgaatttcatgtatgtccagagaacaaatgggtgttctaccttcgttgtcattcgcttagagagtgaagaagacaatcagtgtctgattacatgctgatatgacacttttaaatgtttgatttgagttttttcccttcattctgatgtctcgtaaatttggttttcaaattttggtcaaccaagtttgatgaacatggatgagaaccagacaagtgtatatgataccacaaaaaagattgtccttttctctaactgtcacgtgtagatgagaatcctcactttgttgaagtgatgccctcttttcccttgtactagatgcttgctcccagttttgagcataaaacaaaaacatgttctagtacagagtatataataatgtgcatatatactcagagtagggaatggtgcacatcagcacatggttcaatcattccttattgattgtctactctttgattggagtcatgcttatgatcaataaacagttatgctttcaattcagaaaattataaaaaaaaattgtgatgaaataacaaatactccacatgcattacaagtacaagtttgtttctgggagacatacaagtagtttagaatcatgagattacttaatgcttataatggcgttttcgatggatgaattcagaccaaatgagaatgaatcttgtattcttttgcactgacactttcagcaaatttcatttcttagcattctggtagtttggtcatgtgatttacctctggtgcttttggaatacgagttttttattcgttgtaacatttcctattgataatagatggaaatggttcgtcttattaagatgattctctttagtgaaattatgaattctgtttagtagagaaagagcctactgctactgctgtcaagtttgatcccatacccaccccaacccccagcgtctggcgggcttccccttctggatgagctcggtccaccgctatcctccacaaggtcgtgccattgtcctccgtcgcttcccctccctccactcctgtcgcttgccttccccttccttccgtcgatctgaaggcagtgagcagagaggccaaggtggtggctgcaaggagtagatggcgatgtcgcctggatccaagagagagagaaggggtaagaaggaatatatgctggcaaatggggacagtcggattttgtaaaattatttcataatcttgctgagtggattgccatgtgaccaaattaacaccatgtagtatcaaaaccactccgttttttgccaggggggtaatttgtccagattcaatagcttggaggtgtcaaatgtccggtattgtagtgtagttcgcgcagggcgggtgggtgtggggtgtaaatcgtacggtcctaacccttataattgcatacaagcttaaactacaccctggttctcaagcagggctactgagtactgactgttactctcttcaactgacacccctacacactgtcttctagtgccatgcctttccttcagtaactgtttatattgtttgtgctcaggtggtgtgcacatttggaagtatggtgttcgtgaccatccttcttgttcgtggaatatggtctggagtgacttacataagagaaaaccgatatagctatattcgccagattgataatgatgacaaccgatggagcagagtacagactgctggctaatcatttgatttccttgactacatacatacactttgcaccaaagggatcatcagtaaacctttcctcactgttaagacagcatgctaccagttcagcaccaactgccaacagctgttgctatacagcagagttgaacaagaacaaaaggaatcccatgtattcgtcgaataagtggaattttcttcctctgcacaaatgcaggagggatggttgagctgaacaagattaatacgcgtgtaaaacaatccagcacactgatgaatgagagctgctgctgtgatgcattttctgctactcttttcttgaagagatgtatcggtccttattagtgtatgtattgttccatgctgttacaactagccggtgtagaaaaactcatgtttgttgtattgaaaggtggtgcacgatacctttttggttaaaaagtgaatatcatttcgatttcatttgaatctctcagagaaatatgaatcaagtagtacgtcttttggtttgatacctgaattctgaagtgattgttctgggatgcaaatgtgcaacgaacctgaaatagaagccccacatccggattagcttcagatcatgccggggcgatggggccggacaactgtcttttgatcggcaacaggttgtcggatcttcggtttcgtcctggcttttcgttgctcattcgggcatttttcttcgtcggcgtgcccgtttgattttcgtgcttcatttttatggctgcaattgcaacggtttgttcagcattacttgataacaatgacgtctcaaatgcttagtgggggaaatggtacagtagtatataatttatgggccttctcttccaacaaaaagtttcaacgtcctcccccttaatttgtaatcgccgtagtgcttgccgaattgcagatatgtcacatcagatctgcgtggcatgcactcgtgcaaaagtccagggctccaggttggagttagacaaggatcactccacgcagaccaaaaaaatagaaaagaaaagggaaaatgcagttcatttgtctcatgtccttttgccttttgaacctggcccggcgacgtactaaacggcaaatgcatggctggaatccattctttggtgggttcttctctcatttgccaactttgttcttttgtttttcatgtgtatattttttaactgctaaacagaatattttttaaatatatatatatatatatatatatatatatatatatatatatatatatatatatatatatatatatatatatatatatatatataggaaagttattttaaagaatcgtactaatctagtttttaagtttttactaatatttaattaatcatatgttaataaggtaacttgtttttcatgcgggaagaaaaagttcttttaactctccttctcccgaacgcacgaggtgttgtttggcgtagtcctcttatcctctcctagctaaggggggctcccatcggatggcctaataagctaaagaaaaagctaaattttaaatttttaaacttaattctaagattgattttgagatattttcaacgtagttttttttcagtattggtttttaagtcaccaagaacatatatataaaagttttacctacaaatttatttttattctctaataagtcgttttgacttattaggaaaaaaaaccaaacgatggggcctggggtgtttgggtgtcaaaaataagtttttaggccccctttgattcaaaggtaattcataggaattttaaaggattccattcctatagtaatttttcctatatagccatttgaatcaaaagaatgaatcctatgaaatcctatgaaattcctatggaatgcctaaagacatgcaagttttggaggaaatctagcatgaggttctacctcatggaaactttcctatgaatcttcatctctcctctaattcttgcgtttttcctgcggtccaatcaaatagccattcctgtgtttttcttgtgttttgcaatcctctgttttacacttacactcgtaccaaaatcctacgtttttcctattcctacgttttttcaatcctgtgattcaaaggggctcttaaaaagggacttatttttcgtgagatagcacccaaacaccccagtacgagcttctcttaaatgtacaactctcggaccaaacgaatattctgatcgaggccatcaaggcttcaggtttaatcatccagagactcgacagaacgcacgccccagcggtgccacacggttgcggtcgatctaaaacaataatactccctccatattttattaataatcgcattcgcgaaatattttattaataatcaaggccttcaactgttcaacgagacaacgagttatctccagcaagccattagccagctagctaggctcatgctcgactcgacaggttcagacaaatgttcagtagctctacagatacgcagtatatgtgttatacgtagtgcaaattataaacctgaaaactaccgtatatatactacaatagttttcagatttgtagtatatacagggatttgcactacatattatttttttggtgcaatataacttaactgcacatgtatgtatttgctcgtactaaagcagccttaacctcagattgacaatgacttgaacccaactaattaagtagtagtgtagtacacactcaagctaactaagcaagaataaattgaaaactatacacactctagtttctactataggactaaaaagattatgcttcgccattactatatttgacccacctgatgttatcacgatggagacgtcagcgtgtagataaatgctacccataccactgacgaaacgaacgaacaaattttaagacacgtgtgttgcaacttgcaagtgttgcaaacctgcaactgactcagctccaggcgggcctagcttgaccctgtttagatccatgattaaattcctatcatatcatatgtttgaaccctaattaaaaatattaaacacaaaacccatttcataaccctatactaattcgcgagacgaatctattaagcctaattaatccataataatttgtctctcaaattagctctcatttatataattagttttattattagtctacgtttaatactctaattactgtccaaacatccgatgtgacgtagaatttagggtgcgatcgtttcagcttttcatgattagattctcctcgttttccgttagcttttcaaactgctaaatgatatattttatgcgaaaactttcaataaaaaagttgttaaaaaatccaacaaatttatttaaaaatatatatatattaatacttaattaattatatactaagtgtattttccgttttgttttgtgtgcggctaaacagtccaccgtcactgctggaacgatcgaaccctttagtgtctgatcaaaacaccaccagcctccaaccagacgcaatgaatacgtacgtacgcgaatgcgacagtcctgattggtcctcttttcttttgttttttccattgttttctcgctacttgccagagttaatccctatattttctcccaaattaaattgagtgccatgcatatccccaaatccctaaatcaaagtaacatcccaaatcttcacatcacaaatcctaagttacttatacacacaaatcaaatacatcacagattatacatctcatatttatgcaatgaatcacaaattctaaaataaagaaattatacatcttagcgaatcacaaattatatataaaaaaaaagaaaggatgccggtagaggagagggcgccccgcctccatgcatgcgcgccccccgccccctctcccgacggccggcgcctgccgcctgcggccccaccggccgccggatgggaggggaggaggagaggggatgatccgatcttatctaaatatctcggtgatgaggaaagtcttgtctaggacttaaccgatcgaagatgggagagaaatatttactcccggtttagtaactccaaccgggactaaagatggatttttagtgccggttggtgttactaaccgggactataaatctctggcgccctgacatcctctgacataaatagaactgggactaaagattctatagtcccgctgcacttttaaacctggattaaaaatggtttttagtccccttttttggttgaaccaggactattgtagattttgggcaacccggcaaagatcacttctccagtagtgtctacagtagcgttcatattggaagttgatatttgaaaattaaaatggtaatctttggggtggagttctgtcgatagctacttttctgtacggcttcggttggtcccatatgtacatgtgtctgcagtgctgtagttttcgcggcgaaaaggaaatgcatcaatcatgccgaaaattcactcaatgttgcctagtagtactacgctattgagggtgcgtcatcactgtttcgatggtcagtttgaatcaacacaaagccccctcgcatgccacttctttgatattacatcatgataaatagggttcgactcgttcatgtctccacacccaggttatgccgcaacatcctagattgaaatatgacagcaaacatttgctatgggcagggattagtccacttcggtaaaactgcccaacctgtcacgttttggaagaacttcggaataggtttttcctagttaggtaactcggtttagacaccatgacccctatgaattatcaagttgcagcttcgctaataagttgtttacaaaatgaaagaagaaaatacgaaagaaaagcgtacgctaaattttaggggctgctacaggatgggatcttgtgcccatctctccaaacgatacttgatgtcagactggtacaaggtttgatactcatagataccaaacttatacccccatcaattccctagctcatacccattagtatcgtattcatggtgggatgctatcatgtgaagccaaattgtgtcgtctcgcttagacttgcttttgaggatatggattcaaggaggcacatctaaaatcgacggcagtgctcagcagtaaggatggtttgccttggacggatgcatggttaatggatgaaggtcgatgtggtggcgcaggttgacatgaatgaacctagtgtggtggaggacagcgactgccacgatcgcaagttgacggtcggactttgcgaggaagatggcatcgacggtcggattgggcggtccctgtatgctctcaccatcgaggcatcgacacataggatcatggttgtcgtagctacatggatctaggcttgtcaagatccttcgcccgaagttgaaccatgcaagtgagttaggccagtgccaccaaccactagtgacctcctagatctgcatcgtcgaggccatccctgatcttgctttacatagcctcgttgaccctagtgtcacaacctaaatctcattaggcttatccatgacggcttcctccacaacctcctagatcttgtttgtgtacgccagctacaaccttgctcttgactgcccctcctcctgccaccgccatcgcttccttagggaaggtctcttttgtcacaaccaatgccattgtcgatcctgccgcttcctgatgagactaggcggttaggacgggatgagcaaggcggaggattggggggaggggttggggacgaggaattcaaggtcgtgggttcatgttgtcacatcgtcccacgagcaggatcccaactttctattgtatgcattttctttttttcttaagacatcactactaactttataggatcacaacatactcggaacacatcctgtagtaggcataactactttttataggaacacattctgtagtgttcatgctgtcatgttgtcccacaagcttgatcatttaatctctatcacagtaccctttcttagaaagtgataaataatttaccactcatcctcccaaagtggtaaatagttaaatagccgcgaagtgagcgtagtcaactggctaggttagtatttgtcactttctagcgtagttcaagtcccaaacttgatacggatgctcatatttacggctaattattctttcagtgttaggaaatgcactcatcgatagcgagatgcctatggagatttcttcaatctcatgatatgttggcctagtcttttgtcggaggtgctcataggggtagggtgtgcctgtgtgtcttcataggggtgagtatgcacatgttgtgagcttctgtttttgtacagtgtttctaaaaataatacaccctccgttcaagtttgattatcacatttcaaaaaaaaaattggattttcaagtttgatcgtcacatttgcaatcggcaagctgtggcccttttcagttgacatgcgaaattaaccagccgttgtgttgacgcctcgggagcacttctcaaaagctcattgcatgcatgctaaattaatgtcatttacaattagctacatatcgtttgtttcaccttgattgtcaagcttgcacggcccattacgataggcatgctggtcagttggtgtaggaatagattaggaagatgataagagcgagtataataagatgatgtaagcgggctatatatgttgccacatcatattcatacttagagcaggtacaatagcaggcgataagccagctataaacatattttaaagagataagaaagagagagaagagtagcgggttacaaatttgtagtcagctgtagcacggactcaaagacgtaatgtgtgtaccacaggtgggactaggtattaattgcatagtaagcaactattgtatgaattggttattacattggctatagatgatttgaagttagtagtggactatactattatgtggaggaaatagaagaggagagagagaggaaaatggtgtagtaacatatgtgagagagaaatgtggggaaaacattaatggtgtagtatgtatccatagttaactattatattagtaggctattaagttagctatagatgatgtgttaatttttggagttagtagttggctatattattgctctaagtgtgcttgttgttcttggtccttgtatcgggtcaaaatatgacgattaaacctaaatggaggatagttaaataagctctttttcatagggaggcaaatcaggcaccttattaaaaaacacttcatattcgtcttatttaaaaggtttatataatagtattttttgttgttgttagataataaaatataatactttatacgtggctaattttaaaaaaaattataaattttttaaataagacatgcggttaagtgttggacagagaaacctaaaaatgaagtctctgtgcgtgttaaaaaaaaaagtctccgtgggatggaggggtatctcgtgcaacaactgcagcatggtcttcagccatattgaccatgcttttagttttcaaaaagaaaaaaagaccatgcttttccttttttttttcctttttgttagggggcgtgggatgggggttgggtttgtagaggcggcatgatggggccagagcgttgcatggctttggctgaaacagatcaagcacgataccctacaatattggagtgtgttgtagtcttgtagaggcagcatgatggggttggagtgtaccttatctgggacgacagagcaagcatggcgtgttacagttactcgactttacaaactaattatttttagtgctggataacgtacatgttaatatgaagacttttatatcgatttagtctctcgaagatgttcacatggtaagatgtgcgtattttgcatgtgtatataagtatatgcatttgtattgttttttaaaaaacaaaagtactttgatagtaaacaaaactaaaggcatgcttttcatttaatgatatgagacaacttccttagttaatttagatagtacccatttcctcgtgtaaaaaccaacataaaatataatatggtattggatatatttaaatttattttattagaacacgtaatatccattctagcatgtcctatgggatggagggaatacattttcgtctacttgcggaaaagagttgcatctatccctttaggtaatgtttggtttagggataaagtgggatgggttagacctatcctagttttgcgggatgggatgattccagttatctgtttggtttatggtatgggatggttatagttttctgtttggtagaagggattgaggtgggatgagatggacgaatttgtactcaccgttagtaccgtctgggggcggagtagctcggcggtgctcggatctgagaggagcagcggcggcggcgttcgcggaggtggcggcggttgcagacaagcggcggttgtggacgagacggaggcggcggcgggtgcggaggcgaggcggctcccggatctgagaggagcgccggcggtgctcgcggaggtggcggcgctcgtggtggtggcgctcacggaggtggcggcgctcgtggaggcggcggcgggcgcggtggcgaggcggctcccggatctgagaggagtggcggcagtgctcgcggaggtggcggtgctcgcggacaagcggcggcgctcgtggaggcggcagtggtcatggaggaggaggaggcggcggcgctcgtggacgcgcggaggtggcggcgggcgtggacgaagcggcggcgctcagggaggcgatgacgctcgcagacgcgcggcggagctcgcagaggtggcggatggcgcggtgacgccgttcgctcgtcccaggtgggacgagttcgtccgctagttttttggagatcagttggtcccagatcttagaggaatattcctctccagagatcaacccatcccacccacccctaaaccaaacacctctaaaagtgggttcgccccatctcatcctatccgatccttgcaaccaaacactacctcagtcttcaaacccaccttgagctaatgatttttgtttgaatcatggatctgtagctaataaagaatttgagatatatgttggccttgaagagttgaaggtagcacagctagctaggcgcgcacatgattggcccctgcaaggatgcacgcacatgtgtggattcgtccttaattttaaaaaggtgaccatcagatcgcatcaaataaatgcggtagtacgcgattactaaattgcaggctaaaattattcttgttatttctatttaaacagcactgtttatcgaccacgtatttaaataaagcacaacaataatgctagtaaacaaattaaggaaagatagcaaagccaggtttgcaaagaacaatgccttttcaaaattatcttccattttaattatttggtttctttattttatcaaaatatataatgtatgctacattaatgatttagaccaaccataatattatgaaagagtaaccttaaggctcttaagatgaaccatagccatttgtggcactgaacataagctgggaaaaaaaacaaccataagttcacgggcaacctcaagggaataaaaaaagtatctataagaatctctcttctccttttgcttcgttctctccccactcaataaaaggttgatttgaagtcttttttatttgtaaatggatcttacccatacaaaacttaaacactgtagcaattataacaactatgatcaactgacatatggtccaccttaaagctatgttttgcaataaacactgatcttgcctagtatccatcatctctgaacttcttaacacaagaggaacatgcgagtacagaaaccacccgaaaaaaatattatgtgtgaaatcgtacgttaataagcaaatatgaaacccaattactgtgacagaatccatcacgctacacaagtgatggtctgatagaacaaccaaaactaccgcttggtccacaaatcaataaagaatatcgatacgatcatatacgagcaatcattgttctcctcatatggtgaagcattcttgcaacttgcagaggtccgtggtactggtatgggcagcggcgtctgatcccatggcccatggcatatctgatctcaccaaaccaccccactaaactaacctccccagtctaataaaccagaacaaaaccgaagctaaaatttaaatttttaaaattaaattaaaaattgatttaaaaaattcaatgtatttttttacattaaaattttagtcgctgagaacacatatataaaaattttatactataaattaaatattactattgtctgataaactgttttggtttattagtaaatgtgagcaaccaatgagactttaaaatatctcatcgcatacagaaaagtaggaatactactccaaaacatacaacgggggattcgcgagcgtgtcggtgaactctcgtgcctcgtgtacgtgcggccggggcttgagcccttgatgggtttggttgccatgcagcatacaacaaatctgagaatagtgtggtgcgcgcgagacgctgctgctgctgcgggcagatcgctgcacgtgagttggcacagagcggcaggcaggggaggggcagctagcgatcggcgagggcgtatgtgcggtcagatcgcgtgacagatcacccggtcccagtcccacagggggaccagtgcaacggcacaaaggtttagagtacgagaggctcgtccttgcaagccaaaatgatttatttgaaaataagaattgatttattggtaaaatctttatatatttatttgtaacgagttaaaaaccaacgctgaaaaaatatgtattgaaaatatcctaaaatcaacttcaaaattaaattcgaaaaattcaaattttaacttttgttttgctttattacgtcaaccaataggactccgagtctagtggatgtgtttttgtcggtgtgttttacacccacttcgtgggtttttcatgttcagacaattccaaaattattgttagtactatgtttggtggattgaaaaaaatatatatatccgactcaaaatatattaactttttgaatccaaacaaaacttatattttaaagtaaaggaggtagtacacggcaatatcctataaagaatacaaattttgttgagtgctaggtatgtatcatgctcctcgcaaacaatttagaaaaatgttataaataaaaaataaaacctaatagtatacatcaccaagtcatatactatctctatttcaggttataagactttttagcattgtccactttcatatagatgttaatgaatttagacacatacatctatatgaatgtgggcaatgctagaaagtcttatattttaaaacggatgaagtagatatttaacaatatgaaggtgcagtgaaaaaaaaaaagataatttcaaaggttacgttgtgttccttatcatcatcgtccactaaaacttccgtcacaactctagtctagctctccgtgtgtcctccagccagtgtagtgaggttttagaattagtattccataaaaatttttgaaatgattgcacggtaattgatgaagacacataaaggattgcttgttgggctatcgatgatcaaattggcgatacgactttatagtacaggttgtcgacttgttctgtgtgatattggttttgatgttgtgttggaaaaattaagatgatggttgatatccgttcatcttattttgcgcatgctgcagttgatcgacattatggttgcgtggctctactcatctctcgcgacattctataatatggatcctttttttctttgcaaggtaaaaatctctatctagtttcacttcaaagagatatattagtagattttgaagattatgtcgacatataatttgaagtgacatgttttatttatcatagagatgatcaatatgtggtgattcacatagcatgaatcattttctcacaataagttttgacatacattattttgatcatgactgcaaataatttctgccaactccattaataccctctcggttcaacggtacccttgattgctatagagagtgatatattatcaaatttcttttcgagtcctaccaatcgacgtgtatcataaaatatgtatatttttatgtgccacaaaatagtatcacaacccggccaccagatattgtagacgaagatatctgataagtttacagaacaaaccaaccgtatgaaatgaattcatttgttaggcaggacccttgacgcggactatgacgacgtggccacctcttgtaatacaagttgcaacgccagaacaaaacaaaatttgcccatttggacctgtttagttgtaaaaaattttatccctacatgttacatcgaatatacagacacacatttaaaatattaaacgtagtctaataataaaataaattacagattccgccaaaaagttgtgagacgaatttattaagtctaattaattcgttattagcaaatatttaccgtagcatcacattgtcaaatcataacacaattagacttaaaagattcgtctcgcaattttatggcgaactgtgtaattgattttttttctacatttgatacttaatacttaatgcatatgtccaaacattcaatgtaatagcgccaaaaaaaaattgtttgaaactaaacagacaaaaaaaactcaaaaaaagagacgtcaaaatcgtatttttgggagttgggaaaaatccagcgatgcggaggaggagccgagccgagccagctatgaaaaccggagggaggagtcctcctcttcttcctccttcccctccgctcccgataaatcggaacaatctcgaagcatccgcccgtctccgcctgctcctcccaccaccaccaccgctgcttcccttctcccctctcgcccgccgccgcctcgccgcgacgcgcatcggcgccgccccacgaccgcagcagagaagcccaccaccacgcgcggagcggccgaggaggcctcaccactattggtgcgggatggcggaggtcgccgccggcaccgggcagctcattggcgtcgccgtggccacgctcctcgcggcgatcttcctcgccgccgcgcttcttggcagccgccggcgccggcggcgggcgccgttggcagggaagcctgcggccgtgggtggctgcggggtggccgacggcgaagggtgcggcggggatggccggaccgacgtcatcgtcgtcggagccggggtcgccggatctgcgctggcatacacgctcggaaaggtgactccttctcgcctacttagttcgcctacttagatgggttcttcttctttttaaatctgcaaatttgttgcttacgcttcgttgagaacagggtgattcaaaaaaaaaagattgaagaacactgcaagattgaatattttttttccggtaagttaggcgcaaggacgaatttttctatcctgaagcagagtcttaagtacaaattgccaacccctgtttatgcatgcgtcgagctttgatttatttctggaaaggcagctgatgtcttaatccaagaagactagattcgtgtatgaattaattgtgatttcatgcaatttcttgttttgatcaatatttttgcatgttctagcgtgccggtagaaagcgaagtctgttggtctcttccttttttgtggacatgaaatttgtgtggccaataaatgttggtgtgcaaaaaatcgcatgtcttgtaactgtgatgagaaatctctcttttccatctgcagtactccatactggccgtggccggtgaccacaagtcatctggatgcagcagaaaagggacagaaagtgacaaccaagaggagagttaatacatgatttgaataaaaataaaagatgaatctcaggtgttctataaaaccaatacaattttggttatagcaaaacagattttgttgattggtgatgcaaatcttttactgcagtaataacaatataaattaactcaaaccgaaaagtttttctcaaacaagttgtatagagcatgtccaatataattccgactgtatacagtttatcttctagtctggaactactgtaactccattactatatcttttcttatatagaagcaaagagtcacttgtgttcccttctctggttttctattctttatcatgctcctttctatctgcatcaacagagcatttatgtgctctatcttgacacaatggaatgcccaactaaatcaatgacccaatttattttcccaactcccagcaactatgagagtgacaccttcttgatagaaaaactgatactgcttgggcatatcttgagttcttgactttgcgcaaacttaggaggtggtaaaattgagataggtccaggagaaaatgactaactcaccccatgactgcttttgaaatatgagtgagaacactttgtgtgagcgtaaattgtatacacacaaaggatagtgagaacagtggaggcatggttgacaatgtcattagaactaaatgtttgtattaccatcaaccattcaatggaggggatactatacctagcacgtttgttctttgtaaatgatactcccaatgatgattttaacaagggctgttttaattttaaaaaaggtcaaaatatatacatattgaccatagtcaatttacaagtacatttagtgtataaaaattatacaaattggctcgcatttcaacgtgctctcacaaaatgtcggttttatagtttgaagaatatattttatgataaatcaattgctaaagtttaataaacttttcaaaaaaagcatcccctataaaaataatcatcggatgtattatatttttgagtctgcacaaacttccaaaagctgacaatcaatatgcttaaaaacacctaggttgcccattgccatatgaattcactgcatttcaccttaaaattactttcaataatattattttgtattgatatgatcacaatttgcccttgttattcagagacttatcgattaatacatgattttatactgagattctaatgtttgtagttttgtgggttgcgatgttccgttagtcacctagtgcttctgtatttgttaaaagcacctctactgtatcatttttgctctctaataaaaacttattgatattaaggcaattcaatggctcattatgatcaaatgatgaattacagtgaaacaattatccctgagatttctcttatcgctttttttttctttttgtgacttaggatggccgtcgtgtgcatgttatagagagagacctaacagagcctgatagaattgtcggtgaactgttacaacctggtggctacctgaaattgatcgagttgggtctcgagggtaagcttcccccttatctctctatgtatgtgtgtatgtgcacgcgcgcgcgcatatttcttatagtattagtggtacagtggactaaatctttaactatattcagattgtgttcaagaaatagatgctcagcgtgtccttggttacgcgttattcaaagatgggaaagacacaaaactctcctatcccttggagaagttccactcagatgttgctggtaggagctttcacaatggacggtttatacagaggatgcgccagaaagctgcatctttgcctaagtaatagtctttctcgacacaaatttatctttactagaatttttgacatacttatttttatgattttcttgtattgtttgatgtgagcatttcattagtattttagttgcctctagaggattaaaatattagattatgtttaagtgcttattttgctactcgtccagaatgatgtatttcacatgttctttccttctacatgcgccgtatctggatgtatctaattcgtgcacctgcatgtgacatgaggtaaatgtttggcattatgttttatatttcagtgttcaattggagcaaggaactgttacatcattggttgaagaagatggtacagttaagggtgttaaatacaagaccaagtcaggtgaagaattaaaagcatatgcacctctgacaattgtatgcgatggctgtttctcaaaccttcgccgcgccctttgctctccaaaggtacagtttttagattttgcactatccttttttgttcatgcatgtagaagatctaatactgatggaaatatgtggttaggttgatgtaccatcttgttttgttgggctggtcctggagaattgtcaacttcctcatgcaaaccatggccatgttgtcctggccaatccttcacctatcctattttacccaataagcagcactgaagttcgctgtttggttgatgtccctggtcagaaggtgccttccatagcaaacggtgaaatggcaaaatatctcaaaacagtggttgcacctcaggtattattttgctatttcagtcagtcttgtcccgagtttttgcttgcctactcatagcaactaaatgtcaatggaaatgttctgttgacagattcctccagaaatctatgattcattcatagcagccattgataagggaagcataagaacaatgccaaacaggagcatgccggctgctccacatccaacccctggtgcacttttgatgggtgatgcattcaacatgcggcatcctttgactggtggcggaatgactgttgcattatctgacattgttgtgctacgtaatcttctcaagcctctccgcaatctgcatgatgcatctgctctttgcaaataccttgaatcattctatacactgcggaaggttagtcttcactcttcatttcacaatttaccacccacctttcaaaatgtatgctgtctaatgtatggcgctttcatgttcacagccggttgcttctaccataaacacattagctggtgctctatacaaggttttcagtgcctcacctgatcaggctaggaatgagatgcgccaagcctgctttgattacttgagccttggaggtgtcttttcaaatgggcctattgctcttctgtctggtctgaatcctcgaccattgagtttagtggcacatttctttgctgtcgctatctatggtgtcggtcgcctaatgcttcccctcccttcacctaaacgcatgtggatcggcgtaagactgatttccgtgagtatctcaaatcttattcttcaaagttttcaaactttactatttccatcgtggtaccattcatggacagttttctatacaattttttcattccctatcctaaaccctaaacgctaaaccctaaatagacttttttttcccgtttctatactattgctaatccagagttttcactgcagagtgcatgtggtataattttccccatcatcaaagctgaaggtgtgaggcatatgttcttccccgccactgtccctgcctattatcgtgctcctcgtccaatggagtaaggggggaaaatgaaaggagaagcgaagagaaaatccctgccactgtcctgatcggcggatgtttttcgtggatggcaattttcctgtgtaattggtagtagtcgtcaggccgtgaggttgtgtgtgctgttgttctaatggaacgaggggacctgtatacaccgtcacattccctgtacacttgccactttcgttgttccgtcagggatgcatgtcgactgctaatccttaagctgtatatcccccatgaattcatcatgattgcgtctttgctctaactgggtgcgttgctaatccactgaattccattgggtaggactcctgtgtgtgattgattgatacaactgtgtttgctagtaaacaacatcattagggcattagcaatgcgccaccgtctcagcgagaagcccagcctccacataggcaaaaaacagacgaagctcctgtctccccagtgcgtgtagctttgggtggggtccataacagatttttttttctcacgctgggcccaccacgggaatacctttccccacccatctctctccccgagcaaatcgatcaatctcccgtacgtgcgctgctccttctctctcccgtgccgctgctccttctcctccgccgcttcttcagatcgatcccgtgctactgctgcttcctctcctcctcctcctcctcctccaggcggcgcaaatcgaggtgggacagggccgacgagatcccggaggacgtagagatggggatgggtgagatcgaggcggccggcgagctcacagcgacacggatcgagactgccggcgagctcccggcgccacggatcgagacggccggcgaactcccgaagggggcgcagatcgggatgggtgaagtcgtggtcgtcatcgccgtcattcgccggtttacctggtaagactacctccatggctgcgccgccgccgctgggctcctgctcgagctccccgcgaagggggtcgtgggaggaagggcgaggccacgacctccacaacgcggccgcgccgttctcccccacgccgcgcgccctcgagttgtcagatagttgcagaagaacgggtggccaaagtatgctccgcggacttggtttggtcgcgcgtgacgcctagctggctgcgaatctccgacgtgtcgagcgatggccgaatgacacgtcggagcactgtgaatggctatggtccaacatgccaagaggcccacgatctgcgatctgtaccatttaatattttcatcttctgtttggcttccggcgacggcgattgccagtctttgctcctcctgtctgttctgtctgctactgtttcttttatgcaaagttgcttggtccacagcactaaataaagccatggtatctatgatattcatggcattctttcatccgacgaacaattcctgcaagtagtagtcatatggcaagggccaaggggcatgtctgccagactgccacctactaataaccagtaaaaattatcacttcattaagcgccaagatccgtgcctggggatctcggactgtagcggcagaagaagaggtggtaatgcaatggccacagcctgtaaaactgggagccggacatggttttccggcctcgagattcgtgtggcgggggcgagatggacggctaccgtttgctcgctgaatcacgttgactcctgttgcgcaaagcagctccagctctgccaacacgagccacgccagcgaaagctgacgatgccattgccagctgctaatcagcggcggtccggccttttttcagctcacttcttctcccataaaacgtagtctcccgtcacctcgcttgcacttctctaagcttccacccacccacgtacgtacgcacgcagagcagcaagaaatggatgcggtcgccggcgccgggcagctcgttggcctcgccgcggccacgctcctcacggcggccttcctcgtcgcagtgaagatggggtggcggcgccgccgccgccaacgggaggtcgcgccggagggtggctgccgggttgttggcggcgatgggggtgaccggacggacatcgtcattgttggtgccggggtcgccggatctgcgctcgcctacacgctcggaaaggtggctacatttttgtctctcactcgtttgttgacgtactcgcatttggttgaggcgaatcgttcgtatctttttaggctggaattttgctttcgtaactactactagtaccagtctaccaccaacttgtaagtggcgcaccaatgcaccattgatacgaaaatgttttatttgttttttctaaaagtaatacatctgggttttttttctttaaaccgggccaacaatagctggtgttatgtacttatgttcagtacgagatgcagtttatgtacacttttcacttaggagtaaaattaccaaagcgccaggttttttttaacaatactatgttttaggattagtgcaaatttctaatcatcaagagttttaccatcatcttccttaaaaccacctagattgaccatggaactgtactagttccatttcactctatttctcacttaaaatactttcgtactataattttagtaacctgtacggtgaaaataatgtcttgtagaacgtgaagagtcaaaattgctattgatacaaacacattgagataccatagtgtcttttgtatttggtagaatgaatcacttctattgtactagtatcattcatgttatccgacaacagaacactcaatagtaaaaatgcagtcatgtatctcgttaccatcaagcgatgcattgtggtaaaaacagaaatatcctgaaaaagaaaatctaatattcctggtttcgtttgttgaattaggatgggcgacgagtgcatgttatagagcgggacatgacggagcctgatagaattgttggtgaactgctacagcctggtggctatttgaaattgatggagctgggtcttgagggtaagagtggcatttttcgaaaagcatcgtcagtactttgtacttaatgtcctttgattttattcagattgtgttgaagaaatcgatgctcagcgtgtccttggttacgcattgttgaaagatgggagaaacacaaagctttcttatcccttggagaagttccattcagatgttgctggtaggagctttcacaatggacggtttatacagaagatgcgtcaaaaagctgcatctttgcctaagtaataacttttgcgcatgcaagtttattttattgaaaaatcatatatttatatagttcttctgaataatgccatgtgaacattccatttgtttatattactctactggattaatacatttgattgtgtcaatttcttgattatctacacctccagaatgatatactctagacggatctattggatttacatacttgattatgattatgcaaaatttactactttgggcttttgctgtccactcattctctctttttatgtaaaaaaaatacacctgctttcagtgttcatttggagcaaggaaccgttacatcattgctcgaagaaggtggcacggttaagggtgttcaatacaagacaaagtcaggtgaagaattaaaggcctatgcaccattgacaattgtatgcgatggctgtttctcaaacctacggcgtgtcctgtgctctccaaaggtacatttttcaaagtatactgatttgcttcttgctgaattcaccaatactatttttgacttgactgaattcactaatattaatgggaaatacatgcgcttaggttgatgtgccatcctgttttgttgggttggttttggagaattgtcaacttcctcacccaaaccatggccatgttatcctggctaatccttcacctatcctatgttacccgataagcagcactgagattcgttgtttggttgatatccctgggcagaaggtgccttccatggcaaccggtgaaatggcaaaatatctcaagactgtggttgcacctcaggtattaatttttgctctaccaagtgtaattattattgtgtactcttcacaactagatgctaattgaaatgttatgttttcagattcctccagaactccatgattctttcattgcagcaattgataaaggaagcataaggacaatgccaaataggagtatgccagctgctccacttccaacccctggcgcgctgttgatgggtgatgcattcaacatgcgacatcctttaactggtggtggaatgaccgttgcgttttctgacattgttgtcctacgcaatcttctcaagcctctcggcaacctgcacgatgcaccttccctgtgcaagtaccttgaatcgttctatacactgcggaaggtcagacttcactcttcatgtcacagttaaccacctagttttctcagaatgtgtatacggttttagtaaatacaatgctattatcttttcagcctgttgcttctacaatcaacacactggctggtgctctgtacaaggtcttctgtgcctcaactgaccaggctaagaatgagatgcgagaagcttgctttgattacttgagccttggaggagtcttctcaaatgggcctattgctcttctctctggcctcaatcctcggcctctgagtttagtagcccacttctttgctgttgctatctatggcgttggacgcctaatgctccccgtcccttcacctaaacgcatgtggatcggcgcgagactggtttccgtaagttcctcaaatcttcttctttttttaacatcctcaaagttcaaatgcacggtcatttatacacagaaaactttgtggcagcctctctgacattttctcatcaaaatccatacaactgcagacgatttcattttctctacataactgaattttcactgcagggtgcatgtggtatcatcttcccaatcatcaaagctgaaggtgtgaggcaaatgttcttccctgctacagtccctgcatattaccgggcccctcctccaatggagtaagaatctccatgttagcctatggtgtttgctgttctttagttcttttgagctgtcgagtgtgctcattagagtagtctgttcttcctataggaaattgggatgtgtatcgattgtcaatactaagttgtatatccctctgaacttgctaatgcgtcttgctcattatctcttttagaatatttgaggtgctctgcttgtctctactgcaccgttggaatgagctagttccttgtttttatgggcacacttcctaaatgccacgcttttttgaaaaaaataatctttctagaagttttttttaaaaaaataaatgattttttttttcaaaattgtaatagttaatcataaataattatgtgttaatgacttatctcatctcgtgtgccgctgaaaagctcaactcaaccactaattcgaacagtgctttaccctactgaattccatggaccagaatagtgtttgatctgtaaagccctgtaggcttaggctggctgggaaatctaagagcaagttcaatagtatagccaactactagctccaattcatctatagccaatctaatagctcattcatataatagttacatactacactattaatacctagtcccacctgtcatactcacaccgcgtcttgaagttcgtgctacagctggctacaaatctgtagcccgctactcttctctctccttatttatctccttaaaaaaatatttgcagctggcttatagcctgctattgtacctgctttaagggggtgtttgggagtctctccaaaaaaaaattaaatctttaccctagggacttattttttagaagagggactactcccaaacaccccctaaactagtcgctttcgtccttgcaagtaatccacgatcaccgaaatcttcttttaagctgcttgttttgttgaaaaactgaaaatccgttacctttgttatgtcttatttgaagaccttaagattttaagtagctgtttgttagccatcttaagagaatatagagaaacggtaaaacccaacttttgacttctgttttttatttaattgtgtacctatatcgtcttagagaatatgatggactgtttgcgaaaatattttaattctgaaaaaattatagctgttaaaagctctcctaagcggactcttaatcgagactctagttgtacaaagaaacaaaaaatcttgtatgcaactaaagaagcaaaatcattcaaggaaaagatatagtagtaggacaaccacctggacaggttgaccagaaatctagagcacacctccaaacctgacgtatgaactcctactagtaaggacaagactagtgagcctctggaagctctttagagcaggttcaatagtatagcctactactgacttcaattcatctatagctaatttaatagctaatttatacaatagttgcttactatactattaatatatagtttcacctatcatacatgttgcgtcttggagtacgtgctgcaactggctacaaatctgtagcctactgctcttctctctcatcgtttatctcattaaaatatatgtttataactggctaatagcatgctattttacctgctcttagccagatccggataacgcatatcaatgctatcctgcatcgatcatgccgtttgtgtcccctgatctcggagctgctggaagcagaaaaaggaacagaagtaccgtgtttgtttcggcatcgaactcttcccttcaaacgtctaaatgcatgcacaggcgatatgacgtacacatacatgcagtaattaagcgccggtgggtatttggatatttggattagcatacccacgtggaggtcgtccaagaaaacgaccacttaacctcgtgtcaaaatcggcgtgtacttccgtttcgtgtcactgcagctagagtggcaaatttggccacttccctttcgttgccactgtgaactgctagctgcggctgtcctgctgctacttgcttcacgcgtgcgtgaaagtacattaggagaaatcaacatctgatgtttatggattgggaaaggaacaacgacgtcaaggctgtcacaacttaaaattaattgtaaacgttgtacatcaaaacagttgccttcaatcggctttgtgcataattgcattcaccgttcgcgtgcctagatgactgagtgactcggaattatgcatttgttcattagcgtactattcagttatctcaaagatttggcaatgacaagattttattggccacacagagattacgcagtaagatgatctgcatttgcttcctgttcgtccaaattccacttgcgctgtgatcactgtcgctacaggaagatatataaaacgacaataatctacattggatgacatgaggaataatcgggatccctttgcccataatccatccttaatctattgccactgtccatcctttcttgtcctcagccaggcccatctggatggacgtcagagtcgtgtgcagtgtctgcgataacgtgtcatgtccagtcctgaactcgtacctgcacacgcgcccaagaaaccgatacaaaatcgtcagagatttgcgggattcagaattcagatcgatcctgtcgtgaacgatcgactcgcagattttacctttgcccatggtaagtaacactcgatactggggcaacgaccaccgctgttccggtgcagaacacctcgtctgcgccgaccagatcgtcgatggagacgagccgttcttcaacctgcttggccaaagagatcacaacgatttcagaattaatttttttttcgcgaatactcaaaataattacacggaaaattttcagaattaattcagatgtgctgtcgccaaatcactgatggatgcagtgctctgcgtagattgattggtcacctgatagccgcggtccctggcgagctcgatgacgctcttgcgcgtgatccccggcaggatggttcccacggtggccggcgtggcgacgacgccgtccttgacgatgaagaggttgcaggaggaggcctcctccaggtacgtcttgtgcaccgcgtcgaggtacagcacgtcagtgaaccctctgctcttggcgtccatctgcgccttgagcacctgaacacatttagatgtaatagatattaattcctccatccaaaatattgttacttagtatggatcccattccaaaccaaagaatctgaacataacctctagccgtcagatttattgttttagtatggataccattatagatcaacgaatttagacataaccactgtccagatttattattttaatatggatgctattatagaacaacgaatctggacataactactctctatatttattgttttaggttataatattttgggacggaagtagtggatatggtatcttttgtttaccggcgcgtagttggtgatcgtcttgaccccgccggtgccgcccggcatggcccggtgtatcgagtcctctacgacaaggtttatcggcgctagaccctcctgaaaccgatccatccatcgagtccaaaatattcagatttttgctagctgctgcagcgttcagaaagacgaccgagctaatgaccgagttttgtgctcaccttgaagtacgttccaaccggtgcggcgtagatgaggaacgtgtactccggggcgggagccagcccgagaatcggtccgctcccgatgagcagcggcctgatgtacagcgccccctttccttgcggtggcacctgatagaaaaaccacgcaacgcgaccgaattaccacggggaattcatcgagatggcgtgcgagaattaattgacggtcgtgttacgttcgtcgtacgcgcttacgtacccagcggcggttggcgaggacggtctgcttgacggcgtggacgaactgctccaccgacggcgacggcatgcacatgcgctcggcgccgtgctgcatccgccgcgcgttctcctccggccggaacagcatgtacgacccctgttggttcgccgccctgtacgccttcagaccctcgaagagcccctgatcatcgagcacatacgtacgtacgcacgcagccatcaccctcgttcacttgttagtccggtcgcctggatcgacgtttcgttgcatggacatgtgtgtggactggagaacgtgacagacctggccgtagttgatgacgccggaggaggggctgagctcgatgttgccgtagcggctgagctcgccgcgggagaagacgccgtcctccagcgagcaccgcatgacgtacatgtagtcggtcggcgtcagcccgaaccccaggttgtcccagtcgatttcgccgccgctttcctcatcggacctgcacgcacactcgtacacgccccggcggcaatggcataaacaacactaaatccgaagcggacgtgaaaagaacaaaaatctcgttcaacggagaccggaagagtagaatctgcatgcatgagtagggggctcacctgtcggcggagtcgagctgcggcagcgacgacctccaccggcactggagcagagaccacctgcctccggcctgcacatccacaaggcccctaccgtgagccccaaccgatcgcatcaacacagaaaccatctcgatcggacagaacgcgcgcgcaacccaccacgagtcgaagagaaactaagcagagcgagtgggatccgaaccactgaaaaagtgcgggtaatcacacgtaccgtcgggagcgccccgcggagaccgaggccgccgccgccgccgcatccctgcagggccctggccagcgcgtggtgggcgtcgcgtgcccacgggaggagcgcgcgcttcgcggacgacgcagcagcagcagcagcagccatgcaagagacctgtgcggctgtgcgaacgggaagcgcgcgtctcaggctcagctcgtcctcgttcgtaaccaaccgttggcgcgccaaggtgaggagagatatacacgagtcgtttcacggaaacagcttcgcgagtgtgtgtgtgttttaaactactctcggacggggcggcggccgtttgtggtgttccggtctcgcgttgtacgtgtcaggatttgttggtggcgatgcaagattacaacgaacgacgtttgacgtcacggggc

SEQ ID NO: 56876 - DNA, 12793 bp, Oryza sativa
ttacctcttggccacgtccatgtgtccagtaccagcgcatgtgccatgttgtgtgaccactccgggtccacaccagccgtgcgcaccatgcctgcgccactgcgacacacgcgctcgtgaaaccgcgactacttatatctgatagcttttaaaggtcatagactgccctcacagaccaacacatgtcttttctgcacactttgtcctcactcgtgcgcacccggaaagaattttccggtcggtcacccatcccaaattgcttcaggctaagcacgcttagccctggagttctttggagatcggcttccgaaaaagaaattaatatgagtattctattaatcctattaaactctgagccgggatatcacacatatggtcctacctgtaatacacacattgtgtcttggaatctgtgcgacagctggctatagatttgtagcccgctgtttctttctcttctattttattttctcgatatgtgattataactagtttatagcttattattgtatctgctctaaataatctcttcagacttcacctaaaattgcatatcaagtggtgaagcgtgtcagcgtgactgtgtgagccactgagcccaaacgggcgcctgaaacaaattattgattatattagattactgttatgagttctcaacttgattaaataataaattaaatatttaaaaataaatttaacatatactccagcttaattagaactttgtggtctaaataatttcatagaagaaagtttttgagaaatagtagtaacaatatccaatgaataagctaaaaaaggtgggactgctattgaccatttttatacttaacaaataaatttctttacgtaaaaaaataaatttcttttccagaacgtagtaaatatatttattcttcacatttgtattacttctttatagaacatagtaaatataaactcacatcttaaattgtactatttcttttgtgttgcaaagattaaggaatatggatgaaaagatcataatacctttcattcctttagagcaaggttaatagtagcccactactagctccaattcatctatagccaattcatacaatagttacttactatactattaatatatggtctcatctgtcaaacacactgcgtcttggagttcgtactgcagctggctacagatctatagcccgttgtttttctatctcatattttatcttattaaaatatgtttacagctagctaatagtttgctattgtatctgatcttaggtggcttagaaagagtggctttgaaaatggtaggatagccatagtagtactaaataatctaccgtataaaaaagctatactacttttttgggacgggacagagtatatctctttcacggttatactactgccttcgctttcaccagttgaaggtgttctgaactttctgatcgagttgcgtgtaatttgtttcacagggaggatcgacgagttttccagctcccagcctcccaccaaccagctaccgatatgcttttgagctggccgctggcgcatacagtctcgatcctaccttgcttatcctcttcgttttcttcttgatcgttggcaaattgtctcttcagctagtcatccatgttgccatatttgcatgcaacccatgactgtgggttggtgatcagctacgggacagatcacagatcgataggcatgcacgccatgcagtcattattgtggattggatcggctgactctatgtctacgtgtacatgtctgtgcaagtggattatccccccccctcccccccggggcgccccacccacccaaaaaaaaaagccagaactccaatccacggcttccacgctcatgttttctatgatttcatcaagctgagtgcatactgcatacgtatatatagtagttttgtatgtattttatgaaaatttaacaagaaatggaacaattctcatacacaaaaaggaggaaagttcctacgattcaaaaaagaacgtgaaattcaaaaagaccctgccacttgtagcaatggaccagtagtggagctagcttaaacaagaaatgggaagggccaattaaaagtttcatttatagtaggaactattatgctacggagtattttgtgtaacaaatatgtgtctaaatttattaatatctatatgaatataggcaatgctagaaagtcttataatatgaaacggagaaagtattatataatattaacaccttaattaacttctctactgtataattcatattattatatcctcaacgcaacaaacacacgaatcatgataccatcgaaaatcaataaacggttggcaatataaatactaatggatagtatatgttgatttgggcggatctaccataggacataggacatggggtatctacctaaaatttttggcaagtaatctatgtaggtgcaatacatgcatatatattattagttgggttagaacaaccattccctaatgccatgtacaacgcatgaccttagcttgtggtctcacggctctacgtcggagccgagctgagctggcacgcccgctcgtggtctcgcaggcgcgcagcgagcttgtagaaaaaccgaaagaagcaccgcgcctgcgctcgggagccgtgaagccacgagccgaagcctcgcgttggaggagtcggagccccggtcgtcgcctcgtccggacccccgtgcaactgccccaaatccccatctcgtcatggtcgtcgtcgccaccaaatctgctgccaccgccatggtcgtcgtcgctgccagatcaacgcagccgccatggtcgtcgtcgtggtcgtcgtcgtcgccagatccggcgccaccggtgctccctgccaccgagctcgccccggagaggggaggggagcagtcggcgagctccccgccgccagatccggcgccaccgctactccccgccgccgagctcgtgccggagagaggaggggagcagccggcgagctcgcgctcgagaggggaggggagcagccggcgagcccgcgccggaggggaggggagcagccggcgagctcctcgccgccagatccgcctccactgctgctcctcgccgccgccagacccgtcgccaccgctgctccccgccgtcgacctcgcgccggagaggggaggggagaaaccggcgaggggaggggagaggagaagagaaccgagcgacacgatgcggctgtcggtggagaaaaatcgaagagagagagaggggaataaaaaagagagggatgggaagagactgacagtgggtcccaggttgtttaggggtgtacatatacttcttttggttactctagggttcaaaatataaagtttcaataggttttataatacaagggctgacatataaatagataggggctgatatgcaaaatacgttttggagtggtttccactgtaggtagtgtgacctttgtgtgattctatcctacttgacgtcttgagaccataattgcttgtggctaccattgtacgtgacctaataaacctagaatcgtagtacaacccatgaaacagcttcggcagaatccttttccttgaccctgatgctttgctgtggttcaatcgttgagggtaatgccagtgcgccccactgcaacgcgcggccatgcaggcgctgctcgcgtcgagcaccaaccaccaagcagcagaaaagcttggtgcctgcgactgcgatagactgatagggagctagcgcctagcgctactgacaacaaaccaacaggcaacagtgagtcagctgtgctataggctgtgtttagattttaacttttttctttaaatttttgaatttttccgtcacatcaaatatttggacacatgtatagagcatcaaatatgaaaaaaaaaatactaattgcacagttcgactataaatcacgagacgaatcttttgagcctaattacatcatgattagccataagtgctacagcaatctacatttgctaatgacagattaattaagctcaaaagattcgtctagcagtttacagtcggaatcttgttttgttagtagtctacatttaatacttcaaatatattttcgtatacgtaaaaaaaatttagccaaatttttacagtatttaaacacggccatactctcaatatcgagattgttcacattggccatactctcaatatcgagattgttcacattaaatcagtggtgaacccagaaaaaactaccataatcctatacgtaccaaatttttaataaaatctaatatactaattaacatgatatataaattactctttctatttcttattacaagtcgtttgacttttttttgtcaaacttatttttaagtttgaccaaacttataaaaaatataataatattttcaatacatatcaaatatattatcaaaatatattcaattttaaatgtaataaaactaattttgtgtcgtagatgttactattttttctataaatttgattaatcacgaataattttaaaaaagtcaaatgacttataatataaaacggataaagtagttatcattgaataatttacctgggtcatatgaccccgttaagcggttcaacactgcatatattccaaaaaaaaaaaacgttatgcacttttcctagcccatctttcaaatagttaatggttgattcaattgatatttcttgaccacactttgaagagctcgtcaagacacagtagtgatgccgccatcgcccatctgaaaaagatatggtttatatggttttcacccagagaagctcgtcgagaaagggaaagggtaacccttgacaacgccccaaagaggttatgacgtccgaagacgtagcccagtgaaccaccggactaggctttcgcctgggatcctacaaccttgactgcaggtcgctgtccaccaactcagaaccaccacacaggcaaatggcagcatgtagcatccaccacaccgcactgacgcccctccgtcggccgacttcatcgaaccaccacccctgagagctggcccaggacccctctgttccaccacccgccggccgcctcgccagtttttgccaaagaggaacccaggactaggtgtcattgcttcgacagcctgagcttcccccgccgacgagttgccgcctcaatccaacctagaatctccccgcaaagaaggggaggagctccaggaagggcgatggtgccgaccggcaacgaggaagacaacccaccgccgccagctcccttagcactaccatctcgccgccggtggcggtgccgctccagaccggcgccacccactggccccgttatccggccgcgcgcctcacctagccaccgcggtggcatctcggctgcccggccaccacgccgagccgtcacctaggtctggacgctgaggacgacctaccttgcacagggggcggtcgctgcgtcctgggctgctgccgggcggccaggtcgagctggggcgctgctaccgagccgctgctgccgcgtcgggcaggctgcgctgccagccgggcacaccactgccgcctccgtgcgcgggtcggccacgccgagttgcggccgtccgccgccacagcgcccgggctggccttgccgagccacaaccagccgcctcgcccccggccaaaagccgctgccaccacgcccgcacgccgccgcgctgccgagccgccgctgccaggttgagcgggggcgccgctgccgagctgccgctgccgccttgggcagccggccacgccaccgccgcctctgcgcgcgggtcggccacgccgagccgtcgccgagccgcgaccgtccgccgctttagcgcccgggccggcctcgccgagccaccgcccgccgccgactccgcgcccgagccgggccggccgagccgcagctgcctgccgtctcgccgccggccacatgccgccgccaccatgcccgcacgccgctgcgccaccctaagccctcgcgccgccgccgcgcagatccaggtgggggatggccggatccggccttgggggcgccggatccgccgcctcggaccgtgctggtgggggactttgtcgtcttcgtcccgtccagttcgcgctgaggaaggaaacaccacgaagaaaaaggcctcaccgccgccttccctactcgctgccggcttcaccgccggcgagctccagcggtggcgaggaccagggatggagaagaggcgtgggcagctagggtttttcaccccaccgagccgcccgcgcgagagcgacgcggggagagagacgatgcctaaatatatccatcacaaataatttttatttctctatgacggataagcttttgtttttacggtgaaacaattttctattactctgtacctctatatatctctaaaatcatgcgtttgccactggactgtggacgaacatgccaatcaacaagactgttggtgatgcatagattagcaagtggttgtgtccagcggattcatatcctctgacttttcgtaggattaatatcaccgcgtgagatctccctatctaatccgtccatttgaaaccaatggttgagtattagggaatttaacttcacagaatcacaggtcaaggcgttgtgggtcaattaatcctcagccattgatttcaaatggatggattaattagggtgaatggctaatttagtccctcaagttttaccgaaggctcaatttggtccttcacgtttcattttgtccacatagctcctctaaatatttgttttggcttgaaatcattcttgggcccacttaatatgccatatggctatttctagttaatatttcattggaaaatgtcccttttgctcttaatttgtatagaaaatagaaaaccaagatgaataaacaacagtgcagatgtacttcctattattttaacatgtgcacatgaaacttaagctattgctatcgtatacactttatagtacataatttatttttgttttacataatttactatgcattatctataaaaaaagttaagcatgcaatttttctcttatatatgtgaatgatgggggtataagtatcatttatcaaaaagttgttggttaaaggataagttcgaactaaactgaaaacttaaaggagtaatacggatagattgaaacatcaaggactaaactgagcatcagatgaaatttgtaagacaactttgactattcatccattaagataggaagaatgtcacgcggtgacatgcattaatcctacggaagtcagaggatacgaatccgtgtcgagcttgcgtggagttgacatggattacttgctaattaatctgtctctaccaatatgtagcgaatagcactcttgttaactgtactgtacgcagtataaccgcgcacactttacacgtcaaaccatttggatccgtaacacatacacaagaacaatcttagctagaaagaaggtattcccaacatttgtagatacgtcgatcctcttattattcaataactcaagttgctactaccttctgtccaaattgatcatcatatattaaattcaaaatttctcaaattaattatcatataaccgtataaatacggatttcatcggaacaaaattaatgtagcaaaggagaatatatgcatatcaaggatataattggcatagtgttttattcgatacatgtattgtgggagattgtgtgcattgtgtcttgattgatacgatttaaattatttttaatcttgctgaataaatacatatgatcaatttgagatgaagggagtgtgacggagagtactacttaagagtatttgctgagcagtaagcacttacggagtacccctacacattcggagtaaggggctggaatgtgataaaacagtagcaaaatctgagcagttctgtactcgtgtggttcccaaagacctggggggaatgatacggctggccttaactcgaccgttcatggggttcacggctgcttcccgagctctcacttcttggctgcttcctccactgcagacaaaatagaaagacgaatgggttgaaggcatcaagtcacacttgacatcgatcgatgacaaggttgcggtctagtctccacatcagcaactgaaaagggtacatccccggggcagtgaatggtgcaatggccatgtttagtttatattgcaaaattttttaggccgtcacattaaatatttgaacacatatataaaaaatattaaatgtaaaaaaaaccagttacacagattacgtgtaaattgcgatacaaatcttttaagcttaattacgttataatttaacaatgttgtgttacagtaaattttgctaataacagattaattagatttaataaattcaactcaccgttttttggtggaatctataatttattttattattagattgtatttaataatttaaatatgtgttcgtatatcggtgtgacaacccaaactttcgcccaactaaacaaggccaaagcctcgcacttttacagctacgtgaggtcgagcggcgatgctgtaacgcaggagattcctaggacaaaaatgtgagggcctcgttgccgtgtgaagttttgtgtgtttgacgcagcctgacatggacgtgacatattagcacggctggacgaaaacttgattctcgattttaatagtcgataaaaaaatgtcgctgttaaggtactgtgtagaactttttacaacgacgcggaaaaggactgggttgattgcactctcacattttttctactctccctactttagatgaccgtaaagccgtaaagagaggattaagcttagtgatctagtactactacaagctttctttgatcacctagttcgcttgaaatcttaagctaaacgtgtagccggaatgataaaaaaaaaaaaaaacgtgtagccggtactgtaggcggggacttcccggagtccgtacatgggccggacccacttcctatgtccaggccagtggtgatgatatagcccattaggctgtcgacaaactgggcccgttggacatgtcgactctcctcgaagccccgtcaccccgtgccaccgttgtcctccgtcctccccgcctcgcacggcgcatccgttcctcgcggcgccaccgacacccgctgggcttccaccgtgcagcggcgaaaataatgctgcagccgcggcacctcgaacgcgcggcgcggggcgtctcctgcaccggagccggctaatcacgcagaagacacgggcgcaggcgtccccgcctagtacgcgatcgttgtgctgcggccgagccaaaccacgtacgcgaagacgctgcccggtgtgacggtgccctgcgcccccatcaattctaagcgagtactccaccaacactagcctcccgtgatggccgaccacccaccgatcgagagagcgtctcacgccgaacgtatgagctattcattgcacgaggaggaaacatgctcacgctgaacgaatgggcgggcggaagggaagaagattcacgctcacgcacggctcacgggatcggcagggaaggccctggcctctcggtgaaaatcagcccaggagatggtcacctgagcccagcgcgcagcccatctagtcgagatctaacgtggcctcgtttccagggctccttttggtccgttcgatcgatcgagaagctgcgatgcgatccgcgtacgtatgccgatgccgtgccggtgcagaatctctatggacctcaactcgatctcctgcctgcctctgcctacctcggcttggcttggcttggcttggccccatgattcgaattctctgctgcactagatttgctttcgccgcccacgtgcattgctccggagcatttactactgtacgtgtaatagtatctgtcagtggaaggacggacccacgacgggcttgcgacttctgggccgcggatcacatgatcgacggcttggattaattgtccgccgtgactggggcaccatgcccgctttgcctcggatgatctactcattttcttttaccacgacgcgtgatgtgtgactactataacttactttagttgagataaacaaagaacttactttacttcatctagaaaacttattacttgacccaattaggctatctcgcactttgtcgtatggtcgtggcagattcacgacatgtatctctgcaccacatactaatgccacccaaaaattaccataacgtaagtttctgcgtgctgtgttatggtgtcatgcggtcacattatgcgtagacaggtaccgaaagaaatatattataaaaaattaccgtttgatcggttcattagagattagacgaagactaaaaaacacatgcaattccttttgttttctgaaccttggtgttctctcgtgggaaagcagaggacgttggcaacgagagaacattgtcgtcagccaaggttccaattccctgcggatatattccatatctcatctgattgacctgacgtgcgggcagaaagcaaatctctccacatcgcaaatgaacagtgacgatctaaatataaaatcatcaaaaaaagcctgaggataatgttggcagaagcgagacggaaatctacgggtagatctcctgcattgtattcctctcctgcaaaccgcccgttggtgccctcaaatcaatcctgagatgacagtacagagggcagttttaatccagaaacaatattcctatcgccggccggtaggtacgctccatatcatattcgatctcatccaatttcatgtgcagctcggtacgtagaattaggatcgtttgattgtacaactactaccccgaaacgaataaattgtcacgcacgcacgatgcgagaaagataggtacggaaagtacgtatcccacaaagcctgaggtcccgagggctgagcccaatcctgatggccaatgattgcgtgaggcacgtcatgtgggcatgccgcagcgagcgtatccacaggtaaatccgccgcgaatgatgagaggctgacacagcctagtacagagagagagagagcacaggagatggtcccgtctcgatgtgccgctccgcccaacgacccgcgcgctagtacagacctcgtcagatcgttgcctcagatctcgggacaggctcgggcgaacgtgccggcctttgttgctgacgctggggcgaaacgcgccgatgcgcgtacgcggcgctggtgtccagaactcacaggagggcgcgcaggtcgccatgatgcgcgccgcgcgggggacaggagcgacgacgcgtcgcggaggcgcgagcgacacatttaactctcggggacgggaggcatgtggacgtgcatgcatgcacgcgcgcggtgtgaccggcgtaaactctcgtttgggctcgctcgcgcgcactccggccgtttcatcgccttcacggggaaccggccggcccccgtcagatgctttggtgcaagtccggtgctgccggtatatgtgatatactactactagtcgtatagtatattgtacggagaatagaaaattatgagatcggggaactatctggagttcgatctagactagagatgccaaagcgacatcaaacgtccagatcagccaataagagctaagctcaatcatatacgtgtacgataacaaagtctcgcttgtttgtagcgccaacgcatgctacatgcatgattgatcctcgatatatactatcgtcatcgatatattgtttcgtgcaacacacaatttataaagggttatagagccaacacaacggccagagtacgtgccagatgccgccgcgcagcgcgcagcgagagagagagagagagagagagagagagagagagagcaagccgtcagaaaaggaattcggctgccaggttaaatttccaggagagagatcgatcgaacgcgcgcatgcgtgcgtgcgtgctcccgcgccggccatgccagccaagccccgcccggctcatatttcttggcatgcctcccatattaactaccacgccgcgacgcgaagctcctttttacgtgtcatgatttggtcgtgccatccctcatcacacacaccatccgcataattttcctgtgtaaattagttagtccaggaaggcaggagctagcaagggcaactagcttcgacgctgactatacctaagtgcagtaattactcaacgaactagctactactatagtatgatcgcacggaaaccgtcagtgtccaacagtacgtgcaaccggccgatcatgtatgtgctacgtacccgcagcaagagtcgatcgcgagtggtggtgtggccgtacgtgttaaaattgccttgggttaattaatatggcgtgcagcagagcagagatccagatggctagctaccgctctcaagtcctaattaagcaaacaaaaagatgagacgagagggcgaagtcccgctctctcttcctgattaaccaataatcagcagagaggcgaaagcgatggcaactcaataaatttttgaagttggggagccccgacacacacaatcattgagacgtatatccatacaaaagtaaacacatgtacacgcacccgacagggccgagcgaacaggagggaggcaggcatgctagctaagctagctcatgtcgtcatccgatccaacactgtgcgtgtgtgacactatctaagaattttaatccatcagtagtgctagtatacaagcttaatctatctagctactgcactgccccatgatgatcccctctgaaaattaactagcctgtgaaacaaaaaagaaaagtaaagctaactagtgatgagaggggggcacacagttacatacttacatgcatgcacaaaaatatacattgatcgggtactagctgtggcccggctataattaatttgactaatcctatc

SEQ ID NO: 56877 - DNA, 14007 bp, Oryza sativa
ttcttctgaaaattactactactgcataaaaaagtttgggttttttatttttcggtttggatgattggattgagcgcgtttggaaggccacgtgggcgcccatgtgtaaaaagggcccggaaatattagaagcgtccatgtcattctcaaacccactgtgtatgcaccagtactagtttgcccatttttcttcttaactcgtgccggcccaattgcaaacatgcatccataatttgcatagtatttcaaaaggcgacgcatgcgaaattaatcaaccgatcgggaaatgaaagagcaatctatatatggcgaaatggatggctacggtggtgttcttttcttctgaagatgaaagattaaatttttttacgtaaaatgagatggtattaacgtatgattgattgagttttaattattacaaacttaaaaaatagattaatattatattttagagcaactttcatatagaaagttttcacagttgaaaagcgcggcacgaaaatcttaatctttatctaactcttatcggagaaaagaaagagacctaggttgcttatactattcgtgtgacttgctaatggcggggcacgtatacctgcgttctagagcagttaggtatgtcgtagctgtgtttgtatgagcgcacgcgttagttaaggttcactataaaaaacggtttttaaacaggcggctaaaatcgattaatcgactgagaggcacggttcggacgacctcttctaataaaaggtccataaaaatcatcatttttacggaggatttttttaagacagcggtatgtgaaaattgatcttcacatatgactaggttaagaccaactagtcaacgatttttggtgtaaaaaaccgaaaacaaatccaatcacagcctacaatcagatttagtacacatcaaattcacattcaacatacacagtcagttttaaaaaaaacattgacaaaattcacacaaactccccaaatccaagaaacaaaaatcattgacacgccatatcggtccctcctgagaccgtggatgtaaccggtatcggatccactgctgaatttgaagcattggacttggggctctccatagcgtctgattgagcaaacaagcatgacggtgcaaggggagtggtcaacgacggtggcgacatgtctatggctatatttgcaagagctggatccaactccctagtctagttttccgcgcgtacgtttcttcaaactgctaaacgatgtgttttttaaaaaagtttctatacaaaatttctaaaaaaaaaatcatattgatccatttttttaaaaaaatagcaaatacttaattaatcatagtactaatggaccgctccgtttttcgtgcatactatttggttggaaaccagctcttgccaacacagctaggagatagcagagaaggagagggcaggcataacggtgagataaggggagagggaggagaggagaggggacttaagtccctcagccggcccgccactattttagggtgtgtttggttcccggtcaaggttggatgggacatggcaatccatattttattggatatggcgatccagttttttgtttggtagagtgaatatgacaatctagttttttgtttggttgtatggatagaggtggatttggtgatctattttttttgtttagttggaggagtaggatggatgagtggtgttgatgtgaaaacacgaggcttgggagatctgcttaactccagtgcaggtccaaaactcgccttcgggtatgctagcgtgccagttgatttgatcctgcaatcaacaagaaacaaagacaaagaaaccgtggttaaatccataaatgatagccgatcggctaggtgccgatgacatatcatttatctttgagctgatgtcatatatgcatcgatcgacagtcacaaatagaaaaaaaagaactaaatctactcgatcggctgtagataccaatgatatataatctttatgttgatatatacttaaatcaagtgattgggataaatcggtcgccatgccgagacagtataaatcacttagatcgaagtatatactaacaatgagactatatacgttcatagcatagccgatcagatagatctaacatgtatcggctaatactccgataccactctatattaagatatcaaagcaagtagaatataccaaacgaagagcccaatatacttaaatgcaacaagatattaacataaaaggcggatttaatatatcaataaagcatataaaacaaatatagttaaatcaggtaagatcggctgaaaccccgatactaccctaatcggcaaccaagaagcaggctagagattgagattctaatcacgactcataagatcaaactcaactgatgcagctataagtataaaaagaaggacaatatctagacaatcaagccatgggaagtttcatagagtggtagatatcatatataatttaagccaacgttgatatttaacttaatcggctgccttctattgatagatgttagcccattgtaggttagatagcaatattgccagagattatataagatatatgataactcgacgaattacataagcaagattagagtatcataaagatggaagaactaatcccgagaacgcaagccgtcataacaagttttacctcttgttgaagatcgaaaccgatgcagctcaacccgaaagtaagaactcgtcgaaataaaacgaaagcaaaaagggtggcgatgcgccgagattatattgaacgtgtgttagtttgattacatagggttcgggtctatttatacccgaaaattacaagatatgtccatatcggacacgactattatctctaacaaactctaagataccataagtctttgcggcagacttttgcccaaacatatctctaaggaaattacatgaaatatcctaattaatagatacaatcgccttctcaggactctatccatgcatggcaatcatcttgaagcacgtcaacctaacccgacaatgtatgtcgtgtcacattgtcggattcggctcaatcggctaaccctgtttgactcgatctctgtcgaccctagtcgcagccgattcggacttcagccgatccttactctgtttccgggacgatttccatctcaaattccatctcggtttcttcttcatctccgattcttgaattaccaaatttggtcgttaataagtggttacaatcaccctttcattagaggtggtgagtatacctcccttaaaattcaccaaaccaaaaaaatatcaatctactacaataaaaaaaatctgaatagaaataaaaagatagaaataaataaaaacggaagaaaaagaaaaaaaaagtcttcttcaccgaccgccgctgcgcctcctctcccacccgccggcccgcctcttctcccgttggtcgccgccttgtctccaaattgtcgtctcagtcgtcgtcccagtcggtcgccgtcgtcatccagatctagtcgccgcctcgagcgctaaggctcaccgccccgccttctctcccgccagtcgtcgtcctggtcggcggcagcggacctcttcccgttgcgccaccgtcccctcttcccgcgccggccgagctcgcatcccactgcctccctcacgtcgtcgtcgtcgttctcccatggtgagaggggtgacgcaacccacatcgtcgctcgccctagtcctcgggcggctccatccggccaaattggccggattccactatccggcatctgaagggaatattcccctccgggccgccctatcccactcccgcccaccaaccaaacacccaaaaaaataggccaccatgttctatccacccaaatccctccatccaaacacatccttaataacatctcaccagtcccatatatagtttttacacgtggcatttagatcacatgaccccaaccattattgcgagcgtgttttcttagagcccattaatagaaatggaacctgtgcaatgagaaaattgttttttaagaagcagtatctattagaaaaaaaaatctatgttatggtttgattagttattgccaaattctactatagaacatataaaatttatatagtttgctagttgatatcgtaaaaatgtgttacagctagaaggcacttaaaaaattggtaattggacgaatgacacttttgacccaattgaaaagagcaattcttcaaacggataagaatatgcacctatggccacatgcttctaacattgtgttgaagtgaaaatttgaaaattatacaactctaaatttatcatcacctcaattacattactggcatgtactccctccatcccaaaatataacaacttatagctatcaggatttgtcccaaaatataacaacttttccaccagcattctcttcccaaccaattataactttccaccattcacttttcccctacctccactactcattcaattataaccttacactgttcatttttacttattttcttaacaactgtatccaactttaaaacttcttatattatagtacggatagagtatcatatttcatctttcactccagcggtaggttagaaactttttggccctaggtgtgttcttgttttttaaaaattttctctctctaattgcgctagcaattattcgctagcaaattattaattttttctttaatcatggtacactcataatgtccataagtaaattacacaatcttaccgtaataaaattacacaatcattagtactacgtgtattgccacaatcgtacaatgatttggatacggcagatccggcagcagaagagaacattactcattacccacccaaccacctgtgcatgtgtgcgtgcacactactcgctccgtttcaaaatatttgacaccgttgattttttaacacatgtttgatcgttcgtcttattaaaaaaatttgttaaatatgtaaaactacatgtgtacataaaagtatatttaataataaatcaaatgatatgaaaagaataaataattacttaaattttttgaataagacgaatgatcaaacacgtacttaaaaagtcaacggtgtcaaatattttgaaacgaagggagtactaatttactaggtgtttgtggttggcctgttgcacggtggattcttccccaatcgatcgatctcaaattaaaggccctttgcttcaaagtaaaatcattggaattttagaaaatttcattcttataggattttttttcctatatagcactttgaatcaaagaaatggatcttatggaatcctatgaaattcctatggattggctaatgccatgcaaattttagaggaattctaacataaggtaaaacctcttggaaactttcctttgagtctttttctctcctctaattcctgcgtttttcctgcggtccaatcaaacgaccattcctctgtttttcctgtgttttgcaatcctatgttttacacttccattcctaccaaaatcctgcgtttttcctatttctatgttttctcattcctacgattcaaaggggccctaactttccttcatttcctctcatcatccagcagtgcagctaccaatatactagctgggtttggctctccttttctccgagattgccattgcctgccgccgcccattgcctccccttcgcccaagttctactaataagcagtaggcactaggtaatttggcctcttgttgccatctttccacaacacctcgcggcttttccacatgggacatgaacacgcccctggaaaggtttgcgtttggtgtggatcaggggctgttagctagcccagtgacaacttttttaatggcgggcttggagttcacatccgtgtctccgtccatctcattcccggtcgccgcgatcgtccttgttaattagctagctgacctagctagcagaattaattatggcgcgacttctgctgcttcaattatatgctggagaggagcaggagaaggagtactatttacggttgctggtttaacattttttttctaattataaaaaagagacacgcgtctatatattaattttcttttaaaatatgtcattattttttaagatacgtttgactattctttttttaaccttttttcatagaaaataggccaacctttagcaataaatcaagtcacaataaaataaatgatacttatatatatcaaaaaatattatatatatcaagaaaataggccaacctttagcaataaaccaagtcataataaatggttaaacggatataaaaaaatcaaagatcataccacattaattctacataattaactagacacttttgttcgataaattatcgttggtcaaaacctgatttattggtaaagtaagaactggtaattatatcataccgtgtttggttggttggctcaatttgtggaagtaagaagaagcatgtttggttgagtaggtgtacgtactggacgagagcctacacccacgggtgaacggactatcaacctaggctaaagaggaccacaaaattcgagctttgcttctcagtccggccgagcttgggtactagctagctagttcatgggcagttgtaggcagggggtgcaagtctactcaccttcctctttcccattcacctcatggaacggtaagggtcttgaccaagctcgagggatgccaccactacttctttcatcggatctctacctcctctcctctcctttcctattctcattgtcgttgagctttttttctcatgttctcagttggaccgggcgggcacaagggtgcaggtgccaaattcgacaataaactcgatgaaggaagcatatttggacactacagatcgaggtgacgagctctaggtgacactagctgcctccaatagccaaacccctcataattaaccacaggaccgccggctccactgtccacgagccatgaagctgttatatctggcaggcttcaactcgtggttgttggatctagtggctttgcccgtcaaggttggttcgagcgacggggacgagaagtgtgagcaacgaacagtagccagagaggtcaaagaagtggcaagcggtggggctaaaggaccagaatgggtgggggagtagccagtgggtgagaaatagcgcaacgatgagcggcggagaggagtgtgagaggaacattattttctttcttttcttctttttttacaacccctaattgccattatataaaacttaattttaccatgtgacagcgtgtgatgaattatttgccaactgtacttttgtatgaattatttaacaattgaatttagtttaaatcaactaatctttgagaaatttagaattgacaaattttgagatgcaagaggtaacaacaaccagttttatacaactaaacaaagaagattcccacatacaacaatcccatgttgcattccagatatcaacctcatatatatccaagctgagtcaacctcttagccagactaacccttgcccctgattacgggagcttaagattctgagaatctactgtttggtagccagcttctgagaatttggagaagttggattttctagtttctgggttctagttcattttctggattctacgactacagattcttagaatctggatgacaatttgaattgtttaggagagatggagattttgtgagaagttgtagctactggaagctccccaaaacaaaccccttatatggatggctcgacatccaagatgttaggcaaccaaataatcccttagggaatgtaaggagttttttttagaaaaaaaaagataaatgaatgaagggaggaattaagcaagagagtatatatatatctagcgtgcataactgcactacgaatggttagatgatcgagcgacgcgtacaccgtatcgatcaatcagattctccgtgcccttcgcccatttttactagtagctgcatgcagtagtggtgtcgtcgttgttggcatgcatgcatgcatgagtgcgtttggaagatctcccaatatttgccgctagcatgcatgcactgagccctgattcgctttaatttgacaccaagagagagatggatggcattatattgcattggcaagagagaaggacgctccaactaagagcagctacaatagcaaggctataagctagctataaatatattttagatataatagaagaaagagaagagcagtgtgctatagatttgtagccagctgcagcacggactccaagacgtaatgtgtgtatgacaggtgggatcagatattaatagtatagcaagcaactattatatgaattggttatagataatttggagctagtagttggctatactattaaacttgctctaatggaggcaaatggggctgtggctaaatgcaccgtggcccccggtgtctcgctcacgagggaaaaacaagatgatgtggggcctaacacatattgcacggatgacattgcaaccagtaggggatttgaggctgctttgggcactagcttagcccttttggccttgctcccctaacttttcgcaatagtgtgtttgtgtgttgatgtggccaatctatctcgagagagccgctgagccatggagatggtgcatgatgagatatgtattgtcacagtactgtgtactttgtaccatgaaatggggggcttctttcaatggccagaatgggcgtaattatatgatcaccatcagatgcctcatggccagcttccaaccaacccggtctaaccaaactatactattagtcccatcatctcacctaaatagctgagtataagtcataacgattattgattaatgataaaagaataatttatatgtatgtgtattctagtgatttataagctaaagctataaaataaattacaatgaacgaaaaacatcaaaatcatctccaaaattaattcttaaaatttaaattttggttgcgtttgataaacagaaaagcaaacaataaagctgatgtgtgaaagcgccaaaatatgatggtagagtcatgggcatgtatgtgacttcatcgctttgtttaaattctgatacacatgatcatgaatataaccagtgggcttttaacacaggatcttaattagtgaggttgagatttatcgttggtcttctcgtaatttgacaaggcgcgcttattcacacgattatgtttaacatgtatatattggtgtgtgcatgtgcttttttccgtaattttttttacacgtataccggtcgtacgtattgtagttatttgtcaaatcccaaactacatgcgagaaaggacgatgagcgtactgacgatcgcagtagaattttcccgcggtagttccttcaccaagcttgaagtttttgttttttcttccttccgggacataagcctgaccgattgtgttgtgtattaaaactcttttcctttcaatatatttatgtatgtgtattttttttcgtgctggtgaaaaaaaaggaaaggacaatgagcgtaccgacgatttaattattggcaacagcgaggcttaatcatgttggaaaattaaaaatatatagaacttcttcgatgaccattacaaagatgtgtacaaactttaagactcatgaaaaggctatgtgcaacttctcttgtaccttctcactaaggaagtcgtacgtttgatcacactaaaaacatgcatatatacttttttttgaacattaacatgcatatatactgcttgcgcttttccatagagatcagttgacacagatattaaactataccaccttgcacctttcaaacgttgtcgtgtctgtacggcagtttagttgggagcaacagtacatattaactcgcatattactatatacttccccagtttcttattataggtccgttttaatttttctttttctatttaattttctaagtctgatcaaatttatagaaaaatatagtaatatatatctctaatataaaataaacatattatcaaaatatattcgccacacattctattaaactaattagtgttgtcaatgttgctaaaacttttttataaacttgattaaacctaaaaatattttactataaaaaaatatcaaaatgacttataatataaaatggagggtgtactcattactacgaagtatatatcttcatcattcttaaattgttattttaattacgaatactgctttacttccaattatatcaattttaattacccctgctttttactattaaggttatacttttgatcaatttttgcactagtccctactccctacttgtactacaaatctacaatcagtccaaacgttatttttttttatcgttttcttctctagtggattatatctatttattatactatcacctcaattatttattggcagtgaaatatccttttctattgctagtggaactcgtaaataaatgatgtacaatactaaccaaaccgaaaaagaactctaaagctttttcctaatcaaacttacttaactaagtatctaacggtaagtatggaccagattagcggtatgaaattgcaggaatttcattttgtaaatctgaatatatagttacaaaaaaaaagcattccactaaaaagttaaaagttaaagttaaccaagttaggtttggtctggatgtgccacatgtgtacgcgcgtcttggtaattttaagaattcgttaccattccatttggtaaaatttcttcttaccttttacctttctatattcttcccacaagtaaagaaaatcttatcaaatcttttggagattcttcagtgtcgttattgaagtaggcgtgcaacaacgacaattacaaccgaagagatgattaattgctctagacaaatgcccattcgtctcgcacctcaccactgaatttctcaatttacaaagcgaggcacatacctgcagtctaattttcaatggaagaaaaagacagaaaattatattttaagtttgaagtgttatgtataattactacaatcgccaaatcattagccctatcaagacacgccgtacatagatgaattattggtcgtcgaattgtataattcgtccttttcgaaaaaagaattgtataattcggctggatatcatcgtcatccgtgcacgtatcctcatctcctggggttaagttgttttgattagttagcaattttgcgcccctgaaaaaaaaactagctgtaatataattaacaaataaaagtgcaggtcagatacacacacatcaaatctttgatgtgtggtgactagtttcaattccattattaaaaaaaatattaaataagaacccgtgcacggaggccatggcaatatgcagaattaacaaagatcatgaacaggtagtttcgctcgtgattatccttaattaatcatcaactctgatcactcgccttgtttttttcgtaatcattatcacggggagatctagctgcccaatccaaaccatagagatatgtattgactttggaagccatcgtgcggacaaaagcagcatatctaatgatatgattagcgaataacaaaccggccctcctgcaaacgaaagcggttaaaaaagcgcgcgagcctaacgtttcacactcacacgtggcagcatctccttggttccacgtcagcatcgcatccagccgttgtggttccctatgtcagcagcattgcccgtggtctgatgtagacaagccctgagcaccacactgtcagcagctgatcctgtaaataatccaacgtgatttaccgtggaaaacccaaaaactacagtagaagtgagactacactcttttatctggatgatgagtgccaaaaacattattatctagaggatgatgccaaaaatattatagttatacaatacagtcatatatgaaacggaaaataatatccagtgaaaaccacccttaaatgttctctgaatttatgaaaaacatatattaaagattggtataggcatggaatgcattcccactaaatctttagtccaaactcaacttcatttagaagaagcataaaagacaaaattttgagggaataaattacattttttaatattagaaaaaatacccatgtgttgcaacgggtgaagtctattttaatcttattattgttatatggtttagttaatatgaaatttacagtgggagttcgtttgaatatatatatttttagaaaatcatgagctgcaattaggagtccgatcgtctcaaattagcatgcaagtttttttaaacggatttcttatatgattccttctgcattatcaaaagtgaacgatattaaaaaccgactcaaatacggatacgtattttcaaaagcaaacaaacttaaaaactgactcatatacggatgacgtaccaaaatactggcaaaaacatgtttaatttttataatagtagagatatagttggcgccaagctagataagtaattaagtattatattctatcttgtgaaaaattaattaaaaaggtttctaaagtatcaacctactttctcttgtcccataatataagagattatgttttttttaacaaacattaagaaagtaacaaaagaaaacaagtcatggtacaaaatgtgatagttgaggaaataaagtacaaaagtaaataaagttctaatatttttggcctctagaaagttgaattccacaaaagatttacaaaaccagattttttttttcttggaaaaatcttactaatttaaatgtccacgattacttgcagaagttgtaattagctaaggcttgagattcacttccattttgtctgttttctcactttcttcagcccaattgaaatgttacattttttttattacacggtaggggctcgggcagtgctggagttgaagcagaggatgagaccggccaaggtagatcgttcctggcagcatggtgctggaggcgctaggatcggtgggttcgacctccaaaatttgcgagattgatggcgcgatggttttgagggctccttcttgagcacgattggcaacgacggagctgtaacgtgtcggtgaggaagtcctatacgtaccggtgttggatcaacgctgaatcctaaggcgatgatgaaagggaacttcttgtgctgcttgatgatgtgaagacgatgacaaagaaattaaacgcccgcgagatcaatctctcatgggtgatgactgacgatgtgaaaacaacaatgaaaacaaaacaaaaataagataagggctgccctgggtgatcactactcctagggcaacaacggcggaaccgtaggagagatgctagatcgtccactctaataacatgaaaacttatggatcacttgtattgcgtttagggggactagcgtaaaaaaagattatatggcctgattttaagcactcccaaatagatagaaacagaaattaatcctattctataataacaaccggatcacatacaaccgtatccatatgctctaaaaagatcttgtgaatttttcaaaacaaatatgtaaaatccctgtacattatcttctgttataattaattattagagcaaaacaagttccttactaattaaatatacaacagtcaacctgctaatcattggcacggctagccaaatacatcacatttctagcccatgggacaactgcaggaaattacaaatacgtacaccaagtacctgcagcaagccagcaactgtagtagtatattttccttgagcacatcatagttagatgttgctatcagcaaacagtgacaccagatccatctattcattcatgtatggaaaagagagaaaacaaataaaaaaaaaggaagggcacacaagaaaaaggaggaaaattataagaagataacagaaactgccggatggagcaagagatggtgccgaccgctgacttgtcgggttagtgtggtgacacgttggatggacaccagatagggtggcgcccacaaatgatttgcaatcctggaggtgggggcgcatttgatccgctttgggaaccgatggtgacgatgataatcgccgtgcgattgtcgagtgcgcacatcggattgtctgtgcattggctca

SEQ ID NO: 56878 - DNA, 13161 bp, Oryza sativa
taagaactgtaaaatttctctaaaaaaaatagataagccgggtgctgcgtcaaagatgcctaaggcttattcttttcatattatttaccgggttgttaaaatggattatttgctcaatgctttgaaaaatatattttctcaagaaactttcttttactataaggccacttgattttttaagtttatttatcaaaatattctatttattcctatgattcaagtagataaccgcagcaacaatccggtcaaatatataatctatttcaaactgagcctgaaacgattcttgattataattgcacataggcggactcatgagtcatgacaaatatttctaacacttccacgtattgttgcgtttcctttgtctgttctcatgattgggtcagctgatcgagctgctcaactaatctgcctttgttaaccaagttcattatatatctgaatatctctatgcttggtaatgttgctcaacttgtcctttttcatgatatagcaggccgatctaccatcctttatcatcatttgtttaactaatccttttgttcttaaattaccatctaaaacgtatagatcactacttttgcactcattcgtatttttctacgtactttcgatcatgatctaaccaagtttctgtgtgcggttcttatctagctctatacaagatgcaacttgcaagtttgtttgccgactacttgatttctcaagcaaatagaaatctggcctatggtaatttccagcaagagaaatgtgttgttaacacaaaggtgaatcatctatctcttgagacctttggaaatctactcttgtgcgggaactaattcgccaaattcttcccagctcaagaggggattctatgtgataaggcaaggggatagattttccatgtgccaaaagtggcttagattacttgcaatgctgccgaaaatgcagccaagggccatgtggaatcctatgctgatgaataacttcagacatcatgatgagcagaaagaaattctgatttctgacgtatcatgagaaaggtactgaaatatcctccgagaaaaatcctgaaaatacgtttgtggactctgtagaaagcaatatattcagttcattttgcagcagttcatacttcgtttctgaatttatctttttcagcagaacaggtcctaagtacgattaacctgcacattatttttcttcctcagagattcttggtgtcttgtaggaagtaaacaagcaaatgattgataataacaacctgagatcacgtccatatctttttgtttgctttctgtctggttgaattggcctgtttgaggctaagacaaaccactcttccattagagcattaacaaaagaataggctaatcatttggtcatgcaaagtgctgataatatataaatgcaccatatggccttcagaaaggcattacggataacgctcttctgtttgtttggacttaatagttaggtcagaagcgattggccaataaacaatagacgcaaagcaacagagcataagccaagcacaagatctcataatatattttaggtatggagccatgtttctacaagtcaaaatgtgatgtgcatatcgccattagcaagcctccagtgcctctttagaaagggctattcgtttgactcgttattatgaggtggacatcattaggtgaagtagcaaaggttattgttcagtgattagcataagccccgggttgattgcgtaatgtgtgaacaaagaaaaacaaagtggggggttgcaagatagaataagtgatctagaccggagataattttgtcaaagcatatctttttgagtttttcctgaaaacaagtgttcgatcacagtgtgatcacaagaacagaatggactaggtaataagtcactacacatcgaattgacatatgtgcttatgcaagaacaaactgattggagaacagaagagacatggcagcaaaagagcttgaggtcagatcatgattttacctgcttccatatccagccaaggtgcaactgggagttctcaatgtttaacccatttgaaaaaatcgaagtccaccgaacaatatctgcctattgaaattgcaagttgggatgttgcctgtgtacgtgtcagcacaacagaagctacagaatttcccagtgtgctcctgtcagcctgaaaatcgtgtacttttacaaggacagatcaaaatatccagggacgataatgattagtcggcaatactaatcaaaaaccaccaatcatcggtattaatcatttgcttcttgtttaatatgtagtccatttccgactgatcaaaaaacaaaaccagctctgaatgtcctgattcctgaataatttatactacttggtcgtacacgaattctctcacactaccagctagtagtagtcagaacctatcatttgcagttgcagatttggtcctgcagattagtccaaatagaccaacacaatacaccttacttaaccttcaagcacgagtcggaaaaaccacacaccggcaaattaagcgcgtgcgtgtgtgcgtcacgcacaaacgccatcgccgagcggcgccatgatctagcagacaaaaggaaaggcaaaaaggaggagatgaggagaaggtcagaggatgaatcgcggcctatccatggtgatagcagaaagactccggcgctatcatgatgcactgtaaggcgtaggtagagataacgatgtccctttttttttataaaaagtgaatttgaggttttacgacatgtttttataaaccccagatttttcctttttattacggcgtagaggtttcatgaaataccatatttgtgtctatatcatatatttggctatagtatttacttatagagacaaacatacttgtacaaaatagcagatcgttttcttttaagtacaaatataaactgaccactttctccataaacatggttgctagctagcaacatgtaaccgattaatgtgtcattgcaactgcagtttatattgttgtctttgccttcttgtatgggagagtgagaaggaaagatactagacggtgaaaatgtttatttcaagccacaggtatttcttaaaaagagtacattttagtaaataccatgttttatggctaaagttgcataaaacacctgatattattactaatggcacataatctcggtttttatggttctaaagttccacaaaccctaccctttacatgtttgagcacacatttacttcgatttttaaaatagtctatattaaatttgtagttattgattccttgactaatgactaaggttattgatttaactcttcactactttaaaaaaatatttgataaaactagttacgatttgaataagtgtggggttttagaagcacttagatcataaaatctatggttggtgccacaagtcataatgcatgcatgtggtttctttaactttgaccatagaaaatgtgattttttaaaatttactctattaaaaaaaatactccgtgtaatacaatggggtataaaatactttgtataaatttggggtcttatatatgaagcatttttgtctcaacacccgggtttcttgaaacaaattataaactatatgaaactccatgcattgttgtgggagttttgtataatattagtagaaataacatgtaaaactaacatataaaatagctacactttatataattttcatctatgatcaactatgcaaaaaaaaaggagctatatataaaccatttgatgatgtggtttacaacaacttaaatcaaatatggttgatagtttaaaaaaaactaagatgatgtgatttaatgaggggaggaaaagaaaaaataatataatttgatcattcaaatacaaaattaaggtgatatgactttataattaagagaagaaaaggagtaagataatttgaaccatatatacaacatccaaggttagaagcaattgagatgatgtggcttatgaaagaaaagagaagtggtattaactacactttgtagggatgaactttcataggtttataggatgtggattttactatactaatgccatcaaaaagtatggttttgtaagaaagaaaaaaattgcttactttttcttatcttaactttagcagcgagctaaatgacaataaccggaaaagatcagatcgttaaactaaggtggccgtggatacgtcgaatatatgccggcgggtgatccacgcgtcgccggccggcgacttgagcggcggcacgattgaaaattccggccttttggagggagacggggataaggcacaatggcgcaagttcgtagctagcggcaggcagagagctctctgttaagttggggtttatgtaaattaatcttgccgtgccgggtgacgcacgcatgcacggcacggcaggacgatgcgttagcttttttgcacaggtagtgaccggctttgtgttgggggttcctggataatgttggcatgtcaggtcagggtaggtcatgcgtttttgtttaagccgtgtcggccgagctgggtgaacaggattaggagacagggacatgggggcaaagaaaaaaaaagatgaaaacaatcgatcgatggaggatgtgagatgcgtgagcaggcaccaactaatgatagatagatagatagatcagacgtaaggaggagaggaagagaagggttaagttgcatgcatcatgcatatgtgcttgtctactgggctatgcgtacctaaacactggtcgctaatgggctgtgacggcgatcgaccgaacatgtcctcccctccccggttgtttcactgctcggttggggagtcaaatcgcgcgtggttggatgcatcagcagcggcaggcagcagcagcagccttgatgtgtgtggtgggtggagacggagcctgtcgctgatgaaggggattagttagacagaagtaggagtagaacctatgaaccaacacggcaacacggcctgggccagaagtgagaagccgatggagaaacgcttccgggcccgcgtgctaccgtatcgggcgtgccggcccaggcgggagagaaggcggcacgcggtcacaaactcacggcgcggggacgcgttcaacaccgcgacgagcccgtgtttcggtgtttggggctttgggccatggggcgcgggtgcgtgagagcaagtctaatagtacagtctccaattcatctatagttaatctaatagccaatttatataatagctgcttactatattattcatatatggtcccacctattatacacatagtgtgttttggagtctgtactgcagctggctacagatttgtagcccgctgctcttctctattatcatttatcccattaaaatatgtttatagctggctaatagcctgctattgtacctgctctgagcggcaccgggtgattggtacgtaaacagcggcgcggcgtcggcgattccaccgcgcgatccttggcggattagcgggacgaatggcaccggttttccgcaaaagaagtctactctgactccctcaattttaggtctaatatgattcgtatctctcaaccgtaataccatacattttcaccctctagcttattaaaaccgtacaatttaactctcttgatggtttttagaccagtttttgctgacgtggctcgttactagtccaactgactgagacagacctacatgtcagagtccctcttcctctcctttcttctcctctttcctcttcacgcctccatgtccacccagccgcgccaccacgggcacaacgctaccacatcctccgtgcaagctgccctccctctgctctacatcctcgggcccggcctctgctgcggccacctcatcggcggcgaggacgcccttgttcatccattcctcctccgccatcgccgctatcgcgtggtcctccacgacgtgcctccgattggcatccccggccaccgtcacccattgccgtttcgcctgctccagcagtgccatcagcgacaccctcccaccccgtgctccccccgccgctggcccgctgctgccacgcgcggagcagtggccgtccttgtccacgttgtggattggtgtccttcaacgatgttagaagacgggtggtcatggttgtcgtcctcgattcaactcatcatgtcgctgtcgcggagcttgaggagtttgtggagtcagcatgcgccacttcttcgtctcctcgctgccaccgccacttctcttcacctgccatctctagccccctattgtaaacccccacccccttaactagtgcaacggtgccaggcctctccaacaccccatcaccgccatcgtccctcccttctcagcgtcgggccaacgggaccgagctccatcgctacggcggagcgactccaccatccaagccgccgaggtggcaggggtcttgtcctgatgagcacctggaggattgccatccgtctcccctccctcctatacaccgagccaacgaggccaaactttcttgttgctctgccatccatgccgaggctcaccgtggccgagcgcttgaaggaccgcccgccatcaccccttcctcctctgcactggaccaagctctatagctacggtggcatggctccgctgtccaagctgccgaggtggtggggggctcgtcacaggctcacagccgagcgcctgaaggattgcccgccattgtctcgctgctaccctactgccgagagaaaatactacatttgagaggagaggtaaggaaaggaagagaaagagaagaatcactgataggtgggtctcacatgctaacttaatctattgaactatgccaatgtgacatgttagcgaaaaccgtcgacaaagttaaatttcacagttttaatagttattaaggggttaagatatctggtagggatacatatcagattttaccttaaattaagagagtcaaagtggatttattcctccgcagaatcctcgccgttttacgctagttgaggcttcacgctctcttgggctcctattgtctctagtcttctgggctaacatcagatacaagaagaaagtttccgatgggctccggaaacagggttgcaggaagaggaataagtattgtcactgcctgcgtttattagcaaacatgccaaacaaaatacagcgttagcgaaaataaatatataaataactagaaacggctaaacaaataaacgacggtatgaatgctagtgtctacttcgttccatcatctcaatatcttcacaagaacagtttgataatgacatcctccatacatcgcagactatttaatgatcaggcaatcagcactcagcggagaatcagcactacattgcagtttccagggagaaacaagcactgtaattatggagacagaagccacagttgacagcaccacattgcagtttccagagagaaccaagcattctaaaaggattgctcatgaaaaagataatgaaattattgagacagaagccttgacgaaggcacgctgggaacattcagtgttagtgatttatacaagcactcggcattagaaaatcgatccattttttcatctcttctctaatccggtaagtgccaccattttctgggaagacaccctaaatctctcttcctcaaagccttgggattaaacttatttctccgagatatgtacactgactgctagaccgttacattccattttgttaatgttcagcaggactctttgcacttcagccgccgcttaagcacttcttgtacttgctttgcgcaagattcagcaagaaatcggtgaatatgtgctcataacctggcattttcccgaaccctgcgcaagcaagagggagtgagcgtacactcaagaaaatgctgctgcagaacaatgatcatgctgtgttaaataacaagaacacagaaattcgagacgacaaagtactactggataaactggatcagtattaatttggcctagaagtccaggtatgtgtagcgatgtatcctcctttccccttaggctggaataaaatcaggcctaacaaattctgcacgaacatatgaagagaagaaaagaaacgcaaatgatagtatgccatttatgaaggcagtgggaaaataactgcacacctgggaagtagttgatgtcaattatatagtaccgatctttggttccaagttctctgatcatatctatgttgaacaatcttaaaccctgaaatttttaagcctgtcagatgacgaccatatgaaacagagcttggttaatataaatacatggccataccagtcttccacgaagctcttttcccagtttctctaggagtggtcttggaggaagttctatcatgtaacagaaagttctgatcaatatatagcaaaagtttatctggtgccgtcgactactcatcaaaagcaaaataaatcaagaagtatcgatgtcatagaacaaacgctgtcctcgacttgatatatggtaaggaaacataaaaactctttaccatgtacactgcgttaaggttctaaagaaagtttgtgtttgaatttagtgccccctcttacattaatgaagcatggatcaataataaccaaaatgaagattaactacaatactgcagatgtctcacctgagatatgaggatcgaggtctgcatggtctgcactagctgcagcacatgaaactcttggaaatcgatagacgccaacattgtttaataagtcataagtgttaacatcaggaagagaaaacctccgtacaacttgtatagtttcaccaatgatgtacaccttaaagaggatcccacctgtagagggaatagtttaggtccgaacttctaccgttggaggaaaaagtctcaggatatgcaaaagtactacagttacagggggggaacagaacttaccatggttcacaaattcctggaggaccagaggaggatcaagcattgataaggatgcctcatcatatgcaagagatagttcgtgggatttagatgttccatcaacaaccaatggcttcgcaactgtatagacagaagcacttcgcatcaaacaatttctaagctcaatagttccaagaatgaaaagagaacatctcccaaaattaactatcaacgaaccatgcttaaatattatctgaaaaacagaccgcatgttcaaaaacgaactgagaatggccaggtgaaaaaatattgccggaataaaaatgttgaatatttttccgctgtatttaaacattcgcatgatttggcaatgttttcttatctagaggaaatggatagttttaagatgtagattatgaccaattacccaagggcaaggttagtccagccatggcaactgcggttggtatagaggatggatctctcataatgaccagttggcgtggagtgcaaacttctcctgcaatggttcaatgcataaacaatcatatattggtatgaatagatatgccctcaatagatttagttgatgatacacttttggaattctgccttttactatctcggtacattgtattcacaaccagctgcaaagaaataatgtttcccaatcaagcaacatttgtccttgaaatctctgcaaagcaaaaaaatctatgggtttctattgggaatttcagcatttctaagagttaacacaaatttcttttgtttgaagaaagaattacatagcagcattaattggaaattcctgaatcctgaggtcacaaggaatagaaaatatatattgtttatcttagaaggataaatattctgcacatcgcttttgaaagcaaaagtttcttccattctaggacagaagtttaaatgtgaatatatttttcttttttgcgactacacggcagacgcacacgcgcgcgcaccacactaactcaactgatgcgcccctaacacacactctaagagacagaaaccaacgacaatcgctgatctcactaagtttctagtgaaagcccacttgggtgtgcataatattcgtgagcatcaggatttgaaccctggcaggtggagtacctacgactacaccacatgaccagtgcttccctgacatgtgaatatattcgataattaaacagacactaactaacattataaacattagaaatggaaagtaaaataacgaatccattttatagcatataaatatacatgttaagcttcatgattaccatagaaactggataagttcaaatcagatacttctgcaagcatagattgccgattattcagatgattgatggcatttggtgggtcaaggacagtaacctctggatgttcctcatgataatccttcaggaaagtgaaaggagttaggttaacagagagtttcaataaatgggcaacacagattagaagccaacagcaaattccaagaattatggatttatgttgagctttacaatagggcactgcaatcaaatagtttggatatataatcattacatacagtgacaaacatctactgctcatttcctcagttgataacatatttccccatgatgaggcagtgaacaagtagaaaaaaggcaacgatggtatggtcatttactgtgcatcatcagatttctgcatacgtactcagatcttacctccagaacctgttgccattccttgctagtaatctgcacaaagaaatttcttcaataaaatatgcatatactttaccaaattacaatgacataattatcagaaaacattaattataactaaagctcataaatagatgatgttattctttaacaaaatgcatcatacagggccaatgggcagcactattttagtccagctttaaaaaggtcacgactaaccttgtgcaagataacatcaaatgggccttgttctgcaagcgggcgagtgtcatcaattgctacaagattaattcccttcttcctgacacagtacataatgaaacatcatgaaatagtgttatacaagaagaatggcaagaaacagaaatggatcctaacatccatatggaagtacaatagccatcttgaccaagtccaagccctcacagaatcaagaatttttttagtacatcatcatctctccatgtataacatgtcgtttgggctacatttatactctatcgatagtataaataagaatgataaaaaaaagttaaactgccttgcaacagagtatttctcaattatactttgaaaataagactactacagggatataaaaaagcgtttagagaatatgcaggttgtttgaatgaatatagttggattttgcataaatatatattgtttcctttattttcttggaataactaaacaataaatctatcgaaacaaaagcacaaactaggcatgcaatacacaaatagttttaagcaaaaacattttgattttgcataagtatttcatatattaatttcatttcccttctatatttcagcttgtgttgcttatgtctgcagcctaccgagcaactagcaaatgattgactcagctagtcagcttggatcttgattcagggagctaacaagacaatcacaaagatcgtttgtcagcggtccatgttgccatcaaacctagcaagtcagtcactaaattgtaaacgatcccagaaaaggcattgccatcactaaagctgtcgtaatccatgtgatgtgcttatccatgggattatgggaatattccaaactagaatcccagacaccaagtagcaaagatttgcatgctaagacccatttttgacaagttggcatgataatatacaattatagactatagagacccccgcatgcagtggaactgtcaacatgagacgcacgtaagggggcatctacaaatgctaccagaattcctaataaacactagccatattcttcagtttacaatatatcgcaaatgcagcaagcttcgcccagaatccactatcactagccgcccctgctaactttatactccagtagaggttcgattcgatcactacttgattagtgctacaaggaatagaattgcattccattcccaccccccattttgttatggaactaccaagttttttacctgttctcgcaaaaatcctctgggcttcagaaatagaaccaattacagcatttaatcaaagactcaaaatgcaaaactgtatctcataaaccatgcattcccccctcaaatcatttaccatttccctccaacagcaaaaaattctggttttagtgaaaaaaatttcgttgccactcgatcaacaagaaatccaacaaaaatactctattgtctcccaaaatcctccaccacggccacgaatcagcaggttcatctctttgagcgttgatccaggtttttacctcgccagcaacagcagattgggctgaaggaagctcttcaccttcttcttggtgagggcgtaccccaccacgagcctcgtcaccggaacggccccgccgttgagcggcgacgacgacagcgccgccgccggaaccatcaccacttcctcctcgtcctcatcgaaggaaacctccccgtgcagccgcataccccgcccgcaaggccgcaacaactcccccccaaaaaaactctcctcccctcgtctcgaatttgccccaagaaactaaacaaacaaacggcgaaaatcagggtgggaatccgcaggcaaaggcgggatcgagcagaggtagccggcttcttacgaagcgaaccactcccccctagctgttgctcgagaaggatttgggggaaggaaaaaaagaattcttgttaatggcgagacgagtggaaggaaggggaggaggaagagagcgagcgggtatttgtaggcgacgaggtcgactgccattttcctccgtgcctacccgcctcacatccgctgctgtccacagccgtgctgctactcaaattgcaatcttttttcgcattggcgagcgtcgatggagtagtacgtagtagtacaagatttgggaaacgtgttctgcggacgccaaccgatggaacgacaaaaaaaaaaaaaaaaaaactatgcgcgcacacgcacggccgtctcgattcagtgcgtcgccgttgaagccatcgttgtcggtagctgcttgcaggaagagacgggtttgggttaggccacacatgaccatagattcaggtgagtggtggtggggcggcgacaacgggggaggattgctagtatcgagcaaacgcgacagtgaccctgttggtggtcaggtgaagtagtaggagtaattttttgtgttgatgctggtggtgagatgagacggc

SEQ ID NO: 56879 - DNA, 15826 bp, Oryza sativa
  unsure (1)..(15826): unsure at all n locations
tggatgcacaaagactgtttagtctagacaagaggatacatgtgtaggtgtttagttgttcgcattggtttagcataagggactgcggcggcgaaagatttactctaatgcaacgtaaaaacttaaatatgtgcaacaaattcaattaccaattgaaacatttactctaatgcaccaaacatcaaattaagagtttatcagaatataatcatgtgcgatgttattataaagaacacaaaaatataatcaaatcatagatcagataaatagttttatgaaaaaaataattttaaagctcgcgttatacttactcctacgtgcatgcacaaagagggaaagaagcatatattgtgtaccgagtatgtgaccgttcgatatttttgaaagcaaccggcgcctgacgtgtagcattgttgccattagatccccatatattacactacatccgtctcaaaataaatgaacttgtgggtttccgggttcaacgtttaaccgtccgtcttatttaaaaaatttatgaaaaattaaaataaaatagtcacacataaagtattattcatgttttatcatataacactaataaaagtactaatcatattttttttcaaataagatggatgtgtcaaatgttggacatgaaacccacaactgtatttattttgggacggagggagtatagctttgcacttagatccccagtgtttcggatcaagccctgaaaaatgcacttagatccccagtgtttcggatcaagccctgaaaaatgttttctcaaaattagaatggtagatgtagatggccggctgttgagctgtcctctcgctgacaggtttccgcttctccggccggcctcgcggatggattcgttggacgatggatccccttgccccctcgagcgaagaagatttaggcggcggtgggcagagaaggtaaaactaacggggcgcggcggtggttacctctcctacgctatggtgactggtgagcgggtgctgatggccggaggccgactgccgccgctggaggagacgctgcgatcgccgttgtacacagtacatctgctccaagagttcacggatgccgccggcgttgcatcgttctctcttttgttctgtgggctgtggcaccgtcagatcgacgaaattaatccttccttgcttggttgccatggacagcgggacaggtagatggactcaaagtagacaaccacgcgaacgaagcatgcacacgacgtttgtcattgtcatcggtttgctgcaggcagagttcattgtgcctgttattttcttcaacgaaaagtggataaagttttacttcctccgtttcaggttataaaactttctagcattacccacgtttatatagatttaatgaatctaacatgggcaatgctagaaaatcttataaactaaaatagaggtattagttgaaagtggcacgcttttcaaactgctaaacgatacgtttcgtgcgaaaactttctatatgaaagttattataaagggcctatttggttctctaccctaccaattaattggtagtgccaaaatctaggcaaattttggcactatcaattttttggtaggacaaagttagctagtttatgtttggtttaataccaatataaagtcaaaatttagtatgagagtaaaaaagattctagaatgtagctaaattgagcgtgggcactacgaattgtttgtcttcaatccaaattgagcgtggataaagggtcatgttttgtcttcaatccaaaacggcccaaaatactccctccgtcccgaaatattgacgccgttgactttttaaaacatgtttaatcgttcgtcttatttaaattttttttatgaaatatgtaaaactatatatatatatacaaatatatttaacaataaaccaaatgatatgaaaataattaataattattaaattttttgaataagacgaatggtcaaacatgtttaaaaaagttaacgtcgttaaatatttagagacggagggaatataagattaatctattttttaaatttctaataattaaaacttaattaattacagttataaccatctcgttttatataaaatatttagtaatctttatttcattttcatttttagaagattccaacgcttaaaaacatatcattgattcacgcggccgccgaggatgccgcttaccgaccaaacacgatccgtatgccgcgtggcaggacacgtgtgagataacagtgtacgctcaatctgcagaccatttgtttgaggagaaggaaataaagaagattggaaagatacgtaaaatgaggtgaatcattagcgcatgattaattgagtattaactattttaaactttaaaaaatggattaatatggttttttaaagtaatttttctatagaaaatttttacgaaagacgcaccgtttagtagtttgaaaaatgtgcgtacgaaaaacaagagacaatctcccatatctcccctgaaagaacgcagccattatggctaatctgtgcggggatcacggaggcgtttcacactatgaccgcgatctacgagactaccaaggagagcacgtacgcagatcgtgcgctaaactaaccacatgatcccgattcccgagtcgaaaaaacggggaaaagacaacaatacaattttacatcaaagctccgtaaactcccgaaactgaattgattgtttcctgaatcaaaagctcaacagaatcgagtctgtacaaattacaagttgctgaaaataagtaaaactatgaccgaactcaagaattgcataatttgcatcatatcacatatacccttttgtgttggttaattggaagatcacagtaaaccccctctatgttcatgacaataaacatttgagcaccggaaaaactaaagcagcatcagaagagaataaaccctgtcaggattggtacacgacacgcactgttcgattctacggagttagtcgaattcagccacggagtggagacaaatttgcaccttgcactagtaccctcggagtttcttggccacggtggtcaacacattgtcgccgatgtgggagcgcaagaaccggatgaactggtccttcttcatctgtcctctctgaaacaaaaagaaaatttatgtcattggattttcaggacttcagcttcgcttaaagttataacgccgttatgctgagctgaattcgctttgcacagaatattgacaggtagatgattctgttctactacagaataaagtcggcagcatattactacagaataaagtcggcatgatcatattaaaaccatagcagtgcggtacaaatcaacatttttacgtgctaattattgcgtatagtgaagagttagacctgaatacaacacaaaccaggcagagcaaaattgttcaactatatgtaagactaaggccccgtttgtttcagcttaagattattgtaatctaaattattaaatcagattactctaagctgaattataataagctaacataaaataagctacgagttgtttgtttctctggattattagaggcatctaagggtagtgggtctttagctactcaataatctagaaaaagcttctctagaggagattattagattatagtaatctaagctcctctagaggagattattatattatagtaatctggcttataaattataataatctaacataataatctacttatttgtttcagcttaatcctaataatccagattataataatcctaagctgaattaaacagggcctaaattcacctagcagatcagcagttgtgtttcagcccattgtttcgcttttacttatccaaacaatttattaaccaaaaaaaggtatagtaaaaccttttttatacgtgttcatgcggtaaaataaacaactaaaaaaaccacaaaatcaactcttatattaaattttgacttacaggcatgatcataagcgcgaaggggttgttttgtgtaagctagcgcaagattctaatcaatcatctatctagaaatgaaatgctcagcaagaagtaccagtttaccttgaagcagttgtacgtcctctgcaaagtctgcagcttcggggatggaacgaaccgctggatctccgtcagaagcatagggaacatgtcgcgagtagctgctggtgatggcttcttcagcttcgatcccaaccccgatgatcctgaaaaccacagtttcactgttatggcagtgccaaatgggaacagttccatccagcaaatttcagacacgagagaccaaccttccatctgcggcaggttgggccacctgaagctgaccacgtactctgggaggatcctggtgttcatgtctgtgctccatacaacgtaccaccgcggattctcaaggttgtcgacggcgctgtcgtattcgtcgctgctggggtggaattggggtgagctggcagggacggcctctggacggcccatcaggacgcggcacagcacgatgtgtgcctcgccattctcgtctggcttggtcagcatcgcactgctcgaagacaagttaattaactcgttaacttagttgaacattgactcacaaatttcatcccaatttataacaatttaggtagctactgtaccatactgtctaatttgctctaaattcaaacttagatgcaaaacaacgattggtagtttcattgtttagcaccaagatggcaggcagaaaataattttactcaagattcgtatggtaatatcgaaagatgaaatatatgaggcacttggtgaattttcagaaattactaaaaatgttctccccaatagttcaaagcatttgcagatggaaagagttgaaagcatttgggaaactcacctagcgtgagggtactgcggcggcgaaaggtgaacgccgtcgccgtgtgcgcgcccgccgagaaactgcccgttcgtcctcccgaagccgtgctccaccgccgcggccacatccgccgccggcgcgccgtaccacgcgaacttggcgttgctgccatcgccgacgccgcgagcagcggcaaggagctgtccctgcagatggaaggctcttgcccggggcccctgcgcgaccttgtgcaccgccgtgatcgccacgccgcgggccgccgccacgggagccatccggctgacgaagagcttctccaccaccttgtagaacttgtccgcctcgtccagcctcaccgccttcccccacaacgtcccgcgcgccttcttcctgtcgggctcatccgcctcggggcggctctccccggaccgctcctccacgccggacgacgcctcgtccccgtcctcctcctccgccgccggctgccgccgccgccgatcctcccccttcacctccgaccccgcctcgtccctctccctcttcctcttcctcccgccctcgggagccgggaagaagcacgcgccgcggtcgtcgatccaccccagcgcggcctcctcggcggtggcctcatcgatccgaaccatccgcatgaagtcgaacaggaacaccctcccaccgcaggcggcctcgcaaacggccttcccctccatgaacgcccgccgcagcagccccaccacctcgcccgcgacgtccgcccacgcgccgccctcgaagcagaggagcctcgccggcgcgccgctcctccggaacgcctgccacccacgcaggagcgggatcgccccaccgttccctcccccgcgtgccgccgcgacagagggccggtggatcgccggcttgacgtcgccggagaagtccatcacccctcccgacccggatctctctcgccgcctctgctctcccgcgcgcgcgcgcagatgtgcaggtggagaaatggcgatcgggatcaagtgggagcggaagacggaggaggtggggatgaatatataggttgaggccgcggcggggggtcggtctcttgaagagcacgtcggcgaggaggtcggttttttttttttctcacttgtgttctggggcggcgcccgcccgagtcttctttgcgtttgttggtaatggtaatggcggttttgcccctgatgaaggacagaaggagatgccttggtagagaagtctagaaatgtctagtttgcccccgaacctgttttacttgcgccagttgtttttttatttcttttttggtctggactactacttacttgaacggaaagaatagtgctccttcccttaaaaaaagaaaaaaatatttctcctctataataaattaattaatataagaaaattggtctaaaaaacggttacatttcaatttcatgcatacacatttgattgtatgagtttggttaattatataaaccaaaaaattgtttcctaacaatagcaaaattcagcatagcacttctactagtactagtccttgctcgtactgtcgtacataaagacttggctctttacttcaccttgggtcagagttgtcgcatgtgaagcacgctgactataccgattagtaccgactttgccctttacttcacctggacaggcccaggcgcccagccggtctccttgttgtataccagcttagtacgaaacgtccgttaatgcgaaaaaaagaaagggagaaaaaaagaaaacgaaaatgatactccggcacgaaaccggcgcgtggctttctctccggccacaaaaccgcgcctactcttctctcttgtgcgtatttttcttggcgcttaagattgctttcgctcgttcccacccacgatgttcttgtgaagcaagttgtttatttctcggtctagtaataattagacttccaggtgggccccaccggcccaccgccggacgaaggcgtggtaaaccaaacgctgacctttgccatcgccgttgaccatctgatcatcctacggttacgggagtttttgagttttcgtctggatagtataatggcgagttaaacgttttcaattttaactattaataaaaaattaattatataaaattgatgttattagatttattattaaacaatctatcataatgtgtaactctttttttatttaaaacatcttacttttatatatattattaattaaattagtatctctgagatcatgttaaagtataaaaatatttatattttagtacggacggaagttcgtgtgtttgtgtgcgccgtgctcgacctgtgttcgacttggcattcggcaacttttgtttgtactcctccacggattgatgtgcttcgtgacggtcaagtcagttccggaaatacagagaccacccacttgtaacacctcacgtgatcggctttgctggagtagcagttcgctttctctttttctgctctgctcgcctcctcgtgacaggttgtacgtggatcgcttgcacgcatcatcatttcgctagtgaaaaaaggcatcgcaaattttgggggaaaccgtttgaaattagcgtcgtgtggtcttcatcaagaagaaaccgcagaaacatatgaagacttgggggtgaagtacgtacgtacccgtttgggcagttcggctgaattagtcgtaagaactacacattagaaaatggtggctctaatccaaacattgtggggatcggatcggatgtcgtcagatttgtgtagaactaatccaaaccaaaagaagtcccgggatcggaaaccgactctcgaaatgcctacaaaatcagtcggtcgacgtgtgtgtactgtgtagtgtccgatcaacgtacgttttgttactggagatcagattatcagtgtcacgtctaattcgcgagaataccaatggatggctttggcgtgagacacgcacatgtgtgccgcgtgagtatgttgatattcctgtgtgcaggtatagagagatatgcacgccagccacgcatgcgtgaagcacctgacttgccagaaaatgcactgaacccaataatacgagcagagatgttttcaacatgtgcggaagatattttgatcttgaattggcaatgccccgagaaaagaagtggtcggacactctaaacataataaaaacagcaaaacaagaaaaaaaacagtttaaaaaaattatgaaaaaaatgaacataaacatatcggcgtctattgcagactgataaaaaatattctctacattactatatgcactcaagttaaagaatttggttgaagagttaatgtgcctctaaactatggatcaaatagaatctaagtcattttaacatttttcacattatataaatgatgaaacggagagagtatatattatgtagataaagggggtttaataatattgtacttaccatattataaaaataaggtggaatacgaaataaatggacgatacaacaccaaaacaatttccgttttcatttatataagttttattgctctcccgtttcacaatataagtctttttagcatttctcacattcgtattgatgttaataaatctagatataaatatgagaaatattagaatggcttacattgtggaacggatgaagcagttcgttcacgatgactataaatttcatattgatcagtcgatcgatagaaatcagaaacgagcatcggttgatcgggatttttcgtgaacttgttcatcccttcatgcaattcatcagccgttttgggattgagctccccgtgacgcaacgcatgacaattgttttgccactggctaaattaacgaggctggttgaccagctgctgctagccaagcatcgctacgttgacctagtttggcacgacgtacacattggtccgaaccaagagaacacgtgtaagatggaaaaaaaaatcaagcagtggaattttgcgtgcattatattaggcgtataacgatcgtcaggaggcgaccttcaatggctgaaatccttgaattgaagtcagcaactgggcgagagccattaaggccccgtttggcacagctccagctcccaactccaacttacctagagctggagctgtgccaaacggtacagattctctattttctggagcggagttagcagagctgctctacaaatttgtactatgggggtggagctgggttttgctgctccacagctccactccaccctaaaagacccactaccctttaattttttaaggatatttacaccaaaataccattgaactaccctatctaccccatctcccgttctctctcctcccaatctttctcccttcacaccggcgttcggcattggcgtcggcgtcggtagcggcgggcagcgggcgtcggtggcagcgggtggcggcgacgacagcaggtgcgcgggcggcggcgggtcggcgacgcgtgggcaggacagcgcacgggcgcacaggtggcgagagacaggacgacgagcggatggcgactggcggggacggcgcgcaggcggcgaaagggcagagctcgctcgtccgccaccgcggcgacacaagggcggcgactggcgacgatggcgcacgggcggggacagggcggcagcgcgtgggaaacgcaagggcggggatagggccgccgacggcgggtggccgaacgtggccggcaaagggcggcgcatggcaagggaagggcggcgcgcgcggggagggattggggatttttattttttttaaggcaatttcagatctggagctaaaaagtcagccaaacactttttcaatgggtatctactcccacaggagctagctctcactggagtgggagtttagagttaggagttggagtttggagccctaccaaacggggcctaaaggtgggatgatttaacccggtgtcctcaaatattattcatgagtcgttattagtacttgatttttttaagttaaactttttaggtttaatcaagtttataaaaaaaattaataacatctacaccaccaaaataatttcattacatgtagcattacatgaattttgataatacgtttgatttatgtttgaaatgttgttatattttttcgcgaacttaaacatgtttaacttaaaaaattaaaagatctgtaatgtaaaatggagggagtaggaatttagtgtaaatgagagatttaccgtagttgtgatgtactcgtactatataaaatgacacgcatatgtatacatattgtaggctagcttatagataggtatttttatgtatatataattcagtgaccgaataactgaatgattttaatatattcacggatacaaacaaactattataaaatcaaataatatttaaacaaataaattttatgaaaattatattaatcatttagcagctgtagaagcgtgttgaagaaaatgacaagggagagacgtccttcaattttttgaagaagaaattatgagcatgttacaatttaaataatgtaccttaaaattaaaatcacacaccccttaccaatacactgtcaaagtactaagtacatctcaaaacaaataacatgccccacaaaaccaaccgaccaactacttaatccattcacacgtaggatattaacggattaactaaactaatcttgaactcgggtctactgcttccgtggctttcgatgctgccaattagctaggctgcagatacttagcgcctaagctaacaaaccaactcgcagtagtccagcagccggccgcgctggtcgatattttgcgtcggatcatacaaaaaagtagaaccaaaaaaaaaaaaagataacgcgatccaagcgaactttttgatggcgacgttgcgagctcgctagcgatcatcgagctaaatatatagcacgggggcagcggctttacgattcattgcgaaccgctacctttttttcgccagaatcatatgcaaatgtaccttaattatctatattatattacatatcatacaaatatgacatattatttacaattttattatatttttaagaacttaacattcaaataatgtaagtcattatctccatatcattttcatattaattaaacatatacatctatcatttatataatatatagcatgcgttcattgatccatatatttcacagcaaagcgcgggatattaactacgactttctccgtcttataatataaaagatttagattgaatatatgtgacatattataatgctatgaatttagataatttttttatctagctttataatattaggatgtatcgcatatatatacgatctgcgagctcgatcgaaaggttgcgatttaattagattaattagtctcgtttaattaattgttcctacgtgagtacgtgcgccgccacaggggagcatatgcatgcactggttcggtttgggttcgtgagatcacttgcttaaaatttagtttcgcctttgctttggggcaaaggaacgaacagatgcgaaagagacgagccttgcggccactttgcatagaggaccctcacgttcaggcaaatccttgtggggcccttatactgccatatctcaaaacgtttttattttggtcttttttatatcatccgactgccatgtcgaccttgatatggcgtgtgttgtcatggtattcgctttagggaaccttcatggcatgcatagtctttcagtatcaggcctgctatttttcagtgtagtggtgtttctctttttattaaaatacatagtttatctcgacttttattagcatatttttcaagctgcttatgaaaactttctatatatacattactttaaaatattaaaacttaatttgttgtacgttaattactttttttatgtatcctagctaggggaaaaaacaccaccgtagagtcactcttggaaatggagtatggctgtgtttgcaaccccttgttcctagcccctatctctcgttttctgtgtacacgtttttcaaactgttaaacggtatattttttttgtaaaaagtttctatacgaaagttgcttaaaaaatcaaattaatctatttttgaaaaaagaatagctaatacttaattaattatacgctaatggaccgttccgttttccgtgcggagagaatgagttctcatcaagctcaagcgaacacagcctatattgtgtttctggctacgaaacttccgattatgcgtgcaaaagcaagaaaacagcaacttggtagcatatgattttctgtggtttatatttgcccgtaataggatttcatatgtaaaatacatgtggattaatctatcccagaactagaagagcctttggacaaaaaaagaaaacactcctttcgatttttttttccacatctctatgtgcaaagaaaatcaaaccctcacatcacgagacaattttagtcatgaaagtaaaaaagaaaacaatgattctcattaaacaggaaagtcgtagtattgaccattagcaggtggtaagtaagggacattaaagaataaaacttcttatttcatggatcgagagtagataagaaggtaggatttgatatactttttaagacagagtttaaactttattactttgggacgaagaccgcactctctcggtttcatatcataagttgtttaacatttttattagtcaaaattttttagttttgatcaaatttattaaaaatgtcagcaatttctacaacaccaaattagtttcattaaatttaatattaaatatatattttgataatatgtttttaattaaaaatattagtatatttttctacaagcttgatcaaatttaaagaagtttgagtaagaaaaaaaatcaaatgacttataatactaaacggagggaatatatgatttggggtcttttttttttcttcttacaagtggcagagtgctgtccataaaccataatattggcaagcagccgggtttgtcctgtaaagtgcatggaaaaggcagattcaaaggagcaagattaaagacgggagaaaaatagcttctttcttcttttggttttctgttatggaagggcagttcgcaaggtcagaattccacctagttgacccttttgacgcatcccctttccggttctttacgatattactcctacgtgccttactcctgattgtctattatatgcactaagcaaattaaagcacttaaccaaacggccggcatacgtagttaaggttttcagtagcatgcatgcatacacttgcatgggcgtcaaagcatagtttagtattgcactcactcactgatcccttctgctgagagggtgagggtgagggagagaggtcactatatataattatatatatatcaacatttttttatggaaagagagctttattgattgggagtaagtaacaggattaatattacattgatgcattatgtgcttaacacatgatggagcatgaccatgcgcgctaaactgcgcaatgaatcatccgcttattagcaaactgaggattgaacattgatatatgtagtttctctgtttatagatccgttatctaaaattttcttactctggtcattaattagcgtagaaaagttatgtatttagactagaaagagtagtacacatctaaacttgtccagaggacattctaaatttgcataaaattaaatatgtgttggtttacttaatttgtttaatacatctctcggcttatacctatactgtgtttttaagattgtctatatcgatgggatacccgtagtccggataaatagggtattatggtacgttggtacgaggatctacacgatacgacatcaagcaaacaaggagacaaagattatactggttcagacccctcgtaagataatagatctaatccagtttatatgagattgatatggaaaaccacataatacaatgagaacagatgaatccggcgttaccggctagatccttgtcgagatgattcgatgagatccctgggcgagtaggtttcgcgtcctccggctcgtagactttggcgggtgtgttggcgctatgattcgatgatctgaacccctcagagggtgttgccttttacaccataagtcaccttagtctccaagtagaacccggagacaatgaaccttgcacgatatagaataaacccaatcctctctgagtaggactctgataaccacttgcccgtgaggatattttccataatgtcttgtagatttccttacgcatatggaaacacatcgtatatatgaaggtatatcgtatccgtatattccgtaagtcataggttatgaggtatgccttactcgtaaccatgatactctataatatgcattttattttcacattggcactttgtttttataaaaggcattataatactcggcttttaacaaagccaaaaggacaaaataatatacattgttctttttttaagttacagcaagttgatagataagaaatacctatacattgttctttttttaagaagtatcaatcatttgatgaacttatgatacctatattagagcaataggctctgattggttgagttacgtacggccgataaccatcgaaatattaattaacgaagcaataaaaataaattgcatgtaaactttcatatctatatattgttaatttgtttctaaaagcccatgctagaatatatagagagactacaacgaaaaaataaagccttaagcaaactttagtttaagtcaaattttgtacagggctaataagccaacaagcgggtgatgagaggctaaaatgcctctttgtttgagtttaggtttattggtttggtttttaagctaatgtttccgttgatatgttttataagccgatgacactatggcagcttttttttcttatatattttataagctggtggatttaaagttatggtttaatggtggagtcaaagtctccatcccacataagaaaaaaaaacgaagaatgtttattttggcttagacttttcggctcgtaaattggtttataaatttaaaaaagggcctaaagcattaagtttaatggtgaagttataccctcagttgaaataagctaaaaagctagtttctccaacctaacttttggcttaacatgtgatagtggcttttggttttagaaaagctagccaaacaaaaaggctactcgtttgtttaggtttaaactttttagcttataaactggctaataagcctgaacagttacagctttattgatcaacttatttagtttaatgattcatttgcatgaaagttcctaaccacgggcctatatagcagaaggatctaattctctaactttccacttggggctataattcttcgaccagcatgcatgaattggcactagaccggaatttttctttgaacaagaatttgacacttggctagtgcatcttcatcaccttacttctttttttttctcttgtcttttacatttctttaggttctaaaatgctagagagagaagaaaaaaagaaacggaatctatatcttcatggagcattagccccaaagaaaggaatcaaggaaccatttctgaggggcccacagagtataaagagaagaataaaaactgtgaattataagtataacccaaatactacttctgaactgcacggttgcccatgtatatgctaattcctgagtatatcctttcctttgcttggttcatgaatcatgatgcaaaaaacaatattgaggacaaaggatttacttaacgaagaagcacctacaatttcaaatttacaataatgggatttcgaattttgaaattaaaggtgcttcttcattaattaaattttgatatcacctagggagatttttttgagaggcactgttttggctctggttaaatagaattacctacttcaaaaaaaaggttactgaaaaaaataggaccaacagctttcgtnnnnnnnnnnnnnnnnnnnnncgtttagtaagcgggaggtcttgagttcgactctcaacgaaagcaattcatttcaaatcatatttttatttgctggagaataaaatcattcgtaactttttttttgttgttg

SEQ ID NO: 56880 - DNA, 3520 bp, Oryza sativa
agatctgcaggcaccaatgcgcgcaataccatcattcatcgacagacgcacaaatgagccgatctcgatttctcgggaacaatttgcaggagatattggatcctgcactggcagaatgtaaggacctgaaatgctggtaagtgtgtgattccctgaaaatgctgaaagtgtgcgactccgagcacagtgatgattgcgagcgcgacacaagtatgtgcacccacaatcactgaaaattcgatggtgtgacagcctcgtgtctcgttgagctgaaaatgtactggtagaattgagcagactactagtaccacttgcccaagcacattcttgattatctgtgtcaaaaattgttggcaacatcttgatgaatgatgagagtctcaagaaacaaaagatcatgcagggctgagaatcaatcattacaagtttgcaaccaactcggtactactacttctagaagcattatgaatctcctctgcggctctgcatatttcggggctgtctggttctctcccttatcaagtcattggtagtaccaaattcttgacatgtttggtattatcaattttttagtagggtagagatttattatacatgtttggataactaccaatatgatgtcaaatattgatcatatagagaagaatgttatagattagtaacaaattgatcattggcattaccaacaatttggcttcaatccaaacccacactattagggcttgtttggtttagtaccctaccaatatgttggtagtgccaaactctaggcaagttttggcactaccaatattttggtagggtagaattgtaaatgagtgtatttagatttatgccaattgaaagccaaattttaaattgtggtgaagaatattctagaattatgccaaattgagtattggcattaccaaagatttggcttcaaaccaaatcatcacatttactatttaaaccaccaaaaatttggtatggcaatattttggtatcaaaccaaaacaccccttactattcaaggtatcaataaattggtagggcacattttggcatcaatccaaaatggcccttcttgccccagaagtttgctgatgggaacaggcgatcatgttctcagcttcgtcagaactacaaggtgcagaatgcgtggacaaacactaggaactaccctatatgaattcataccaaatcatatactccagaagtatcatagtagtagctatgggtgtgtttagttcacgctaaaattgaaagtttggttgaaattggaacgatgtgacggaaaaattggaattttgtgtgtagaaaagttttgatgtgatggaaaaattggaagttttgtgtgagtgcatatactcatggacctagggaaaacagaacagtatggacactaaaatacaactctgcaatagctctgaagctaccatcctactaagtgtgtttagttcacgttaaaattgaaagtttgattaaaattggaacgatgtgacggaaaagttagaagtttgtatgtgtaggaaagttttaatgtaatagaaaagtttgaagtttgaagaaaaattttggaactaaaatcggcccaagccaatttgagtatgcactgatacaaacatgcaatgatccaataaaacttggctttctgaatgtaggagttgatgaaaatgaatataggcggtgtttagatatagggtgtaaagttttggcgtgtcacatcgaatatatggatacacatttgaagaattgaacgtagtctaataacaagacaaattatataatccgcctataaaccacgagacgaatttattaagcttaattaatccgtcattagcaaatatttactgtagcaccacattgtcaaatcatggtgcaattaggcttaaaagattcgtctcgttatttacacgtaatctgtataattagttattttttttatatttaatactccatacatgtgtccaaacatttgatgtgatagagtgtaaaattttgccgggatctaaagagacccatagagtagaaaatttgggactcaaaaaaatgtctcattaataagggtgtgtttagttcacgttaaaattagaaatttggttgaaattggaataatgtgatagaaaaattgaaagtttatgtgtaggaaaattttgatgtgatgaaaaagttgaaagtttgaaaaaaaaagtttggaactaaacccggcataaacccaactgaccaactgtgctgaactgacagccatttaaagttcaaatgtcaactgactactaatcatcgccaactaataaatttgacattttgattctttttttcaaacttatataactttaaccaaattagtttgattaaatctaacatattgaatatacctgtataatatgtttatttgtgttataaatgttgctatgtttttacaaacttaatcaaactaaatgtttttcgtgaacgtgcaaaaactttgcacatcactaaaacttaaagaattttaagttagaaaaaaaaacaacgtcatatagagtaatatgtaacggaaggagtactaaacaagtgctcagccctgaacttacatcttccatagtgatcaagaaagggatgcatagcatcaacttcaggcattcaatgcaccaatggataatgttttttcttactacacaaacatcgagtgatgagcaatgaatgattagagaaatgagcaaaagatctcatatgcatgatgcatcacaaactgacatttagcaggatacgcagaggaacagcgctagaacataaccacatcaacttattccatccacaatatcacacaaaaatggaaagaattaattagcatatgctagaagtttagcataattgcataaaccttttgatgcagttcaagcttagcatggagaacccaatatatagacttaaaactactcgagccacaacagcagtcaagcgctgctcgcaaacttacacgagaagagtcaggggcataaaaatctctccgtaaaaccaaaactcgaagaaggaacaaaaataatactagcaaaatggttcaaaattcagaggactttgctcaaagatatcctccacccaacaatatataaactactgaaaaggaaaattaactgaaaacatcaccaatgacccggagagcggtggcaagcaaagaaccttttagatccgtacaatactccgccgcctccggccgtacctatacgccttgtatatacggtacgaacgcacacacgcacgtagccttcttctcgatctcccttcgcatcctctcatcgttggtagtagacagtagtacaactacaagtaacgcctggctccatcctgtctgcctttggtggcggcggcggcggcggccgcaccctcttacacctacattggccgagactaggcaatgacagggctagtcattcgtgggtgcggccgccgggttcgccattggagaggccggaggcaatggaaggaggagcagggagggagacgaccagaagaagaggcctttccggaggcaatgctgatcagtgtgggctgcaggaat

SEQ ID NO: 56881 - DNA, 16634 bp, Oryza sativa
  unsure (1)..(16634): unsure at all n locations
agagagaggatgggcctagtgggcatggttccgccagtgatgggcccacacggagatagagcgtgtgggtccttggtaggttgaatggggagatgggctatgggcctatggaggcctctttcagttttctgttggtggggcccaacacaggacattcctccctgtctttcgttttcatcgctttaaccccaaacctcccaaatgtaaagcccacaacgctcctcacctcttaccgtccctttccttccacctctactgtatgtggcgtcgaggaggaaacaacagtgctagtatgctactactgttttatatggctaattcacctgtcctaaaatataagagattttagattaatgtaacacaacgtccaaattcgtagtacaacctggttgtgttaaattcatttaaaatcctctatattttgagacagaggaaaaacttttctttagtaacatgcatgtttgttaggtaggaaggatatcaaatgtggtgtttttttaatgaagatgaatataaaattaggacatataaaaacaagaaagtcattattgtaaaattaggttagttttagttattacaaacttaaaaataattgatttaatatttttaaagcaacttttatatagaaagtttatgtacgaaatacggataaaatctgtatgttaatcagagaagaaaattgtgtttatcatatcacgagatgtcggcaagtttacgattgccatgcttaggtctgaagaagctacccaaaaattgtcctaccatttttagcgtgtagaaatgatcctttttctattactatgaaattcttatgtaatggatcggtccatttggaaccctatgcatttggaattgaaatttgtactggttggcatttgtggacggagggagtacgagtaactcgtaccgtcggccctatgcccggagcaatatgaatgccgctcagtggtgacgcgacgagcgccgtgcagccggtgcaggcagcaggctatcatctggtcccagccgcgtcaccgattcaatccacctgaagaattcctccagctagcggagcggtccagcccaatctcacgcgaagccatgcacacgcaagcagctctcgggcagagcgcgcggcgccctcgtccgtcctagagctgcccgacgaggccgatggcttcaggctcgccaaagccgcgctcgctatcgctgcctttgcacggagtagtgtctaatctgaccccgcgcccgccaattgcagtacacgacgtagggactgacggactgtggcctgtactactccagagtgtagtagagtctgtagagcatgtaatacctggactggagtagtggagtcgtgtctcgatcggcgcatggagggacggtccgtcgacgtacgtgtggaccatggaggaggagacgccgcctgcgacgctgagctgagccgtgtcgtgtgggcgtgtggcaatgtgccacgcccacgcgcaggagcgtggacctcgcgaattaacggcgctcgtggcctcgtgctttgctcgccccgcgctgcgcgcacccatggctcggctggctcctggcgacatcgtgggatgctggaaacgtgcccagaggcctcgtcgtttgcacctgcctacacacgcgtttgctagtacaatgcaaggatccaagagtatacggcggcaatgtaacgtaaattcctccaaggatttctactgtaccaaccacgttttgtgggcttaaacatgtactgtacatgcaacagagagatgcacgctgtcacacttcctcaactggctcgatgtcacacccttcaattctccttttttttttttcagaggtactcctgacattagtgaagcatcatctagtctagcagtaacaaggttaacgaaaggaaaaggtcaactttaaccgactcccttaatagtacgctgaatttaattcgtacctctcaacaaaaaaaccggatagaactactcctcaaactattaaaatcagtgcaatttgactctctcagtggttttaagtggcggttttactggcatgacactgttgacctgatattcatcccaggtggtgtttatgtggcattagagcatctccataagtgactctccaagttaaattttagcctacacatgaaaaaaactccctccatcagcctagctacttggattgccaagccatatggctggccaaacgagcttctcaactggccaaatttggccagcctcctcccagttgccaaacggtgggccccactgtgggtcccacctaactctttctttgcttccctcttctcttagccgacggccagctctcatgccctctaccgacggcgccgatggctagctcccacggaggtcgagatggccggcaagtggcgcaaggtggtcggcggcggcaccaacggtggaggaaggcatgcaatggggcggcggagggggacgtggcgaccgtgagtgagagagggcgcagagacgacggacttggagggacgtggcatcgagggagggggatggggcgcgatgcacggccgtcgaagaggacgaggccgacaacgccgttcgtcgtcggggacgcctcacgcatgcacggatccaccattgtcgactgccgccgaggagggcctcccgcgccatgcactcgccgctgcctcaaatgcgcgagggcacgccatcgccgtcgccgctcgggtgctgccgccgccgccaccgtcatcactcggcttcttccccgccgccgatttccgccgctacctccacctccgtcagatccgctcgcccgcccgctgacggcacgagggaatcgacgaggaacggtggcgtcgtcgaggtcggcgtcgcaagctgccgccgtcgtcgtcgtcgaggtcgtcgtggcaagccgccgccgtcgccatccccgccccgagctccgccgccgccgtcgccatcccggcgagcgcctcccgcctcccgcgccgccgcgccgccttccgcctccccgcgtccaccgcgcgccatgcgtcggccaccgttgtcatcagcgtggttgacgggaaggaaggaaatgggaaaagaaggaaaggaaaggaagaaggtggggaggagagagagaaagaagaggggcagaggcttacatgtgggtctgtttttattttggagaggattaacagggagtctgttggagtgagtatctagtttgactagctaaatcagatggagagttggccatatagatgtttggagagtccgatttagagaagctgctagagatgctcttagaattacaaaaatataagtgggacctatttgtcatcacacgcaaaaatatattgtaggacccactgacatgtggggcccacatgtcatctcctctctatgacccttcttcccatctccccttatcctcatccggcagtgccctccccattttctctcctggcggcagtgtggaggttgggcacggagatccggaggtagtgcggaggctaggcaagcagacctggcgaggtggcgatggtggcaacagtggtggtgtggaggaagctcatcgcccccctctctctcctggcggccatggacggcgaggaggagcacggcgcagcatggcgctgccatctccctcgctcgtcggcctcctctttctcccagcagccatggacgatgaggaggagaacggtgcgtgcgcggcactaccgtctccctcgatgtcatctcccttgctcgccgatcccctctccctcccggtggccatgaacagcaaggaggagcacaacgcggcgtggcgctaccgtctccctcaatgctatcccccttgctcgcaggcgtgggacatcgtcaacgctaccagggatagagacggagccagaggtggggaagggcaacagaaagggcacgaaggagaggtgagggaatgacttcgtcgggaggaccacaaccaccggtgaggaggcggtggcggagagtgagaggaattgcgctgcttgtttcgcgagctccttccccacacgtggtttcccgcgcgagatcctcccccacgcgctgggataagggagagacagggaggaggaagggctggagagagagaggatgacaagtgggccccacaatatatttttgtgtgaatgacagatggttccagatatattttttaaattctattgctacataagccatgtgggacgaagaccaggtcaacaccgctacgtcaacgtcatgtcagtaaaacctttgagggagttaaatgttctggtttcaatagttcggggagtcatcctatccggatttatggttgaggggtacaatacttaggctgtgttcggcacacccttttcccaacccctctccctcgttttttacgtgcacgcttttcaaactgctaaacggtatgtttttttaaaaagtttctatatgaaagttgctttaaaaaatcaaataaatctatttttgaaaaaaaaagctaatatttaattaatcacgcgctaatgatctgctccgttttctgtgtggagggaatgagttcccatccgtttgatgcgaacacagccttaagggagtccaaatagacttttttcttaacgaaaaatggcttagctcctcgtcgtcgtctctctctcctgcctagctctggcccaataacgatactgggcttcctttttctaatcaacgatatcaccgcaaaaaaaggaaaatctaatcagtgataaacacacactttaagccacgtatctttgattcttttccccttcttttcctgctatcttgggctcttgcctccttggtggactcgccgccgactactctcggagaaggaaagagcgaagaatggccgcctcatcgtctctcagagtaatcacggcgcccccaaaatccctccttttttcctttgttacatctcgttctctaattcgtgttggtggttggttgacgatgcagctaatcctcggctcctcgtcggcgtcgcgccgccagattctcgccgagatgggatacagcttcacgcttcttgttggtgatttgcccccatgttttctggagcttttttactctattattagtctgttttccttgtggtttatttagttcgtacttttactgtttcccttctaccctcccgtggggtttttagagtgcggatattgacgaaaaggagatcagaaaggagaagccggaggagcttgtggtcgcgctggctcatgcaaaagtaactcctttcctcctcctgttattcaagaacttggattctagttccttcgctaggaaggagaagtactgaagtactttcttaggaaggatagagaagagggggaggggagttggacctagcctgacaatttttggtttggttgtagactacttgtctattacaactattaaagagatagaaagagaatgtaacatgttacatgttcactctacagggctagaaattctgctttagttagaggaaaaaatgattttggtgggtttggattatgatagtgtagattggttgcatatacactagaattgttacatttggactattagtgtaattatacttttatcaataggtataaaaattgtatagcagatatattttcagagggatagtctattagtttcacttgtgtgggtcagcaggacgttcggctaggttttactatttactgcgagagaaacattttagggggacattttggaggtttgggcatgaaaaggtctgtccttttatcaacttccattaatttattgtatctgcttcaaaagttttatgttttcctggttctagatacaattttctttcagtgctgtagtgcagaactgcagactacagttcaactgtgcagcacattctgaattaggcattgactatgtactatgttactatggtttattaattttgcaggcagatgctataatggagaagctgagggataatgggatgatgaaggaaattcttgattctcaagagactacactgttgataactgcagaccaggtgtgtggcttacatctacttatgagataactgcttaatagtcagtaatgtgttgtggtgagatgattttaactagtttgtgtagatattgcagccaatttaaacaaacactagtctaggctgaattgttgttaaaagcgttcttgtggctgcatatttcaaaattgggttcagctgcttgtgttttttttctctgtttgattttaaacttatatgccgctcaaaagataatagtattgaccatcaaacatgcctattgattataagggcagtctcatagttattagggtatactaggatgggttctgaaggagtatgtgtaatattactgattgatccatctccagaggcataacctgtttgtttgcctgactcatattcatatgcttggcatcttgccattgttattttgatctgtagtctactcatgtttgatcagttatgcactgacttatagataatcataagcattcctatgtttgtgatttccctatgacttgtaacggaaaattggaaactgaaccttccatagccattgctaactaccttcatctgtttgtcatgactcatgaggcaaactagtttttgtagggcacattattatgacattagtgatttatggcttcatgggtaatcatgtttagcatatgcttggtctaaccgaaatacttagggatggttctgtagtaaaatgcatcattaatggcactcaactcacatgtatttagatgaacattttggttcttatttgttttttatccttctcatttttactttctgatggaggttgtggttcatgatggagtgattagagaaaaacctagcaccccagaagaggcacgaaagttcatcaaaggtttgtgctattgtgtataagctcaagttttgttcagatagtcctttccctgtattgcttgctggctgctgctcaactatattccgtttacaggatactccgaaagccatgcagcgacaattggatctgttcttgttactaatgtgaaaagtggagccagaaaggaaggatgggacaaagctgaagtaatacctaaatttcttgatgttttatttcggaacaggacatcaaagtcgtgcataaaacctcagagactagatttcatttttaactccaactctatttcaaggagagacctgaaacttgaactactgtgaatagttcaaatttgttattcttctaatatgattgggtgcgtgtgtaattatagcttccacttcaaacttggccgagcttttaatctgatttaagtgaactatgcaaattgcctcaagctctaaattctaatgttgtttagtgcttatcacttctgaaatctggtgggctaacttgtatcaaacattcagattctgagtcacttgtgatctttgtaaagtgatgggccagattgagactgatgtgaatgtttaaactaattgtagaacgctaattttttgcatcctgatttggctcagaagtattagctttctaggtcttcatgtagaattaggtgcacaatcagatcacactatcattgtttgtagacaaaaaaaattcaaactaatcctaatgattaaacataatcagttaggaccctatattgccattgatatgagttctggaggtggtttttggcctgataataactttccactataattgtctatgaacaggtttatttccataagatacccgatgaagttgttgagagtttggtaagtttgtagccattggtcgcaaaagttatttcttgctattttggcactatatttttgattccggagtttgattactttgatactttgactcagttgaacaatgtttttcacctgtttatatttcagattgaggagggcgatgtcttctatgttgccggtggcctgctggtagagcacccgctgacttcacctcttgtggaagctattgtgagtgtagttcttgcatatcctgcttcttggttcagcactgaaaatagaaacctttttacacatggtactcgcctgacatttgataaactcttatgaaggttggcaccatcgacagtgtaatgggactcccgaaatccctcacggagaagctgatcaaggagtcccttgaggagccatagctattttttttaccgggacaactgactgcccatgctgaagttcatatgctagaatttttcactcatctgctgcacaaccaactcgtcatccactctgcttggattggaggatggagatgcatcttaccgatgttgtcagcttgactatgctaagctacttgccgtgattggcattattgtagtaaaacctgagactttactatgtggattaatctgtttggattaaattttctctcttggtgcgtgatcatctctctcatgatggatgcaaacccggttcatctattcgaatctctgcggttttaggatgtgtttggcacttgaggttgagaactactccctccgtcctataagggatcttgagtttttacttgcactgtttaaccacttgtcttttcaaaaaattttggaattattatttatttatttttgacttactttattatctaaagtactttaagcacaactttcgctttttatatttatacatttttaataagacgagtggtcaaataatgcaaacgaaaacttaaaaccttatggggtggagggattaatcctctaggcacttaaaacataacggctcattagcatttaaagtaattttttatagaaaatcttagaaaaaatatactgtttatcagtttggaaaggaaaatgccgagtgaaaaacgatgtagaagctgggagagaagggaatatagagccttcaatgtgcgttgggacttgggaagttctgagcgagcgatgggggctttgttccggtttgaacggtcgatgacaggtggggtccaccgtaagagggatggccatgggcccacaaagcagagactgaacgctaccatccatccctggacgaaacactcgaaaatctcgaatctttctcccgttctcctccccacatcgccggcaccgcgaaccaccgcggccaccggatcgcggcgcggcgcggccgccgacgagcgagggctctcgaccgaccagaacaggtgcgctaatattttctccgcgtggtttccgtgcctcgtatgccctaacggaaggaggaggttgccgcggttaataatgttgggttatttttttcccccgcgatttagcactcgtgaatcacgcgctactctgttttggagtgaattgtgaatagtatgcacaatcattttgcttagctgttgacgcgctcagcttgctgtgtgagaaaacactgatgcctcatttatctgcaccttatttttttatggccggtgtgtttgctgtttagattcataggatagccagccactggctcctttgaacttctgggaaaatgttttactcatacgcttttctattggcatacctatgtgatattattcagattgagctgtttagttttgaatttaatcacatacctagagttgtcctctcggcaggttagtacaacagcaatagttgggcacttgagatatatttgtgggtgggatatagaacttatgataatggaaagtaatatcatagcttcatgcgctgcagtttaattttagatatttgtaagcaacacaaaaatggtagacatctttaactcaaaggatgctagcttttaataactattctccttttactactatcggaggccgctaagtattaatgttagtgaatttaggcacgcatgtatgtgcgcacactgatatttttgtgtgtcattaatgactggtggatggggttacttgtgtattggcctttgacttgatggcgccaaatgctttagtagttaatatacatggtaatatatcatgcttgtatgttctataattgcagtttgtgtcctgaacccacatagtatcttctgtaatcctattgtttgactactgcaattgtatttctatgaaggatgcagttatatttttagagaaagggggtcaattcttttttttttagtgaaaacatataacagagtttatacagcaagggaaatagctgctcacaacgcaataaaaactttgtaaccatataagcactaagcacaacaggctatccagatttaaccatggttacatcaaaagacactgctctcagcaacaacgataaccccagcttgaattttcaattcacaattattctatgccacatcgacacaagagtctagcctacagtacttcagacagccatcaccggggtcttttccttcttgctcaacatagactttcttttgctgcgtttaactcaaatttttacataaccaaatctatcttcaactaccatcttattttgacaggcaacaaagcccaaaggacggatcctagaccaacaagcacctactgattttgcatgtcctactacaaaacatttttgtgtgaagtctttgatatttggagcatataccaagtaaagtttcaacaatccaaccagtcatatatctttgagatcctcaatgtgctcaaacagaacactggaacatattatttctgcaaatcacaaaaataaagcatgttttttatagcttaacctgttcgaaactgggtattctttgaaaatagggaaaacaccacatgggaaaatgaccataacaagataattctttttccttgctatgcccatgaaagaaatgtaaatgatcattgatttggtctaccatgcctcacaaggcctttttcattggaaaaagtaatatgaattattgatttggatccacatccttagtaattagtttaaatctgaactaaatcccaaaatgtcccaaagaaatagccctcagaaatttcaaatgcaccttaaaagagataatttatgtttgtcctttatctacataatttccagttaaaagcttgaattattttgatctttgttgttggtgtgttgtgaggtcatggatgtataatggcgagtacacaagacaaaggtaaaactaatggaggtacttgggagttgggaccatataaatttgtataagttacatatcgttgacaaatgtgctgcatgtaggctgttgctgtggaccacttttctgtagcaccagctttgtttcttgactttgtacttatctaattttctctattgagctaatgttacatacacctgttgaaacccacattgaaattccaattggttccacttaatcccagtcaactttgtatatagctggttgtttggttctttcttatattaccatgcttaagagttatacatgaacaaattatctgtgatcaattttccttaggtcagagttttcactaagaacaagtttgcattactaaaaatatccttttcacccatgaaatctctttttgataacgtgcctttcgttgattttgggatttaagaattttattgcagggattatactttatgcaatccttctggcgagcaatctgctcaacccagacttgacaatttagtgaactttgggcggttatgtttcccttcctgttcaggctaaaatttccaaccagtagtggtactttcttgtctgtaaatttgtatcaaactgttactgattttatttgccccacctcagagcatactggatggttccccagtcatacttaataatgtatctgtgacatcttctgcttcttttagatgtccattgtctaacattgatgtaaggacaccgacatccttggcaagagaaaaggaagtggcctatgagttctagccttgttatagtacctcgtttgactccatgggtgctgttcctatatctaaaaattgagatgcacgtggatataatctgtaagttagctgcataagctacgaatttgtatgtttaacaagttaaacattagtgctattgtttgttcactctccttgcatttggtgcctcatagctcatacatggctagaggactagaagtatgtggttgaacttgaaatggtcaagggatgactagttgagtgctatgaatctgataccgtgtcaaccagttgaattctctttgagatagaaggctctagaaagaaagtgaaactctgttaaatgtgcatgaactttgcattttatgcagtgaaggatctttccccttgttttagtgttatactagtgatatgcaacattctcttacgttgaagcacttcaagacaagagtctgttgcatataggctttttagactattattttaccacacttcaaggaaataaggcgtttgcatataatttaggctattataccacagaacacatcagcacatgcactagaaaccaacacactacattagattcattttttcatgaaaaatactaatgtcagacgttgcaatcactgtttttgcatgatcaaattttggaatctgctagggctcagcctataagcttgagctttgccctcaataagcttaagttatggtcaaatgtaatatctgttaggacttaggggttttactagcttataaagataagctagagctagagagtatgctatcaataatgctgtcgagttcttttatcttacaaattttttatttatacaacattatttatgtcttaattttcagagtctgtttattacctattggtcatttaggccagaccgtcagaatctatacaaagtggattataaaagaatcttaagcttggcaaaagttccaacaagccttcaatatactcgcttcgtatagtttgcaggctcttgtaccaagggcggcaaggaaaccttttttttttctttttactaaattacccataattatcatagtactattctagatattaagggtgaagtgctttgatatatgtgtgctccctacattcttttacaaaagcttttacaattttatatggaggagggagtagttgatgtagtgttcttactttgagctattggactccagtatctatcatgggctgtgtggttatggctgaaccaaccaccacgattattgctggaatttttagctgggctaggctgtaagcactccagtggggcatcaatcactgcaccagacttgataaaaattaatatgaaacttgagctgtaccagtttctgctagttggaaatactgcagagctagtctaggagtttctatttgttctttgtgcttgcctgttacctattcattttgaactaccttttttatcttttgcttggtactacccagcagaatgctgtgagttattcaaatttcatcaccctgttttccagggcaccaatgatgtgtactttgttgcaactttctagctcacagtagaatcaatcattttgcaaactgatcataatgatcattaacatgctttgtcctcctcagggaaacaatggtggcaccaaatctactgatgtattatcttgatggtttctcttagtagctagtatcctgttactggctgggccatcttactgcattcttatctaactctgagagtttgctattgttgtgctgcgttgttttgcattgtggaaatctagttctttacaggcatccttggtaatgctaataagattttcaattactagctaaattccattgctttgctacggataaaaggaaaaaatcataatattgcgttaaataaataaaagcatgtttgtgatgattatgttacccacctttttgctacaacgaatactcacctcaatttaattttatatgtggctaaatatatctagttgtgtataatattaagaagtttaagggataatgtgtaaaaactacagtaggagtaggtggggtggcagattcactgccaccaccactgtaatctttttaaaggagtatagatgacaccaaaatagatggtttcatactaactgaaatatacacaagctgaacaaacttttttcatcagctactaagatgacaaattgagacttacaaagggttatcttgaactctttcatattcatattcaaagtacctattccttgtcaagttgggtacaacttagttgaagcataatttgcctatagtgtgattcatgtgtgccatgagtgcagttttttttttcccatttaccatatgtaaatatgagaatatatccaagtcatatcatcaattaagtgtttgtcatgtttttactgtggccaatgtataagccgtactagaccaggtgttctatctctctgggagatttactgtgatcaattatatgaatgtggcaatttgccagccttttctgcagtagcagatgtgcagctttttcagtgtgcctggtagcaataatcagagtcactaactcctatggtgctagtagggggtcaaaagtactgaaagattgtattaatattgctgctagtgcttctgtgcttgccatttgcatgctgccgagtgacgacggctgttgaaagctgatattcggtgaaattttaaatgctttgccaattagtgtaaaactgttgttctctgtggtccatgtcttctacatgtccttagctgtttgcctaggtagctacagttatctgccgagtgactgagtccttgtagcacatcacaaaagagttccctgttgttgccttttatgcttgccatcacatttgaaactagttttggacacacagtttcgttgggcatacagttctgctgaggtgtttgtggggtcttctatgtaaatgtttgctgaaaccttgtaattgatcctttctttccaacttcttagggtttcaatctttggatgcatgcgtgctttagtccatcattgatgtccccaaggtgcaagggatgatatctgaagaaaatatgaggggatgtttctagaaggtactgttgctttacttacgctccaacctaaacttgtgaataacagggcttgaactgagttattttatactccctccgtttcataatgtaagactttctagcattgcttatattcatctagatgttaatgaatctagacatatgtgtgtctagattcattaacatctatatgaatgtgggcaatgctagaaagacttgtattatgaaacggaggaagtactgtatatgtacataaactgcaaaaatgagctatagcacaatgaaaccacatcttggatgtgtttccaggatgtggtttggtgtgatgtgctaattcttaaggattgttcctagtggtggtgtctggatttcctacccaagttgctgacaaccaagatgaggatatggtgatatgctgattgtcatcaccgatagagacaggttgtgcttctgtttctgcggactttaaattttggcattttccttttaaatgcccgtccatcattatcccgaataaattcctgcatttggcgccagcataaggttctgaagacacctgattgctttcaatgcaatgccacagtgacttaaatgttctgaaaatgttagaaagccaagatctgtacggcggtggtatttactattgtcatcttgagcatgtgtcacattggatatgcaataacttctgtaatggcaccaatacaatcaaaagaatatgaccaacatgctacctgtaaagaaaaatgtagtttttgcacaggcctttggtggtacaaaagtgtagtttttgcacaggcctttggtggtacaaacattttgagaaattccagagaaagggaagagtggtactgtaacttgggttgatggtttgttacttcagttattcagcggtcactgtataatttcttcacatatcattgttcaaaattatgtagccttgactgatatcgaagggataggatgtgagaccccttgtgcccattggcacaaaatgccagctatatgatcaaatgataggggcaatggtggtcacacttaaccagattttaggagcaccaagcccagctggtagtgggggcaatggtgagaggagcattacacacatatactctcaccaggcagaattgccatataagtcccagcagatgcattcaccattggaacatattctgttcatgccttgtccttttttaaagagttattgattctgcaagatatttgcaaattgaactgattctggtgtacccacaacaacctgtttctgatgttagtatcttgtagaggttgtcaatgtatttttcaagccatgaagtagtatttattcatgtattgaactgttggcgattgcatgtgatctaattggccattactgtatcatgaacacagatgcaaaaaatgataaggtcatcccttggaggtctacggaagataaacctcatctggaagtagggttaaagtgtgtttgtcataacgtgcatctgatcctctctcatactgcagcgacgagatttaaaggattatgctccctccaaaatgttcgcaatttgtcactttatccgttcaaaagcaatgctttctatatgctcaagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaatta

SEQ ID NO: 56882 - DNA, 3273 bp, Oryza sativa
acctccaagggatgaccttatcattttttgcatttgtgttcatgatacagtaatggccaattagatcacatgcaatcgccaacagttcaatacatgaataaatactacttcatggcttgaaaaatacattgacaacctctacaagatactaacatcagaaacaggttgttgtgggtacaccagaatcagttcaatttgcaaatatcttgcagaatcaataactctttaaaaaaggacaaggcatgaacagaatatgttccaatggtgaatgcatctgctgggacttatatggcaattctgcctggtgagagtatatgtgtgtaatgctcctctcaccattgcccccactaccagctgggcttggtgctcctaaaatctggttaagtgtgaccaccattgcccctatcatttgatcatatagctggcattttgtgccaatgggcacaaggggtctcacatcctatcccttcgatatcagtcaaggctacataattttgaacaatgatatgtgaagaaattatacagtgaccgctgaataactgaagtaacaaaccatcaacccaagttacagtaccactcttccctttctctggaatttctcaaaatgtttgtaccaccaaaggcctgtgcaaaaactacacttttgtaccaccaaaggcctgtgcaaaaactacatttttctttacaggtagcatgttggtcatattcttttgattgtattggtgccattacagaagttattgcatatccaatgtgacacatgctcaagatgacaatagtaaataccaccgccgtacagatcttggctttctaacattttcagaacatttaagtcactgtggcattgcattgaaagcaatcaggtgtcttcagaaccttatgctggcgccaaatgcaggaatttattcgggataatgatggacgggcatttaaaaggaaaatgccaaaatttaaagtccgcagaaacagaagcacaacctgtctctatcggtgatgacaatcagcatatcaccatatcctcatcttggttgtcagcaacttgggtaggaaatccagacaccaccactaggaacaatccttaagaattagcacatcacaccaaaccacatcctggaaacacatccaagatgtggtttcattgtgctatagctcatttttgcagtttatgtacatatacagtacttcctccgtttcataatacaagtctttctagcattgcccacattcatatagatgttaatgaatctagacacacatatgtctagattcattaacatctagatgaatataagcaatgctagaaagtcttacattatgaaacggagggagtataaaataactcagttcaagccctgttattcacaagtttaggttggagcgtaagtaaagcaacagtaccttctagaaacatcccctcatattttcttcagatatcatcccttgcaccttggggacatcaatgatggactaaagcacgcatgcatccaaagattgaaaccctaagaagttggaaagaaaggatcaattacaaggtttcagcaaacatttacatagaagaccccacaaacacctcagcagaactgtatgcccaacgaaactgtgtgtccaaaactagtttcaaatgtgatggcaagcataaaaggcaacaacagggaactcttttgtgatgtgctacaaggactcagtcactcggcagataactgtagctacctaggcaaacagctaaggacatgtagaagacatggaccacagagaacaacagttttacactaattggcaaagcatttaaaatttcaccgaatatcagctttcaacagccgtcgtcactcggcagcatgcaaatggcaagcacagaagcactagcagcaatattaatacaatctttcagtacttttgaccccctactagcaccataggagttagtgactctgattattgctaccaggcacactgaaaaagctgcacatctgctactgcagaaaaggctggcaaattgccacattcatataattgatcacagtaaatctcccagagagatagaacacctggtctagtacggcttatacattggccacagtaaaaacatgacaaacacttaattgatgatatgacttggatatattctcatatttacatatggtaaatgggaaaaaaaaaactgcactcatggcacacatgaatcacactataggcaaattatgcttcaactaagttgtacccaacttgacaaggaataggtactttgaatatgaatatgaaagagttcaagataaccctttgtaagtctcaatttgtcatcttagtagctgatgaaaaaagtttgttcagcttgtgtatatttcagttagtatgaaaccatctattttggtgtcatctatactcctttaaaaagattacagtggtggtggcagtgaatctgccaccccacctactcctactgtagtttttacacattatcccttaaacttcttaatattatacacaactagatatatttagccacatataaaattaaattgaggtgagtattcgttgtagcaaaaaggtgggtaacataatcatcacaaacatgcttttatttatttaacgcaatattatgattttttccttttatccgtagcaaagcaatggaatttagctagtaattgaaaatcttattagcattaccaaggatgcctgtaaagaactagatttccacaatgcaaaacaacgcagcacaacaatagcaaactctcagagttagataagaatgcagtaagatggcccagccagtaacaggatactagctactaagagaaaccatcaagataatacatcagtagatttggtgccaccattgtttccctgaggaggacaaagcatgttaatgatcattatgatcagtttgcaaaatgattgattctactgtgagctagaaagttgcaacaaagtacacatcattggtgccctggaaaacagggtgatgaaatttgaataactcacagcattctgctgggtagtaccaagcaaaagataaaaaaggtagttcaaaatgaataggtaacaggcaagcacaaagaacaaatagaaactcctagactagctctgcagtatttccaactagcagaaactggtacagctcaagtttcatattaatttttatcaagtctggtgcagtgattgatgccccactggagtgcttacagcctagcccagctaaaaattccagcaataatcgtggtggttggttcagccataaccacacagcccatgatagatactggagtccaatag

SEQ ID NO: 56883 - DNA, 9423 bp, Oryza sativa
taaatgaccaataggtaataaacagactctgaaaattaagacataaataatgttgtataaataaaaaatttgtaagataaaagaactcgacagcattattgatagcatactctctagctctagcttatctttataagctagtaaaacccctaagtcctaacagatattacatttgaccataacttaagcttattgagggcaaagctcaagcttataggctgagccctagcagattccaaaatttgatcatgcaaaaacagtgattgcaacgtctgacattagtatttttcatgaaaaaatgaatctaatgtagtgtgttggtttctagtgcatgtgctgatgtgttctgtggtataatagcctaaattatatgcaaacgccttatttccttgaagtgtggtaaaataatagtctaaaaagcctatatgcaacagactcttgtcttgaagtgcttcaacgtaagagaatgttgcatatcactagtataacactaaaacaaggggaaagatccttcactgcataaaatgcaaagttcatgcacatttaacagagtttcactttctttctagagccttctatctcaaagagaattcaactggttgacacggtatcagattcatagcactcaactagtcatcccttgaccatttcaagttcaaccacatacttctagtcctctagccatgtatgagctatgaggcaccaaatgcaaggagagtgaacaaacaatagcactaatgtttaacttgttaaacatacaaattcgtagcttatgcagctaacttacagattatatccacgtgcatctcaatttttagatataggaacagcacccatggagtcaaacgaggtactataacaaggctagaactcataggccacttccttttctcttgccaaggatgtcggtgtccttacatcaatgttagacaatggacatctaaaagaagcagaagatgtcacagatacattattaagtatgactggggaaccatccagtatgctctgaggtggggcaaataaaatcagtaacagtttgatacaaatttacagacaagaaagtaccactactggttggaaattttagcctgaacaggaagggaaacataaccgcccaaagttcactaaattgtcaagtctgggttgagcagattgctcgccagaaggattgcataaagtataatccctgcaataaaattcttaaatcccaaaatcaacgaaaggcacgttatcaaaaagagatttcatgggtgaaaaggatatttttagtaatgcaaacttgttcttagtgaaaactctgacctaaggaaaattgatcacagataatttgttcatgtataactcttaagcatggtaatataagaaagaaccaaacaaccagctatatacaaagttgactgggattaagtggaaccaattggaatttcaatgtgggtttcaacaggtgtatgtaacattagctcaatagagaaaattagataagtacaaagtcaagaaacaaagctggtgctacagaaaagtggtccacagcaacagcctacatgcagcacatttgtcaacgatatgtaacttatacaaatttatatggtcccaactcccaagtacctccattagttttacctttgtcttgtgtactcgccattatacatccatgacctcacaacacaccaacaacaaagatcaaaataattcaagcttttaactggaaattatgtagataaaggacaaacataaattatctcttttaaggtgcatttgaaatttctgagggctatttctttgggacattttgggatttagttcagatttaaactaattactaaggatgtggatccaaatcaataattcatattactttttccaatgaaaaaggccttgtgaggcatggtagaccaaatcaatgatcatttacatttctttcatgggcatagcaaggaaaaagaattatcttgttatggtcattttcccatgtggtgttttccctattttcaaagaatacccagtttcgaacaggttaagctataaaaaacatgctttatttttgtgatttgcagaaataatatgttccagtgttctgtttgagcacattgaggatctcaaagatatatgactggttggattgttgaaactttacttggtatatgctccaaatatcaaagacttcacacaaaaatgttttgtagtaggacatgcaaaatcagtaggtgcttgttggtctaggatccgtcctttgggctttgttgcctgtcaaaataagatggtagttgaagatagatttggttatgtaaaaatttgagttaaacgcagcaaaagaaagtctatgttgagcaagaaggaaaagaccccggtgatggctgtctgaagtactgtaggctagactcttgtgtcgatgtggcatagaataattgtgaattgaaaattcaagctggggttatcgttgttgctgagagcagtgtcttttgatgtaaccatggttaaatctggatagcctgttgtgcttagtgcttatatggttacaaagtttttattgcgttgtgagcagctatttcccttgctgtataaactctgttatatgttttcactaaaaaaaaaagaattgaccccctttctctaaaaatataactgcatccttcatagaaatacaattgcagtagtcaaacaataggattacagaagatactatgtgggttcaggacacaaactgcaattatagaacatacaagcatgatatattaccatgtatattaactactaaagcatttggcgccatcaagtcaaaggccaatacacaagtaaccccatccaccagtcattaatgacacacaaaaatatcagtgtgcgcacatacatgcgtgcctaaattcactaacattaatacttagcggcctccgatagtagtaaaaggagaatagttattaaaagctagcatcctttgagttaaagatgtctaccatttttgtgttgcttacaaatatctaaaattaaactgcagcgcatgaagctatgatattactttccattatcataagttctatatcccacccacaaatatatctcaagtgcccaactattgctgttgtactaacctgccgagaggacaactctaggtatgtgattaaattcaaaactaaacagctcaatctgaataatatcacataggtatgccaatagaaaagcgtatgagtaaaacattttcccagaagttcaaaggagccagtggctggctatcctatgaatctaaacagcaaacacaccggccataaaaaaataaggtgcagataaatgaggcatcagtgttttctcacacagcaagctgagcgcgtcaacagctaagcaaaatgattgtgcatactattcacaattcactccaaaacagagtagcgcgtgattcacgagtgctaaatcgcgggggaaaaaaataacccaacattattaaccgcggcaacctcctccttccgttagggcatacgaggcacggaaaccacgcggagaaaatattagcgcacctgttctggtcggtcgagagccctcgctcgtcggcggccgcgccgcgccgcgatccggtggccgcggtggttcgcggtgccggcgatgtggggaggagaacgggagaaagattcgagattttcgagtgtttcgtccagggatggatggtagcgttcagtctctgctttgtgggcccatggccatccctcttacggtggaccccacctgtcatcgaccgttcaaaccggaacaaagcccccatcgctcgctcagaacttcccaagtcccaacgcacattgaaggctctatattcccttctctcccagcttctacatcgtttttcactcggcattttcctttccaaactgataaacagtatattttttctaagattttctataaaaaattactttaaatgctaatgagccgttatgttttaagtgcctagagaattaatccctccaccccataaggttttaagttttcgtttgcattatttgaccactcgtcttattaaaaatgtataaatataaaaagcgaaagttgtgcttaaagtactttagataataaagtaagtcaaaaataaataaataataattccaaaattttttgaaaagacaagtggttaaacagtgcaagtaaaaactcaagatcccttataggacggagggagtagttctcaacctcaagtgccaaacacatcctaaaaccgcagagattcgaatagatgaaccgggtttgcatccatcatgagagagatgatcacgcaccaagagagaaaatttaatccaaacagattaatccacatagtaaagtctcaggttttactacaataatgccaatcacggcaagtagcttagcatagtcaagctgacaacatcggtaagatgcatctccatcctccaatccaagcagagtggatgacgagttggttgtgcagcagatgagtgaaaaattctagcatatgaacttcagcatgggcagtcagttgtcccggtaaaaaaaatagctatggctcctcaagggactccttgatcagcttctccgtgagggatttcgggagtcccattacactgtcgatggtgccaaccttcataagagtttatcaaatgtcaggcgagtaccatgtgtaaaaaggtttctattttcagtgctgaaccaagaagcaggatatgcaagaactacactcacaatagcttccacaagaggtgaagtcagcgggtgctctaccagcaggccaccggcaacatagaagacatcgccctcctcaatctgaaatataaacaggtgaaaaacattgttcaactgagtcaaagtatcaaagtaatcaaactccggaatcaaaaatatagtgccaaaatagcaagaaataacttttgcgaccaatggctacaaacttaccaaactctcaacaacttcatcgggtatcttatggaaataaacctgttcatagacaattatagtggaaagttattatcaggccaaaaaccacctccagaactcatatcaatggcaatatagggtcctaactgattatgtttaatcattaggattagtttgaattttttttgtctacaaacaatgatagtgtgatctgattgtgcacctaattctacatgaagacctagaaagctaatacttctgagccaaatcaggatgcaaaaaattagcgttctacaattagtttaaacattcacatcagtctcaatctggcccatcactttacaaagatcacaagtgactcagaatctgaatgtttgatacaagttagcccaccagatttcagaagtgataagcactaaacaacattagaatttagagcttgaggcaatttgcatagttcacttaaatcagattaaaagctcggccaagtttgaagtggaagctataattacacacgcacccaatcatattagaagaataacaaatttgaactattcacagtagttcaagtttcaggtctctccttgaaatagagttggagttaaaaatgaaatctagtctctgaggttttatgcacgactttgatgtcctgttccgaaataaaacatcaagaaatttaggtattacttcagctttgtcccatccttcctttctggctccacttttcacattagtaacaagaacagatccaattgtcgctgcatggctttcggagtatcctgtaaacggaatatagttgagcagcagccagcaagcaatacagggaaaggactatctgaacaaaacttgagcttatacacaatagcacaaacctttgatgaactttcgtgcctcttctggggtgctaggtttttctctaatcactccatcatgaaccacaacctccatcagaaagtaaaaatgagaaggataaaaaacaaataagaaccaaaatgttcatctaaatacatgtgagttgagtgccattaatgatgcattttactacagaaccatccctaagtatttcggttagaccaagcatatgctaaacatgattacccatgaagccataaatcactaatgtcataataatgtgccctacaaaaactagtttgcctcatgagtcatgacaaacagatgaaggtagttagcaatggctatggaaggttcagtttccaattttccgttacaagtcatagggaaatcacaaacataggaatgcttatgattatctataagtcagtgcataactgatcaaacatgagtagactacagatcaaaataacaatggcaagatgccaagcatatgaatatgagtcaggcaaacaaacaggttatgcctctggagatggatcaatcagtaatattacacatactccttcagaacccatcctagtataccctaataactatgagactgcccttataatcaataggcatgtttgatggtcaatactattatcttttgagcggcatataagtttaaaatcaaacagagaaaaaaaacacaagcagctgaacccaattttgaaatatgcagccacaagaacgcttttaacaacaattcagcctagactagtgtttgtttaaattggctgcaatatctacacaaactagttaaaatcatctcaccacaacacattactgactattaagcagttatctcataagtagatgtaagccacacacctggtctgcagttatcaacagtgtagtctcttgagaatcaagaatttccttcatcatcccattatccctcagcttctccattatagcatctgcctgcaaaattaataaaccatagtaacatagtacatagtcaatgcctaattcagaatgtgctgcacagttgaactgtagtctgcagttctgcactacagcactgaaagaaaattgtatctagaaccaggaaaacataaaacttttgaagcagatacaataaattaatggaagttgataaaaggacagaccttttcatgcccaaacctccaaaatgtccccctaaaatgtttctctcgcagtaaatagtaaaacctagccgaacgtcctgctgacccacacaagtgaaactaatagactatccctctgaaaatatatctgctatacaatttttatacctattgataaaagtataattacactaatagtccaaatgtaacaattctagtgtatatgcaaccaatctacactatcataatccaaacccaccaaaatcattttttcctctaactaaagcagaatttctagccctgtagagtgaacatgtaacatgttacattctctttctatctctttaatagttgtaatagacaagtagtctacaaccaaaccaaaaattgtcaggctaggtccaactcccctccccctcttctctatccttcctaagaaagtacttcagtacttctccttcctagcgaaggaactagaatccaagttcttgaataacaggaggaggaaaggagttacttttgcatgagccagcgcgaccacaagctcctccggcttctcctttctgatctccttttcgtcaatatccgcactctaaaaaccccacgggagggtagaagggaaacagtaaaagtacgaactaaataaaccacaaggaaaacagactaataatagagtaaaaaagctccagaaaacatgggggcaaatcaccaacaagaagcgtgaagctgtatcccatctcggcgagaatctggcggcgcgacgccgacgaggagccgaggattagctgcatcgtcaaccaaccaccaacacgaattagagaacgagatgtaacaaaggaaaaaaggagggattttgggggcgccgtgattactctgagagacgatgaggcggccattcttcgctctttccttctccgagagtagtcggcggcgagtccaccaaggaggcaagagcccaagatagcaggaaaagaaggggaaaagaatcaaagatacgtggcttaaagtgtgtgtttatcactgattagattttcctttttttgcggtgatatcgttgattagaaaaaggaagcccagtatcgttattgggccagagctaggcaggagagagagacgacgacgaggagctaagccatttttcgttaagaaaaaagtctatttggactcccttaaggctgtgttcgcatcaaacggatgggaactcattccctccacacagaaaacggagcagatcattagcgcgtgattaattaaatattagctttttttttcaaaaatagatttatttgattttttaaagcaactttcatatagaaactttttaaaaaaacataccgtttagcagtttgaaaagcgtgcacgtaaaaaacgagggagaggggttgggaaaagggtgtgccgaacacagcctaagtattgtacccctcaaccataaatccggataggatgactccccgaactattgaaaccagaacatttaactccctcaaaggttttactgacatgacgttgacgtagcggtgttgacctggtcttcgtcccacatggcttatgtagcaatagaatttaaaaaatatatctggaaccatctgtcattcacacaaaaatatattgtggggcccacttgtcatcctctctctctccagcccttcctcctccctgtctctcccttatcccagcgcgtgggggaggatctcgcgcgggaaaccacgtgtggggaaggagctcgcgaaacaagcagcgcaattcctctcactctccgccaccgcctcctcaccggtggttgtggtcctcccgacgaagtcattccctcacctctccttcgtgccctttctgttgcccttccccacctctggctccgtctctatccctggtagcgttgacgatgtcccacgcctgcgagcaagggggatagcattgagggagacggtagcgccacgccgcgttgtgctcctccttgctgttcatggccaccgggagggagaggggatcggcgagcaagggagatgacatcgagggagacggtagtgccgcgcacgcaccgttctcctcctcatcgtccatggctgctgggagaaagaggaggccgacgagcgagggagatggcagcgccatgctgcgccgtgctcctcctcgccgtccatggccgccaggagagagaggggggcgatgagcttcctccacaccaccactgttgccaccatcgccacctcgccaggtctgcttgcctagcctccgcactacctccggatctccgtgcccaacctccacactgccgccaggagagaaaatggggagggcactgccggatgaggataaggggagatgggaagaagggtcatagagaggagatgacatgtgggccccacatgtcagtgggtcctacaatatatttttgcgtgtgatgacaaataggtcccacttatatttttgtaattctaagagcatctctagcagcttctctaaatcggactctccaaacatctatatggccaactctccatctgatttagctagtcaaactagatactcactccaacagactccctgttaatcctctccaaaa

SEQ ID NO: 56884 - DNA, 9848 bp, Oryza sativa
  unsure (1)..(9848): unsure at all n locations
gtgcatgcgtgaggcgtccccgacgacgaacggcgttgtcggcctagtcctcttcgacggccgtgcatcgcgccccatccccctccctcgatgccacgtccctccaagtccgtcgtctatgcgccctctctcactcacggtcgccacgtccccctccgccgccccattgcatgccttcctccaccgttggtgccgccgccgaccaccttgcgccacttgccggccatctcgacctccgtgggagctagccatcggcgccgtcggtagagggcatgagagctggccgtcggctaagagaagagggaagcaaagaaagagttaggtgggacccacagtggggcccaccgtttggcaactgggaggaggctggccaaatttggccagttgagaagctcgtttggccagccatatggcttggcaatccaagtagctaggctgatggagggagtttttttcatgtgtaggctaaaatttaacttggagagtcacttatggagatgctctaatgccacataaacaccacctgggatgaatatcaggtcaacagtgtcatgccagtaaaaccgccacttaaaaccactgagagagtcaaattgcactgattttaatagtttgaggagtagttctatccggtttttttgttgagaggtacgaattaaattcagcgtactattaagggagtcggttaaagttgaccttttcctttcgttaaccttgttactgctagactagatgatgcttcactaatgtcaggagtacctctgaaaaaaaaaaaaggagaattgaagggtgtgacatcgagccagttgaggaagtgtgacagcgtgcatctctctgttgcatgtacagtacatgtttaagcccacaaaacgtggttggtacagtagaaatccttggaggaatttacgttacattgccgccgtatactcttggatccttgcattgtactagcaaacgcgtgtgtaggcaggtgcaaacgacgaggcctctgggcacgtttccagcatcccacgatgtcgccaggagccagccgagccatgggtgcgcgcagcgcggggcgagcaaagcacgaggccacgagcgccgttaattcgcgaggtccacgctcctgcgcgtgggcgtggcacattgccacacgcccacacgacacggctcagctcagcgtcgcaggcggcgtctcctcctccatggtccacacgtacgtcgacggaccgtccctccatgcgccgatcgagacacgactccactactccagtccaggtattacatgctctacagactctactacactctggagtagtacaggccacagtccgtcagtccctacgtcgtgtactgcaattggcgggcgcggggtcagattagacactactccgtgcaaaggcagcgatagcgagcgcggctttggcgagcctgaagccatcggcctcgtcgggcagctctaggacggacgagggcgccgcgcgctctgcccgagagctgcttgcgtgtgcatggcttcgcgtgagattgggctggaccgctccgctagctggaggaattcttcaggtggattgaatcggtgacgcggctgggaccagatgatagcctgctgcctgcaccggctgcacggcgctcgtcgcgtcaccactgagcggcattcatattgctccgggcatagggccgacggtacgagttactcgtactccctccgtccacaaatgccaaccagtacaaatttcaattccaaatgcatagggttccaaatggaccgatccattacataagaatttcatagtaatagaaaaaggatcatttctacacgctaaaaatggtaggacaatttttgggtagcttcttcagacctaagcatggcaatcgtaaacttgccgacatctcgtgatatgataaacacaattttcttctctgattaacatacagattttatccgtatttcgtacataaactttctatataaaagttgctttaaaaatattaaatcaattatttttaagtttgtaataactaaaactaacctaattttacaataatgactttcttgtttttatatgtcctaattttatattcatcttcattaaaaaaacaccacatttgatatccttcctacctaacaaacatgcatgttactaaagaaaagtttttcctctgtctcaaaatatagaggattttaaatgaatttaacacaaccaggttgtactacgaatttggacgttgtgttacattaatctaaaatctcttatattttaggacaggtgaattagccatataaaacagtagtagcatactagcactgttgtttcctcctcgacgccacatacagtagaggtggaaggaaagggacggtaagaggtgaggagcgttgtgggctttacatttgggaggtttggggttaaagcgatgaaaacgaaagacagggaggaatgtcctgtgttgggccccaccaacagaaaactgaaagaggcctccataggcccatagcccatctccccattcaacctaccaaggacccacacgctctatctccgtgtgggcccatcactggcggaaccatgcccactaggcccatcctctctctagacctggtccatggatttgcttctccccttcttgcatataaatggcatatgggtctatacactaagtctacaaacaacgtacccatgtacagtgttccacactgatcagcattgcctccggaaaggcctcttcttctagtcgtctccctccctgctcctccttccattgcctccggcctctccaatggcgaacccggcggccgcacccacgaatgactagccctgtcattgcctagtctcggccaatgtaggtgtaagagggtgcggccgccgccgccgccgccaccaaaggcagacaggatggagccaggcgttacttgtagttgtactactgtctactaccaacgatgagaggatgcgaagggagatcgagaagaaggctacgtgcgtgtgtgcgttcgtaccgtatatacaaggcgtataggtacggccggaggcggcggagtattgtacggatctaaaaggttctttgcttgccaccgctctccgggtcattggtgatgttttcagttaattttccttttcagtagtttatatattgttgggtggaggatatctttgagcaaagtcctctgaattttgaaccattttgctagtattatttttgttccttcttcgagttttggttttacggagagatttttatgcccctgactcttctcgtgtaagtttgcgagcagcgcttgactgctgttgtggctcgagtagttttaagtctatatattgggttctccatgctaagcttgaactgcatcaaaaggtttatgcaattatgctaaacttctagcatatgctaattaattctttccatttttgtgtgatattgtggatggaataagttgatgtggttatgttctagcgctgttcctctgcgtatcctgctaaatgtcagtttgtgatgcatcatgcatatgagatcttttgctcatttctctaatcattcattgctcatcactcgatgtttgtgtagtaagaaaaaacattatccattggtgcattgaatgcctgaagttgatgctatgcatccctttcttgatcactatggaagatgtaagttcagggctgagcacttgtttagtactccttccgttacatattactctatatgacgttgtttttttttctaacttaaaattctttaagttttagtgatgtgcaaagtttttgcacgttcacgaaaaacatttagtttgattaagtttgtaaaaacatagcaacatttataacacaaataaacatattatacaggtatattcaatatgttagatttaatcaaactaatttggttaaagttatataagtttgaaaaaaagaatcaaaatgtcaaatttattagttggcgatgattagtagtcagttgacatttgaactttaaatggctgtcagttcagcacagttggtcagttgggtttatgccgggtttagttccaaactttttttttcaaactttcaactttttcatcacatcaaaattttcctacacataaactttcaatttttctatcacattattccaatttcaaccaaatttctaattttaacgtgaactaaacacacccttattaatgagacatttttttgagtcccaaattttctactctatgggtctctttagatcccggcaaaattttacactctatcacatcaaatgtttggacacatgtatggagtattaaatataaaaaaaataactaattatacagattacgtgtaaataacgagacgaatcttttaagcctaattgcaccatgatttgacaatgtggtgctacagtaaatatttgctaatgacggattaattaagcttaataaattcgtctcgtggtttataggcggattatataatttgtcttgttattagactacgttcaattcttcaaatgtgtatccatatattcgatgtgacacgccaaaactttacaccctatatctaaacaccgcctatattcattttcatcaactcctacattcagaaagccaagttttattggatcattgcatgtttgtatcagtgcatactcaaattggcttgggccgattttagttccaaaatttttcttcaaacttcaaacttttctattacattaaaactttcctacacatacaaacttctaacttttccgtcacatcgttccaattttaatcaaactttcaattttaacgtgaactaaacacacttagtaggatggtagcttcagagctattgcagagttgtattttagtgtccatactgttctgttttccctaggtccatgagtatatgcactcacacaaaacttccaatttttccatcacatcaaaacttttctacacacaaaattccaatttttccgtcacatcgttccaatttcaaccaaactttcaattttagcgtgaactaaacacacccatagctactactatgatacttctggagtatatgatttggtatgaattcatatagggtagttcctagtgtttgtccacgcattctgcaccttgtagttctgacgaagctgagaacatgatcgcctgttcccatcagcaaacttctggggcaagaagggccattttggattgatgccaaaatgtgccctaccaatttattgataccttgaatagtaaggggtgttttggtttgataccaaaatattgccataccaaatttttggtggtttaaatagtaaatgtgatgatttggtttgaagccaaatctttggtaatgccaatactcaatttggcataattctagaatattcttcaccacaatttaaaatttggctttcaattggcataaatctaaatacactcatttacaattctaccctaccaaaatattggtagtgccaaaacttgcctagagtttggcactaccaacatattggtagggtactaaaccaaacaagccctaatagtgtgggtttggattgaagccaaattgttggtaatgccaatgatcaatttgttactaatctataacattcttctctatatgatcaatatttgacatcatattggtagttatccaaacatgtataataaatctctaccctactaaaaaattgataataccaaacatgtcaagaatttggtactaccaatgacttgataagggagagaaccagacagccccgaaatatgcagagccgcagaggagattcataatgcttctagaagtagtagtaccgagttggttgcaaacttgtaatgattgattctcagccctgcatgatcttttgtttcttgagactctcatcattcatcaagatgttgccaacaatttttgacacagataatcaagaatgtgcttgggcaagtggtactagtagtctgctcaattctaccagtacattttcagctcaacgagacacgaggctgtcacaccatcgaattttcagtgattgtgggtgcacatacttgtgtcgcgctcgcaatcatcactgtgctcggagtcgcacactttcagcattttcagggaatcacacacttaccagcatttcaggtccttacattctgccagtgcaggatccaatatctcctgcaaattgttcccgagaaatcgagatcggctcatttgtgcgtctgtcgatgaatgatggtattgcgcgcattggtgcctgcagatctggctccgatgagcgcccgggtattccccccgactttccggcattccatcattgcataatgcaaaagttccacggcagctggttgagattttgctggtgtatcgatcacctggaccctgtttttgtcgttctagtactgttgctaacttcttgttattgccactcactctgtagttacaagacattcagacacagttttaaacagttatactagctgctagcctgctacttccgtcacaaaatatactagtaacttttgtctacgggcttgtttggtttggagctaatttttatcctacaaaaatcttggtagtgccaaaacattggtaaattttggcaataccaaattgattagtattcaatttgaacaattgtgggtagaatttgatagcaaaccaaacatacacttgctactgttgaagttaccaaaattttggtagggtaataaattggaaccaaaccaaacaggccctacgtatgtaaatatacccttatccacctagaaattttagaaatttagtatattttaggacggatgtagtagcgaattattatataatgtatgtttattccaaaccactaaaaggtatatttttaaaaaagactttactgaaatttaaataaatatatttttaagtttataatagttagcacctaattaatcatacactgatatattttccgaaaagacaaggcttaataagccaaatggctgaaatgaacgtagcctttaatagaaaaggtgttaggagtatcttttagttggataatcctgctaccaaatacaaacatttataatattcaaattttgtatacaatatatatttttggggaacacttattccaatgaatgggattcaaccagacaattaggtgctgagaagagaatacaaccaatttaaaaattaaccaatgtgataacttagtaaaaggaaatatttcctgtaatccttatttctttaacaaatatttctctttatctgtaatatttgctaagcaatttagaaatgcttataattacaaactgagatagagtatatcataagacgatgaaatattttcgttcatgctttcgataaacatgtgctaagaagatttgtcctgaaagaaaaaagtatgaacgatttcatcctcggaaataaaaagaaatgtttgttcccaggaaagaagatccctcttcatgaaaaaaaaaatgaatgatttcatcttcagaaaaaatatgaacgatttaatcttaaacaacaacaacaacaacaacaataatatgtttgcttccatcaaagaatattcatattcatgaaatggaaatttttcagcaaaaatgaaaaaatgattttaagaattatgaatgagtccatcttcagcaaaaatttaaaaattattgttttcttccagcaaagaagattcatcttcaagaaaaaaaaatatgaatgatttcatcttgatagtcatgggaaaaaaatcatgaatgattttattcgacaacaacaaaaaaaaagttacgaatgattttattctccagcaaataaaaatatgatttgaaatgaattgctttcgttgagagtcgaactcaagacctcccgcttactaaacgnnnnnnnnnnnnnnnnagctnnnnnnnnnnnnnnnnnagctgttggtcctatttttttcagtaaccttttttttgaagtaggtaattctatttaaccagagccaaaacagtgcctctcaaaaaaatctccctaggtgatatcaaaatttaattaatgaagaagcacctttaatttcaaaattcgaaatcccattattgtaaatttgaaattgtaggtgcttcttcgttaagtaaatcctttgtcctcaatattgttttttgcatcatgattcatgaaccaagcaaaggaaaggatatactcaggaattagcatatacatgggcaaccgtgcagttcagaagtagtatttgggttatacttataattcacagtttttattcttctctttatactctgtgggcccctcagaaatggttccttgattcctttctttggggctaatgctccatgaagatatagattccgtttctttttttcttctctctctagcattttagaacctaaagaaatgtaaaagacaagagaaaaaaaaagaagtaaggtgatgaagatgcactagccaagtgtcaaattcttgttcaaagaaaaattccggtctagtgccaattcatgcatgctggtcgaagaattatagccccaagtggaaagttagagaattagatccttctgctatataggcccgtggttaggaactttcatgcaaatgaatcattaaactaaataagttgatcaataaagctgtaactgttcaggcttattagccagtttataagctaaaaagtttaaacctaaacaaacgagtagcctttttgtttggctagcttttctaaaaccaaaagccactatcacatgttaagccaaaagttaggttggagaaactagctttttagcttatttcaactgagggtataacttcaccattaaacttaatgctttaggcccttttttaaatttataaaccaatttacgagccgaaaagtctaagccaaaataaacattcttcgtttttttttcttatgtgggatggagactttgactccaccattaaaccataactttaaatccaccagcttataaaatatataagaaaaaaaagctgccatagtgtcatcggcttataaaacatatcaacggaaacattagcttaaaaaccaaaccaataaacctaaactcaaacaaagaggcattttagcctctcatcacccgcttgttggcttattagccctgtacaaaatttgacttaaactaaagtttgcttaaggctttattttttcgttgtagtctctctatatattctagcatgggcttttagaaacaaattaacaatatatagatatgaaagtttacatgcaatttatttttattgcttcgttaattaatatttcgatggttatcggccgtacgtaactcaaccaatcagagcctattgctctaatataggtatcataagttcatcaaatgattgatacttcttaaaaaaagaacaatgtataggtatttcttatctatcaacttgctgtaacttaaaaaaagaacaatgtatattattttgtccttttggctttgttaaaagccgagtattataatgccttttataaaaacaaagtgccaatgtgaaaataaaatgcatattatagagtatcatggttacgagtaaggcatacctcataacctatgacttacggaatatacggatacgatataccttcatatatacgatgtgtttccatatgcgtaaggaaatctacaagacattatggaaaatatcctcacgggcaagtggttatcagagtcctactcagagaggattgggtttattctatatcgtgcaaggttcattgtctccgggttctacttggagactaaggtgacttatggtgtaaaaggcaacaccctctgaggggttcagatcatcgaatcatagcgccaacacacccgccaaagtctacgagccggaggacgcgaaacctactcgcccagggatctcatcgaatcatctcgacaaggatctagccggtaacgccggattcatctgttctcattgtatcatgtggttttccatatcaatctcata

SEQ ID NO: 56885 - DNA, 12518 bp, Oryza sativa
ttacacgtgttctcttggttcggaccaatgtgtacgtcgtgcgaaactaggtcaacgtagcgatgcttggctagcagcagctggtcaaccagcctcgttaatttagccagtggcaaaacaattgtcatgcgttgcgtcacggggagctcaatcccaaaacggctgatgaattgcatgaagggatgaacaagttcacgaaaaatcccgatcaaccgatgctcgtttctgatttctatcgatcgactgatcaatatgaaatttatagtcatcgtgaacgaactgcttcatccgttccacaatgtaagccattctaatatttctcatatttatatctagatttattaacatcaatacgaatgtgagaaatgctaaaaagacttatattgtgaaacgggagagcaataaaacttatataaatgaaaacggaaattgttttggtgttgtatcgtccatttatttcgtattccaccttatttttataatatggtaagtacaatattattaaaccccctttatctacataatatatactctctccgtttcatcatttatataatgtgaaaaatgttaaaatgacttagattctatttgatccatagtttagaggcacattaactcttcaaccaaattctttaacttgagtgcatatagtaatgtagagaatattttttatcagtctgcaatcgacgtcgatatgtttatgttcatttttttcataatttttttaaactgttttttttcttgttttgctgtttttattatgtttagagtgtccgaccacttcttttctcggggcattgccaattcaagatcaaaatatcttccgcacatgttgaaaacatctctgctcgtattattgggttcagtgcattttctggcaagtcaggtgcttcacgcatgcgtggctggcgtgcatatctctctatacctgcacacaggaatatcaacatactcacgcggcacacatgtgcgtgtctcacgccaaagccatccattggtattctcgcgaattagacgtgacactgataatctgatctccagtaacaaaacgtacgttgatcggacactacacagtacacacacgtcgaccgactgattttgtaggcatttcgagagtcggtttccgatcccgggacttcttttggtttggattagttctacacaaatctgacgacatccgatccgatccccacaatgtttggattagagccaccattttctaatgtgtagttcttacgactaattcagccgaactgcccaaacgggtacgtacgtacttcacccccaagtcttcatatgtttctgcggtttcttcttgatgaagaccacacgacgctaatttcaaacggtttcccccaaaatttgcgatgccttttttcactagcgaaatgatgatgcgtgcaagcgatccacgtacaacctgtcacgaggaggcgagcagagcagaaaaagagaaagcgaactgctactccagcaaagccgatcacgtgaggtgttacaagtgggtggtctctgtatttccggaactgacttgaccgtcacgaagcacatcaatccgtggaggagtacaaacaaaagttgccgaatgccaagtcgaacacaggtcgagcacggcgcacacaaacacacgaacttccgtccgtactaaaatataaatatttttatactttaacatgatctcagagatactaatttaattaataatatatataaaagtaagatgttttaaataaaaaaagagttacacattatgatagattgtttaataataaatctaataacatcaattttatataattaattttttattaatagttaaaattgaaaacgtttaactcgccattatactatccagacgaaaactcaaaaactcccgtaaccgtaggatgatcagatggtcaacggcgatggcaaaggtcagcgtttggtttaccacgccttcgtccggcggtgggccggtggggcccacctggaagtctaattattactagaccgagaaataaacaacttgcttcacaagaacatcgtgggtgggaacgagcgaaagcaatcttaagcgccaagaaaaatacgcacaagagagaagagtaggcgcggttttgtggccggagagaaagccacgcgccggtttcgtgccggagtatcattttcgttttctttttttctccctttctttttttcgcattaacggacgtttcgtactaagctggtatacaacaaggagaccggctgggcgcctgggcctgtccaggtgaagtaaagggcaaagtcggtactaatcggtatagtcagcgtgcttcacatgcgacaactctgacccaaggtgaagtaaagagccaagtctttatgtacgacagtacgagcaaggactagtactagtagaagtgctatgctgaattttgctattgttaggaaacaattttttggtttatataattaaccaaactcatacaatcaaatgtgtatgcatgaaattgaaatgtaaccgttttttagaccaattttcttatattaattaatttattatagaggagaaatatttttttctttttttaagggaaggagcactattctttccgttcaagtaagtagtagtccagaccaaaaaagaaataaaaaaacaactggcgcaagtaaaacaggttcgggggcaaactagacatttctagacttctctaccaaggcatctccttctgtccttcatcaggggcaaaaccgccattaccattaccaacaaacgcaaagaagactcgggcgggcgccgccccagaacacaagtgagaaaaaaaaaaaaccgacctcctcgccgacgtgctcttcaagagaccgaccccccgccgcggcctcaacctatatattcatccccacctcctccgtcttccgctcccacttgatcccgatcgccatttctccacctgcacatctgcgcgcgcgcgcgggagagcagaggcggcgagagagatccgggtcgggaggggtgatggacttctccggcgacgtcaagccggcgatccaccggccctctgtcgcggcggcacgcgggggagggaacggtggggcgatcccgctcctgcgtgggtggcaggcgttccggaggagcggcgcgccggcgaggctcctctgcttcgagggcggcgcgtgggcggacgtcgcgggcgaggtggtggggctgctgcggcgggcgttcatggaggggaaggccgtttgcgaggccgcctgcggtgggagggtgttcctgttcgacttcatgcggatggttcggatcgatgaggccaccgccgaggaggccgcgctggggtggatcgacgaccgcggcgcgtgcttcttcccggctcccgagggcgggaggaagaggaagagggagagggacgaggcggggtcggaggtgaagggggaggatcggcggcggcggcagccggcggcggaggaggaggacggggacgaggcgtcgtccggcgtggaggagcggtccggggagagccgccccgaggcggatgagcccgacaggaagaaggcgcgcgggacgttgtgggggaaggcggtgaggctggacgaggcggacaagttctacaaggtggtggagaagctcttcgtcagccggatggctcccgtggcggcggcccgcggcgtggcgatcacggcggtgcacaaggtcgcgcaggggccccgggcaagagccttccatctgcagggacagctccttgccgctgctcgcggcgtcggcgatggcagcaacgccaagttcgcgtggtacggcgcgccggcggcggatgtggccgcggcggtggagcacggcttcgggaggacgaacgggcagtttctcggcgggcgcgcacacggcgacggcgttcacctttcgccgccgcagtaccctcacgctaggtgagtttcccaaatgctttcaactctttccatctgcaaatgctttgaactattggggagaacatttttagtaatttctgaaaattcaccaagtgcctcatatatttcatctttcgatattaccatacgaatcttgagtaaaattattttctgcctgccatcttggtgctaaacaatgaaactaccaatcgttgttttgcatctaagtttgaatttagagcaaattagacagtatggtacagtagctacctaaattgttataaattgggatgaaatttgtgagtcaatgttcaactaagttaacgagttaattaacttgtcttcgagcagtgcgatgctgaccaagccagacgagaatggcgaggcacacatcgtgctgtgccgcgtcctgatgggccgtccagaggccgtccctgccagctcaccccaattccaccccagcagcgacgaatacgacagcgccgtcgacaaccttgagaatccgcggtggtacgttgtatggagcacagacatgaacaccaggatcctcccagagtacgtggtcagcttcaggtggcccaacctgccgcagatggaaggttggtctctcgtgtctgaaatttgctggatggaactgttcccatttggcactgccataacagtgaaactgtggttttcaggatcatcggggttgggatcgaagctgaagaagccatcaccagcagctactcgcgacatgttccctatgcttctgacggagatccagcggttcgttccatccccgaagctgcagactttgcagaggacgtacaactgcttcaaggtaaactggtacttcttgctgagcatttcatttctagatagatgattgattagaatcttgcgctagcttacacaaaacaaccccttcgcgcttatgatcatgcctgtaagtcaaaatttaatataagagttgattttgtggtttttttagttgtttattttaccgcatgaacacgtataaaaaaggttttactatacctttttttggttaataaattgtttggataagtaaaagcgaaacaatgggctgaaacacaactgctgatctgctaggtgaatttaggccctgtttaattcagcttaggattattataatctggattattaggattaagctgaaacaaataagtagattattatgttagattattataatttataagccagattactataatataataatctcctctagaggagcttagattactataatctaataatctcctctagagaagctttttctagattattgagtagctaaagacccactacccttagatgcctctaataatccagagaaacaaacaactcgtagcttattttatgttagcttattataattcagcttagagtaatctgatttaataatttagattacaataatcttaagctgaaacaaacggggccttagtcttacatatagttgaacaattttgctctgcctggtttgtgttgtattcaggtctaactcttcactatacgcaataattagcacgtaaaaatgttgatttgtaccgcactgctatggttttaatatgatcatgccgactttattctgtagtaatatgctgccgactttattctgtagtagaacagaatcatctacctgtcaatattctgtgcaaagcgaattcagctcagcataacggcgttataactttaagcgaagctgaagtcctgaaaatccaatgacataaattttctttttgtttcagagaggacagatgaagaaggaccagttcatccggttcttgcgctcccacatcggcgacaatgtgttgaccaccgtggccaagaaactccgagggtactagtgcaaggtgcaaatttgtctccactccgtggctgaattcgactaactccgtagaatcgaacagtgcgtgtcgtgtaccaatcctgacagggtttattctcttctgatgctgctttagtttttccggtgctcaaatgtttattgtcatgaacatagagggggtttactgtgatcttccaattaaccaacacaaaagggtatatgtgatatgatgcaaattatgcaattcttgagttcggtcatagttttacttattttcagcaacttgtaatttgtacagactcgattctgttgagcttttgattcaggaaacaatcaattcagtttcgggagtttacggagctttgatgtaaaattgtattgttgtcttttccccgttttttcgactcgggaatcgggatcatgtggttagtttagcgcacgatctgcgtacgtgctctccttggtagtctcgtagatcgcggtcatagtgtgaaacgcctccgtgatccccgcacagattagccataatggctgcgttctttcaggggagatatgggagattgtctcttgtttttcgtacgcacatttttcaaactactaaacggtgcgtctttcgtaaaaattttctatagaaaaattactttaaaaaaccatattaatccattttttaaagtttaaaatagttaatactcaattaatcatgcgctaatgattcacctcattttacgtatctttccaatcttctttatttccttctcctcaaacaaatggtctgcagattgagcgtacactgttatctcacacgtgtcctgccacgcggcatacggatcgtgtttggtcggtaagcggcatcctcggcggccgcgtgaatcaatgatatgtttttaagcgttggaatcttctaaaaatgaaaatgaaataaagattactaaatattttatataaaacgagatggttataactgtaattaattaagttttaattattagaaatttaaaaaatagattaatcttatattccctccgtctctaaatatttaacgacgttaacttttttaaacatgtttgaccattcgtcttattcaaaaaatttaataattattaattattttcatatcatttggtttattgttaaatatatttgtatatatatatatagttttacatatttcataaaaaaaatttaaataagacgaacgattaaacatgttttaaaaagtcaacggcgtcaatatttcgggacggagggagtattttgggccgttttggattgaagacaaaacatgaccctttatccacgctcaatttggattgaagacaaacaattcgtagtgcccacgctcaatttagctacattctagaatcttttttactctcatactaaattttgactttatattggtattaaaccaaacataaactagctaactttgtcctaccaaaaaattgatagtgccaaaatttgcctagattttggcactaccaattaattggtagggtagagaaccaaataggccctttataataactttcatatagaaagttttcgcacgaaacgtatcgtttagcagtttgaaaagcgtgccactttcaactaatacctctattttagtttataagattttctagcattgcccatgttagattcattaaatctatataaacgtgggtaatgctagaaagttttataacctgaaacggaggaagtaaaactttatccacttttcgttgaagaaaataacaggcacaatgaactctgcctgcagcaaaccgatgacaatgacaaacgtcgtgtgcatgcttcgttcgcgtggttgtctactttgagtccatctacctgtcccgctgtccatggcaaccaagcaaggaaggattaatttcgtcgatctgacggtgccacagcccacagaacaaaagagagaacgatgcaacgccggcggcatccgtgaactcttggagcagatgtactgtgtacaacggcgatcgcagcgtctcctccagcggcggcagtcggcctccggccatcagcacccgctcaccagtcaccatagcgtaggagaggtaaccaccgccgcgccccgttagttttaccttctctgcccaccgccgcctaaatcttcttcgctcgagggggcaaggggatccatcgtccaacgaatccatccgcgaggccggccggagaagcggaaacctgtcagcgagaggacagctcaacagccggccatctacatctaccattctaattttgagaaaacatttttcagggcttgatccgaaacactggggatctaagtgcatttttcagggcttgatccgaaacactggggatctaagtgcaaagctatactccctccgtcccaaaataaatacagttgtgggtttcatgtccaacatttgacacatccatcttatttgaaaaaaaatatgattagtacttttattagtgttatatgataaaacatgaataatactttatgtgtgactattttattttaatttttcataaattttttaaataagacggacggttaaacgttgaacccggaaacccacaagttcatttattttgagacggatgtagtgtaatatatggggatctaatggcaacaatgctacacgtcaggcgccggttgctttcaaaaatatcgaacggtcacatactcggtacacaatatatgcttctttccctctttgtgcatgcacgtaggagtaagtataacgcgagctttaaaattatttttttcataaaactatttatctgatctatgatttgattatatttttgtgttctttataataacatcgcacatgattatattctgataaactcttaatttgatgtttggtgcattagagtaaatgtttcaattggtaattgaatttgttgcacatatttaagtttttacgttgcattagagtaaatctttcgccgccgcagtacccttatgctaaaccaatgcgaacaactaaacacctacacatgtatcctcttgtctagactaaacagtctttgtgcatccaaccaaacaaaatcttcatatagtatcttttgtgaaattaatcaaacaaaatcttatagtagctaggctaaaccaatacgaacaaccaaatgcatgcacgtgtatccagcggcggagatagctcccgggcaggtcgggcggtctcctgggctccaccgctgccgtttcaattgccgtagcagtcggtcactaacaaacgttactaatcgcctaggctttacgcggtgttggctccgtcactgcgtgtatcttttgtccggtctaaacccaacctagatgagagaaatgggctagactagaaggatataagcaaccaaacacattctaaatcggtgcgaagtactggtaatactgtagtagggaccatagtgcaaatatgatcctatttagatgggccgcatactgcactgacactggataacaagtgtgggcttttacatggtccacaattcgccaggacgtacgggatttactgcagcgctctgcaccctcaccccgtctgtccacggacgactaatctgagcgagatcaaatcctctgcagctcagttaatttatctaaccaccacccaaaaccgatccacacaaaagcaaaaaaacccatgctacttgtcacgttgccgtctcatctcaccaccagcatcaacacaaaaaattactcctactacttcacctgaccaccaacagggtcactgtcgcgtttgctcgatactagcaatcctcccccgttgtcgccgccccaccaccactcacctgaatctatggtcatgtgtggcctaacccaaacccgtctcttcctgcaagcagctaccgacaacgatggcttcaacggcgacgcactgaatcgagacggccgtgcgtgtgcgcgcatagtttttttttttttttttttgtcgttccatcggttggcgtccgcagaacacgtttcccaaatcttgtactactacgtactactccatcgacgctcgccaatgcgaaaaaagattgcaatttgagtagcagcacggctgtggacagcagcggatgtgaggcgggtaggcacggaggaaaatggcagtcgacctcgtcgcctacaaatacccgctcgctctcttcctcctccccttccttccactcgtctcgccattaacaagaattctttttttccttcccccaaatccttctcgagcaacagctaggggggagtggttcgcttcgtaagaagccggctacctctgctcgatcccgcctttgcctgcggattcccaccctgattttcgccgtttgtttgtttagtttcttggggcaaattcgagacgaggggaggagagtttttttgggggggagttgttgcggccttgcgggcggggtatgcggctgcacggggaggtttccttcgatgaggacgaggaggaagtggtgatggttccggcggcggcgctgtcgtcgtcgccgctcaacggcggggccgttccggtgacgaggctcgtggtggggtacgccctcaccaagaagaaggtgaagagcttccttcagcccaatctgctgttgctggcgaggtaaaaacctggatcaacgctcaaagagatgaacctgctgattcgtggccgtggtggaggattttgggagacaatagagtatttttgttggatttcttgttgatcgagtggcaacgaaatttttttcactaaaaccagaattttttgctgttggagggaaatggtaaatgatttgaggggggaatgcatggtttatgagatacagttttgcattttgagtctttgattaaatgctgtaattggttctatttctgaagcccagaggatttttgcgagaacaggtaaaaaacttggtagttccataacaaaatggggggtgggaatggaatgcaattctattccttgtagcactaatcaagtagtgatcgaatcgaacctctactggagtataaagttagcaggggcggctagtgatagtggattctgggcgaagcttgctgcatttgcgatatattgtaaactgaagaatatggctagtgtttattaggaattctggtagcatttgtagatgcccccttacgtgcgtctcatgttgacagttccactgcatgcgggggtctctatagtctataattgtatattatcatgccaacttgtcaaaaatgggtcttagcatgcaaatctttgctacttggtgtctgggattctagtttggaatattcccataatcccatggataagcacatcacatggattacgacagctttagtgatggcaatgccttttctgggatcgtttacaatttagtgactgacttgctaggtttgatggcaacatggaccgctgacaaacgatctttgtgattgtcttgttagctccctgaatcaagatccaagctgactagctgagtcaatcatttgctagttgctcggtaggctgcagacataagcaacacaagctgaaatatagaagggaaatgaaattaatatatgaaatacttatgcaaaatcaaaatgtttttgcttaaaactatttgtgtattgcatgcctagtttgtgcttttgtttcgatagatttattgtttagttattccaagaaaataaaggaaacaatatatatttatgcaaaatccaactatattcattcaaacaacctgcatattctctaaacgcttttttatatccctgtagtagtcttattttcaaagtataattgagaaatactctgttgcaaggcagtttaacttttttttatcattcttatttatactatcgatagagtataaatgtagcccaaacgacatgttatacatggagagatgatgatgtactaaaaaaattcttgattctgtgagggcttggacttggtcaagatggctattgtacttccatatggatgttaggatccatttctgtttcttgccattcttcttgtataacactatttcatgatgtttcattatgtactgtgtcaggaagaagggaattaatcttgtagcaattgatgacactcgcccgcttgcagaacaaggcccatttgatgttatcttgcacaaggttagtcgtgacctttttaaagctggactaaaatagtgctgcccattggccctgtatgatgcattttgttaaagaataacatcatctatttatgagctttagttataattaatgttttctgataattatgtcattgtaatttggtaaagtatatgcatattttattgaagaaatttctttgtgcagattactagcaaggaatggcaacaggttctggaggtaagatctgagtacgtatgcagaaatctgatgatgcacagtaaatgaccataccatcgttgccttttttctacttgttcactgcctcatcatggggaaatatgttatcaactgaggaaatgagcagtagatgtttgtcactgtatgtaatgattatatatccaaactatttgattgcagtgccctattgtaaagctcaacataaatccataattcttggaatttgctgttggcttctaatctgtgttgcccatttattgaaactctctgttaacctaactcctttcactttcctgaaggattatcatgaggaacatccagaggttactgtccttgacccaccaaatgccatcaatcatctgaataatcggcaatctatgcttgcagaagtatctgatttgaacttatccagtttctatggtaatcatgaagcttaacatgtatatttatatgctataaaatggattcgttattttactttccatttctaatgtttataatgttagttagtgtctgtttaattatcgaatatattcacatgtcagg

SEQ ID NO: 56886 - DNA, 2029 bp, Oryza sativa
tcctcatatctcaggtgagacatctgcagtattgtagttaatcttcattttggttattattgatccatgcttcattaatgtaagagggggcactaaattcaaacacaaactttctttagaaccttaacgcagtgtacatggtaaagagtttttatgtttccttaccatatatcaagtcgaggacagcgtttgttctatgacatcgatacttcttgatttattttgcttttgatgagtagtcgacggcaccagataaacttttgctatatattgatcagaactttctgttacatgatagaacttcctccaagaccactcctagagaaactgggaaaagagcttcgtggaagactggtatggccatgtatttatattaaccaagctctgtttcatatggtcgtcatctgacaggcttaaaaatttcagggtttaagattgttcaacatagatatgatcagagaacttggaaccaaagatcggtactatataattgacatcaactacttcccaggtgtgcagttattttcccactgccttcataaatggcatactatcatttgcgtttcttttcttctcttcatatgttcgtgcagaatttgttaggcctgattttattccagcctaaggggaaaggaggatacatcgctacacatacctggacttctaggccaaattaatactgatccagtttatccagtagtactttgtcgtctcgaatttctgtgttcttgttatttaacacagcatgatcattgttctgcagcagcattttcttgagtgtacgctcactccctcttgcttgcgcagggtcgggaaaatgccaggttatgagcacatattcaccgatttcttgctgaatcttgcgcaaagcaagtacaagaagtgcttaagcggcggctgaagtgcaaagagtcctgctgaacattaacaaaatggaatgtaacggtctagcagtcagtgtacatatctcggagaaataagtttaatcccaaggctttgaggaagagagatttagggtgtcttcccagaaaatggtggcacttaccggattagagaagagatgaaaaaatggatcgattttctaatgccgagtgcttgtataaatcactaacactgaatgttcccagcgtgccttcgtcaaggcttctgtctcaataatttcattatctttttcatgagcaatccttttagaatgcttggttctctctggaaactgcaatgtggtgctgtcaactgtggcttctgtctccataattacagtgcttgtttctccctggaaactgcaatgtagtgctgattctccgctgagtgctgattgcctgatcattaaatagtctgcgatgtatggaggatgtcattatcaaactgttcttgtgaagatattgagatgatggaacgaagtagacactagcattcataccgtcgtttatttgtttagccgtttctagttatttatatatttattttcgctaacgctgtattttgtttggcatgtttgctaataaacgcaggcagtgacaatacttattcctcttcctgcaaccctgtttccggagcccatcggaaactttcttcttgtatctgatgttagcccagaagactagagacaataggagcccaagagagcgtgaagcctcaactagcgtaaaacggcgaggattctgcggaggaataaatccactttgactctcttaatttaaggtaaaatctgatatgtatccctaccagatatcttaaccccttaatactattaaaactgtgaaatttaactttgtcgacggttttcgctaacatgtcacattggcatagttcaatagattaagttagcatgtgagacccacctatcagtgattcttctctttctcttcctttccttacctctcctctcaaatgtagtattttctctcggcagtagggtagcagcagagacaatggcgggccaatccttcaggcgctcggctgtgagcctgtgacgagccccccaccacctcggcagcttggacagcggagccatgccaccgtagctata

SEQ ID NO: 56887 - DNA, 24097 bp, Oryza sativa
cagcagcgggccagcggcggggggagcacggggtgggagggtgtcgctgatggcactgctggagcaggcgaaacggcaatgggtgacggtggccggggatgccaatcggaggcacgtcgtggaggaccacgcgatagcggcgatggcggaggaggaatggatgaacaagggcgtcctcgccgccgatgaggtggccgcagcagaggccgggcccgaggatgtagagcagagggagggcagcttgcacggaggatgtggtagcgttgtgcccgtggtggcgcggctgggtggacatggaggcgtgaagaggaaagaggagaagaaaggagaggaagagggactctgacatgtaggtctgtctcagtcagttggactagtaacgagccacgtcagcaaaaactggtctaaaaaccatcaagagagttaaattgtacggttttaataagctagagggtgaaaatgtatggtattacggttgagagatacgaatcatattagacctaaaattgagggagtcagagtagacttcttttgcggaaaaccggtgccattcgtcccgctaatccgccaaggatcgcgcggtggaatcgccgacgccgcgccgctgtttacgtaccaatcacccggtgccgctcagagcaggtacaatagcaggctattagccagctataaacatattttaatgggataaatgataatagagaagagcagcgggctacaaatctgtagccagctgcagtacagactccaaaacacactatgtgtataataggtgggaccatatatgaataatatagtaagcagctattatataaattggctattagattaactatagatgaattggagactgtactattagacttgctctcacgcacccgcgccccatggcccaaagccccaaacaccgaaacacgggctcgtcgcggtgttgaacgcgtccccgcgccgtgagtttgtgaccgcgtgccgccttctctcccgcctgggccggcacgcccgatacggtagcacgcgggcccggaagcgtttctccatcggcttctcacttctggcccaggccgtgttgccgtgttggttcataggttctactcctacttctgtctaactaatccccttcatcagcgacaggctccgtctccacccaccacacacatcaaggctgctgctgctgcctgccgctgctgatgcatccaaccacgcgcgatttgactccccaaccgagcagtgaaacaaccggggaggggaggacatgttcggtcgatcgccgtcacagcccattagcgaccagtgtttaggtacgcatagcccagtagacaagcacatatgcatgatgcatgcaacttaacccttctcttcctctcctccttacgtctgatctatctatctatctatcattagttggtgcctgctcacgcatctcacatcctccatcgatcgattgttttcatctttttttttctttgcccccatgtccctgtctcctaatcctgttcacccagctcggccgacacggcttaaacaaaaacgcatgacctaccctgacctgacatgccaacattatccaggaacccccaacacaaagccggtcactacctgtgcaaaaaagctaacgcatcgtcctgccgtgccgtgcatgcgtgcgtcacccggcacggcaagattaatttacataaaccccaacttaacagagagctctctgcctgccgctagctacgaacttgcgccattgtgccttatcccgtctccctccaaaaggccggaattttcaatcgtgccgccgctcaagtcgccggccggcgacgcgtggatcacccgccggcatatattcgacgtatccacggccaccttagtttaacgatctgatcttttccggttattgtcatttagctcgctgctaaagttaagataagaaaaagtaagcaatttttttctttcttacaaaaccatactttttgatggcattagtatagtaaaatccacatcctataaacctatgaaagttcatccctacaaagtgtagttaataccacttctcttttctttcataagccacatcatctcaattgcttctaaccttggatgttgtatatatggttcaaattatcttactccttttcttctcttaattataaagtcatatcaccttaattttgtatttgaatgatcaaattatattattttttcttttcctcccctcattaaatcacatcatcttagttttttttaaactatcaaccatatttgatttaagttgttgtaaaccacatcatcaaatggtttatatatagctcctttttttttgcatagttgatcatagatgaaaattatataaagtgtagctattttatatgttagttttacatgttatttctactaatattatacaaaactcccacaacaatgcatggagtttcatatagtttataatttgtttcaagaaacccgggtgttgagacaaaaatgcttcatatataagaccccaaatttatacaaagtattttataccccattgtattacacggagtattttttttaatagagtaaattttaaaaaatcacattttctatggtcaaagttaaagaaaccacatgcatgcattatgacttgtggcaccaaccatagattttatgatctaagtgcttctaaaaccccacacttattcaaatcgtaactagttttatcaaatatttttttaaagtagtgaagagttaaatcaataaccttagtcattagtcaaggaatcaataactacaaatttaatatagactattttaaaaatcgaagtaaatgtgtgctcaaacatgtaaagggtagggtttgtggaactttagaaccataaaaaccgagattatgtgccattagtaataatatcaggtgttttatgcaactttagccataaaacatggtatttactaaaatgtactctttttaagaaatacctgtggcttgaaataaacattttcaccgtctagtatctttccttctcactctcccatacaagaaggcaaagacaacaatataaactgcagttgcaatgacacattaatcggttacatgttgctagctagcaaccatgtttatggagaaagtggtcagtttatatttgtacttaaaagaaaacgatctgctattttgtacaagtatgtttgtctctataagtaaatactatagccaaatatatgatatagacacaaatatggtatttcatgaaacctctacgccgtaataaaaaggaaaaatctggggtttataaaaacatgtcgtaaaacctcaaattcactttttataaaaaaaaagggacatcgttatctctacctacgccttacagtgcatcatgatagcgccggagtctttctgctatcaccatggataggccgcgattcatcctctgaccttctcctcatctcctcctttttgcctttccttttgtctgctagatcatggcgccgctcggcgatggcgtttgtgcgtgacgcacacacgcacgcgcttaatttgccggtgtgtggtttttccgactcgtgcttgaaggttaagtaaggtgtattgtgttggtctatttggactaatctgcaggaccaaatctgcaactgcaaatgataggttctgactactactagctggtagtgtgagagaattcgtgtacgaccaagtagtataaattattcaggaatcaggacattcagagctggttttgttttttgatcagtcggaaatggactacatattaaacaagaagcaaatgattaataccgatgattggtggtttttgattagtattgccgactaatcattatcgtccctggatattttgatctgtccttgtaaaagtacacgattttcaggctgacaggagcacactgggaaattctgtagcttctgttgtgctgacacgtacacaggcaacatcccaacttgcaatttcaataggcagatattgttcggtggacttcgattttttcaaatgggttaaacattgagaactcccagttgcaccttggctggatatggaagcaggtaaaatcatgatctgacctcaagctcttttgctgccatgtctcttctgttctccaatcagtttgttcttgcataagcacatatgtcaattcgatgtgtagtgacttattacctagtccattctgttcttgtgatcacactgtgatcgaacacttgttttcaggaaaaactcaaaaagatatgctttgacaaaattatctccggtctagatcacttattctatcttgcaaccccccactttgtttttctttgttcacacattacgcaatcaacccggggcttatgctaatcactgaacaataacctttgctacttcacctaatgatgtccacctcataataacgagtcaaacgaatagccctttctaaagaggcactggaggcttgctaatggcgatatgcacatcacattttgacttgtagaaacatggctccatacctaaaatatattatgagatcttgtgcttggcttatgctctgttgctttgcgtctattgtttattggccaatcgcttctgacctaactattaagtccaaacaaacagaagagcgttatccgtaatgcctttctgaaggccatatggtgcatttatatattatcagcactttgcatgaccaaatgattagcctattcttttgttaatgctctaatggaagagtggtttgtcttagcctcaaacaggccaattcaaccagacagaaagcaaacaaaaagatatggacgtgatctcaggttgttattatcaatcatttgcttgtttacttcctacaagacaccaagaatctctgaggaagaaaaataatgtgcaggttaatcgtacttaggacctgttctgctgaaaaagataaattcagaaacgaagtatgaactgctgcaaaatgaactgaatatattgctttctacagagtccacaaacgtattttcaggatttttctcggaggatatttcagtacctttctcatgatacgtcagaaatcagaatttctttctgctcatcatgatgtctgaagttattcatcagcataggattccacatggcccttggctgcattttcggcagcattgcaagtaatctaagccacttttggcacatggaaaatctatccccttgccttatcacatagaatcccctcttgagctgggaagaatttggcgaattagttcccgcacaagagtagatttccaaaggtctcaagagatagatgattcacctttgtgttaacaacacatttctcttgctggaaattaccataggccagatttctatttgcttgagaaatcaagtagtcggcaaacaaacttgcaagttgcatcttgtatagagctagataagaaccgcacacagaaacttggttagatcatgatcgaaagtacgtagaaaaatacgaatgagtgcaaaagtagtgatctatacgttttagatggtaatttaagaacaaaaggattagttaaacaaatgatgataaaggatggtagatcggcctgctatatcatgaaaaaggacaagttgagcaacattaccaagcatagagatattcagatatataatgaacttggttaacaaaggcagattagttgagcagctcgatcagctgacccaatcatgagaacagacaaaggaaacgcaacaatacgtggaagtgttagaaatatttgtcatgactcatgagtccgcctatgtgcaattataatcaagaatcgtttcaggctcagtttgaaatagattatatatttgaccggattgttgctgcggttatctacttgaatcataggaataaatagaatattttgataaataaacttaaaaaatcaagtggccttatagtaaaagaaagtttcttgagaaaatatatttttcaaagcattgagcaaataatccattttaacaacccggtaaataatatgaaaagaataagccttaggcatctttgacgcagcacccggcttatctattttttttagagaaattttacagttcttaatagatactaaaatttttaatggaaattttccgtacctccaagtactactaaattttacgctagaaaatatagatcccagtatttgctcaaggactgtaaaatcactcattatatatcttaaaattaatttaaaattgagaagtcagttttaggataatacagaggaatatacatcgaaatttgagcaaaaattactcgaacctagttatgtggcatcctacaagttggcaactactattacagttggatcttgtgcattgcacataaatctctcttgacaaagaaagaacttatgaatatgattggtatgcaattgcttgaagaattctggtgaacacacttataaagtattccttttctacttgatctagaagagaatatattggtgaggtcatggttcatgccggcaccggcaataatttgagctactagtccaagatccccacaagatagccctagcagttgcactccaggctccagcacacttatgtaaaccataatgtcggtcttatggattgcagagtttaacagttctatttgtaaaacatatcaggaaaaaaaaggaaattcaaggagaaaaaaaaagaacaagctttaactgtgtatgtttcaccagctttagggcttctctaaaatgaagaaattatttatttaaaaattgcaggattttgtttagtttctaagaaaaaaaactctgaaactgctctattccaaaagaggccttaatgtttctattagcgcgactaaaagaactgaaatttcattccaaaattttacaccttggtgtcatatatttgttccatccatgtggttttggatggatttgcatgcatgctgacgctacagagagggataaaaacgatataaagcaatatcatatctagtcagttaggaatttttcatattcataatttaactatttattagcgacatcagtactatgatactacagatattagaaaaaaaaatatcaattttatatggctagaataaaaaaaagataccactattgtagaaatgattctcagtaggttggaaatttccgtgacggttttcatttctctacagcacgatctaagagatgagaactattggagaaaaaaaaagtgatacggtggtttgggtcgcagtcgtgattcctgaagagagtacaaggtggaaaaagcatggccatgacagattgttctggcatggtgaattggtgtggtgataaggttgtgattcaaagggcacgtgaagattggaacccttgtcccctatagcttcctagtagtagcaggcacagagagaggatggtgagactggggtctgccacttgtaggaacagcaattttggcccaaacaaaaacttgtgccccagcatttgcaaacattggtgataactattacaaggtggcgatgattggatgttgacccagaaggaattgcacaaacatgaagatgtgttcatgacgcaaactctccttgttttccctcactaaggctgcgttcgtttgtgtgatatagggtgagaaagcacatcgttttctgtgcgcacgcttcccaaactactaaacggtgtgttttttgcaaaaatttcttatagtaaagttgctttaaaaagtcatattaattcatttttaaaatttaaaatatttaatactcaattaatcatgtgctaatgactcatctcgttttacgtatctttccaatctcctcaatctccttctcctcgaacacaccctaagtagcactacgaactgccccctaaactgttgcttgtagtaccttaattagctgatgacttctcactttctcttcctcatattgattttcaatataatccatcggaaagaacaggttgattgctattgttttcccttgttatcatcgacctttgcatcttgaacttgcacagctggttattagtagttggatgggcatgctctagaaaagttaaaaaaaaatgttaatgatcactatcatgggtcacctaatgatattgcaaggatgaaactcaccaaagtaactgagtgtatctttattgcttcctttttgatgagtgaaggataaaaggagagcaaaagtagaacttttttttcataaatcaatggaaaaattcatgaagtgagtcagaagcaattccatgttctctcccgcaccaacgaatgtcaactattgtgaggtaagtgatgaggatgagcacaaaggcaaattctacaagacctcttccacttatgacaggtctgacttactctctatgttctttttttacttgtttagaacatcgacacaatattaaatgaagatattctatcattatttctttaatcatatatctgtgcgaataattaaaattacaaccatattataatacctttaatgataaatctgttaatattattttaattttatatatccccttattcttcgcacccacatgttagtggattaaaattccgaggttttaccgcactcattctttaaaaaagatgttttcatttgtcccttaatttgaatatatagttacaaggatatattacaaatgacaaaccacaaccaatacatgtctaattttgtagatgaaaggtgagaatcatggtttaatttttgtctggtatcacggttcagaaccttagtatagttgcactaattatgtatgcactaaactaaactttctcattaggtcccatgagtcatctcatggcaattgacttgaaggaaaaagagaacaaaaaaagggggggatccattaattcagaccctgtgagccaatgcacagacaatccgatgtgcgcactcgacaatcgcacggcgattatcatcgtcaccatcggttcccaaagcggatcaaatgcgcccccacctccaggattgcaaatcatttgtgggcgccaccctatctggtgtccatccaacgtgtcaccacactaacccgacaagtcagcggtcggcaccatctcttgctccatccggcagtttctgttatcttcttataattttcctcctttttcttgtgtgcccttcctttttttttatttgttttctctcttttccatacatgaatgaatagatggatctggtgtcactgtttgctgatagcaacatctaactatgatgtgctcaaggaaaatatactactacagttgctggcttgctgcaggtacttggtgtacgtatttgtaatttcctgcagttgtcccatgggctagaaatgtgatgtatttggctagccgtgccaatgattagcaggttgactgttgtatatttaattagtaaggaacttgttttgctctaataattaattataacagaagataatgtacagggattttacatatttgttttgaaaaattcacaagatctttttagagcatatggatacggttgtatgtgatccggttgttattatagaataggattaatttctgtttctatctatttgggagtgcttaaaatcaggccatataatctttttttacgctagtccccctaaacgcaatacaagtgatccataagttttcatgttattagagtggacgatctagcatctctcctacggttccgccgttgttgccctaggagtagtgatcacccagggcagcccttatcttatttttgttttgttttcattgttgttttcacatcgtcagtcatcacccatgagagattgatctcgcgggcgtttaatttctttgtcatcgtcttcacatcatcaagcagcacaagaagttccctttcatcatcgccttaggattcagcgttgatccaacaccggtacgtataggacttcctcaccgacacgttacagctccgtcgttgccaatcgtgctcaagaaggagccctcaaaaccatcgcgccatcaatctcgcaaattttggaggtcgaacccaccgatcctagcgcctccagcaccatgctgccaggaacgatctaccttggccggtctcatcctctgcttcaactccagcactgcccgagcccctaccgtgtaataaaaaaaatgtaacatttcaattgggctgaagaaagtgagaaaacagacaaaatggaagtgaatctcaagccttagctaattacaacttctgcaagtaatcgtggacatttaaattagtaagatttttccaagaaaaaaaaaatctggttttgtaaatcttttgtggaattcaactttctagaggccaaaaatattagaactttatttacttttgtactttatttcctcaactatcacattttgtaccatgacttgttttcttttgttactttcttaatgtttgttaaaaaaaacataatctcttatattatgggacaagagaaagtaggttgatactttagaaacctttttaattaatttttcacaagatagaatataatacttaattacttatctagcttggcgccaactatatctctactattataaaaattaaacatgtttttgccagtattttggtacgtcatccgtatatgagtcagtttttaagtttgtttgcttttgaaaatacgtatccgtatttgagtcggtttttaatatcgttcacttttgataatgcagaaggaatcatataagaaatccgtttaaaaaaacttgcatgctaatttgagacgatcggactcctaattgcagctcatgattttctaaaaatatatatattcaaacgaactcccactgtaaatttcatattaactaaaccatataacaataataagattaaaatagacttcacccgttgcaacacatgggtattttttctaatattaaaaaatgtaatttattccctcaaaattttgtcttttatgcttcttctaaatgaagttgagtttggactaaagatttagtgggaatgcattccatgcctataccaatctttaatatatgtttttcataaattcagagaacatttaagggtggttttcactggatattattttccgtttcatatatgactgtattgtataactataatatttttggcatcatcctctagataataatgtttttggcactcatcatccagataaaagagtgtagtctcacttctactgtagtttttgggttttccacggtaaatcacgttggattatttacaggatcagctgctgacagtgtggtgctcagggcttgtctacatcagaccacgggcaatgctgctgacatagggaaccacaacggctggatgcgatgctgacgtggaaccaaggagatgctgccacgtgtgagtgtgaaacgttaggctcgcgcgcttttttaaccgctttcgtttgcaggagggccggtttgttattcgctaatcatatcattagatatgctgcttttgtccgcacgatggcttccaaagtcaatacatatctctatggtttggattgggcagctagatctccccgtgataatgattacgaaaaaaacaaggcgagtgatcagagttgatgattaattaaggataatcacgagcgaaactacctgttcatgatctttgttaattctgcatattgccatggcctccgtgcacgggttcttatttaatattttttttaataatggaattgaaactagtcaccacacatcaaagatttgatgtgtgtgtatctgacctgcacttttatttgttaattatattacagctagtttttttttcaggggcgcaaaattgctaactaatcaaaacaacttaaccccaggagatgaggatacgtgcacggatgacgatgatatccagccgaattatacaattcttttttcgaaaaggacgaattatacaattcgacgaccaataattcatctatgtacggcgtgtcttgatagggctaatgatttggcgattgtagtaattatacataacacttcaaacttaaaatataattttctgtctttttcttccattgaaaattagactgcaggtatgtgcctcgctttgtaaattgagaaattcagtggtgaggtgcgagacgaatgggcatttgtctagagcaattaatcatctcttcggttgtaattgtcgttgttgcacgcctacttcaataacgacactgaagaatctccaaaagatttgataagattttctttacttgtgggaagaatatagaaaggtaaaaggtaagaagaaattttaccaaatggaatggtaacgaattcttaaaattaccaagacgcgcgtacacatgtggcacatccagaccaaacctaacttggttaactttaacttttaactttttagtggaatgctttttttttgtaactatatattcagatttacaaaatgaaattcctgcaatttcataccgctaatctggtccatacttaccgttagatacttagttaagtaagtttgattaggaaaaagctttagagttctttttcggtttggttagtattgtacatcatttatttacgagttccactagcaatagaaaaggatatttcactgccaataaataattgaggtgatagtataataaatagatataatccactagagaagaaaacgataaaaaaaaataacgtttggactgattgtagatttgtagtacaagtagggagtagggactagtgcaaaaattgatcaaaagtataaccttaatagtaaaaagcaggggtaattaaaattgatataattggaagtaaagcagtattcgtaattaaaataacaatttaagaatgatgaagatatatacttcgtagtaatgagtacaccctccattttatattataagtcattttgatatttttttatagtaaaatatttttaggtttaatcaagtttataaaaaagttttagcaacattgacaacactaattagtttaatagaatgtgtggcgaatatattttgataatatgtttattttatattagagatatatattactatatttttctataaatttgatcagacttagaaaattaaatagaaaaagaaaaattaaaacggacctataataagaaactggggaagtatatagtaatatgcgagttaatatgtactgttgctcccaactaaactgccgtacagacacgacaacgtttgaaaggtgcaaggtggtatagtttaatatctgtgtcaactgatctctatggaaaagcgcaagcagtatatatgcatgttaatgttcaaaaaaaagtatatatgcatgtttttagtgtgatcaaacgtacgacttccttagtgagaaggtacaagagaagttgcacatagccttttcatgagtcttaaagtttgtacacatctttgtaatggtcatcgaagaagttctatatatttttaattttccaacatgattaagcctcgctgttgccaataattaaatcgtcggtacgctcattgtcctttccttttttttcaccagcacgaaaaaaaatacacatacataaatatattgaaaggaaaagagttttaatacacaacacaatcggtcaggcttatgtcccggaaggaagaaaaaacaaaaacttcaagcttggtgaaggaactaccgcgggaaaattctactgcgatcgtcagtacgctcatcgtcctttctcgcatgtagtttgggatttgacaaataactacaatacgtacgaccggtatacgtgtaaaaaaaattacggaaaaaagcacatgcacacaccaatatatacatgttaaacataatcgtgtgaataagcgcgccttgtcaaattacgagaagaccaacgataaatctcaacctcactaattaagatcctgtgttaaaagcccactggttatattcatgatcatgtgtatcagaatttaaacaaagcgatgaagtcacatacatgcccatgactctaccatcatattttggcgctttcacacatcagctttattgtttgcttttctgtttatcaaacgcaaccaaaatttaaattttaagaattaattttggagatgattttgatgtttttcgttcattgtaatttattttatagctttagcttataaatcactagaatacacatacatataaattattcttttatcattaatcaataatcgttatgacttatactcagctatttaggtgagatgatgggactaatagtatagtttggttagaccgggttggttggaagctggccatgaggcatctgatggtgatcatataattacgcccattctggccattgaaagaagccccccatttcatggtacaaagtacacagtactgtgacaatacatatctcatcatgcaccatctccatggctcagcggctctctcgagatagattggccacatcaacacacaaacacactattgcgaaaagttaggggagcaaggccaaaagggctaagctagtgcccaaagcagcctcaaatcccctactggttgcaatgtcatccgtgcaatatgtgttaggccccacatcatcttgtttttccctcgtgagcgagacaccgggggccacggtgcatttagccacagccccatttgcctccattagagcaagtttaatagtatagccaactactagctccaaattatctataaccaattcatataatagttgcttgctatactattaatatctgatcccacctgtcatacacacattacgtcttggagtccgtgctgcagctggctacaaatctatagcacactgctcttctctttcttctattatatctaaaatatatttatagctagcttatagccttgctattgtagctgctcttagttggagcgtccttctctcttgccaatgcaatataatgccatccatctctctcttggtgtcaaattaaagcgaatcagggctcagtgcatgcatgctagcggcaaatattgggagatcttccaaacgcactcatgcatgcatgcatgccaacaacgacgacaccactactgcatgcagctactagtaaaaatgggcgaagggcacggagaatctgattgatcgatacggtgtacgcgtcgctcgatcatctaaccattcgtagtgcagttatgcacgctagatatatatatactctcttgcttaattcctcccttcattcatttatctttttttttctaaaaaaaactccttacattccctaagggattatttggttgcctaacatcttggatgtcgagccatccatataaggggtttgttttggggagcttccagtagctacaacttctcacaaaatctccatctctcctaaacaattcaaattgtcatccagattctaagaatctgtagtcgtagaatccagaaaatgaactagaacccagaaactagaaaatccaacttctccaaattctcagaagctggctaccaaacagtagattctcagaatcttaagctcccgtaatcaggggcaagggttagtctggctaagaggttgactcagcttggatatatatgaggttgatatctggaatgcaacatgggattgttgtatgtgggaatcttctttgtttagttgtataaaactggttgttgttacctcttgcatctcaaaatttgtcaattctaaatttctcaaagattagttgatttaaactaaattcaattgttaaataattcatacaaaagtacagttggcaaataattcatcacacgctgtcacatggtaaaattaagttttatataatggcaattaggggttgtaaaaaaagaagaaaagaaagaaaataatgttcctctcacactcctctccgccgctcatcgttgcgctatttctcacccactggctactcccccacccattctggtcctttagccccaccgcttgccacttctttgacctctctggctactgttcgttgctcacacttctcgtccccgtcgctcgaaccaaccttgacgggcaaagccactagatccaacaaccacgagttgaagcctgccagatataacagcttcatggctcgtggacagtggagccggcggtcctgtggttaattatgaggggtttggctattggaggcagctagtgtcacctagagctcgtcacctcgatctgtagtgtccaaatatgcttccttcatcgagtttattgtcgaatttggcacctgcacccttgtgcccgcccggtccaactgagaacatgagaaaaaaagctcaacgacaatgagaataggaaaggagaggagaggaggtagagatccgatgaaagaagtagtggtggcatccctcgagcttggtcaagacccttaccgttccatgaggtgaatgggaaagaggaaggtgagtagacttgcaccccctgcctacaactgcccatgaactagctagctagtacccaagctcggccggactgagaagcaaagctcgaattttgtggtcctctttagcctaggttgatagtccgttcacccgtgggtgtaggctctcgtccagtacgtacacctactcaaccaaacatgcttcttcttacttccacaaattgagccaaccaaccaaacacggtatgatataattaccagttcttactttaccaataaatcaggttttgaccaacgataatttatcgaacaaaagtgtctagttaattatgtagaattaatgtggtatgatctttgatttttttatatccgtttaaccatttattatgacttggtttattgctaaaggttggcctattttcttgatatatataatattttttgatatatataagtatcatttattttattgtgacttgatttattgctaaaggttggcctattttctatgaaaaaaggttaaaaaaagaatagtcaaacgtatcttaaaaaataatgacatattttaaaagaaaattaatatatagacgcgtgtctcttttttataattagaaaaaaaatgttaaaccagcaaccgtaaatagtactccttctcctgctcctctccagcatataattgaagcagcagaagtcgcgccataattaattctgctagctaggtcagctagctaattaacaaggacgatcgcggcgaccgggaatgagatggacggagacacggatgtgaactccaagcccgccattaaaaaagttgtcactgggctagctaacagcccctgatccacaccaaacgcaaacctttccaggggcgtgttcatgtcccatgtggaaaagccgcgaggtgttgtggaaagatggcaacaagaggccaaattacctagtgcctactgcttattagtagaacttgggcgaaggggaggcaatgggcggcggcaggcaatggcaatctcggagaaaaggagagccaaacccagctagtatattggtagctgcactgctggatgatgagaggaaatgaaggaaagttagggcccctttgaatcgtaggaatgagaaaacatagaaataggaaaaacgcaggattttggtaggaatggaagtgtaaaacataggattgcaaaacacaggaaaaacagaggaatggtcgtttgattggaccgcaggaaaaacgcaggaattagaggagagaaaaagactcaaaggaaagtttccaagaggttttaccttatgttagaattcctctaaaatttgcatggcattagccaatccataggaatttcataggattccataagatccatttctttgattcaaagtgctatataggaaaaaaaatcctataagaatgaaattttctaaaattccaatgattttactttgaagcaaagggcctttaatttgagatcgatcgattggggaagaatccaccgtgcaacaggccaaccacaaacacctagtaaattagtactcccttcgtttcaaaatatttgacaccgttgactttttaagtacgtgtttgatcattcgtcttattcaaaaaatttaagtaattatttattcttttcatatcatttgatttattattaaatatacttttatgtacacatgtagttttacatatttaacaaatttttttaataagacgaacgatcaaacatgtgttaaaaaatcaacggtgtcaaatattttgaaacggagcgagtagtgtgcacgcacacatgcacaggtggttgggtgggtaatgagtaatgttctcttctgctgccggatctgccgtatccaaatcattgtacgattgtggcaatacacgtagtactaatgattgtgtaattttattacggtaagattgtgtaatttacttatggacattatgagtgtaccatgattaaagaaaaaattaataatttgctagcgaataattgctagcgcaattagagagagaaaatttttaaaaaacaagaacacacctagggccaaaaagtttctaacctaccgctggagtgaaagatgaaatatgatactctatccgtactataatataagaagttttaaagttggatacagttgttaagaaaataagtaaaaatgaacagtgtaaggttataattgaatgagtagtggaggtaggggaaaagtgaatggtggaaagttataattggttgggaagagaatgctggtggaaaagttgttatattttgggacaaatcctgatagctataagttgttatattttgggatggagggagtacatgccagtaatgtaattgaggtgatgataaatttagagttgtataattttcaaattttcacttcaacacaatgttagaagcatgtggccataggtgcatattcttatccgtttgaagaattgctcttttcaattgggtcaaaagtgtcattcgtccaattaccaattttttaagtgccttctagctgtaacacatttttacgatatcaactagcaaactatataaattttatatgttctatagtagaatttggcaataactaatcaaaccataacatagatttttttttctaatagatactgcttcttaaaaaacaattttctcattgcacaggttccatttctattaatgggctctaagaaaacacgctcgcaataatggttggggtcatgtgatctaaatgccacgtgtaaaaactatatatgggactggtgagatgttattaaggatgtgtttggatggagggatttgggtggatagaacatggtggcctatttttttgggtgtttggttggtgggcgggagtgggatagggcggcccggaggggaatattcccttcagatgccggatagtggaatccggccaatttggccggatggagccgcccgaggactagggcgagcgacgatgtgggttgcgtcacccctctcaccatgggagaacgacgacgacgacgtgagggaggcagtgggatgcgagctcggccggcgcgggaagaggggacggtggcgcaacgggaagaggtccgctgccgccgaccaggacgacgactggcgggagagaaggcggggcggtgagccttagcgctcgaggcggcgactagatctggatgacgacggcgaccgactgggacgacgactgagacgacaatttggagacaaggcggcgaccaacgggagaagaggcgggccggcgggtgggagaggaggcgcagcggcggtcggtgaagaagactttttttttctttttcttccgtttttatttatttctatctttttatttctattcagattttttttattgtagtagattgatatttttttggtttggtgaattttaagggaggtatactcaccacctctaatgaaagggtgattgtaaccacttattaacgaccaaatttggtaattcaagaatcggagatgaagaagaaaccgagatggaatttgagatggaaatcgtcccggaaacagagtaaggatcggctgaagtccgaatcggctgcgactagggtcgacagagatcgagtcaaacagggttagccgattgagccgaatccgacaatgtgacacgacatacattgtcgggttaggttgacgtgcttcaagatgattgccatgcatggatagagtcctgagaaggcgattgtatctattaattaggatatttcatgtaatttccttagagatatgtttgggcaaaagtctgccgcaaagacttatggtatcttagagtttgttagagataatagtcgtgtccgatatggacatatcttgtaattttcgggtataaatagacccgaaccctatgtaatcaaactaacacacgttcaatataatctcggcgcatcgccaccctttttgctttcgttttatttcgacgagttcttactttcgggttgagctgcatcggtttcgatcttcaacaagaggtaaaacttgttatgacggcttgcgttctcgggattagttcttccatctttatgatactctaatcttgcttatgtaattcgtcgagttatcatatatcttatataatctctggcaatattgctatctaacctacaatgggctaacatctatcaatagaaggcagccgattaagttaaatatcaacgttggcttaaattatatatgatatctaccactctatgaaacttcccatggcttgattgtctagatattgtccttctttttatacttatagctgcatcagttgagtttgatcttatgagtcgtgattagaatctcaatctctagcctgcttcttggttgccgattagggtagtatcggggtttcagccgatcttacctgatttaactatatttgttttatatgctttattgatatattaaatccgccttttatgttaatatcttgttgcatttaagtatattgggctcttcgtttggtatattctacttgctttgatatcttaatatagagtggtatcggagtattagccgatacatgttagatctatctgatcggctatgctatgaacgtatatagtctcattgttagtatatacttcgatctaagtgatttatactgtctcggcatggcgaccgatttatcccaatcacttgatttaagtatatatcaacataaagattatatatcattggtatctacagccgatcgagtagatttagttcttttttttctatttgtgactgtcgatcgatgcatatatgacatcagctcaaagataaatgatatgtcatcggcacctagccgatcggctatcatttatggatttaaccacggtttctttgtctttgtttcttgttgattgcaggatcaaatcaactggcacgctagcatacccgaaggcgagttttggacctgcactggagttaagcagatctcccaagcctcgtgttttcacatcaacaccactcatccatcctactcctccaactaaacaaaaaaaatagatcaccaaatccacctctatccatacaaccaaacaaaaaactagattgtcatattcactctaccaaacaaaaaactggatcgccatatccaataaaatatggattgccatgtcccatccaaccttgaccgggaaccaaacacaccctaaaatagtggcgggccggctgagggacttaagtcccctctcctctcctccctctccccttatctcaccgttatgcctgccctctccttctctgctatctcctagctgtgttggcaagagctggtttccaaccaaatagtatgcacgaaaaacggagcggtccattagtactatgattaattaagtatttgctatttttttaaaaaaatggatcaatatgattttttttttagaaattttgtatagaaacttttttaaaaaacacatcgtttagcagtttgaagaaacgtacgcgcggaaaactagactagggagttggatccagctcttgcaaatatagccatagacatgtcgccaccgtcgttgaccactccccttgcaccgtcatgcttgtttgctcaatcagacgctatggagagccccaagtccaatgcttcaaattcagcagtggatccgataccggttacatccacggtctcaggagggaccgatatggcgtgtcaatgatttttgtttcttggatttggggagtttgtgtgaattttgtcaatgttttttttaaaactgactgtgtatgttgaatgtgaatttgatgtgtactaaatctgattgtaggctgtgattggatttgttttcggttttttacaccaaaaatcgttgactagttggtcttaacctagtcatatgtgaagatcaattttcacataccgctgtcttaaaaaaatcctccgtaaaaatgatgatttttatggaccttttattagaagaggtcgtccgaaccgtgcctctcagtcgattaatcgattttagccgcctgtttaaaaaccgttttttatagtgaaccttaactaacgcgtgcgctcatacaaacacagctacgacatacctaactgctctagaacgcaggtatacgtgccccgccattagcaagtcacacgaatagtataagcaacctaggtctctttcttttctccgataagagttagataaagattaagattttcgtgccgcgcttttcaactgtgaaaactttctatatgaaagttgctctaaaatataatattaatctattttttaagtttgtaataattaaaactcaatcaatcatacgttaataccatctcattttacgtaaaaaaatttaatctttcatcttcagaagaaaagaacaccaccgtagccatccatttcgccatatatagattgctctttcatttcccgatcggttgattaatttcgcatgcgtcgccttttgaaatactatgcaaattatggatgcatgtttgcaattgggccggcacgagttaagaagaaaaatgggcaaactagtactggtgcatacacagtgggtttgagaatgacatggacgcttctaatatttccgggccctttttacacatgggcgcccacgtggccttccaaacgcgctcaatccaatcatccaaaccgaaaaataaaaaacccaaacttttttatgcagtagtagtaattttcagaagaaagaatgaaaataaaggaaaaaggctagcagaattggcttggctcgtcaaacctttggagtgcgtccgcgtgtgcgagctgcgcccgtgtgatgtgggcgggtgggtgttcgtgtctccgcttgtctccccgcggcgccctcctcaaatattctcaactccccaaccaattcattcccccgagctgagctgagctctcattccttccttctcctttccgccggcctcgcctctcgtctcctcctctcccctaccgatacgcacgctcgcttgcttgcacctcgcgcgcgagagacgagagagagacggcgagccctggcacgcacgagaagcgaatcgaagtggcggcgacaggagcagctgctgctggtggattatccgtcgtcaacatggctcaggaggacgtcggtcacctgagcgacgccggcctggcgctgggcctgtccctcggcgggggaggaggagggacgaccgacgcggcggcggcgcaccgtggcggctgccggcggccgtcgccgtcgtcgcagtgcccgccgctggagccgtcgctgaccctgagcttgcccgacgacgcggcggccggcgcggccgcgaccgcaaccgcgaccgcgtccggcgggggcggccctgcgcacaacgtgtcgtcgctgtccgtcggcgcggcggcggcggcggccgtgaagagggagcgcgcggagaaggccgacggcgagagggtgtcgtcgacggcggccgggcgtgacgacgacgacgacgggagcacccgcaagaagctccggctgaccaaggagcagtccgcgctcctggaggaccgcttccgggagcacagcacgctcaacccggtacgtcacgtacgtccgcgcgttctccttacgttctattgacttgccgccgcttagcctagctgcagaaagctgcacttgtagtagaacacaaggagcaaattaagataaaaacatggcgcatattaatttgtgttttgttcatcttttttgatcgaatatatatgggtcactgaaccaccgcttttgttttgtttcttcgagcagaagcataaagtcgctttagcgaagcaactgaacctcaggccaaggcaggtggaggtctggttccaaaacagaagagcaaggttagtatttttcatttttcgcgacttttctttcctcttcgagaccagtattttgcaacatgtacacgcgccagtgggcacatatttgcatcacgtatatatacatatcctactacttttatctcagcaagaaccttcagcgtcgcttttcctttacgtaattcaatcatgcatgcatgagacaaggattatgattatctccgtgtgtagaaaa

SEQ ID NO: 56888 - DNA, 2691 bp, Oryza sativa
cagacggaggtggactgcgagttcctgaagcgctgctgcgagacgctcaccgaggagaaaccgtcggctgcagcgcgagctgcaggagctccgcgcgctcaagttcgccccgccgccgccgtcctcggcggcccaccagccgtcgccggcgccaccggcgccgttctacatgcaactcccggccgccacgctcaccatctgcccgtcctgcgagcgcgtcggcgggcccgcgtccgccgccaaggtcgtcgccgccgacgggaccaaggccggccccggccggaccaccacccaccacttcttcaaccccttcacccactccgccgcctgctgatccgatccatccatcctcatgaatctgcagttcgatcgatcgatcgatctgcaacaccaaacagacatagcactgctgctgactgctagctaaagcttagtactacctcacgtcacaggtaacatatacacgtgacatacatggcgattggcgacatgatcatcatgcatcatcatcctctccttgagctactgtttcttgccctgggggattccagcttccattagctagacagtccatctcagtcaaatcaatcataggcttaatgataggattagtcaaattaattatagccgggccacagctagtacccgatcaatgtatatttttgtgcatgcatgtaagtatgtaactgtgtgcccccctctcatcactagttagctttacttttcttttttgtttcacaggctagttaattttcagaggggatcatcatggggcagtgcagtagctagatagattaagcttgtatactagcactactgatggattaaaattcttagatagtgtcacacacgcacagtgttggatcggatgacgacatgagctagcttagctagcatgcctgcctccctcctgttcgctcggccctgtcgggtgcgtgtacatgtgtttacttttgtatggatatacgtctcaatgattgtgtgtgtcggggctccccaacttcaaaaatttattgagttgccatcgctttcgcctctctgctgattattggttaatcaggaagagagagcgggacttcgccctctcgtctcatctttttgtttgcttaattaggacttgagagcggtagctagccatctggatctctgctctgctgcacgccatattaattaacccaaggcaattttaacacgtacggccacaccaccactcgcgatcgactcttgctgcgggtacgtagcacatacatgatcggccggttgcacgtactgttggacactgacggtttccgtgcgatcatactatagtagtagctagttcgttgagtaattactgcacttaggtatagtcagcgtcgaagctagttgcccttgctagctcctgccttcctggactaactaatttacacaggaaaattatgcggatggtgtgtgtgatgagggatggcacgaccaaatcatgacacgtaaaaaggagcttcgcgtcgcggcgtggtagttaatatgggaggcatgccaagaaatatgagccgggcggggcttggctggcatggccggcgcgggagcacgcacgcacgcatgcgcgcgttcgatcgatctctctcctggaaatttaacctggcagccgaattccttttctgacggcttgctctctctctctctctctctctctctctctctctctcgctgcgcgctgcgcggcggcatctggcacgtactctggccgttgtgttggctctataaccctttataaattgtgtgttgcacgaaacaatatatcgatgacgatagtatatatcgaggatcaatcatgcatgtagcatgcgttggcgctacaaacaagcgagactttgttatcgtacacgtatatgattgagcttagctcttattggctgatctggacgtttgatgtcgctttggcatctgtagtctagatccaaagccagatagttccccgatctcatagtcttctattctccgtacaatatactatacgactagtagtagtatatcacatataccggcagcaccggacttgcaccaaagcatctgacgggggccggccggttccccgtgaaggcgatgaaacggccggagtgcgcgcgagcgagcccaaacgagagtttacgccggtcacaccgcgcgcgtgcatgcatgcacgtccacatgcctcccgtccccgagagttaaatgtgtcgctcgcgcctccgcgacgcgtcgtcgctcctgtcccccgcgcggcgcgcatcatggcgacctgcgcgccctcctgtgagttctggacaccagcgccgcgtacgcgcatcggcgcgtttcgccccagcgtcagcaacaaaggccggcacgttcgcccgagcctgtcccgagatctgaggcaacgatctgacgaggtctgtactagcgcgcgggtcgttgggcggagcggcacatcgagacgggaccatctcctgtgcctctctctctctctgtactaggctgtgtcagcctctcatcattcgcggcggatttacctgtggatacgctcgctgcggcatgcccacatgacgtgcctcacgcaatcattggccatcaggattgggctcagccctcgggacctcaggctttgtgggatacgtactttccgtacctatctttctcgcatcgtgcgtgcgtgccaatttattcgtttcggggtagtagttgtacaatcaa

SEQ ID NO: 56889 - DNA, 16373 bp, Oryza sativa
aatattgtttctggattaaaactgccctctgtactgtcatctcaggattgatttgagggcaccaacgggcggtttgcaggagaggaatacaatgcaggagatctacccgtagatttccgtctcgcttctgccaacattatcctcaggctttttttgatgattttatatttagatcgtcactgttcatttgcgatgtggagagatttgctttctgcccgcacgtcaggtcaatcagatgagatatggaatatatccgcagggaattggaaccttggctgacgacaatgttctctcgttgccaacgtcctctgctttcccacgagagaacaccaaggttcagaaaacaaaaggaattgcatgtgttttttagtcttcgtctaatctctaatgaaccgatcaaacggtaattttttataatatatttctttcggtacctgtctacgcataatgtgaccgcatgacaccataacacagcacgcagaaacttacgttatggtaatttttgggtggcattagtatgtggtgcagagatacatgtcgtgaatctgccacgaccatacgacaaagtgcgagatagcctaattgggtcaagtaataagttttctagatgaagtaaagtaagttctttgtttatctcaactaaagtaagttatagtagtcacacatcacgcgtcgtggtaaaagaaaatgagtagatcatccgaggcaaagcgggcatggtgccccagtcacggcggacaattaatccaagccgtcgatcatgtgatccgcggcccagaagtcgcaagcccgtcgtgggtccgtccttccactgacagatactattacacgtacagtagtaaatgctccggagcaatgcacgtgggcggcgaaagcaaatctagtgcagcagagaattcgaatcatggggccaagccaagccaagccaagccgaggtaggcagaggcaggcaggagatcgagttgaggtccatagagattctgcaccggcacggcatcggcatacgtacgcggatcgcatcgcagcttctcgatcgatcgaacggaccaaaaggagccctggaaacgaggccacgttagatctcgactagatgggctgcgcgctgggctcaggtgaccatctcctgggctgattttcaccgagaggccagggccttccctgccgatcccgtgagccgtgcgtgagcgtgaatcttcttcccttccgcccgcccattcgttcagcgtgagcatgtttcctcctcgtgcaatgaatagctcatacgttcggcgtgagacgctctctcgatcggtgggtggtcggccatcacgggaggctagtgttggtggagtactcgcttagaattgatgggggcgcagggcaccgtcacaccgggcagcgtcttcgcgtacgtggtttggctcggccgcagcacaacgatcgcgtactaggcggggacgcctgcgcccgtgtcttctgcgtgattagccggctccggtgcaggagacgccccgcgccgcgcgttcgaggtgccgcggctgcagcattattttcgccgctgcacggtggaagcccagcgggtgtcggtggcgccgcgaggaacggatgcgccgtgcgaggcggggaggacggaggacaacggtggcacggggtgacggggcttcgaggagagtcgacatgtccaacgggcccagtttgtcgacagcctaatgggctatatcatcaccactggcctggacataggaagtgggtccggcccatgtacggactccgggaagtccccgcctacagtaccggctacacgtttttttttttttttatcattccggctacacgtttagcttaagatttcaagcgaactaggtgatcaaagaaagcttgtagtagtactagatcactaagcttaatcctctctttacggctttacggtcatctaaagtagggagagtagaaaaaatgtgagagtgcaatcaacccagtccttttccgcgtcgttgtaaaaagttctacacagtaccttaacagcgacatttttttatcgactattaaaatcgagaatcaagttttcgtccagccgtgctaatatgtcacgtccatgtcaggctgcgtcaaacacacaaaacttcacacggcaacgaggccctcacatttttgtcctaggaatctcctgcgttacagcatcgccgctcgacctcacgtagctgtaaaagtgcgaggctttggccttgtttagttgggcgaaagtttgggttgtcacaccgatatacgaacacatatttaaattattaaatacaatctaataataaaataaattatagattccaccaaaaaacggtgagttgaatttattaaatctaattaatctgttattagcaaaatttactgtaacacaacattgttaaattataacgtaattaagcttaaaagatttgtatcgcaatttacacgtaatctgtgtaactggttttttttacatttaatattttttatatatgtgttcaaatatttaatgtgacggcctaaaaaattttgcaatataaactaaacatggccattgcaccattcactgccccggggatgtacccttttcagttgctgatgtggagactagaccgcaaccttgtcatcgatcgatgtcaagtgtgacttgatgccttcaacccattcgtctttctattttgtctgcagtggaggaagcagccaagaagtgagagctcgggaagcagccgtgaaccccatgaacggtcgagttaaggccagccgtatcattccccccaggtctttgggaaccacacgagtacagaactgctcagattttgctactgttttatcacattccagccccttactccgaatgtgtaggggtactccgtaagtgcttactgctcagcaaatactcttaagtagtactctccgtcacactcccttcatctcaaattgatcatatgtatttattcagcaagattaaaaataatttaaatcgtatcaatcaagacacaatgcacacaatctcccacaatacatgtatcgaataaaacactatgccaattatatccttgatatgcatatattctcctttgctacattaattttgttccgatgaaatccgtatttatacggttatatgataattaatttgagaaattttgaatttaatatatgatgatcaatttggacagaaggtagtagcaacttgagttattgaataataagaggatcgacgtatctacaaatgttgggaataccttctttctagctaagattgttcttgtgtatgtgttacggatccaaatggtttgacgtgtaaagtgtgcgcggttatactgcgtacagtacagttaacaagagtgctattcgctacatattggtagagacagattaattagcaagtaatccatgtcaactccacgcaagctcgacacggattcgtatcctctgacttccgtaggattaatgcatgtcaccgcgtgacattcttcctatcttaatggatgaatagtcaaagttgtcttacaaatttcatctgatgctcagtttagtccttgatgtttcaatctatccgtattactcctttaagttttcagtttagttcgaacttatcctttaaccaacaactttttgataaatgatacttatacccccatcattcacatatataagagaaaaattgcatgcttaactttttttatagataatgcatagtaaattatgtaaaacaaaaataaattatgtactataaagtgtatacgatagcaatagcttaagtttcatgtgcacatgttaaaataataggaagtacatctgcactgttgtttattcatcttggttttctattttctatacaaattaagagcaaaagggacattttccaatgaaatattaactagaaatagccatatggcatattaagtgggcccaagaatgatttcaagccaaaacaaatatttagaggagctatgtggacaaaatgaaacgtgaaggaccaaattgagccttcggtaaaacttgagggactaaattagccattcaccctaattaatccatccatttgaaatcaatggctgaggattaattgacccacaacgccttgacctgtgattctgtgaagttaaattccctaatactcaaccattggtttcaaatggacggattagatagggagatctcacgcggtgatattaatcctacgaaaagtcagaggatatgaatccgctggacacaaccacttgctaatctatgcatcaccaacagtcttgttgattggcatgttcgtccacagtccagtggcaaacgcatgattttagagatatatagaggtacagagtaatagaaaattgtttcaccgtaaaaacaaaagcttatccgtcatagagaaataaaaattatttgtgatggatatatttaggcatcgtctctctccccgcgtcgctctcgcgcgggcggctcggtggggtgaaaaaccctagctgcccacgcctcttctccatccctggtcctcgccaccgctggagctcgccggcggtgaagccggcagcgagtagggaaggcggcggtgaggcctttttcttcgtggtgtttccttcctcagcgcgaactggacgggacgaagacgacaaagtcccccaccagcacggtccgaggcggcggatccggcgcccccaaggccggatccggccatcccccacctggatctgcgcggcggcggcgcgagggcttagggtggcgcagcggcgtgcgggcatggtggcggcggcatgtggccggcggcgagacggcaggcagctgcggctcggccggcccggctcgggcgcggagtcggcggcgggcggtggctcggcgaggccggcccgggcgctaaagcggcggacggtcgcggctcggcgacggctcggcgtggccgacccgcgcgcagaggcggcggtggcgtggccggctgcccaaggcggcagcggcagctcggcagcggcgcccccgctcaacctggcagcggcggctcggcagcgcggcggcgtgcgggcgtggtggcagcggcttttggccgggggcgaggcggctggttgtggctcggcgaggccagcccgggcgctgtggcggcggacggccgcaactcggcgtggccgacccgcgcacggaggcggcagtggtgtgcccggctggcagcgcagcctgcccgacgcggcagcagcggctcggtagcagcgccccagctcgacctggccgcccggcagcagcccaggacgcagcgaccgccccctgtgcaaggtaggtcgtcctcagcgtccagacctaggtgacggctcggcgtggtggccgggcagccgagatgccaccgcggtggctaggtgaggcgcgcggccggataacggggccagtgggtggcgccggtctggagcggcaccgccaccggcggcgagatggtagtgctaagggagctggcggcggtgggttgtcttcctcgttgccggtcggcaccatcgcccttcctggagctcctccccttctttgcggggagattctaggttggattgaggcggcaactcgtcggcgggggaagctcaggctgtcgaagcaatgacacctagtcctgggttcctctttggcaaaaactggcgaggcggccggcgggtggtggaacagaggggtcctgggccagctctcaggggtggtggttcgatgaagtcggccgacggaggggcgtcagtgcggtgtggtggatgctacatgctgccatttgcctgtgtggtggttctgagttggtggacagcgacctgcagtcaaggttgtaggatcccaggcgaaagcctagtccggtggttcactgggctacgtcttcggacgtcataacctctttggggcgttgtcaagggttaccctttccctttctcgacgagcttctctgggtgaaaaccatataaaccatatctttttcagatgggcgatggcggcatcactactgtgtcttgacgagctcttcaaagtgtggtcaagaaatatcaattgaatcaaccattaactatttgaaagatgggctaggaaaagtgcataacgttttttttttttggaatatatgcagtgttgaaccgcttaacggggtcatatgacccaggtaaattattcaatgataactactttatccgttttatattataagtcatttgacttttttaaaattattcgtgattaatcaaatttatagaaaaaatagtaacatctacgacacaaaattagttttattacatttaaaattgaatatattttgataatatatttgatatgtattgaaaatattattatattttttataagtttggtcaaacttaaaaataagtttgacaaaaaaaagtcaaacgacttgtaataagaaatagaaagagtaatttatatatcatgttaattagtatattagattttattaaaaatttggtacgtataggattatggtagttttttctgggttcaccactgatttaatgtgaacaatctcgatattgagagtatggccaatgtgaacaatctcgatattgagagtatggccgtgtttaaatactgtaaaaatttggctaaattttttttacgtatacgaaaatatatttgaagtattaaatgtagactactaacaaaacaagattccgactgtaaactgctagacgaatcttttgagcttaattaatctgtcattagcaaatgtagattgctgtagcacttatggctaatcatgatgtaattaggctcaaaagattcgtctcgtgatttatagtcgaactgtgcaattagtattttttttttcatatttgatgctctatacatgtgtccaaatatttgatgtgacggaaaaattcaaaaatttaaagaaaaaagttaaaatctaaacacagcctatagcacagctgactcactgttgcctgttggtttgttgtcagtagcgctaggcgctagctccctatcagtctatcgcagtcgcaggcaccaagcttttctgctgcttggtggttggtgctcgacgcgagcagcgcctgcatggccgcgcgttgcagtggggcgcactggcattaccctcaacgattgaaccacagcaaagcatcagggtcaaggaaaaggattctgccgaagctgtttcatgggttgtactacgattctaggtttattaggtcacgtacaatggtagccacaagcaattatggtctcaagacgtcaagtaggatagaatcacacaaaggtcacactacctacagtggaaaccactccaaaacgtattttgcatatcagcccctatctatttatatgtcagcccttgtattataaaacctattgaaactttatattttgaaccctagagtaaccaaaagaagtatatgtacacccctaaacaacctgggacccactgtcagtctcttcccatccctctcttttttattcccctctctctctcttcgatttttctccaccgacagccgcatcgtgtcgctcggttctcttctcctctcccctcccctcgccggtttctcccctcccctctccggcgcgaggtcaacggcggggagcagcggtggcgacgggtctggcggcggcgaggagcaacagtggaggcggatctggcggcgaggagctcgccggctgctcccctcccctccggcgcgggctcgccggctgctcccctcccctctcgagcgcgagctcgccggctgctcccctcctctctccggcacgagctcggcggcggggagtagcggtggcgccggatctggcggcggggagctcgccgactgctcccctcccctctccggggcgagctcggtggcagggagcaccggtggcgccggatctggcgacgacgacgaccacgacgacgaccatggcggctgcgttgatctggcagcgacgacgaccatggcggtggcagcagatttggtggcgacgacgaccatgacgagatggggatttggggcagttgcacgggggtccggacgaggcgacgaccggggctccgactcctccaacgcgaggcttcggctcgtggcttcacggctcccgagcgcaggcgcggtgcttctttcggtttttctacaagctcgctgcgcgcctgcgagaccacgagcgggcgtgccagctcagctcggctccgacgtagagccgtgagaccacaagctaaggtcatgcgttgtacatggcattagggaatggttgttctaacccaactaataatatatatgcatgtattgcacctacatagattacttgccaaaaattttaggtagataccccatgtcctatgtcctatggtagatccgcccaaatcaacatatactatccattagtatttatattgccaaccgtttattgattttcgatggtatcatgattcgtgtgtttgttgcgttgaggatataataatatgaattatacagtagagaagttaattaaggtgttaatattatataatactttctccgtttcatattataagactttctagcattgcctatattcatatagatattaataaatttagacacatatttgttacacaaaatactccgtagcataatagttcctactataaatgaaacttttaattggcccttcccatttcttgtttaagctagctccactactggtccattgctacaagtggcagggtctttttgaatttcacgttcttttttgaatcgtaggaactttcctcctttttgtgtatgagaattgttccatttcttgttaaattttcataaaatacatacaaaactactatatatacgtatgcagtatgcactcagcttgatgaaatcatagaaaacatgagcgtggaagctgtggattggagttttggcttttttttttgggtgggtggggcgccccggggggagggggggggataatccacttgcacagacatgtacacgtagacatagagtcagccgatccaatccacaataatgactgcatggcgtgcatgcctatcgatctgtgatctgtcccgtagctgatcaccaacccacagtcatgggttgcatgcaaatatggcaacatggatgactagctgaagagacaatttgccaacgatcaagaagaaaacgaagaggataagcaaggtaggatcgagactgtatgcgccagcggccagctcaaaagcatatcggtagctggttggtgggaggctgggagctggaaaactcgtcgatcctccctgtgaaacaaattacacgcaactcgatcagaaagttcagaacaccttcaactggtgaaagcgaaggcagtagtataaccgtgaaagagatatactctgtcccgtcccaaaaaagtagtatagcttttttatacggtagattatttagtactactatggctatcctaccattttcaaagccactctttctaagccacctaagatcagatacaatagcaaactattagctagctgtaaacatattttaataagataaaatatgagatagaaaaacaacgggctatagatctgtagccagctgcagtacgaactccaagacgcagtgtgtttgacagatgagaccatatattaatagtatagtaagtaactattgtatgaattggctatagatgaattggagctagtagtgggctactattaaccttgctctaaaggaatgaaaggtattatgatcttttcatccatattccttaatctttgcaacacaaaagaaatagtacaatttaagatgtgagtttatatttactatgttctataaagaagtaatacaaatgtgaagaataaatatatttactacgttctggaaaagaaatttatttttttacgtaaagaaatttatttgttaagtataaaaatggtcaatagcagtcccaccttttttagcttattcattggatattgttactactatttctcaaaaactttcttctatgaaattatttagaccacaaagttctaattaagctggagtatatgttaaatttatttttaaatatttaatttattatttaatcaagttgagaactcataacagtaatctaatataatcaataatttgtttcaggcgcccgtttgggctcagtggctcacacagtcacgctgacacgcttcaccacttgatatgcaattttaggtgaagtctgaagagattatttagagcagatacaataataagctataaactagttataatcacatatcgagaaaataaaatagaagagaaagaaacagcgggctacaaatctatagccagctgtcgcacagattccaagacacaatgtgtgtattacaggtaggaccatatgtgtgatatcccggctcagagtttaataggattaatagaatactcatattaatttctttttcggaagccgatctccaaagaactccagggctaagcgtgcttagcctgaagcaatttgggatgggtgaccgaccggaaaattctttccgggtgcgcacgagtgaggacaaagtgtgcagaaaagacatgtgttggtctgtgagggcagtctatgacctttaaaagctatcagatataagtagtcgcggtttcacgagcgcgtgtgtcgcagtggcgcaggcatggtgcgcacggctggtgtggacccggagtggtcacacaacatggcacatgcgctggtactggacacatggacgtggccaagaggtaaggggttgaggatatgacatcccggctcagaggttaatgggattaatagaatactcatatcaacaagttgcaacttcttttccggaagccgatctccaaagaactccagggttaagcgtgcttggcctgaagcaatttaggaaattcttcccgggtgcacacgagtgaggacaaagtgtgcaaaaaagacatcagatgttagtgggcccggcatgagagaggcagaatgttccaatatgttaatagtgtagtatatatttgtagataactattatataaattggttattaaattgactatatatgatttggagccaatagttgactatactattaaacttgctcttattatgctagttactccctcgctccctccgtctttaacatatagccatttttaacatataccattttttaatgtttaaagtttgtcttaaaatatagtaactttttacctatttttctttatctcaccaatcacgaccatctcttcttatttaatttgtttcatctatttttttatttcaaacaacaacaataacaccactccggcactccttcctccacaattcccattaaaaactctagagagaggtatattacttgctacctccattcaaaatatatctagttttaactatgcatattggaaacttttagctgatgtaactttttttaaaatcagtagctccctaaacaattcagtttttagtctagattatgagaaattgtaattgtagaattcagaaaacaaactaaaagccagaaacctaatctttttagatttttagaaactggctatcaaccaattattttatattttaagatgaagataatattttttaagagccgtaccaacggccaccgtcagagccgtgagccgacgccttcctcccggattacccatcacgcgtgcagcgcaaagtcgtaccaaccgcagctacagccctctcactgactcgcgggcccagaggtggtccggccgtccacacccctcgcccgtcgctgtgctgtccatatatacggaaaaggttgctaccgtttaggcaaaattggttatatagcattgaaagttcacgtttttattttatagcatcgaaagttaccggttcactttaatagcatctaaagttcaccctattcccatttttaggacttccgtcattttttccgtccgtcttgatcgttattgatccagccacacacatgatatgacatttctacccctcattgatatgcattatatttgtacttgtgaggggtagaaacgtcatatcgtgtgtgtggctggatcaagacggacggaaaacgatcgagaattgacgaaagtattaaaaatgggaacatggtgaactttaggtgctattaaaatgaaccggtaactttcgatgctataaaactaaaaacgtgaactttcgatgctatataaccaattttgcccacaagttattggtattcgtgatagtactatggtactctccactccgtatcgatcgatagccccgtgacgtcaaacgtcgttcgttgtaatcttgcatcgccaccaacaaatcctgacacgtacaacgcgagaccggaacaccacaaacggccgccgccccgtccgagagtagtttaaaacacacacacactcgcgaagctgtttccgtgaaacgactcgtgtatatctctcctcaccttggcgcgccaacggttggttacgaacgaggacgagctgagcctgagacgcgcgcttcccgttcgcacagccgcacaggtctcttgcatggctgctgctgctgctgctgcgtcgtccgcgaagcgcgcgctcctcccgtgggcacgcgacgcccaccacgcgctggccagggccctgcagggatgcggcggcggcggcggcctcggtctccgcggggcgctcccgacggtacgtgtgattacccgcactttttcagtggttcggatcccactcgctctgcttagtttctcttcgactcgtggtgggttgcgcgcgcgttctgtccgatcgagatggtttctgtgttgatgcgatcggttggggctcacggtaggggccttgtggatgtgcaggccggaggcaggtggtctctgctccagtgccggtggaggtcgtcgctgccgcagctcgactccgccgacaggtgagccccctactcatgcatgcagattctactcttccggtctccgttgaacgagatttttgttcttttcacgtccgcttcggatttagtgttgtttatgccattgccgccggggcgtgtacgagtgtgcgtgcaggtccgatgaggaaagcggcggcgaaatcgactgggacaacctggggttcgggctgacgccgaccgactacatgtacgtcatgcggtgctcgctggaggacggcgtcttctcccgcggcgagctcagccgctacggcaacatcgagctcagcccctcctccggcgtcatcaactacggccaggtctgtcacgttctccagtccacacacatgtccatgcaacgaaacgtcgatccaggcgaccggactaacaagtgaacgagggtgatggctgcgtgcgtacgtacgtatgtgctcgatgatcaggggctcttcgagggtctgaaggcgtacagggcggcgaaccaacaggggtcgtacatgctgttccggccggaggagaacgcgcggcggatgcagcacggcgccgagcgcatgtgcatgccgtcgccgtcggtggagcagttcgtccacgccgtcaagcagaccgtcctcgccaaccgccgctgggtacgtaagcgcgtacgacgaacgtaacacgaccgtcaattaattctcgcacgccatctcgatgaattccccgtggtaattcggtcgcgttgcgtggtttttctatcaggtgccaccgcaaggaaagggggcgctgtacatcaggccgctgctcatcgggagcggaccgattctcgggctggctcccgccccggagtacacgttcctcatctacgccgcaccggttggaacgtacttcaaggtgagcacaaaactcggtcattagctcggtcgtctttctgaacgctgcagcagctagcaaaaatctgaatattttggactcgatggatggatcggtttcaggagggtctagcgccgataaaccttgtcgtagaggactcgatacaccgggccatgccgggcggcaccggcggggtcaagacgatcaccaactacgcgccggtaaacaaaagataccatatccactacttccgtcccaaaatattataacctaaaacaataaatatagagagtagttatgtccagattcgttgttctataatagcatccatattaaaataataaatctggacagtggttatgtctaaattcgttgatctataatggtatccatactaaaacaataaatctgacggctagaggttatgttcagattctttggtttggaatgggatccatactaagtaacaatattttggatggaggaattaatatctattacatctaaatgtgttcaggtgctcaaggcgcagatggacgccaagagcagagggttcactgacgtgctgtacctcgacgcggtgcacaagacgtacctggaggaggcctcctcctgcaacctcttcatcgtcaaggacggcgtcgtcgccacgccggccaccgtgggaaccatcctgccggggatcacgcgcaagagcgtcatcgagctcgccagggaccgcggctatcaggtgaccaatcaatctacgcagagcactgcatccatcagtgatttggcgacagcacatctgaattaattctgaaaattttccgtgtaattattttgagtattcgcgaaaaaaaaattaattctgaaatcgttgtgatctctttggccaagcaggttgaagaacggctcgtctccatcgacgatctggtcggcgcagacgaggtgttctgcaccggaacagcggtggtcgttgccccagtatcgagtgttacttaccatgggcaaaggtaaaatctgcgagtcgatcgttcacgacaggatcgatctgaattctgaatcccgcaaatctctgacgattttgtatcggtttcttgggcgcgtgtgcaggtacgagttcaggactggacatgacacgttatcgcagacactgcacacgactctgacgtccatccagatgggcctggctgaggacaagaaaggatggacagtggcaatagattaaggatggattatgggcaaagggatcccgattattcctcatgtcatccaatgtagattattgtcgttttatatatcttcctgtagcgacagtgatcacagcgcaagtggaatttggacgaacaggaagcaaatgcagatcatcttactgcgtaatctctgtgtggccaataaaatcttgtcattgccaaatctttgagataactgaatagtacgctaatgaacaaatgcataattccgagtcactcagtcatctaggcacgcgaacggtgaatgcaattatgcacaaagccgattgaaggcaactgttttgatgtacaacgtttacaattaattttaagttgtgacagccttgacgtcgttgttcctttcccaatccataaacatcagatgttgatttctcctaatgtactttcacgcacgcgtgaagcaagtagcagcaggacagccgcagctagcagttcacagtggcaacgaaagggaagtggccaaatttgccactctagctgcagtgacacgaaacggaagtacacgccgattttgacacgaggttaagtggtcgttttcttggacgacctccacgtgggtatgctaatccaaatatccaaatacccaccggcgcttaattactgcatgtatgtgtacgtcatatcgcctgtgcatgcatttagacgtttgaagggaagagttcgatgccgaaacaaacacggtacttctgttcctttttctgcttccagcagctccgagatcaggggacacaaacggcatgatcgatgcaggatagcattgatatgcgttatccggatctggctaagagcaggtaaaatagcatgctattagccagttataaacatatattttaatgagataaacgatgagagagaagagcagtaggctacagatttgtagccagttgcagcacgtactccaagacgcaacatgtatgataggtgaaactatatattaatagtatagtaagcaactattgtataaattagctattaaattagctatagatgaattgaagtcagtagtaggctatactattgaacctgctctaaagagcttccagaggctcactagtcttgtccttactagtaggagttcatacgtcaggtttggaggtgtgctctagatttctggtcaacctgtccaggtggttgtcctactactatatcttttccttgaatgattttgcttctttagttgcatacaagattttttgtttctttgtacaactagagtctcgattaagagtccgcttaggagagcttttaacagctataattttttcagaattaaaatattttcgcaaacagtccatcatattctctaagacgatataggtacacaattaaataaaaaacagaagtcaaaagttgggttttaccgtttctctatattctcttaagatggctaacaaacagctacttaaaatcttaaggtcttcaaataagacataacaaaggtaacggattttcagtttttcaacaaaacaagcagcttaaaagaagatttcggtgatcgtggattacttgcaaggacgaaagcgactagtttagggggtg

SEQ ID NO: 56890 - DNA, 6615 bp, Oryza sativa
gaaaagataatagcattgtatttactaaaaccgtatacacattctgagaaaattaggtgtttaactgtgacatgaagagtgaagtctgaccttccgcagtgtatagaacgattcaaggtacttgcacagggaaggtgcatcgtgcaggttgccgagaggcttgagaagattgcgtaggacaacaatgtcagaaaacgcaacggtcattccaccaccagttaaaggatgtcgcatgttgaatgcatcacccatcaacagcgcgccaggggttggaagtggagcagctggcatactcctatttggcattgtccttatgcttcctttatcaattgctgcaatgaaagaatcatggagttctggaggaatctgaaaacataacatttcaattagcatctagttgtgaagagtacacaataataattacacttggtagagcaaaaattaatacctgaggtgcaaccacagtcttgagatattttgccatttcaccggttgccatggaaggcaccttctgcccagggatatcaaccaaacaacgaatctcagtgctgcttatcgggtaacataggataggtgaaggattagccaggataacatggccatggtttgggtgaggaagttgacaattctccaaaaccaacccaacaaaacaggatggcacatcaacctaagcgcatgtatttcccattaatattagtgaattcagtcaagtcaaaaatagtattggtgaattcagcaagaagcaaatcagtatactttgaaaaatgtacctttggagagcacaggacacgccgtaggtttgagaaacagccatcgcatacaattgtcaatggtgcataggcctttaattcttcacctgactttgtcttgtattgaacacccttaaccgtgccaccttcttcgagcaatgatgtaacggttccttgctccaaatgaacactgaaagcaggtgtattttttttacataaaaagagagaatgagtggacagcaaaagcccaaagtagtaaattttgcataatcataatcaagtatgtaaatccaatagatccgtctagagtatatcattctggaggtgtagataatcaagaaattgacacaatcaaatgtattaatccagtagagtaatataaacaaatggaatgttcacatggcattattcagaagaactatataaatatatgatttttcaataaaataaacttgcatgcgcaaaagttattacttaggcaaagatgcagctttttgacgcatcttctgtataaaccgtccattgtgaaagctcctaccagcaacatctgaatggaacttctccaagggataagaaagctttgtgtttctcccatctttcaacaatgcgtaaccaaggacacgctgagcatcgatttcttcaacacaatctgaataaaatcaaaggacattaagtacaaagtactgacgatgcttttcgaaaaatgccactcttaccctcaagacccagctccatcaatttcaaatagccaccaggctgtagcagttcaccaacaattctatcaggctccgtcatgtcccgctctataacatgcactcgtcgcccatcctaattcaacaaacgaaaccaggaatattagattttctttttcaggatatttctgtttttaccacaatgcatcgcttgatggtaacgagatacatgactgcatttttactattgagtgttctgttgtcggataacatgaatgatactagtacaatagaagtgattcattctaccaaatacaaaagacactatggtatctcaatgtgtttgtatcaatagcaattttgactcttcacgttctacaagacattattttcaccgtacaggttactaaaattatagtacgaaagtattttaagtgagaaatagagtgaaatggaactagtacagttccatggtcaatctaggtggttttaaggaagatgatggtaaaactcttgatgattagaaatttgcactaatcctaaaacatagtattgttaaaaaaaacctggcgctttggtaattttactcctaagtgaaaagtgtacataaactgcatctcgtactgaacataagtacataacaccagctattgttggcccggtttaaagaaaaaaaacccagatgtattacttttagaaaaaacaaataaaacattttcgtatcaatggtgcattggtgcgccacttacaagttggtggtagactggtactagtagtagttacgaaagcaaaattccagcctaaaaagatacgaacgattcgcctcaaccaaatgcgagtacgtcaacaaacgagtgagagacaaaaatgtagccacctttccgagcgtgtaggcgagcgcagatccggcgaccccggcaccaacaatgacgatgtccgtccggtcacccccatcgccgccaacaacccggcagccaccctccggcgcgacctcccgttggcggcggcggcgccgccaccccatcttcactgcgacgaggaaggccgccgtgaggagcgtggccgcggcgaggccaacgagctgcccggcgccggcgaccgcatccatttcttgctgctctgcgtgcgtacgtacgtgggtgggtggaagcttagagaagtgcaagcgaggtgacgggagactacgttttatgggagaagaagtgagctgaaaaaaggccggaccgccgctgattagcagctggcaatggcatcgtcagctttcgctggcgtggctcgtgttggcagagctggagctgctttgcgcaacaggagtcaacgtgattcagcgagcaaacggtagccgtccatctcgcccccgccacacgaatctcgaggccggaaaaccatgtccggctcccagttttacaggctgtggccattgcattaccacctcttcttctgccgctacagtccgagatccccaggcacggatcttggcgcttaatgaagtgataatttttactggttattagtaggtggcagtctggcagacatgccccttggcccttgccatatgactactacttgcaggaattgttcgtcggatgaaagaatgccatgaatatcatagataccatggctttatttagtgctgtggaccaagcaactttgcataaaagaaacagtagcagacagaacagacaggaggagcaaagactggcaatcgccgtcgccggaagccaaacagaagatgaaaatattaaatggtacagatcgcagatcgtgggcctcttggcatgttggaccatagccattcacagtgctccgacgtgtcattcggccatcgctcgacacgtcggagattcgcagccagctaggcgtcacgcgcgaccaaaccaagtccgcggagcatactttggccacccgttcttctgcaactatctgacaactcgagggcgcgcggcgtgggggagaacggcgcggccgcgttgtggaggtcgtggcctcgcccttcctcccacgacccccttcgcggggagctcgagcaggagcccagcggcggcggcgcagccatggaggtagtcttaccaggtaaaccggcgaatgacggcgatgacgaccacgacttcacccatcccgatctgcgcccccttcgggagttcgccggccgtctcgatccgtggcgccgggagctcgccggcagtctcgatccgtgtcgctgtgagctcgccggccgcctcgatctcacccatccccatctctacgtcctccgggatctcgtcggccctgtcccacctcgatttgcgccgcctggaggaggaggaggaggaggagaggaagcagcagtagcacgggatcgatctgaagaagcggcggaggagaaggagcagcggcacgggagagagaaggagcagcgcacgtacgggagattgatcgatttgctcggggagagagatgggtggggaaaggtattcccgtggtgggcccagcgtgagaaaaaaaaatctgttatggaccccacccaaagctacacgcactggggagacaggagcttcgtctgttttttgcctatgtggaggctgggcttctcgctgagacggtggcgcattgctaatgccctaatgatgttgtttactagcaaacacagttgtatcaatcaatcacacacaggagtcctacccaatggaattcagtggattagcaacgcacccagttagagcaaagacgcaatcatgatgaattcatgggggatatacagcttaaggattagcagtcgacatgcatccctgacggaacaacgaaagtggcaagtgtacagggaatgtgacggtgtatacaggtcccctcgttccattagaacaacagcacacacaacctcacggcctgacgactactaccaattacacaggaaaattgccatccacgaaaaacatccgccgatcaggacagtggcagggattttctcttcgcttctcctttcattttccccccttactccattggacgaggagcacgataataggcagggacagtggcggggaagaacatatgcctcacaccttcagctttgatgatggggaaaattataccacatgcactctgcagtgaaaactctggattagcaatagtatagaaacgggaaaaaaaagtctatttagggtttagcgtttagggtttaggatagggaatgaaaaaattgtatagaaaactgtccatgaatggtaccacgatggaaatagtaaagtttgaaaactttgaagaataagatttgagatactcacggaaatcagtcttacgccgatccacatgcgtttaggtgaagggaggggaagcattaggcgaccgacaccatagatagcgacagcaaagaaatgtgccactaaactcaatggtcgaggattcagaccagacagaagagcaataggcccatttgaaaagacacctccaaggctcaagtaatcaaagcaggcttggcgcatctcattcctagcctgatcaggtgaggcactgaaaaccttgtatagagcaccagctaatgtgtttatggtagaagcaaccggctgtgaacatgaaagcgccatacattagacagcatacattttgaaaggtgggtggtaaattgtgaaatgaagagtgaagactaaccttccgcagtgtatagaatgattcaaggtatttgcaaagagcagatgcatcatgcagattgcggagaggcttgagaagattacgtagcacaacaatgtcagataatgcaacagtcattccgccaccagtcaaaggatgccgcatgttgaatgcatcacccatcaaaagtgcaccaggggttggatgtggagcagccggcatgctcctgtttggcattgttcttatgcttcccttatcaatggctgctatgaatgaatcatagatttctggaggaatctgtcaacagaacatttccattgacatttagttgctatgagtaggcaagcaaaaactcgggacaagactgactgaaatagcaaaataatacctgaggtgcaaccactgttttgagatattttgccatttcaccgtttgctatggaaggcaccttctgaccagggacatcaaccaaacagcgaacttcagtgctgcttattgggtaaaataggataggtgaaggattggccaggacaacatggccatggtttgcatgaggaagttgacaattctccaggaccagcccaacaaaacaagatggtacatcaacctaaccacatatttccatcagtattagatcttctacatgcatgaacaaaaaaggatagtgcaaaatctaaaaactgtacctttggagagcaaagggcgcggcgaaggtttgagaaacagccatcgcatacaattgtcagaggtgcatatgcttttaattcttcacctgacttggtcttgtatttaacacccttaactgtaccatcttcttcaaccaatgatgtaacagttccttgctccaattgaacactgaaatataaaacataatgccaaacatttacctcatgtcacatgcaggtgcacgaattagatacatccagatacggcgcatgtagaaggaaagaacatgtgaaatacatcattctggacgagtagcaaaataagcacttaaacataatctaatattttaatcctctagaggcaactaaaatactaatgaaatgctcacatcaaacaatacaagaaaatcataaaaataagtatgtcaaaaattctagtaaagataaatttgtgtcgagaaagactattacttaggcaaagatgcagctttctggcgcatcctctgtataaaccgtccattgtgaaagctcctaccagcaacatctgagtggaacttctccaagggataggagagttttgtgtctttcccatctttgaataacgcgtaaccaaggacacgctgagcatctatttcttgaacacaatctgaatatagttaaagatttagtccactgtaccactaatactataagaaatatgcgcgcgcgcgtgcacatacacacatacatagagagataaggggaagcttaccctcgagacccaactcgatcaatttcaggtagccaccaggttgtaacagttcaccgacaattctatcaggctctgttaggtctctctctataacatgcacacgacggccatcctaagtcacaaaaagaaaaaaaaagcgataagagaaatct

SEQ ID NO: 56891 - DNA, 18099 bp, Oryza sativa
ccataagtttttattagagagcaaaaatgatacagtagaggtgcttttaacaaatacagaagcactaggtggacgaacggaacatcgcaacccacaaaactacaaacattagaatctcagtataaaatcatgtattaatcgataagtctctgaataacaagggcaaattgtgatcatatcaatacaaaataatattattgaaagtaattttaaggtgaaatgcagtgaattcatatggcaatgggcaacctaggtgtttttaagcatattgattgtcagcttttggaagtttgtgcagactcaaaaatataatacatccgatgattatttttataggggatgctttttttgaaaagtttattaaactttagcaattgatttatcataaaatatattcttcaaactataaaaccgacattttgtgagagcacgttgaaatgcgagccaatttgtataatttttatacactaaatgtacttgtaaattgactatggtcaatatgtatatattttgaccttttttaaaattaaaacagcccttgttaaaatcatcattgggagtatcatttacaaagaacaaacgtgctaggtatagtatcccctccattgaatggttgatggtaatacaaacatttagttctaatgacattgtcaaccatgcctccactgttctcactatcctttgtgtgtatacaatttacgctcacacaaagtgttctcactcatatttcaaaagcagtcatggggtgagttagtcattttctcctggacctatctcaattttaccacctcctaagtttgcgcaaagtcaagaactcaagatatgcccaagcagtatcagtttttctatcaagaaggtgtcactctcatagttgctgggagttgggaaaataaattgggtcattgatttagttgggcattccattgtgtcaagatagagcacataaatgctctgttgatgcagatagaaaggagcatgataaagaatagaaaaccagagaagggaacacaagtgactctttgcttctatataagaaaagatatagtaatggagttacagtagttccagactagaagataaactgtatacagtcggaattatattggacatgctctatacaacttgtttgagaaaaacttttcggtttgagttaatttatattgttattactgcagtaaaagatttgcatcaccaatcaacaaaatctgttttgctataaccaaaattgtattggttttatagaacacctgagattcatcttttatttttattcaaatcatgtattaactctcctcttggttgtcactttctgtcccttttctgctgcatccagatgacttgtggtcaccggccacggccagtatggagtactgcagatggaaaagagagatttctcatcacagttacaagacatgcgattttttgcacaccaacatttattggccacacaaatttcatgtccacaaaaaaggaagagaccaacagacttcgctttctaccggcacgctagaacatgcaaaaatattgatcaaaacaagaaattgcatgaaatcacaattaattcatacacgaatctagtcttcttggattaagacatcagctgcctttccagaaataaatcaaagctcgacgcatgcataaacaggggttggcaatttgtacttaagactctgcttcaggatagaaaaattcgtccttgcgcctaacttaccggaaaaaaaatattcaatcttgcagtgttcttcaatcttttttttttgaatcaccctgttctcaacgaagcgtaagcaacaaatttgcagatttaaaaagaagaagaacccatctaagtaggcgaactaagtaggcgagaaggagtcacctttccgagcgtgtatgccagcgcagatccggcgaccccggctccgacgacgatgacgtcggtccggccatccccgccgcacccttcgccgtcggccaccccgcagccacccacggccgcaggcttccctgccaacggcgcccgccgccggcgccggcggctgccaagaagcgcggcggcgaggaagatcgccgcgaggagcgtggccacggcgacgccaatgagctgcccggtgccggcggcgacctccgccatcccgcaccaatagtggtgaggcctcctcggccgctccgcgcgtggtggtgggcttctctgctgcggtcgtggggcggcgccgatgcgcgtcgcggcgaggcggcggcgggcgagaggggagaagggaagcagcggtggtggtggtgggaggagcaggcggagacgggcggatgcttcgagattgttccgatttatcgggagcggaggggaaggaggaagaagaggaggactcctccctccggttttcatagctggctcggctcggctcctcctccgcatcgctggatttttcccaactcccaaaaatacgattttgacgtctctttttttgagttttttttgtctgtttagtttcaaacaatttttttttggcgctattacattgaatgtttggacatatgcattaagtattaagtatcaaatgtagaaaaaaaatcaattacacagttcgccataaaattgcgagacgaatcttttaagtctaattgtgttatgatttgacaatgtgatgctacggtaaatatttgctaataacgaattaattagacttaataaattcgtctcacaactttttggcggaatctgtaatttattttattattagactacgtttaatattttaaatgtgtgtctgtatattcgatgtaacatgtagggataaaattttttacaactaaacaggtccaaatgggcaaattttgttttgttctggcgttgcaacttgtattacaagaggtggccacgtcgtcatagtccgcgtcaagggtcctgcctaacaaatgaattcatttcatacggttggtttgttctgtaaacttatcagatatcttcgtctacaatatctggtggccgggttgtgatactattttgtggcacataaaaatatacatattttatgatacacgtcgattggtaggactcgaaaagaaatttgataatatatcactctctatagcaatcaagggtaccgttgaaccgagagggtattaatggagttggcagaaattatttgcagtcatgatcaaaataatgtatgtcaaaacttattgtgagaaaatgattcatgctatgtgaatcaccacatattgatcatctctatgataaataaaacatgtcacttcaaattatatgtcgacataatcttcaaaatctactaatatatctctttgaagtgaaactagatagagatttttaccttgcaaagaaaaaaaggatccatattatagaatgtcgcgagagatgagtagagccacgcaaccataatgtcgatcaactgcagcatgcgcaaaataagatgaacggatatcaaccatcatcttaatttttccaacacaacatcaaaaccaatatcacacagaacaagtcgacaacctgtactataaagtcgtatcgccaatttgatcatcgatagcccaacaagcaatcctttatgtgtcttcatcaattaccgtgcaatcatttcaaaaatttttatggaatactaattctaaaacctcactacactggctggaggacacacggagagctagactagagttgtgacggaagttttagtggacgatgatgataaggaacacaacgtaacctttgaaattatctttttttttttcactgcaccttcatattgttaaatatctacttcatccgttttaaaatataagactttctagcattgcccacattcatatagatgtatgtgtctaaattcattaacatctatatgaaagtggacaatgctaaaaagtcttataacctgaaatagagatagtatatgacttggtgatgtatactattaggttttattttttatttataacatttttctaaattgtttgcgaggagcatgatacatacctagcactcaacaaaatttgtattctttataggatattgccgtgtactacctcctttactttaaaatataagttttgtttggattcaaaaagttaatatattttgagtcggatatatatatttttttcaatccaccaaacatagtactaacaataattttggaattgtctgaacatgaaaaacccacgaagtgggtgtaaaacacaccgacaaaaacacatccactagactcggagtcctattggttgacgtaataaagcaaaacaaaagttaaaatttgaatttttcgaatttaattttgaagttgattttaggatattttcaatacatattttttcagcgttggtttttaactcgttacaaataaatatataaagattttaccaataaatcaattcttattttcaaataaatcattttggcttgcaaggacgagcctctcgtactctaaacctttgtgccgttgcactggtccccctgtgggactgggaccgggtgatctgtcacgcgatctgaccgcacatacgccctcgccgatcgctagctgcccctcccctgcctgccgctctgtgccaactcacgtgcagcgatctgcccgcagcagcagcagcgtctcgcgcgcaccacactattctcagatttgttgtatgctgcatggcaaccaaacccatcaagggctcaagccccggccgcacgtacacgaggcacgagagttcaccgacacgctcgcgaatcccccgttgtatgttttggagtagtattcctacttttctgtatgcgatgagatattttaaagtctcattggttgctcacatttactaataaaccaaaacagtttatcagacaatagtaatatttaatttatagtataaaatttttatatatgtgttctcagcgactaaaattttaatgtaaaaaaatacattgaattttttaaatcaatttttaatttaattttaaaaatttaaattttagcttcggttttgttctggtttattagactggggaggttagtttagtggggtggtttggtgagatcagatatgccatgggccatgggatcagacgccgctgcccataccagtaccacggacctctgcaagttgcaagaatgcttcaccatatgaggagaacaatgattgctcgtatatgatcgtatcgatattctttattgatttgtggaccaagcggtagttttggttgttctatcagaccatcacttgtgtagcgtgatggattctgtcacagtaattgggtttcatatttgcttattaacgtacgatttcacacataatatttttttcgggtggtttctgtactcgcatgttcctcttgtgttaagaagttcagagatgatggatactaggcaagatcagtgtttattgcaaaacatagctttaaggtggaccatatgtcagttgatcatagttgttataattgctacagtgtttaagttttgtatgggtaagatccatttacaaataaaaaagacttcaaatcaaccttttattgagtggggagagaacgaagcaaaaggagaagagagattcttatagatactttttttattcccttgaggttgcccgtgaacttatggttgttttttttcccagcttatgttcagtgccacaaatggctatggttcatcttaagagccttaaggttactctttcataatattatggttggtctaaatcattaatgtagcatacattatatattttgataaaataaagaaaccaaataattaaaatggaagataattttgaaaaggcattgttctttgcaaacctggctttgctatctttccttaatttgtttactagcattattgttgtgctttatttaaatacgtggtcgataaacagtgctgtttaaatagaaataacaagaataattttagcctgcaatttagtaatcgcgtactaccgcatttatttgatgcgatctgatggtcacctttttaaaattaaggacgaatccacacatgtgcgtgcatccttgcaggggccaatcatgtgcgcgcctagctagctgtgctaccttcaactcttcaaggccaacatatatctcaaattctttattagctacagatccatgattcaaacaaaaatcattagctcaaggtgggtttgaagactgaggtagtgtttggttgcaaggatcggataggatgagatggggcgaacccacttttagaggtgtttggtttaggggtgggtgggatgggttgatctctggagaggaatattcctctaagatctgggaccaactgatctccaaaaaactagcggacgaactcgtcccacctgggacgagcgaacggcgtcaccgcgccatccgccacctctgcgagctccgccgcgcgtctgcgagcgtcatcgcctccctgagcgccgccgcctcgtccacgcccgccgccacctccgcgcgtccacgagcgccgccgcctcctcctcctccatgaccactgccgcctccacgagcgccgccgcttgtccgcgagcaccgccacctccgcgagcactgccgccactcctctcagatccgggagccgcctcgccaccgcgcccgccgccgcctccacgagcgccgccacctccgtgagcgccaccaccacgagcgccgccacctccgcgagcaccgccggcgctcctctcagatccgggagccgcctcgcctccgcacccgccgccgcctccgtctcgtccacaaccgccgcttgtctgcaaccgccgccacctccgcgaacgccgccgccgctgctcctctcagatccgagcaccgccgagctactccgcccccagacggtactaacggtgagtacaaattcgtccatctcatcccacctcaatcccttctaccaaacagaaaactataaccatcccataccataaaccaaacagataactggaatcatcccatcccgcaaaactaggataggtctaacccatcccactttatccctaaaccaaacattacctaaagggatagatgcaactcttttccgcaagtagacgaaaatgtattccctccatcccataggacatgctagaatggatattacgtgttctaataaaataaatttaaatatatccaataccatattatattttatgttggtttttacacgaggaaatgggtactatctaaattaactaaggaagttgtctcatatcattaaatgaaaagcatgcctttagttttgtttactatcaaagtacttttgttttttaaaaaacaatacaaatgcatatacttatatacacatgcaaaatacgcacatcttaccatgtgaacatcttcgagagactaaatcgatataaaagtcttcatattaacatgtacgttatccagcactaaaaataattagtttgtaaagtcgagtaactgtaacacgccatgcttgctctgtcgtcccagataaggtacactccaaccccatcatgctgcctctacaagactacaacacactccaatattgtagggtatcgtgcttgatctgtttcagccaaagccatgcaacgctctggccccatcatgccgcctctacaaacccaacccccatcccacgccccctaacaaaaaggaaaaaaaaaaggaaaagcatggtctttttttctttttgaaaactaaaagcatggtcaatatggctgaagaccatgctgcagttgttgcacgagatacccctccatcccacggagacttttttttttaacacgcacagagacttcatttttaggtttctctgtccaacacttaaccgcatgtcttatttaaaaaatttataattttttttaaaattagccacgtataaagtattatattttattatctaacaacaacaaaaaatactattatataaaccttttaaataagacgaatatgaagtgttttttaataaggtgcctgatttgcctccctatgaaaaagagcttatttaactatcctccatttaggtttaatcgtcatattttgacccgatacaaggaccaagaacaacaagcacacttagagcaataatatagccaactactaactccaaaaattaacacatcatctatagctaacttaatagcctactaatataatagttaactatggatacatactacaccattaatgttttccccacatttctctctcacatatgttactacaccattttcctctctctctcctcttctatttcctccacataatagtatagtccactactaacttcaaatcatctatagccaatgtaataaccaattcatacaatagttgcttactatgcaattaatacctagtcccacctgtggtacacacattacgtctttgagtccgtgctacagctgactacaaatttgtaacccgctactcttctctctctttcttatctctttaaaatatgtttatagctggcttatcgcctgctattgtacctgctctaagtatgaatatgatgtggcaacatatatagcccgcttacatcatcttattatactcgctcttatcatcttcctaatctattcctacaccaactgaccagcatgcctatcgtaatgggccgtgcaagcttgacaatcaaggtgaaacaaacgatatgtagctaattgtaaatgacattaatttagcatgcatgcaatgagcttttgagaagtgctcccgaggcgtcaacacaacggctggttaatttcgcatgtcaactgaaaagggccacagcttgccgattgcaaatgtgacgatcaaacttgaaaatccaattttttttttgaaatgtgataatcaaacttgaacggagggtgtattatttttagaaacactgtacaaaaacagaagctcacaacatgtgcatactcacccctatgaagacacacaggcacaccctacccctatgagcacctccgacaaaagactaggccaacatatcatgagattgaagaaatctccataggcatctcgctatcgatgagtgcatttcctaacactgaaagaataattagccgtaaatatgagcatccgtatcaagtttgggacttgaactacgctagaaagtgacaaatactaacctagccagttgactacgctcacttcgcggctatttaactatttaccactttgggaggatgagtggtaaattatttatcactttctaagaaagggtactgtgatagagattaaatgatcaagcttgtgggacaacatgacagcatgaacactacagaatgtgttcctataaaaagtagttatgcctactacaggatgtgttccgagtatgttgtgatcctataaagttagtagtgatgtcttaagaaaaaaagaaaatgcatacaatagaaagttgggatcctgctcgtgggacgatgtgacaacatgaacccacgaccttgaattcctcgtccccaacccctccccccaatcctccgccttgctcatcccgtcctaaccgcctagtctcatcaggaagcggcaggatcgacaatggcattggttgtgacaaaagagaccttccctaaggaagcgatggcggtggcaggaggaggggcagtcaagagcaaggttgtagctggcgtacacaaacaagatctaggaggttgtggaggaagccgtcatggataagcctaatgagatttaggttgtgacactagggtcaacgaggctatgtaaagcaagatcagggatggcctcgacgatgcagatctaggaggtcactagtggttggtggcactggcctaactcacttgcatggttcaacttcgggcgaaggatcttgacaagcctagatccatgtagctacgacaaccatgatcctatgtgtcgatgcctcgatggtgagagcatacagggaccgcccaatccgaccgtcgatgccatcttcctcgcaaagtccgaccgtcaacttgcgatcgtggcagtcgctgtcctccaccacactaggttcattcatgtcaacctgcgccaccacatcgaccttcatccattaaccatgcatccgtccaaggcaaaccatccttactgctgagcactgccgtcgattttagatgtgcctccttgaatccatatcctcaaaagcaagtctaagcgagacgacacaatttggcttcacatgatagcatcccaccatgaatacgatactaatgggtatgagctagggaattgatgggggtataagtttggtatctatgagtatcaaaccttgtaccagtctgacatcaagtatcgtttggagagatgggcacaagatcccatcctgtagcagcccctaaaatttagcgtacgcttttctttcgtattttcttctttcattttgtaaacaacttattagcgaagctgcaacttgataattcataggggtcatggtgtctaaaccgagttacctaactaggaaaaacctattccgaagttcttccaaaacgtgacaggttgggcagttttaccgaagtggactaatccctgcccatagcaaatgtttgctgtcatatttcaatctaggatgttgcggcataacctgggtgtggagacatgaacgagtcgaaccctatttatcatgatgtaatatcaaagaagtggcatgcgagggggctttgtgttgattcaaactgaccatcgaaacagtgatgacgcaccctcaatagcgtagtactactaggcaacattgagtgaattttcggcatgattgatgcatttccttttcgccgcgaaaactacagcactgcagacacatgtacatatgggaccaaccgaagccgtacagaaaagtagctatcgacagaactccaccccaaagattaccattttaattttcaaatatcaacttccaatatgaacgctactgtagacactactggagaagtgatctttgccgggttgcccaaaatctacaatagtcctggttcaaccaaaaaaggggactaaaaaccatttttaatccaggtttaaaagtgcagcgggactatagaatctttagtcccagttctatttatgtcagaggatgtcagggcgccagagatttatagtcccggttagtaacaccaaccggcactaaaaatccatctttagtcccggttggagttactaaaccgggagtaaatatttctctcccatcttcgatcggttaagtcctagacaagactttcctcatcaccgagatatttagataagatcggatcatcccctctcctcctcccctcccatccggcggccggtggggccgcaggcggcaggcgccggccgtcgggagagggggcggggggcgcgcatgcatggaggcggggcgccctctcctctaccggcatcctttctttttttttatatataatttgtgattcgctaagatgtataatttctttattttagaatttgtgattcattgcataaatatgagatgtataatctgtgatgtatttgatttgtgtgtataagtaacttaggatttgtgatgtgaagatttgggatgttactttgatttagggatttggggatatgcatggcactcaatttaatttgggagaaaatatagggattaactctggcaagtagcgagaaaacaatggaaaaaacaaaagaaaagaggaccaatcaggactgtcgcattcgcgtacgtacgtattcattgcgtctggttggaggctggtggtgttttgatcagacactaaagggttcgatcgttccagcagtgacggtggactgtttagccgcacacaaaacaaaacggaaaatacacttagtatataattaattaagtattaatatatatatatttttaaataaatttgttggattttttaacaacttttttattgaaagttttcgcataaaatatatcatttagcagtttgaaaagctaacggaaaacgaggagaatctaatcatgaaaagctgaaacgatcgcaccctaaattctacgtcacatcggatgtttggacagtaattagagtattaaacgtagactaataataaaactaattatataaatgagagctaatttgagagacaaattattatggattaattaggcttaatagattcgtctcgcgaattagtatagggttatgaaatgggttttgtgtttaatatttttaattagggttcaaacatatgatatgataggaatttaatcatggatctaaacagggtcaagctaggcccgcctggagctgagtcagttgcaggtttgcaacacttgcaagttgcaacacacgtgtcttaaaatttgttcgttcgtttcgtcagtggtatgggtagcatttatctacacgctgacgtctccatcgtgataacatcaggtgggtcaaatatagtaatggcgaagcataatctttttagtcctatagtagaaactagagtgtgtatagttttcaatttattcttgcttagttagcttgagtgtgtactacactactacttaattagttgggttcaagtcattgtcaatctgaggttaaggctgctttagtacgagcaaatacatacatgtgcagttaagttatattgcaccaaaaaaataatatgtagtgcaaatccctgtatatactacaaatctgaaaactattgtagtatatatacggtagttttcaggtttataatttgcactacgtataacacatatactgcgtatctgtagagctactgaacatttgtctgaacctgtcgagtcgagcatgagcctagctagctggctaatggcttgctggagataactcgttgtctcgttgaacagttgaaggccttgattattaataaaatatttcgcgaatgcgattattaataaaatatggagggagtattattgttttagatcgaccgcaaccgtgtggcaccgctggggcgtgcgttctgtcgagtctctggatgattaaacctgaagccttgatggcctcgatcagaatattcgtttggtccgagagttgtacatttaagagaagctcgtactggggtgtttgggtgctatctcacgaaaaataagtccctttttaagagcccctttgaatcacaggattgaaaaaacgtaggaataggaaaaacgtaggattttggtacgagtgtaagtgtaaaacagaggattgcaaaacacaagaaaaacacaggaatggctatttgattggaccgcaggaaaaacgcaagaattagaggagagatgaagattcataggaaagtttccatgaggtagaacctcatgctagatttcctccaaaacttgcatgtctttaggcattccataggaatttcataggatttcataggattcattcttttgattcaaatggctatataggaaaaattactataggaatggaatcctttaaaattcctatgaattacctttgaatcaaagggggcctaaaaacttatttttgacacccaaacaccccaggccccatcgtttggttttttttcctaataagtcaaaacgacttattagagaataaaaataaatttgtaggtaaaacttttatatatatgttcttggtgacttaaaaaccaatactgaaaaaaaactacgttgaaaatatctcaaaatcaatcttagaattaagtttaaaaatttaaaatttagctttttctttagcttattaggccatccgatgggagccccccttagctaggagaggataagaggactacgccaaacaacacctcgtgcgttcgggagaaggagagttaaaagaactttttcttcccgcatgaaaaacaagttaccttattaacatatgattaattaaatattagtaaaaacttaaaaactagattagtacgattctttaaaataactttcctatatatatatatatatatatatatatatatatatatatatatatatatatatatatatatatatatatatatatatatatatatttaaaaaatattctgtttagcagttaaaaaatatacacatgaaaaacaaaagaacaaagttggcaaatgagagaagaacccaccaaagaatggattccagccatgcatttgccgtttagtacgtcgccgggccaggttcaaaaggcaaaaggacatgagacaaatgaactgcattttcccttttcttttctatttttttggtctgcgtggagtgatccttgtctaactccaacctggagccctggacttttgcacgagtgcatgccacgcagatctgatgtgacatatctgcaattcggcaagcactacggcgattacaaattaagggggaggacgttgaaactttttgttggaagagaaggcccataaattatatactactgtaccatttcccccactaagcatttgagacgtcattgttatcaagtaatgctgaacaaaccgttgcaattgcagccataaaaatgaagcacgaaaatcaaacgggcacgccgacgaagaaaaatgcccgaatgagcaacgaaaagccaggacgaaaccgaagatccgacaacctgttgccgatcaaaagacagttgtccggccccatcgccccggcatgatctgaagctaatccggatgtggggcttctatttcaggttcgttgcacatttgcatcccagaacaatcacttcagaattcaggtatcaaaccaaaagacgtactacttgattcatatttctctgagagattcaaatgaaatcgaaatgatattcactttttaaccaaaaaggtatcgtgcaccacctttcaatacaacaaacatgagtttttctacaccggctagttgtaacagcatggaacaatacatacactaataaggaccgatacatctcttcaagaaaagagtagcagaaaatgcatcacagcagcagctctcattcatcagtgtgctggattgttttacacgcgtattaatcttgttcagctcaaccatccctcctgcatttgtgcagaggaagaaaattccacttattcgacgaatacatgggattccttttgttcttgttcaactctgctgtatagcaacagctgttggcagttggtgctgaactggtagcatgctgtcttaacagtgaggaaaggtttactgatgatccctttggtgcaaagtgtatgtatgtagtcaaggaaatcaaatgattagccagcagtctgtactctgctccatcggttgtcatcattatcaatctggcgaatatagctatatcggttttctcttatgtaagtcactccagaccatattccacgaacaagaaggatggtcacgaacaccatacttccaaatgtgcacaccacctgagcacaaacaatataaacagttactgaaggaaaggcatggcactagaagacagtgtgtaggggtgtcagttgaagagagtaacagtcagtactcagtagccctgcttgagaaccagggtgtagtttaagcttgtatgcaattataagggttaggaccgtacgatttacaccccacacccacccgccctgcgcgaactacactacaataccggacatttgacacctccaagctattgaatctggacaaattacccccctggcaaaaaacggagtggttttgatactacatggtgttaatttggtcacatggcaatccactcagcaagattatgaaataattttacaaaatccgactgtccccatttgccagcatatattccttcttaccccttctctctctcttggatccaggcgacatcgccatctactccttgcagccaccaccttggcctctctgctcactgccttcagatcgacggaaggaaggggaaggcaagcgacaggagtggagggaggggaagcgacggaggacaatggcacgaccttgtggaggatagcggtggaccgagctcatccagaaggggaagcccgccagacgctgggggttggggtgggtatgggatcaaacttgacagcagtagcagtaggctctttctctactaaacagaattcataatttcactaaagagaatcatcttaataagacgaaccatttccatctattatcaataggaaatgttacaacgaataaaaaactcgtattccaaaagcaccagaggtaaatcacatgaccaaactaccagaatgctaagaaatgaaatttgctgaaagtgtcagtgcaaaagaatacaagattcattctcatttggtctgaattcatccatcgaaaacgccattataagcattaagtaatctcatgattctaaactacttgtatgtctcccagaaacaaacttgtacttgtaatgcatgtggagtatttgttatttcatcacaatttttttttataattttctgaattgaaagcataactgtttattgatcataagcatgactccaatcaaagagtagacaatcaataaggaatgattgaaccatgtgctgatgtgcaccattccctactctgagtatatatgcacattattatatactctgtactagaacatgtttttgttttatgctcaaaactgggagcaagcatctagtacaagggaaaagagggcatcacttcaacaaagtgaggattctcatctacacgtgacagttagagaaaaggacaatcttttttgtggtatcatatacacttgtctggttctcatccatgttcatcaaacttggttgaccaaaatttgaaaaccaaatttacgagacatcagaatgaagggaaaaaactcaaatcaaacatttaaaagtgtcatatcagcatgtaatcagacactgattgtcttcttcactctctaagcgaatgacaacgaaggtagaacacccatttgttctctggacatacatgaaattcagaagcatgcacaatgtttgttctctggacatataatgttattccattatatgtcactgttagtatcagcggaggagccaagccccagcaactgtggctggtctccaggctctgcgatcagcacatgagcaagacagcactccatcaattactacttgatctgctggttcgaatgggagccaaaccaaccaagcaaactacttgatatgccggtttgaatgtttgctgcacgagggtcaaaccgacacaactctaagctagcactcatcaccacatttgtcaggatgataatagccccatagtctagcccattggcaatagacagccatcatctcaacgatataatctctcgtacgtactggttttgctcttcctaaatcacaacttggcagctgtcggttttgcttgcgttcatagtatatggtctatggaagtatggagctatactgattttttatgtacttgttatacatcactaggtttgaccaggctcaagaaaattcctgaatcctccactggatagtatcacagtgtaacacttagtagttcatatcaagggcatgatcacaatcagctcacaattttgaaacaagcctcagacaaatgaattgctcacctcaagtagcccctttaggacccatagaaacgtgagaacaagcacgccgttgaccgagaacttcacctgcacaagcataaactaaacatatcaaggccagatcacacaatacagagaaggatccgctcaatttgaacaagaagaagattgaaaccaaaggggagaaacggaagggttgaacggaccagctcagcggggacggaaggcggcagcacggacctggcggcgcggcgcgcgcggcgggagaccttcctgaacaccgagtgcaggaagcggaccaggaggtccaggctgcggtcctcgtcgtcgtcgtcgttttcgtcatcctcctcccccgcgtcgtcgtcgtcctcttccctgccgtcccggtaggacgcggcggcgcccgagaggtcgccgacccaggggcgggcgtccgggacgacgacgacggcgtcggggtggcggcggcgggcggcgcggaggaggcggatcggtggcaaggggcggaggtggcgaggggaggggtggaggtggcggggggaggaggaaggggccgggaggagaggagggaggagggaggcggtggtcgccatgggaggcagctgcgattggaaagcaggtgtgtttttttcttccttttttttatctctatacttttttcaggttctttacagttactctcggtcacagtctcagagagtaagcgtggtgaaacggctgattattcgtaggcaaaaacgagagagataattacgctacgattaattaagtatcaaaattttaaaacttaagaattatatttattttttattttaaagtatttgctat

SEQ ID NO: 56892 - DNA, 3370 bp, Oryza sativa
ttgagaagaaatacagacttctaattgcagctcatgattttctgaaaaaatatccaagtgaattcccacaataaattttatcctagttataacaataatagaattaaaatagcatttacccgttgcaacgcacgggcattttttctagtaataatataaattgtgggatccaaatattagtggtaggggtgaatgatagaatggacaccaccattactagtagtatagataacaactttccagtatccttatctaagttgaagccagattaaaggctcctttgatttgatttataggggaacatagaaaaattaaagaatttcaatcttaaaaagaaaatcctaagaaaacctttgaaacaaaatattatcattttctttaaaatttctatagaatgggtaattctatgaagattgtggaagaagttagcaaaaatttccaactcttgaagaattttctttaagacttatctctctaattctattcctatgttttttctatggtctattcaaacgatcatttctatatgtttatatgttttgcacatatatttctatccaaattctatgttttcttatttccctttttttttcaatcccaaacttttatacttgaggcttgaaaacaaacatttttttcctcctaaatcctaaaaaacctgtacatacaataataactatatgtcaaataatcaattcattagcaaatggtacctacttgttttaatcacgtcctatttcaatttttgaaacctaattttagaattaaatcattttcctcgctttcgattcttaccataagatttggaccactgaaagtgaaactacaaacgtcttaccctatattttatcttactccggccatgtttttcggcttataggtattattagatgaatgggtgaatctgatcgagtttatgaccattattcggtggcacaaataaaaaaattaaatattagaaaagttgatgatttgatttaaaagaagtttaccaataaatgttgataaaaatgtcttttttcagaaaatgtattgtttaggagcttggagaacatgtatgcaataatccataattcgtaagcaatcaagatctatcctaagcccccatttgaatcactcgctgttttatattactttgttttttaggagttttgtctttaagtgtatctttgatggtatagtttaacatcataacatttacctttttagattcactataaaaatactttcataatatacattttgtatgttgttaaaatatacatatttctataagtagagatcaaagatagaaacatttgactcaagacaaaccagaatgacaaataatttgaaattgagcaaacagatgaaatgtaaataaacatcgatggacaatctacttatttatttttaatgataaattgaatattatatattataacctaccccgcctgtcttaaaaatagcaacctacgatcagattaaacacaatctaggtccaaattcgtgatcttaggagtaatgtttaatccagttgtagttcctatattttgaaataaagggaataataaataggttagcacaagtagtctaaacaaattcgttgtaaaaagtttttttttttaagaaatcgtagcaaaaattttatggcaataatccaagtagacccatttgccaccaaacccagttacacaaccaatccaagcagaaacagtacaacacaccaaatctcaaactttcatcttttcgattagtcaaactgtacaatgattaggctacagagttttcctcgagaacttcgacgacaccaaattcgctcaccccaatggaaacctgtgtgcagcctttgcaaacctgaaagagtgcatccctccattagcagtccaacgcgcgatcatttcaggactttcaggcgtgtcaattgttcatcaccagctgctgactagctactccactttcatcgaatctgcagcatcacgatcgccagaatttcagctgcagaagaaatgtatttaaaaaaagcaagtagggcagtggagctctgaaaaataccagagttctctaagctactggtgccagcggcgtctgaagcgaaaccggccggagcaatgttgcgaagttcctcgttccagatgaggcctctctgctgcagcaaagaaaacatgaataactctcggctgttctgaaggatttgaactactgtattcactggagttagatgtagacctgaggaaacgaagccaagtgaccggcccttgccaaatgaacatctgcgggatttgggacacacacactcccgtacaagccaggaggtgagaggcattgctgagccgccctgtaaaggttaggatgggcattgctcaattgcgggctgcatcccagaaatgcggagcgagcatcttgtgaacaaaggatctgtatggcagtgaaaaagaaaggatcaaggtgtagcaatggtgatagatgagttatttgttcttcagagttggagttttttcatcttacatcttgcaggtcgaggtcagagttcaactcaggactgattgtcgagagcttcatcgagaggaactgcaaaacccggcacggataagcacttcatggatagttcagtcagtgattggcattgagaagtgtaaattcttgttgacaagatgtgtaatttcgggacacttacctccacctgtcgctgcagagactggacgtagtttatgatctcgtcgagcatcatggccttccctgtaatctgctttgtcaagagcaacatgttcacacaggttagagcacaccacaccatcacagactcaaagagttattgatttcgttgctaccttgttgcatcctgggacgaggtcctgcagaagcttcatcctttcgtttatcttctcccttcgaaactgcattcagatggtgaagctgtgtgagcaagaaaatctatacacagaaagatcttccattaatgttggagagatcaattactctttctgcaaggctgtggctgttggtcgcctggccgcgttttgcccggacatgcacgtactcctccctgctagcgtcagcatcacccgccttctctccggcatgctccatgctgagttctctctgaggcatttcaccggtttcctcctgcagtagtacgattttcacgatgaaacgtgctcccacccgatgaagctaagcaaagagagcttctaattaacttgttacttgggaatgtagcgatgaactgccctcgcctgagcccttccttttactgcccttcaaacacttgtcaatgctcatgtttctacttagctgagtatctggggagttggaacacggaaactgtaatagttaggaacttcacaaattaagaaactgtggttatctaattgaaaaaaaaaaagagagg

SEQ ID NO: 56893 - DNA, 8789 bp, Oryza sativa
tagattagatagatgctagttcccaactcccaagaacatacatatgaagaaattaaacaagccaccaaccttgtgcctgatacttgatctcagggtgatattgcaatcattttaagaaatgcgtgatggccttctaaattgtcagctttgacaagtgaatgggctttacttaaagggtagggtagatcgggagctgtggcagtcaatttcttgcaaggctcaacaaggaacaactaacccttgcagccttacataaagattgtccaaagtgaaaagttaagtaagcctaatgcaatagacaaacgcaagggcaaaggtggaaaccacagtcctggaatagaattgtcggtactgctaacaaccatgcaccagctggatcacatccatgaatcagaataaaattctctgaattaagataaattgcaggtggtactgtaaaatgaagaccaaaccaaagaacagatgctattgtcatccactgtatgggccagcccagaataaggttaatgattaattaatgaaccagatccatctttgcttaaagccttaaaccctcttaaattttgtactactggattaatacccttcttcaccatttttttctgataaacccaacttacaagtttttagtttcaaagtcttattcttaacatgttcaacaattcttgcataagaggagaaaagggaacccacctttcagtggcagtgcctagatgtaaggcgtcgtttcaagtgtggtaattaatgttacagactaaaccttagtcctctctttttaatttgtaattaaacgaaatctccaacacaaagactcagattgcgtattcactggggtggatgtgaggctagaggtaacaaggacagaaggttagttgttacacagttcaaactgtcgctctgaaatctgaatggaaatgtcagaagttcgttctgtagaatcagatccacagaacaacaaagacagcaacagctaagaatgtgcaaagcttcgatgaaatcatcagagaaaccagggaagtgattaggttctatgatcgataaaagttaaaaagagagctgattgttatcagtagcaaagcagagggattcttcggctctcaacagtgagtatcgtacataccatcatccgaatttggtgctggcactgtaaatgatctgtcaagcacgacaatgactgcccgattttacacaggctgtcgacacttcgtactactcaccaattcagagcttctaccatgacagtttaagggctatctcgaaattcagaagggagaaattgattgatcccagatgcaaggacaagggttagtacaacgttgaaacttctcccctttctttaatgtgtagattgaggagaggcaaaaggacttggatggagcacagaaaccgttcagtaaaaaggctgttggcacttaatgagcaaacagctaataatgttcttgtgctgtggtttcatcaagggaaaaaacaatgcactgtctacaaagaaactattctgccaaaatgcataaaattgatgtagaaaatattgaacaagatatatatttaggatggaaggggagagttcttattaccagtcgggggtgagggctgctgccactttctctgctccacctctcttgatcagaggtgttagttactcaccagcctatggtagaacgaatagtgttcaccatgtagtggctgcatgcagagacatgtggctaggacaggaggggtgaaataaaagatactagaaggccaccactgctgcttccaccagcttcccagtgtctttatttgattacacctcggtgtaagcatagcagaagtacaacttcccttcatgaagaagactagttgcacatttgcagatttcaattgccacaagattatcctatccaccttggcttaaaaatcggtcctggttaggccttctccaacaagcaatacctgttagtatattacttgtgttgcataaggataaggtccagcatgctactagtagcagatgagagagcaaaaggcaaagctcaaagcagggtgcccaagtgtcaatcatagaagttcatcactgtgctgtttcacttcaagaggctttggaatctggagtacattgccaccatcttttgctgatgctgaagcttgagttgttgagcagcaggcaccagcagatgggggaagctggtaaggattgattggcagtggaataatacagtcaaagtgaatgcctgctgcaggagcatcctgccagcggcaggcagacgtgtgttggcagcgaattggattcttgtacttactccgctgaggctgcctgtagcttgtgcagtatcagccagctatctgtaggagtactattgttccgaggctaacagaactggatgcgtgaattgagctgggtcgctgggatgcagtatcgcttcaggtcctccactgcaatgcaatagcctttcaataatagcacaggctgagaacgtaaaacatactgtatgcaggacaaagttgaatgtgaaacagaagaattcgggtttacaggactattggtaaaaggaacaatgaggaaaatatataaggctgcgtatgaacggtagttgccacataactgaaactcaaatgctgtatttggcacggaactgaaactaaatacttttcatagagcagccaaagttcatggaaccacagagtaacgtttaaccataatttagatcaccaatcatagcattgagatatcctggcagtaaaacactcaaattcttacccatttggatttataaactctttcttcccatactccttcccccacaatcttttcagtgcaccaagccacaagcaaagagtactccccttactgaaagttgtagcttttcttggactccgtgacactccgtacagctcccatttgagtatcgtaacggtggttcagtctcagtccaaagagaagtgatcaaaaagttaaatctcatgaaagatatttcatggtttaattatgcaacataaagacagatgagtccaatagtcaatagaacatgtgtaggcaaagtagatagatgcacgcctacaccaaaaaagtgatatttctccctgcggtcaatataaagcccactttaagaaaatggagcaatctttggccccccaggtctaagactccaatggactatggagagagaagagctatatggttcactcaaccatcatagcctcaagaaaaatatggtatgggaacatcaatgtcgagttgcttcagaagtccatgaaaaaccattattgattgttatatatcgttttacaaagaaactatccatttttgcctctagtcataactcaaatatctcaaaaggttcaggcgttcagctgattatatatgtatagtgagaaatgttgataattcaagtagtgactgcagtgtaaatgtgaagcttctgtataaaatcaagaactttattgtcatatagatcctgcaacccatattcacttaggacaaaagactaaaatctcttaaaaaattatacctgaaccaaatcaaccaaatgataccacagcaaactcaacccaatagtgatgtactggcaaagtagggaatggtagactaatataataagccacctattgcgaaggaaaaataaaagtaaaagcaaatactacagtcagattcataaagtggtgcatcgacaaccaagaaaataaaccatattcgtaagtcgaagtgaaaaaaaaaaggatgactcctttattctcctttatcataaaacaagtacgcgcaaccaaaaatggatatgttaggaggaagcatcagttggagaaatccaattgagatgcaagccacgagaatattgacgatctgcgaaacattgtacaaaataaagtaacagacaaacacaaaaaggacacaaagggaataagaaattaacttaggcatgcaggtaacataacaactattcagaatatttctagaaagaaataaatagttccccagagtgcttatatatattactcacctaccaggttgtgtgacgggcttctgcatataattaccacaggtatacttatcagctagtacgatatccttcctttggtcagagtaaatgcatttacacatcatacaaccgcatgtatctgatcatcaagacacaagtttcagaatcatgttcctgctaaatacaattacaataataaggaaatgacaatcagtcatattgttttaaactgataatgtttcagtcatgttcctgctaaaagtatccccagggaacagattgctccagccccaagtactgataatgtatttgattttaaaaaatccactaaatgtcacatacgtgtgcacaaccaaaagtccttgcactgaaagcttgatcaaaacaaaagcaaacagtggtcatagtttcatagaagctttttatcaaacacagataacgtataacattaactaatgcatttaaacagggcagctcggtttcagcaatatatagaaggaaacaattgattcgtgtaatcacaaaataatatatacaatgaaaatcaggtagaaacttacaaaccataggtaaaacctggtgtaagagaaacctgccacaggatttgctcgatagtatgtcttaacaacatatcatcctcgccttggatgctatttcttatctatacatgtttgtagtgcagctcaacaaattcttactagattttattgccaaatacaaaaattctaaggtattatctgtttgctaattcgtttggcaccagtggttatagtctcgtgataagtctattgatctgttcctgatatatgttcaccttttccttctttgttttcggaccatatgctgcccaagttaatcgcactagcttagacattgattaatgagtacagcctatccagtttgtttgtccttctttgtaggatagcagttttgcacgattcagtatggaggctacaacctgtgaggctacaaccccccacgaacataaaaataacaaaataatatgcataagttgccatagcacaaaaggcaagcaagtattccaaattatcggaatatgggatgaatatatcttttcatagcatataaaacgaaaagaacaaagagatgataaggacaatacttttcttttaccaaagaaagacaccacctgcttccagttatttcacgcaaactttagaaacaagtgacagtttcaatctcatcagcagatcatgatggtatataacatgaccagtatcttgtttctccgttgatggatgaaataatcagattgactaaaggcatccaacaaatgagacttacaagttacaagtgtttgaaatgcatattgtagcacagagaattaaacagacgatactttaccatgattaaggcatgcataacactggtactacaagaaaatataggatatatcaacaaagaaagaaaagattacgagtacagtaatacagttaacaactgaacatgcataaagtgccaactataaaatatgtacaatatgttatatgtagcttttcagatgaaatattcttaacatactagcaaaacccacgaaatgacttaaccaagaaagttgcgatggtgtccaccaaaactgcagctgggtgagatgttcctgcgctgatttccaaagctgcgcccaaggagattgggatgcccgataaacgggagcatgtctgaatccccaccaatcaccggaaagccatgtggactataaggattaccccagccatagttaaaaaaaggactgggcctcttctggcccttattgttagaaaccttccaggctgctccaaacctttccttccagttcctgcccacctgagaactctcaccttgagtattgaactccatctcacacttcttcttccaaagattatcatctgcagcaagatccctcaattccttgcacgtgcattgaacccttgcaagatccaccccatgaacaaactccaagacctttgccttgacatcacctggcagcgccatcaagcacggtggcaagctcaaattgttcagttgacacaacgatatcatcagaggcaagcacatgtcatccttcaggaccctccacagctcatgaatttccctctcctctgctgtgctcacctcatcactatccaagtacaacaaaggcgcaagctccggcagctccaagcacaaccttcgcaccccgatgttgccccaggcacatgcccatacaccatcataaaattccccatcaaggagtagttcagcactgccaccatcccctcctcaaccacaggtaacgcttctacaagctctggcagggtgtacttcatcgatacggggacaaaagaacctgacgcccaattctgtggcagctgaaggcaagaccccaccgggtttgcatagaggaagccggcatcgagcaaggccgcatgcagcgccacgacaaggcgacagatgacggttccatccgcaccaccgacattctccatctctctcttcgtatccccgacgacgagactcgacttgctcttgatcacggcgaaggcctccgccatcaccacatccggtggaggatgatgcggatcggatgcgacaggtaagccaggattcgtgcacaaagcttgcggcatcgacgaggagctaccagactccacaggagatttggtcgggtcagcagctcccgcgatcgaggggacatcagggttagggttacggggcaggggttgggcctgtggctgcggctgcggcggaggcgagggcgacgggaggggggagagcgtgaagtagaggagatcaccggacgcgagcccgagggccgggagggtagcggaggggtcgggggtgaggagctcctcggagcggttgagggtgaggcgcaccgactcggcgggcacgggctgcgccgcggacagcttggtggcgaggaaggccttgacgtcggagagcgtggccgtgtccggcagctgcacgcggtgggtctcggcggcgccgccggcgccgccgcgctggtccatggatcgcaaccgaagcttcatggttcctactttcgtggaatcgtggggaatttttgcgagttggatgggcagaggctgaagcggtgtctacccgacatatgccatcagtatctcaatgacatataggactccataagtcgtgggttaagatggcatattatggaatggttacaattttcccaataatggttctgaagaggaggcaaccgtagctttgggccgtagggttacgtacgggctagctgatctgatgggccgaatggcccatttatgaagctaatgacttcggctataggaataagttcactttaggtcttagtctatgtctgaaattcgttccttaacaacaaaacttgataacgcaccctccaatttacaacaccagccaaacgaggtcgctcggcactacttttttgtccccaaatttgattgacatgtggcacttacgttgctttttttactaggggctggtttggtttaaggtctaaattaggcttatcaatatttgacaatttcaatagtgtttattgtctatttggtttgaagtcaaattttagcatgactaagaaaataggccatttgaatagtgaatttaggttattttgacttcaatccaaacacaactttgccttaccaaaattagtcatgccaaaacttgctaaaatttagcactaacaaaatttggtaaggtctatttaggccacaaaccaaaccaaccctaggtcttcatccaacatgatatgttttgtatattttttatattcaattttgctattttttttcggatcaaactaccacgtaagcgtcacgtaaatgccaagtgcgatgaagacatagtcaaagaacctacgtaggcaccacgtcaactaaaatcgaagacagtattatcgagggatctcgtttgcattacttttgtgagttagaggacgggttgtatatttttatatggttttggttaaggacgaaaatcagactgtacgctaaattgagggaactaaagggaacttgttcctcggctataccagccaaacagtgatgggctttcaagccgggttcttctgttttcggtcatgacaaacgggggcccctctcgaaacagaaaaaaagaaaaaagttttactggaaaaaaaaggaagagatgaaactttgtgtcaagtcactgaatctgtccagcgcgagaaggacattgatagacgtgtggtgcgacgtgaagcagaaggataaaccttcgtttctcacgagcaacgccaaaggcagaggtaatcaaagtggttgaccgtctggtcgctggcggacccagacgccatctcgcccgcgagcaaacgcttttacgcatggcgacacggttggcgtacacgtacggctggcgtgcatcatgcatcacaggctgtgtttatgtttcctcagcctcgataggacgagccaggtaaataagcaaatctaagctcgattaaccgggcacccccgagtttttggtacggtgtcaaagttttcagatcgtactactactactatagtgcgggcatagagatgccaactattgatgaccgaactggtgacacgtgattgtctcagtttttggggcagatttcaattgccacggaacgagcaggaactgtgaagacagacgaggcactcttgaatcaatcaccgaacaaacaaaacgctgttcccccctgtgaaaatcacaactcccgttgcaaccctcacacaaccgtgttgttgcaacttgcaaaaatcctgccgcgacaaaacaggcggggggcgcagcaagacgacaccgcgctctgtctgctgacggcgagcacgctgccctgccatgctgctaccacccctcgcgcggcaa

SEQ ID NO: 56894 - DNA, 4307 bp, Oryza sativa
gcgaccgtgtgcccgcgcccgcccatcacatgacatgcgtgcaaccacacgcccgcgcgatcgagacgatgacccccccgaccccgccaccaccgcacccacgcgcctgctcgagcgagcggcgcggggcccgtcgccccgccgcccgcctgacgccggggccgagcaagcacatggttcgctaggaggacgcacggtacgggtgactgtgcgccgctgcgagcctgcgactgcgactctgcgagcgagcaacatggttcgctagggaggaagctgtacatctgcttttggctaaattcgacttggcgcttgctggatctcgggcggctgtcgcctgtcggcacaggctgtcgcgtaaggagaggcaaaggcaattgcaagcaagcgccaaaggcaaagggggggagatagtgcgcgtcactgttgcggggtatcgcccgctctcggtttgcagccaatgtacaagggtcaaacgcctccctgtgccgccacgacactgacatggtaaaagagaccgccaagattccggtacatgccatcattgacatcattgcggcacaacgtgctgcaactccgactcccctaagccccttatcctcatgcaacgacgtacgtacagcgcgaaaaaaaaatatacgaagagagtgtaaacgatggggaacccctcagcttataagcaaatcgcaaaatttaaattttaaaactctaaattttaaagtaattttacaatctttttcagcattttacttttaaattgctataaacatacataagtatcgtttattatttacttttcaagttattgataatctgttatggtttataataaacctaatcaaaacgataactatgtcagtctcatcttcaacaataagttgttgcggtttatattacctgtgtcccagaatatagcaaccaaaataggatgaaaatgtatctagacatgagacgggccctagattgttacattctgggagggtggaagtaattaacataagcaaaacgaggactatgtcagcctagtctcaccttcacaggccatgccatcatgaagctgtaggctgggacatggaaacattgccgtgggaatctgcaggagaaaccctttggaatgattggggctggaatgtaggaagccttgtggcaacgttccccaaccaaaaagaagggaatgtttatgattctcgtcaccatcatgaagagatgccgtgccatgcagagaaagcaaaagaatgcaacacgagagagagagacagagagctgggacgacgactccggtcaaaagatcatacctgcagtgaattccccacgaccccactgattacaaaaccaacttaactgatgaatgaatgaatgaacgaacgaaacgaaccagcagagagacaccatgtcagctctcactgaaccttttccttttaatgccacagccagatttcgtgttaaaagccatacattcctgatttcgtgttaaaagccatacattccaaccaaatttcccccaaaaaaagaggctcaaaagaagcaaagaacactaccggtctaacactaaaggtctactactactactaccagtggatgctctagagatttggattttgcttgaatgtcctacctatgggtttactggttaaacacttacaccaccagcctagtgcttaccatcataaccaagtatgctactccaggcttccagctaatttaagtaccataagcacctgattgctgctgatcttgctttagtttacaaaaagagccgatcaaaagcaagatcgagcaagcagcaacatggctctaattaagcatctgtccaggctgcaaaaacagggagatgagcaatggcactcggcggcctcatcacgtgagctgcggccggcgccggcatcggcatccaggggttcatggcggcgaggctgacggcggtgggatgatgcttggcgtagagcatggcgaggccaagcctctcagggctcccctccctcgagttgctcaggctagtcaccagcgaagacgagttcgagaagttgatgccactgatcttccctcccgggacatcgatctcgtcagctgccgccgactcgacgtcgaacccgacaatgccgtggagagccgagtgcgcgtcacccatgaagcccttctgaagatctgccgttgcttcggtgcacgctgcagcttgctgctgctgtgatccatggagcaccattctccagtcggtgccgtgacagtagcagcgctcgcttcctcggtcgcaccgagctcgcggcctattggcacatggtccggcgctgcctcgatcgccttcaccttacgcgctgcctcaccaggcagcagcgagctgctctccatgatcttgtccacgtcgtaccttgtgatgtcaaagttcgtcaccgcgttcaggccacggaacttgatggcagcaatgtcgtatgcctctgctgcttcttcttgagtgcctgtattgcataaaaatagattaaccaatggaaacgctccgttgtaataaggccatcttgtttatacatccaaaaaccaatgtagatcctactgcaaagtacaatttacaatctggttatttttgcatcatgataatgatatcttttagtccaaaggagagttaaaacagtcaactgattgctttgttcagaggtcacagccttatgaaaagaacaaccatctggaaaagcaaagaatgatcaggaaagaaatgcatcaacgatgtacagtactccaagacaatactagagattagcagtaaaagctgctgattgatgtctactactaacttctttggcaaatctactttgacaagacaatttccatagatcatcgatagtcacatcccaaaggaacgctagttagttaatgttagtgctaaaagctgcaatgacttatggttatggtgcattactttgtgaaagcgtttagattctaagatcaaatagagtacactgtctttcttactgaaagtgccgagatacaagtccttgttgccagcaaccctgccaatccgagcttgccatcttccatgctggtgatgcctgcaatgcagttaacatttaacacagtgagattgtatcttgatgcgaatgtgttcttgaaataattatcaagaaaaatgcatatgcttgttcagcacaaaatgaaacaccttgttactccccggtagatggaagcaccgcgagagaacccgctgcttctcctgtgagcaggaacagcttgttagtacatatagttttttaaaaaaacagcttgttactagtacatatcaatctgataataatctaatcatagaattcaggcaaaatgagcatgctgctgaccttctcaagtgcgcaacatattcttgccttgtcatcctttccatctcctcgatctcatctcggtagttttctaactgccaaacacaataaattagtccacattacagaaaatggatactccaatcaaagtcccatatcccaccgtactacacggtttcatcatccataccgggaaatttatatgcgtagatagcccccagtatttcagcgcagccagatcataagccctcgcagctttatcttcagtgtcataaccacctaacgaacacgaagaaaaaggtcagcaacagatacaaaatataagtacaatgagaacaaagaaattgtaaggggcaacagttacctagatatactgcaagcgatcaaatttcggtcatggtaacgcccaatatgatgaaatataaaaatcagaatgacattgtcaacaagatttttaagatgaacaaattttgatgttgtagtagtactagatgttcaaggttcaaccttgccttcccttccttgtctgtccatcctttttgcaactgttatcccagaggtgggcttcatatcttccagtccacctgtgcctgctccagtgaatcaaacacacacaaaccttcgtcattcaatataaaaagggtcaaatgatttgctcaaaaacaaaagagtaggtgcctcatcaatacaaggaactgaagaggcatcagatgtaacagagccaccccaagccataatcttgtgcaaaggaccaaaataagaggtacttctagagaataaatccaaccattgcagcgttatgcattaaactgattattagtagtagtaatcaagaaacagtagacgccccactgactaacaagagcagcagagccgtaagaaggaatgaagaactcatcaatgctggaaactagtactattactactagtatagtaggagtgacaacaagaaatggcaaccgagcaataactgattagctcaaaaacagcaatgtacaagtgtgtactaac

SEQ ID NO: 56895 - DNA, 8435 bp, Oryza sativa
cacacaaaagctgaatcttgtaagcagattacctggtgacgcccctatactgcgatgtcctctgcccaaacgtgtcaatggacttccggtgaacaggctgcttttggccccctttcccggtgcccctcttcttcccgacacgctgctcgccaccgtcattactgttgcttccctggccatcaccagcagcagcagctgcagcgaccaccgccatctgctgatgctgctggggagctgcactgacgcagctgctggactgggaccctgggctcatggagaggctgagcggctgcggcatctcctggttgccgtagcaggcgccgtagctggtgacgaggaagttcttggccgccgccattgcgtcctccattggcgccgctgcggcctcttgcagcatctctgcttccgtcaatggctggtagttgtaggggactagctggtggtgctggtaggccgccctgcttgcatcctctgcttcttggccctggctatagtaggtggccgggtcatggccactgccattgccacaccccaagaagtcctcgagctttggcgatgacgacggcatcatgcctacttcacaccaagaagatcaatgtcagagacaaagattatataaatcgatcgagagagaagggagaggtgaacagtgaccttccatgatgcagagggagccatcggacttgataggcatgacagggaggtgcgagtagtagacgccggcggtgctggtcccgtctccgtaggcgccgccgacgtagtagtagccaggtgaaggagcgaccatctgtgctgcaggaggggagaagaggaagttgcaggtcgtggcgctgtcgggaggagacgacatggctccggcagcagcagcagcagcaggtggatgatgatgatgatgatgatgagcagcagtcgatggctcagaggaggacggcacctccatggccggcatgtgcggggagagcgagaagcctaaccagttgctgctgccgccgccgctggccatttgctcgcaccaaccatgcacacgctcgctcgctgccagcctctcgtgccgttcttgcgttgctctctcggctcgcagtcgccgcgcgctagctcgctacttctacatccatgcaaggtgcacgacgaggaagatgagagaggggacccggtgagctgagcagaaaaaaactgcaaaaggaatgagagggccaaagcaaaaaagcggtggataagtagcagcagcagcagtagtagccgtaatgcaacgcgaggatacgatacaaaatctagagcagtttgttcttggcctctcccacgatagctatccactccatagggatctgtgagctgagctctcttgcatgacatgaagccacgaacaccactggtactcctagctgcttaaccccctctccttttcttatcgaggcaattaagcaccatgctgttcaaagcacacaagcacaaacaagcacccccataaagatgcaagaatttaattgtgaagttgccattggacaggatggccaggacttcctctctctgttccaccatatgctactgctgcctagacgatgtagctggatgctgcccaaagtggttgaaagaaggctgcttttgccacagacttcatggacattggagagagaaagagagagagagagagagagacaaggggagagtgtatctaacagagattgaaacggcaggacaactgtacaaggagccagtcacttcgcaacagtaacagctagcttagctgggctgcactgcttgtgtcgcaaatgcgagcaaagcccgcgagcgaacgaacgaatcaagcccgcctattaattatcttaaccggagtactgctattcaatttagcacactgcttcactgaaacaatgctcaacttggacgtgttctagaaagctcaaaaagagcaagattggcacgtattagcggcggttgatacgtgcattagttaatcgcgcttcacctctgatcaaccggatgaacaaggcatgcatgtaataaacacttgtgctttgtcaaggtattactactagtattatacactagtgtgctgtgtgcgtttgtttttggcttggagtttggtcaaagaagcacagcgcaaggcagccatgcagacaaagaatgcctgtgctgtgcgtttgtgtgggtctttggtagccagccttcacatatgttccaggaatgatgaggaaagggccccaaagtcacccactggcatgataaaagccagcccggcttcacttttgcccaagccaaacattctgattccatacggatcgcttaaaatttaggagggaaatcagtgcacgcaattgccataaagaggaaacagcatttgtcttcttctttctccctgaaagtgtgcttcttgatctgaatatactaaaattcactgcaatgcagtaggagtagtagtaggagtattcaatattgaagaaattgttgtgaattttcaaaagagagagagagaagaagaagaaattgttttgtgattcgatgtcaccagacctcctgttgttgttcgggggtgaagggccggtttggaacgtggatctggctatgacggcagagaagcagtgtgccaacagtgtgtctgtggcggatgggacagaaatctacagagacaatgtagcaatgcaatgtagcaatactctgagtttattgtgcatccatgtatgtatagcatgcagcgtcgttactgtagctatccttatgggcaatcggatcggatttcaataaaacggctaggacgagttcctggtatatttgtgcactgttcttcctcctgcaatttgaactctaccacgaatgattattgcctgcaattttgaactctattgctaatgacgactcactctctcccgaaaacaatcaaatcctatggatgaatctaaatagatttgattttttttacagagggagtattgcctgactccccaatatcctttggtgcattgcactaccttcatcaccgttcccaacaacatactcctatttaataccatattaaggtcacttctgtacaatactatattaaggtcatccccaactcagaaactatcaagtagttccatattaccgtatcatataaacaccatgtatagaaactatatatccaatggatgcagggctggaaacaggcatggggcagctagggcttgagccccatgactagctccatgattcccattgtaatcttgaaaaataccatgtaattctgaaaatatttgacttcccgttaattcagccccacacgtgtagattttctggctccgccactgaatggatggtgccttcaaataaaattcttatccaatcacctctgttctctctccttttatccacctatccatttgttttcattcttgattcttgtgtatagatgatttcttgcatgagaatgatttcttcatctttttacatctatcgtcattaactctcttatctcatcggatttttgctatgtgacaatgtatttaacggtatggacactagatgacatggatggttagggatggcctaagaagttttagagttgaacacgattattaagaaattatgtataattaaatggggatgagttatgattggttgagaagtagagatatataagaaaagtgaatggtgaaaggttgttattgattggaaaaagaatgttggtgtagaagttgttgtattttggaataaattatatgtgctataagttgttatattttaggatagaggaaataccagacagataagacggtactataaatagatagtgctcttagtagtactagaagtaagcaataagggcttcttaggaacacatcatcattctaaaaacacatgaataaaaaaaaggattgaaatgttgtggcggttggaccctatgagaaataaaatcacatgcttgtacatagcatatgtttggatggctcctagaaaaaaatataggaattttaagattgcgtactactttagtttttagggaaattaatgtattactttgattgagtaagataaagagagtgaaagagagatgttactttggaatttttataggaaacggataacatgaggttggacccatgtttaaaatcctttgaaattagggcataggaaatgaattccaaaggactttgccaaaccaaattctacaaaacaaacaacttccctagaaaaaaattcctaagattttttcatctgaaaatccttcaataatccaaaggaaaccctaacaacacaagtgatacaattgtgcaatgcatatatgctcggtgaagttttgggttgccatcggttggccaattactgataatagcgatgaaaaataatttatgattaaaatatttacatatgtgtttttagtgacttaaacgttaatgttgaaaagaaactgtgatgaaaaaaataaaattaactaaaaaagtaagttttaagatttaaattttgataagggaaaaatatggcccttgaattaatgtgcttggtactatttcgaagaatttgagaagtcttctgtcgctgccctcgaagctgggaagtgaggtgttagtgtaatagagggcctatttgggagagcttaagattatgagaagtagctggttggtatctagcttttgagaatatggaaaagctaattttttttagcttctggctagcttcttagaatctaagtgtgtgtttagttcacgccaaaattgaaaatttggttgaaattggaacgatgtgacagaaaagttggaagtttgtgtatagaaaagtttagatgtgatgaaaaagttgaaagtttgaagaaaaactttggatctaaactcggcctaaatcaaaagctgaaccgtttgggcagcttctaattaaagctgtaaatccctaaaaagaaaagctgtaaatcccttggtagtacagtatagtgctagactactagaagagtacgtgctgaacccaggcctaaggccctgtttggaagattagcccagagctaattttgagagctaatgtttagtcatgaattagtaggctaaacattagcctagggtggcatgtttggatccatgggctaattcaaggctaaaaggtggagagagagagtagaaagataggagagggaaggagagagagagagctgattttgatggtcccaacacaaaattagccccattagcgtcccttggagagggtaatgttttgagggaggctaattcatattagctcaaaattagcccacctgtttagatccttgagagcaagtttaatagtataggccactactggctccaattcatctataaccaatctaatagctaattcatacaatagttgcttactatactattaatatatggtctcacctgtcatacacacactgtgtcttggagtccgtgctgcagctggctacaaatctatagcccgctgctcttctctctcatcttttatcttattagaatatgtttatagctggctaatagtctgctctgagggctaatttaaagctaaaaggtcaaggctaaacattagcccatgaaacctagcacggcccaagttgccgtcgccgtaacgagctgcatgccggcatgccgcaccatgatgaactcgtctgatgcatggcagcttcagccttcagatcatgccctacgtacgatcgtactgctgcatacccagcccagctgcccaagcctacgcagtagtgcacccaagaaaccaccggatcgatcggtcgatccgttgcgctttgcccgcgaaaacaaaagttgcctgcgcaagcatgcatgcttgcttggctgattgctgctagctgccgcatcatcctctctccctgatggaagcacgcagcaaaggtttcaaacgcgagcgctagcgcgctggtccctcgaggagcagcatgggcgtggcaatggcggagggcccctcgtctcgccacgggaaaaaagggaggagaatgtgcctagcttcttgtcccgggaaccaccgaaccagcagtgaccagtagtagctggataagttctcctatcctcctcccagctgtgttgcgtttagtgtatagttttagttagttcgggccggacacgcagcaggagccaggaggtcgaataatctctctcgttgtcctcctgcgcaatgatggtgttgatttgctgctaccaaatcaatcactttgttcttcggctggccagctgtttgtggtttcttcggatttgtgataggccccatggagattggagagaggaatgtgccctaccagagatgttccttttccttctctttttctaggctccctcatgcccgacattcttttgtgggtcacatttaaacagttcgattccatatactgtaataaattttgggactggctatggaaaatttgcaagtaaatcaccaatctcaatcaatattaaacggcagtataaccttatctttcctctgcactcctcgttctcctatcaaagtgacacctcctcatccagtgttacagtctcacttgcgtagcacgctctccccccctccccctaatcagcaccgacgaggctctgttggccattctccttctcttcccctctccccacctctcctcttctctaagttgggtggcgatgatttgcctagcgccctagcaccaccatcacccccacctaccaccctccttcaactgcgcaatttccgtatcatccccaccgtctgtccatgcttgccagctgccagagctcaagcttcaataacaagtagaagcacaaccccctggattcggcaagggagcaggtgtacggacataagttcacgatggggtgaaatggatggaggcaagcactttatacaagttcaagccgcacgaaagcgtaataccatattctcgagttattctctcaatcttttttgccaatcttacagggtgtgcaaagttttctttctctagctagccctgtcggatactgatttggaatcggaccccccatccttgcggagttgcgggcataggttcttcccgaatctagatactacgttgatcgtcacttacaaatggagcccacataggggaatcatgtaagaggagtattttcatatgctgtcatatgggggttgtgctagaccccctaagagctcccctagagaagatggcgatggcgcttgcatgcagtggggtcgcacaactacctcgtcctcgtgtcagtgcatggcttggagttggtaacatgtgttgacgttgggcagaggcatgcccatttgggggagggggggctcgacgaggtgacatagcagtcaaccatgtcgcgtgctagcccatacccttgggtttttaggagtaatgatggcttgtttatggtcggtatgcgccatcttgtcattcgttgctcttcacgcatgcccgttcgatttgtatccttcgcattaaatgtgagatcgccgtgagacgtgagggaaatgatggttcaggtcgtatcatcgttatggacttatggttcactaggggacccgagtaacgagcagaaaaccaagctcagggccatgagcttggggcacacctagttggaccaagagacaaagccttagtctactggtgactagcgggatgcagtaccgcgtgacctgttccggagatctttgatgtcccgagtaatcagaggtggggacccgggttcccacttctccggcaatcgtccactataagtaccatcctcgacggccattccttcaaactttttcctaccccgaccacaatcctaatccacaagtcatctgttgattttggagtgtcgctagtgttgaagaaaaggagttagtcggagaaggagccgactacaaatcttgagacatgtcctatagtccaaaagtgtaaatccaataaatattgcattggctattgtgcgaaaccgcaagccagctcttccaaacttgtttagcgaagggcgaaggcacatactctaatcaatactatgacgaattgtataattttcagcaaaagtattatttcaacgcgggccatatgtcaaaattggattaacctctacgggtgaagtagagttttttctcctttttttgggcgaagtagaggcgttgttggtaatggtaggtgtttaaagatgactgcattagagcaaacgtttctaacagaagaaaatatgaggcaaactgtccacaccttacatttttcttttctcaaataagaagcgagataactgacctggccagcgcagcgtcgagccgtcgacgccgccactgttgcggtgtacaacgttcgccaccaacgccatcgatctgatcccctccgtactcccatggggcgtagtacgtcgttacggctgtcctgcctgtctgcggtctgcccctcccgacgcgagggcctcgaccccgagcaccgccgccgccacatgccgcgctggatgtttggttaaaatcagatggcgatagatttttgtggatccgatttgggtttgccgtggaagatgaatcgg

SEQ ID NO: 56896 - DNA, 1388 bp, Oryza sativa
ttttttatggccagatgagtaaattgtattctctcacttgttcaaagacttaagagcacctaggttttcactttttcaaagagaataatacttcctccgtttcacaatgtaagtcattatagcattttccacattcatattgatgttaatgaatctagacatatatatgaatgtggaaaatgctagaatgacttacattgtgaaacggaaagagtactgtctaaagagaaggagcagaaaactaaagggcatattagttttacaagacgatcgaggatgttttgtcatcgttatacctcggtggttcgatgttggctcacgagttaaccaggttaaccgggccagggaagactccagggaggcggcagcaagaaacgaggctatgcacttgcaggttcgttcagcaaatctctcaggttggctctcctggatagggcaagcccgtcataaatagcataagtaccaaaaattctctgcagatgggaggaaatgcgtatcgatgtgcgtacgcatctactagtacgagtactcctacagtcctactccgtctacagcagcgtcggctcagtcctgctgtctggtgaggccgcaggcgacaagtgaagacgacaaaattctacctgtagctcccatgtttcgctgtagccgcatacatagccataggcgcacagccagtatagtactcctccgtagtggagtggagtacactagtactatgtcaactggtgtttgtttctttgaaggcgtcacgtgttcttttagagagagagaggagggcacctggccattttacagacctggaactctttatatacagagcatttttacagttttttttagaactgcatttttacagttgatcgactagtttggcgtatggtggccggccatttcagttcacccccaactacccctaacttctaactttctatcacatcatattacatccaaaactttcatacacatataagcttttaactttttttataaacttctaactttttctaaacttccaacttttttcacgaactaaacacagtgtgtagagggcagacgtgtagtgctacagtacatggagtcctatgcttatacaccgcattgaagtcgatctgcattcatgcatatagcataggtcctataagagcaaaccggaattcaggcttttctatgcctactggaatggcatgcaatgtttacgcttatttgaaacaccccacggtttcattatatatatgacatacggagtaatctctaatacacaaaactaagctatgggctcattcggcatgaaggaaatgtgaaggaaaaaatgaaagattgatactagttcctttgaattagctactaatagatgcattcgttttaaatgattggctatcttgattttc

SEQ ID NO: 56897 - DNA, 9351 bp, Oryza sativa
tatatgtgaaattcaaggtattcatcaactttggcggtttggtcagaaaaaccaaaccaacctagaaataccggttcatatggtttggtttcaatgggtttgacgggttaaaccgtagaaagtttctttcttccggcgtacgtgaaagaaggggatcaagcataagaacagcaacacagccatggctgtccttccaagctcaacagcagccgattgcaccatggctcgtatagcctttccatgcgatggaggcaggcaggcaacaagcaggacaccaacacgccagcggcggcggcgatctagcgattgtttcctcctcggatgggagccgccgtttggctgcctcggcgtcgtcgccagcatcggcgctgccggcaccaacgtctacggtgttttgcacttacgtgcgagctaaatagccgatgctattgcttggtttcctcgatcacgcagatgccttctcgccatggcgtcttgttgccgcggaagctcagcgcaggttcggagggggaaggacgagacacgggttcaacgggttacgccggttccaaaccaacccgtgaataaatggaaaaacggtttgggttggtttggtttcacgggttgaacggtttgtgcccaaaccgtgaacaggcagatctgaaatacaagtaaatgaaaacatattagttagccactgctcaactatattaagaggccatcactacgtacctcactgtaattcttgtaaatattcacgtacgagtacataaattaaatcggtgtacctttagcatataagatacatgttctatttgtcgctgacaacacgctaaatcccaaattgagagatgtcgatcccaacagtaagactgtaataagagggaggtggatcactcgtgtacggggtggggcattacgcaaagacgcagcgtgttgtgcgccgcgtacagtctatatatgcacggcccgtattttgcacgtcgttagtagtcgccttgaatttcatggctactacagaagtagtaggagcctacaacacgcacgcagcctctttctctctcacggttctcggttgtgcagaacatcgcacgcaaacggcgaggagcaaatgtaggctcctcactatggacaggccggtttgtcacattcactatggacagcaggccggccgactgcctgcatgtggttctcgatggtccagtccccatggcccgcgaggtactcatgtggttctcgaggatgagcaagtcttcatgacgccctcatcgatctcacatggttcagaccttggaactgtaaccgaagaaaaagagacaggcataggatggcatggcagggcctagcttagcgtcattgcattaagctcctccggtagctgcaggctctacagccacataagaccggtagctccatgctcctccggtagctcccgagtagggatgaaaacggtacgaaaatagacggaaaccatctttatcgttttcgtttttatattttttttcggaatctgaatcggaattggaaaccccggatattatcgaaaccgaaaacgacgcaaaaacgaaccggtgcaaatacagtaacaaaaatttatcggaataaaaggccccttaaactgataaatccaattctcaagtctcaacggtcaacaatttatcataaaacacaatcatataagtccaattgttaagtctcaacggtacaacacaagtggaaagttttcgtatcattttcacccctactcccaagtggaattagggatggtaattttacccatcggtccgggtatccgcgaatacccggcccgataggcatgggcatgggtgtaatattttgcccgtggccatgccagcccgagacccaagaacatagcagacagcagccgggcattattttttgcccacggataacccatacccgacccgatacatatgtatttgctaattttggcccatctcttattcctcatacccttttctcttggcccactaaccagggacatatatatactcaactaatagaaaccctaacctaattccccactctcttctcctacctcaatccccacggcagctggtggcgcacggcgcaggcggcgtcgcacgacggcagtggtggcgcacggtgcaggcgggcccgatatgcccgtgcccgtgctcaatgggcatgggcacatgcataggattttgcctgatagaccttgtgggcatgggttgggcgcgggcacatgggtctccggtcaggcatggaatcgctctacccgtgtcctacccgacctgttgctattcctaggtggaatactccgtccgtcccaaattaaatgttgtagtaatttataggcttcggtttttcttttttcttttcctttttggtttgttttttctggggttttgctgaggctctacagccacatcaagaccggcctggccgcaggcagtatcaggctgtgttgccctgtttccaactttccaagtaggagtactgtgtgatgacaaaattaaatggcacaaaagatgttttatactgcaaatgactgcaagtaggctgtgtttggaagcttgggttcccaattcctctctatcgtattccgtgcgcacacttttcaaattgctaaacggtgtgtttttttaaaaaaaagtttctatgcgaaaattacttaaaaaatcatattgatccatttttgaaaaaaaaactaatacttagccctaatggaccgctccgtttccgtgcgcactgtccatgctgggaacagatgattccgaacatagccctagtatgcaagcagtattgttacgcttatcaaccaaaatttgtgttttcaacattaaatttagagttgattttagagttttttcatcatagtttatttttaacatttgtttttagatattttttaagaacacatatatataagagttttatttaaaaattatttttaatttacaaatatatcgttttgatttttttctcctatatgtgaaatgatggggctagacgttttcacgagtactccagcattcgttttctctgcgagctgccgagctctgatggagtaggctcacataaccaggcatgtctaatgcgcgaaagctcgctagcggcgaacctagcgaacagaaaacaagatctttctatatataaagtttatatattcaaagtccatatatataaagtttacatatataaaatctctctatatagaaagtctatgtatagaaattttccaaggatattattcatttgaaaaattccatgttagtattttgttatttctgcactaaactttctagctatgatgtaatttctatataaagtttacatatataaaatatcacggtatatagaaagtttccatggaaattatttatatatagaaaatttctgttaagaagatataaaaaaatactgtgtataacgaaaaaagaaatctaagaaataaacataagtgaaagaaaaaaaacagaaatacttgatacttgcaacggattaaagaagaatcacgtaaaagaagagaaaaaaatgaaaatgggagaaaatggcgtgtcctcctatttcgcgtgtcccttccgactgatttgccggattataatcgcgaacgttggtgcactacacttttcgcacataaccagcctaccgggctaccacaatgcatgcaggatgcagcgcgttttgccagtccggcatgtcgtcctcgcgtattcgaacctcgtggaccgcagcgtagcagtctacgccgtatgagtacctcgcgggtccagtcctaagaaggatctccctcctcatcctagttatggtttaatttatttatttttaacttggataagttgaatataagtatttttaactatgaaattggataattgtttgttcaaattcatagctaaacgttactatatttttgaacatagaaagtattaatttatcttattaaatatttttttaaaaaaaatcataatcatttaaatgatatgtaaaccatgaaaggatgtcatttgagagtttataatccactctcactactagtctactactccctccgtccatgaatagaaaagattttctccatccaatttatcctaaaatataaggggttttagaatctcaaatactatattcttcaccgaccaacttttatactaatttattcctccatgatctatttttatactaatttcttctcccacctactaacttttatactactttatttttttcacccatcacatgtccttttactattttcttagttcttaaaaaaatatataatccattatattcactgacggatgaaggactagacaaaacaacaattcacttttttttcacgaagtatatacttccaccacatcagcacaggcaggctgccaattctcagtctcccaagctgcggtccgggatagcccaacccaatgcggtgggaagccggtacgcgggctgcatgtgggcaaaaggagtagccagacaactaggccttatgggtttgtttgtgcgggcctcgtaaattgccgcgtggcccacccagcgtgataggccgtgaacagcgatggctagtactcctgaaggctgaagatccaccagatgtatatccgccaggcatccacagatccacttgatgtatcttggtaccttctactccagtactttgggactttgggcaaacttggtcaatttctgaacggtagaattccttttactattgtcttgtcttttttttctaaccccactaaagtgaaatatcaaattccgattaatgaagctgtacacataagactatacacgacgatatatgagttctactaaaagaaaaagccataacatttttaataattaaacaccagtctaaaagacatggatagcattatcaataaaaaatcttatcggtgaatctctattcataggtgacgaaagtctacacaatcattgtctcttcaacaacagcttgtaagatgcatgtagtcgttaactccatatccttcttcaatcgaattaaccctgtcctccatatccaggaatggaagtcttggtattgtggataaaatctactaaccatgaagacctccttaccttgaacctggatgatcatttcccaaattttgaaattaaacttgaagttgaaaacagactctgaaattatcgcttgatcgttctgcaaatcaattcacgtgcacatcaccattaatgactgacatcgaatcgaagcggaagatctcatcggagagtaaatgaattacggatagcatctctcctcgcaaggagggagaactaacgtctcgcccaaagcatgcacatgtcgcaaaacgattattttttgggaatacgcgaggggcgcatctttgtattaagaaggaataaaagtatttacagtgcgggctgaaaactcaaaaaaacgaaggggacaagatacaggagggggaagaggaagaaaacaaaagcctaatctcctaacggatttggagaccttagctttcacccgacataggaatcgccatggccggtattgtggctctagccaaccgccaaagatccgcttcgcccgtaatggccctagcaatttccgcccatgtcctgctcttctggttgaagacccgattgtttctttccttccaaatcgtccatgctaccaaagttgcaatggtgtcaaatcctcgacgatgctcctttgccattcttttgcgactgtcacacaacaggaatgaaaagagtgctcattgagaggtagacactcagatgaccaatagctgaaagagcaatccaccatagccagcgagacttcgggcaagcgtccaataagtgatcaatcgtctcatcacattgatcgcaaagaaggcagtgagccgggtgtgacagccctcaactccgaaggcgatccgctgtccaacaacgattgagggcgaccagccacaagaagtaccgatagcgaggaggcgctagagacttccaaattggcttgtgcttgaggttggttcttcccaagaagagaagacgatacgccgagcgtgcagagtaaatccccgaactctcccaacgccaagagatcgtgtccagtccctccccaagctgaaccgatcgaagaaggtcccaaagcttgagatattccagtattgcctggatccccagcgccgcagagatgtctcgagtccacctcttgtcttgcaaagcctcaaccaccgttcgcctgttccggaaccgagcgggaacagctgcgtagacagccggcgcgagtgaccgaattgaagagccctgtagccagcaatcctcccagaacagtaccaacttcccatcgcccactgagcaaaccatagaatcgagacaaggttgtgttccttctgcaaaattgggatatttagtccctgccacagcttatctggtgaggttctttgttgccagagccatcgcgacctcaaggccatacccaatctctcgagatcgaggatgaaacgattatgcattgaatatggatagagaaacaacataggcgatcatacaacaagggactcggaacgctatagtatgggagacatgtcctttgaagtggcaccggcaccaacaatctaacaggaggagtcagcaatgtaaagtaggtcgaggcggccactgcggcaacaacccgaaacatcaccatagtgctacggggttgtggtttcatcgatcggtgatgttggcgaaactacccgttgtcatcgtatccatccacacgttcctcaaccggacgacgctaggccatcgataatttgtggctagccgctactaatggctaccacatagaagacacgcgacggtgaaagccccatagccaccttccttgcgcctgcaccgtggtggtatgcttaggcggcagctagggttttctccccttagtatttggaaaaactgtagtgtacagcgataataaaacaaaaatgattattgataacagtatgatacaatcccttaatgacaagaatcaaacaccaatgattgtttagattgaagctattttttatccaaccaaaattttaacaactttaacagtattgtataatatttgtttgatgaaaaattttgcctatactaataaatattctactctaacaaatttagtagttattccaaaacttttaaagaaaaaccggcctcaaatcaaactagcccgaatccctctaacaggacaaaataaaggaagaaaacgaaaacaataaacctgtcaccatttaccacagccgaaaaccgctttcgtgtgctcctgtattgtatccccaccgcctagtatcagcgtcacagtacgtacaacttgccccgacattcttttcgatcattaaactttgcctgtgcgcccatgccaccggcctctttcgagtaaatgcagttttatgcgtgcccatcgatctccaccgtacagccggccggtcgttcttgcttccaccgttccacggcgccgtggatggaacacgcaacagttcgcatgcagattgatgtaccgactaatcgtagcagtgcacggctgcccgcctgccccgtacagtgcccagataatatttggctcgctaaggtcgctactactacacgtagtactatactctatatacgtggatatgatatcccccctgcgtctcacggaaacggactcgcgacacgcctcctcctccgaccaggcgtataccgcgcgcgccgcccgatcgcttggcgcgcggctcgccccgtgccagcgttcgcacggctcggcagaggcagctgctgcacgacacggcccgtcgcatccagatatatctgaccgatcgatcgatcctctggccagccaccgcggccgccccctcaagttgccgccggcgcccacgcccccccgcgtgcctgtcgccgtccgcaagcctagctaggaggtacgggtgcgcgtggccgcatgacctgcggttgtggtcatgcgtggcctggcggtgccgttgcgcgcagcggcgggaggggaattatgggggttagttggttgatttgcccgtctaccactgatagacatacgattagccggagattgcgtgtgattccctgcaatcacgcacgcaaagttcaatcggcatcgattttgctataaactatcgacaatttttcttttaaaaatttaacaaatacaatattaatataaatataattacgttgtaacaacagaaaaacttgtatatagcttttatataattttaaaccgttaaatttactttaagcttcatgaaagtgaggaaaaagaaatcaaagagcacttacatgtgagatgtttcagtcctacagactttattttatgataaactagttgggtggcccgcgcagttgcggggctagtaacatacaaaattatattttttaatatgattttacttaaaatttattaaatagttatcatgttgtcttaagactttgaaagatcaaaccatatcatcctttatttgtttgctcgatctaccactgttcctatttatttttcttggaacctttaaaaattgagagaatctcttatatgccactaaaaattggcccgatcccttatatgtcactgaaaatcggctcttcccttatatgccagttgttaggaactaaccccttgtcagatttttgcaaaaatgacaaaaatagcctttggcctaaatggcccaagcccaaaatcctctcaaaaaaaccctagcagggaggaggcattgacctgagcagagtgaggatgcggcgcgacaaaaccctagagggaggagagcaggcggcgcggcgaggtcggcggtccggggtggcgcggctcccctgagcaggcggcgcggctcccctgagcaggcggcgcagcgaaggcgcttggtccagggagggcggcggtcggtcacgggagggctagcgactggaggtgcgacggccggtcgcggtcgcgggaggggaggcgtcggagcaggcaggcggcaggcgagggtggcggcgcccggtcgctggaggggcggcggctagtttttgttcaattttctgtgccgctgtttatatatgttcttgctccagcaaacaagatatgtttgttatactgtgaaacacagaaatattgttcttagcgatctattatatggcttcaatgttgtccctaagtatgatttggaaacatatgtttactgcatgttgaagcttttgtacatgtataatgtctttgtggaaaatatacgtgatggtagtggctaaaaattatgtgactgaaaaatatccgtatattcaatatataaattaatgctgtatattcatgtattcaaaatatgtgtaatgcctagctgaaatgttgtacatacatatatatatgtcaaccaaattaaaaaatctgacattataacctactacatgcctaacagcttagaggggacaaatacgtcttttcacttttga

SEQ ID NO: 56898 - DNA, 6935 bp, Oryza sativa
gccagccactctggcgccccaaaaaggaccatttttggataagtttttctaggggtctatttgcgaaataagtttttcaaaaggaccaaaatgtgaaaaatccagtgtgcaaatttggtccaatggcatataggggaagagcaaattttcagtggcatataagagatcgggccaattttcagtggcatataagagattctctcttaaaaattggatctcatagtttttataatttattgtcccgttgggttttgtttttataatttctataagttccgtcaaatgttatcattatactcttctacagccgtccactgtctcttctctttattgtcattggtatatgatattttaaaaatcgtatataattatcgtttaggtttatattactgaggatttttgaaagttatgtaaaaattatcagaattatactgtattaaatctgttaaattatttaaaaataattatcgattaatgtacatgtaatccattgacattgcgattcaaccatccgttggattccttggaagcggggaggcgtgaaaaccgaaggagcatgtgactgggaggacaccgggcaccgtatagtctaggcacatactgtacactactagaaaacatggatcgacacagtaacacgagcaaccgtatgcccctgaatctggcagcatatgcatccacgcacagggggtgacacggtgcatgcagagccatgagcgtctggcacgtccacacgcgcgtccgcgtcagataaacactccacatgtgaacgcgaacagcggagtagacctagcggcgacggcacattgctgtccttcatgtggtgtcttggcatatcagcctcgctcttcttcttcaccctatataaagcacttggttaagcttgtagatcacccaataattagcctgtgatccctcatccctgaacttcccagagagggagagctcagagaaaaagggcgaggcatggcatccagctccaaactgtctgctctcttcttgacggcaattctgctctgcctcatctgcacgaggagccaagcagcaaggcctgaaccgggatccagtggccacaaatcacaggtacagtcaccatgtaatgcataacctggtcgaactctacacagtatttgcattttgcttccaatctgagcagtttggctatcggtgctggctatctaaccgcgttcttcttggtgtttctagggtgttgttgcctccagtattgcccatcagaagagtgttggtagttctggaatcggtgtggaaatgcatcagggagaacctgatcaggcagtggagtgcaagggaggggaagcagaggaagagtgcctgatgaggaggacactagttgctcacaccgactacatctacacccaagggaatcacaactagtgtagcacagtagctgtgcaaatatatgcaccagtgctctttggcacaagtttctgcccagggtagtttggaacacgggaattttccacgattcttggaggaatgaactagctctgacgcacagtttctacaagatcttctgtgaattcctgcgttcaaacaagcaaagaagaaaggcttgatgaggcaaacggatatcgatcttctgcagttcatttctgtggattgtaccaacccccccccccccccctttttttttttgcggggagtggattgtaccaactttgtagtggactatctgtacatttctcgctccttgttcttcagcccgtatatccattctcgacttccggccatcaccttcagatagtacatggaactttgggatgtaagcactgtagatactgaacttatgtatccatcttgcctcagctataataaaattacagtttctaatatctatcgaatctttcttgggccaaagtggacgagttatgtgtatgatttttgatttggcatgccggccggtggaaccagaagaataatttgacaaactaacagttttagatgtagtggcatgcatttaaagatttcagcaaagtggataattttctgcataccattgcttgcctttttagggaatacgcaaggagcacacttttttcataaagagaaataaagattatttacagaccaagagccccaaatcaaaaaacagaaggagacggaaactggaaccggcaaatgaacataagcctattatcacgatattgactgtctaccacgataaaaagaactccctgcaaactaattattgatagtccatatcaccatattagccgcacaccatgacgctacctcctagaccatcccttttgctaccttgacccagctaccttttcttcgagattgaaaaccctattatttcgctccctccaaattgttcagattactagcgttacgatggtgtcgaatccccaaagatgatgcttggaaactttatttcagctgttgtagaacaaaaaatggaaggatgtttcattcattggcaagcattcatgcagtcgtcctattgctcgcagcgcacaccaccagacatactattgcttctcaatacatctgaacgcacagttagcattgcgcgcggacagttaggccggttgaccaacttgacgtattgggctcctagatggaatcgtcagccatgcagtcaaattaatttaggcacccggtctaccagccaattattataagcagttgacttcacttatctttgttgttagtatcatcatttttctgaaaaaaaaatcggcgtattgtattctgcctaataactgtactagaccaaacagcaaataaaacgatcggagctgttgaatctgacgggatagttgccaacgtacatagtcaacgctgaaactagctcatgattatactccattagttacatagtcgcatcctcactggggttgtaaggttgttgctactttcttcaattcttctcccactcctatctgtcaagtcgcaacttgcagctagtagagctgcagagggctttgcatagagtcaattttgttatagagtatgcgtgtgagaaacgcccagggatcttccggctagctatacaagtggtgggctagacgatctgaattccaagcctcaccctttctaattatttaatattagatccttcctaatattcgtgttttttttatagagtatgcgttcaactcctttttataactcattggtttaacaaaatgtgacctaactggagtactttagaacagttcaaacactagtacatgctgcttaaggtattcttagattctcaagaatctgctgttatacgcaattaacattttaaattgtatgccacaactataaaccaatagaaggttcgctgcaaagaactagaatttgctgagtccataccagttattaggtcttgggtcaataaaacctttcacacatttcattttcctcatgttcgtttttttggggggcaaatatacaactggttcttctattatgtacgcctggtcgtcgtagtatgcttgctaatatttaatttgcattgtcagcgatctaccttttacatctagtatactccctccgctccatgacacatcctagatgtatccaaattcgttatgctagaatatattatattatttatttattttttttttgaacggagggagtacaaactatttactataatcgcagttcgatctgttggatcgtttatttggtcggttattgtcattaagcgccgggaaataaagctgctgcttgttttctcatcgagtatcaataatgacgcggtagcacgccccatagaagtgaacttcccaacttccaagtgactgattctaatggaaatatggaatccttcaggacattcgcaggtacagtattgacgatgcgagattgtcaatgaccagcaacagaaacgacgatgccaccaacggagccttgtgccatctccacaaaatatcaacgacatttaatctcgtcaaagagtaaaactactccgtaaccttttctttttaggtagagactaaaactaacataattcctcagtaataatctgattgcaatcagcagtttttagtagagaaatattattgggtcttccggctagctccataaggtggtgggctagacgaattaagttcgaaacctcataccttcggaaaatgcttcacatcagccgtccgggcagaaggaaggaagaaatcgaacattcacatcagttggtgtaagtgcattcgtgcatgcaatcaaatttaggaaaacagctcataatggttgagaattcaaatttttttctccaactatttatccaaactatgaataaattatgtagttggatttgttataattaaatcttcggaacaatatctcacatcattgtattctgatgacttttttctgactctttttagtgttgtacacggtgttattagaatgtttcaataaatattggttgatgtttcacatagttatttgtaatgttgcatgtggtgttttctatgttctagcaagatcactataataagatctcatatgattatatttctgatgaaaaaattatatatatgtgtgtgttttttagccggtgcaattagatttttcatgtatgagaaataaacgtttcaaatggaattttactttgtaataaattttaagtttactgttgcaacaaaatgttgctcatagtattatttagtattatttggatggtttaatagatattttcttatgtttcactaattctttgtaactgttgcacacaatatacttgatgaaacattcaaataatatgatgtgcaacattcacaaataaataatgaaacatcataatatatttattgatcccgtgtgcaacagtaaaacaacatctaatggataaaaaacttaaaatgtacaacataatcaaattctagatgaaacatttttatttttaacacgtgaaacattaaatcttaacgattgaaacatatataatttttcaattaaaatataaccttgtgagatattgttgtaaagatttaattacaatgaatacaaccatataatcagaatgacaataagataaatggtttggaaaataaatcatctcaaacgctactagtatgtgttaatcaatgcatgcatgtagtatcatcatgtagcagttatgtgatcagcttgctgacgtaggactcgggtagtgtccgatattttgcgttgcatcggacgtccgggcggtagtctcctcccataccttcctgatattcgcgttttttttatcagttttcagtagtgtacaaaacccacttttgcacagttgttttgggccacttttgcagtctattgggcctagtctgtgattataacgggctctggttttaccgaataaatgctctgggcctaataggcccatatgttggcggacggcctcgcgcaggtcgcgacacagggacgacgaggactcgacggccgcgtgagccacccgcgccgcgccccatccggccatccgccacctctccgccgcgcgcgcggctgcggttgctatgctactccggccacgcctctccctcctccgagccgtcgcgccgcgccccgtcccaccaccaccccgcgcctcgctccccgtccgtcgcacgctctcctcgccggccggagcggcgaggaccgcgtccgccggcgatgcgccgccgccggcgcagcgaaccgggctcaagggcgggaggaagagcgcgccaccgccgccgcctcccaggggttcgtccgtgaaccccgcgctgttcttcccgccgggggtggatcgggacgcggcggtggcggcggagatggtgataccggcgtcgaacatcgtggtagggccctacgcgggggactcgcgggtgaaggaggcggagttcgtcaagagcagcgcgcgcgcgcgggactgccccaaggacgaccgccccgagttcgccgtgctggggcgctccaacgtcggcaagtcctcgctcatcaacgcccttatccgccgcaaggaagccgcgctcacctccaaaaagcctggtgatttttaagcttttatctgtttctgcatatctgtttgatgatgcaatttctagtttagctctgaggtagactcccaactcccaagtgagtttaggactgtggtagcgtcaaccgtcagtgcgatgtcctagactgcaaacacattcgtttgctcgcaattcgggagctgaagttagctcagtgcttaaagcaacagaagaaattaatttagcttacggtgctacgctactgctccggttttgatggggaactttgatattgctgcaaaccttataaatctattgattatgcagttttatggaggacgagtttggtatttgtgcacccttcagaaccgaatacatggttttttcaacttgtttatctttctatcctattcgttgcttaactcttaacaaaatgccaaccttcagaactgaactgattcctttgttttatgatttgctccatctaactctatgttattttcatatcaaacttcatgaatatattggctcttggttaacaaaagttggttaaaaaataccatgtaaattgctggagaaaaggtatatgcacacaattggttttggatggttgaaactgtagaattgtagactagtgagagatattagggttattttaggtgtataagaaatgtaattgtatataatgatgtatataatgcatttagctgcgtaattgcacacgaattcagataatgtagtttggcattacaaaaccaacatgttgttatcttctgcattttgttgaaatgtgtacttctgttgttacatggaatatcttatgctttcatagggaagacccagacgattaatcatttcttggttaacaaaagttggtaccttgtggatttgcctggttacgggtatgttgaccttttctaccctcaattcatatgtaacttgatttgcatgtgctactttctaggatgtatcacaatgacaaaatcatagatggcattgcaaatggagagaaac

SEQ ID NO: 56899 - DNA, 5308 bp, Oryza sativa
aatttctctctccatttggatcagatataataaaataatacggccagtgtcaccatattcccacggtgtcctgcagcaaatacacgttctttgggtgtccagtagcaaagagcgcaaactttgagtgtccggtagcaaattttcacttgaaaatactatgttagaagtaggcaattgtgtatatgccaccagggtataccattgaatcgatgttgttcacttcattaccacttaatgaggaggaaaaggcttatgaaactaggcggagtgttagaaacttgaactgtgatcttttgatcatattagtgaacctagtcagttcagttttatatatttctgaagtggtgatctttagatggcatagattcaattattcccttctattcggctgtagtttctgtttctgcatgccagtatctgacattgtaacagtgagcacattctgtacgaaataaactttataagtcaactactgttgcttttccattcccattgggacacaaccccagcatactgttggaactcatttggcgcctggtgataatcaaatctgttcacaaatgtaggtttgcggctgcatctcaatctgctcgaacagattggtcttcatttaccaagggttacttcttgaacagagataccttggttggcgtactgctccttgttgatgccagtattccgcctcagaaaattgacatagactgtgccaattggcttggccgtaacaatgtaaggcaacataagacagtctatgccatgtactgatatctaataacatatctttcatgttctccaactatattgttgcagtctgacttctgttgtttgggtactatttcagattggattgacctatgtgttcacaaagtgtgataaatccaagaaaggtaaagggggccggccagaggagaacatcaaagagttccaggagacgatcagttccctgtacccagagcctcctccatggatcatgacgagtagcgttactggattaggccgagatgggctgctcctccacatgtcgcagttgaggaatactgggacaatgaagcaaccatgagtccatgatttgcttagaagagggaagagggaattacaaaccacgagtccttgacccttgccgatatatcttgaattacatgagcttttagtccagttccttctcattctgttgtatgaccctttggtttatagtgggatactaagagaggctttgcgatgtggagcttcttgtaatttcccctcctcagagtctcaggtgtatacatttaacaggttgcattctcactctatcttaaattgactcctacctaggttaattaagtcttttcataatttctgaatgcaaacattacggcgtaggttctgcggcggcagggggagcgatctggaactagacaacagttatggtgaaggcagcctaggaaattcaaaggactgtaagcattcaatggcacgaaacttattgccaaaaattctactactagtactgtgcatttcatacatttcgtcgcccgatccgacagactgccggcctggatggttttacacttcatgatggcagtaacaagcactgctagtaattttgatgatgtaaatctagattccactggctgtgtgtgactgtgcactgtgcatagtatgtctcggccttgctgtcctttgcatgggatgatcgctttcgctttgataatgtgtagtttgcttgattgaccagccctgtctccttagactacgagagggcacagtttacaggccccacggtgaagccgggagcagagaaaacagaaaggcagccatgcatgcacgtacagaaggtgtttcactttcaccggtgctgcgcgtgccgctcccctaaccccgccggcctgcctcacgccggtgggtcacacgtccacaagtgacaagctagtagtactggcatatctagcaaggccatctatttcacaatgcatgcaacacgttgctcccctaacccttaactaaccagcactttataagttttaaagttagccgttctgcgtgtcaaaccatgaacagggtaaaattaaacgcgttggtgctgttttggctgaaacagcgggcgtccggagtcctggacacgagagctgaaaaaagctgaggggatatgcttgcatgcctacgtcgcgtgatgtgatcagttttgccggtcaggtgaggccacttgggacggacgcatactggccgtgatccggacgccaaactggcagcaaaagcttcactcgtctcgttcgatcgattgccactctggaggtcaatgaaaccaccccatgccccgctgccgctgccgctgccgcttgggggcaaccagccactcgcccccacctcgtcccctctgtcgtgcagggcccaccgcacagtgactgaaagatgacccgctgctgctaccagccctaccaccagggtaggagtgtacaccaaccaatgccatcgccggacggccggagacccggagtaaatggccgctgcgtacaaacatcacgaaaaggctgtagcagcagcagcagcagcacgcgacgcggatcgatcaccagatgcgcgcggcaagagcccagaattgcccatcagtgagtgagtgagtgagggacagctcgatcggcatatgcatgcatcggcgtgtataagcgaaagaggaagcgttgcagggggagagccgatccatcagaccaaagtccacgcccacaggggaacgccaatgatttcgcatctgccgcccacgcgcttatcaggttttccctctgatcgatcggtcgatggcttgatcggtctctggtcgatggcacgagggatccgtctcctctatactcctctcttgacgtgaccatgaccatacgcacgtacgctctacttttaagagtatcagacaaaatccctgatgaggttcaagctgacaatgacgtgcacggtgcaccctccatcctagcggcagcttgcgcttgaaagttgaaagttcgaagcctgtctgtctaaaaataatcgacaagctcacaacgaggttatctggttcgggggtaggagctcatgtgatctctaccggcgaacggagatggcggggcagggggaactgacgacgatgccggaaatttcaaaaccaacatcttccctctgcgtccatgtgttctttccttcagctccgagtgagcgagcgagcgaacaagccgggccaagccggcagaaaattttccttcagataacacctcaccagcattcattgcacatggagctactactagcatcgatcgatcagccgttagtgacggggctgcagcaccgcagtgcagcgtactgtacagccgatcgaccatgggcccccctctcgcgtcgtggcgaatgcatgccacgtcctgtgaatagattgcagcgttcgttcccggcgacctctgcccccaggcaaaatgtacgcgcacacatatgcatgcagcagcagcagcagctgactcgatcactcactccagtgtccgtccgagtagagtacgcgtacacaggcaccagcactaccacaatcctggcgctcccgtgtacgagttgtgctcggcacagtagcgccacccaatcagtgagtagtcgtcgtccatccatcaacgggaggaggcaggcgcgcatgcccgtggtcctgctcgctcccgatccagcctttgggcaggcgatcacctcacctcgcgttcgactgcgcggaggcgaggagaggagaggtgggggtgcccacgccacatggtttgggctggcccgcgagtccacctttttctcgcgaggcgagaccggagaatggcgtgtggaaatggggacggacgacgggtgggtttgtggcgtttgtgcgtgcgcgcgccggcgcggtgcatggagggcggtacgtcacgtcgcggatcatggcaaaagcaggagactgacgaggcatggcatgcatggtgcgctcacttcctcatcctgcttccattccacaggtcaattgtgcggcaccagcacccatcatctgctttacgattggcaacgtataaagggaaaaagtactgagcatagcctactcctgatcatagatgagtgaccctatgctaggcgttgccatggctttatctgtccttgctgatgaccaaggttttttttccctgagattagataagacagccccctgatgtgaaatatacaaagacccgcttttccagtgagagtactagtagatgcaatccaggaaaatgaatgtttggtgttgttgtcaaccttgactggcaattctcgactatttgctgaatcatcagaaaagaacttaaaccaaattatctgttttctccctttttaaggatagtgtgcggctaaatctacaagaagactacaattgcttgactgattatgctctctagattcaaactgggccatctgatactatacttgttaattacagtagtacttgtggcaccagcacaagctgacactggacttcgtctttctactgtttcaatttcagcaccaggaacgccgcctgaagcttttcagtatatgctacaggacaaaggttatccttgaaaaatttactggatgatcaaagcaatgaaagatgcagcaaagagttccaattttttccaagatatggcctatggcaatgtgtatttcaattatgaagcaacagtactgtatacaattctacccagtttataccatcaattacaccgaagatgagaaaaaggaagaacatctacagccctgaaagacccacattgccgaaaatctaaaacagcaggtttcttgcttaatttttctactaccaatggcaaaactggctgtacttaccacctcccagcctcgagtgcttattgagctgaccaaaatcctcatcaatttgcatgtacatcccacctgcttgccactgaattagctgtgtgtatgctgcattttgaatgctgcgatacgcatcatctcgctggacagtgataacatggccacaggtctcacaatctactcatatcatccacccttatgccatcagatgacatggcaaattctgcataactgcaaagtttatctatacatagacgctgtcgactgccaattgctaattgctgccatttcttcagattatgtgagacccaacaggtgaaccattcaccatcgaccaaatcacaagcggaacagcacaattccaaactccactcactggattgtcttcgtaagcttgcacttggagatgaataccgtcgatgtgcaattcatggtgcacagcttgagcagttcggacgcttgctgtttcagctctggtccgcacccactctgtatgaccaagagaagcttgcatgcc

SEQ ID NO: 56900 - DNA, 720 bp, Oryza sativa
attcctgcaccccgttcgaagctgaagcaaagcgtgtaaaaatttgcccgcttcgattttgcagatccgatacacggtaaaatgtacagaaggatttaacaaaaccgtacggttatcacgtggttatcacaattaccatacacggtaatcttttcagttttttaaccacgatatgtctcacggttaccacgtagtttatcgcggaggttttgtaaccgtaccaaaagcaataagagaaacctgatgtgttaaatcccatatgggattggtttattttggaacgtggcgttgagattggcgttcgatctgcgcgtaggtagagaagaatagaacctagttttgccggcaggcgcgccgcgtttcacgcgatgggacgcgcgccacgtcgccggcgtaatggcgccgcggacgctggctgcacgcgcccctactggcccctgctccgaggctcgcctcgccgcgaatccggtactgcgtggtacgagtcgggaccgggtcaccggtccaaggcccccaaacaaattcaccgatccgatccgtcgtcgtttctgccgagttttaccgccgccgctgctgctgtaatttggcgaaggccacacgagttcacgccgcgatcacccagacacgggacaccaccctggttgcgacagaaacaggggagcctttcacatcttacgtggtcagtcctagagaaacagagtagcgtacagtacaaccact

SEQ ID NO: 56901 - DNA, 1138 bp, Oryza sativa
aggcggcggcgccagcctctctggcgctgtcctcctgccaccgtggcgcacgcgaaccgacgtggcaggaggagggcgccagcatggctggcgccgccgcctccattcctatttttctgtatggagttgcaacggtgtcatttttattttattttgtcggatgttttttcacactcaggatcacgatacaaccaaccacaaaaaaaatttaaactcgaactatcacttagctaaatctgaaaatagctagcataccacttagtttactttgcaccttcactaaaattagaccataactccttaagtaaaaccctttgatcagcatgttaaacataatgcactctaccactatatgaaattacttaatctaattcaaaatataaccacatgaaatgacatatataagttaaacagtatatagagatgcatttttttttatttttatttcattttttgatatttttttcacacttaggagaacatagaaactaaccgtataaaaaataaactcaaacggacaaaatatgtgacatgtagaattttccaaaactctatcgaaacggacaaaatatgtcatctattaaaacaggcgtaactttatcttacggactcggaatcaggcaaataatatatgcacggacatctacagaaaaagttacatccgattctcctcgcttcgccgggttcggcgatattaaaacctccaaattccgcttgcaagattgtgttttcgaggagagaagtttttcggtggagctttggaaaattccacatgccacatatttcgtccgtttgagtttattttttacatggttggtttctgtgagttcctaagtgtgaaaaaaatatcaaaaaaataaaataaaaataaaaaagttgcacatctctcctctgcactatttcggagagagaggagaggagaggagaggagaggaaaaattttacaggtcacatattacgtccatttgagttcaatttttctatggttggttcttgtgtgtctctaagcgtgaaaaaaatatcaaacaaataaaacaaaaataaaaaaattcgggggagggggcagccactctggcgcactccccctagccacctcagcatcgccccgccacgtcggcagggggacggcgccagagag

SEQ ID NO: 56902 - DNA, 1103 bp, Oryza sativa
tatggcgttggacgcctaatgctccccgtcccttcacctaaacgcatgtggatcggcgcgagactggtttccgtaagttcctcaaatcttcttctttttttaacatcctcaaagttcaaatgcacggtcatttatacacagaaaactttgtggcagcctctctgacattttctcatcaaaatccatacaactgcagacgatttcattttctctacataactgaattttcactgcagggtgcatgtggtatcatcttcccaatcatcaaagctgaaggtgtgaggcaaatgttcttccctgctacagtccctgcatattaccgggcccctcctccaatggagtaagaatctccatgttagcctatggtgtttgctgttctttagttcttttgagctgtcgagtgtgctcattagagtagtctgttcttcctataggaaattgggatgtgtatcgattgtcaatactaagttgtatatccctctgaacttgctaatgcgtcttgctcattatctcttttagaatatttgaggtgctctgcttgtctctactgcaccgttggaatgagctagttccttgtttttatgggcacacttcctaaatgccacgcttttttgaaaaaaataatctttctagaagttttttttaaaaaaataaatgattttttttttcaaaattgtaatagttaatcataaataattatgtgttaatgacttatctcatctcgtgtgccgctgaaaagctcaactcaaccactaattcgaacagtgctttaccctactgaattccatggaccagaatagtgtttgatctgtaaagccctgtaggcttaggctggctgggaaatctaagagcaagttcaatagtatagccaactactagctccaattcatctatagccaatctaatagctcattcatataatagttacatactacactattaatacctagtcccacctgtcatactcacaccgcgtcttgaagttcgtgctacagctggctacaaatctgtagcccgctactcttctctctccttatttatctccttaaaaaaatatttgcagctggcttatagcctgctattgtacctgctttaagggggtg

SEQ ID NO: 56903 - DNA, 6610 bp, Oryza sativa
  unsure (1)..(6610): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgaaaaaagataagttaaaaaaaaggagagaaatgaactcaccccaagtcttgcttatttgcaatcttaatgctaaagacagtctacattgcctatgcgctgatagtatctctaacagaatatacaaattagactatccaaacacctatacagctatatctccaattgatttggtaagccaaaatcgttgctcacgccaacagcttcttcatctaccctctccactccaacccatatgacactgcaacccatatgtcagcctctaacatctcttcttcttcctcctatttctccattcttcctttgcttccgctggggccaccctgagctactctccatccctctccctccgtgcggcgacgatgtttgtgtgatggcggatggcgacagcggatccgtgagcgcgctaggcggggtggctgacgcggatgaaaggaaggccgtcaacaaagcgcgatacccatgctatagtggcgcttgagctcactgacgtcccgtacactccccaaccctgtcgttgccgtgggcttcctccatgccagcggaggcaaaggctgtaaaaatcgccgttgagaggagacaacgagagctgagggcccccgagtccatgcagggacggaggctgtgaaggtcgtgtggggttgaagacggcaacgacagagtagaggccacggtggcgaggaggtatgtgtaggctgcgacggtggagtagagggggaggtgcgggatgtggcggtgacgatggcggtggcaaacgatgaagacaatgattgtctcgttagggggattgcgagcgggaaaccatggtggcgaggaggtgcgcagcggcaaagttccacttgatctgcatcgcaagtgggaggaaagataataggaggtagttagacccacatatggcaagtgtagttggctcaccaagtttggtaagtaagggaaggagtttgtccagtcggatagcttgaagagtgggatgaagagaatgcaatttttatccactgttgctaaactttggtttgaagagtaaaatagaaaggctgttgaagatgttcttacgctgttacacgtccatgcccatttttctctctgtcaagattcactggtatgcttacatcaatacactttttcttgttatatgtttgttaccttattagctatagccaatatttatttttttaatttaattttgagtttttttgaccataatttattttcttctgtggcttttaaatcaacaaagaaacatatacataaaattgctataaatcattttaatttcttttcactttgttcatttttgcaggtaaaacgatcataacaatggaaaaatcataggggaaaaaaaagaaaaagtagagtcgtgagtgcatgattctatccacgaagactgaaattttggtgcttacgaatattacacacgtatagatgattttttaacaggattttcatctttagagcatatgttacgagacgtattcacgggtgtgagtgtggtgttatgcgtctgccatacaatccaaaaaaaaaaacaaaaatcatggagtaaaaacctgattcacgaatcaacggtgatgataacgcgcaagaacaaggaataagttcatctaaggtcccttaacttatcaacgaatccgattttcgtccttcaaccacaaaaccagatacaacgggtcccttaactatcaaaaccggtgcatattaggtccctcggcggttttggctgacgtggcgcctgcgtggctaattttgactcggtctcgatctgacgtggtatgacgtggcccttacgtggcaatttgacccgggaaaataataaaccccgtgggacccacatgtcaatttcacacacaaaaaaattaataataatggtggaacccacgctgccccacatgtcagtctaactcacccctcctcttctgcttcctctctctctttctctcctcttttcatctctctcttgtgctaggggatgcggccggcgatgacgatggcggcggaaatggagaagagtgactgccaggggcataggtgtgacgtcgctgggggcgctttgaggcggaagtagactcttacgacgtggccgtcggaggtgagcgaggtcgtcatggactcacgggattggcggtgtcgtcggcagcggtggagcaggagttgtagttggagtccttgtcgtcgacctcgagttcgtcaatgtgctcgagcatcacccaccattagtagtcgccggcggcggaaggtagcgccgccatctcctgttgggtttccatgggccgcggcgagcggatcgatatgggttcctcgtcagtccggccggaacagtgttttcttgcctaaaacaatgatcattcattcattcatcaaccccgtcataacacaagcaaatgatgatgacgaagcaaaatatactctagtcagctagtactagtcgctattgcttctacctttgtatgattaggcacataaacgcggagcggaggtcgtcggctttggtgccccagccgaggccgtggacgaagagcttcctgctcacgggatcggcctccgccgtgcgccgcacggtcgtcatcatcactggggtcgtcttcgcagtcggccgcctctcccctctcccgccggcgaggtggccccctcacccgcccacgtggacggccgccttcgaggatgcgcgcgtgtgtcggccggtcggcgggacacgttcatcccgccgccgaggatgccgaggtcgacgtcaacatcgtccgcagccacggccgcggcggcgctgcctccgccgccgggctggttcctttctctccgctagtttccctcccaccggccgccgcgccgcgccccttctcccagccggacaccgtcctctccccggcgcccgtgaaccggagagaagagaaagaggagaggggagagagatgaagacagagaagatggtgaagaggagaatcagaatgacccagcgcaagagagagacgaagagaggggaggaggagagagaggaagcagaagaggaggggttaattagactgacatgtggggtccgcgtgggtcccaccattattattattattatttttattgtgtgtgaaactgacatgtgggtcccacggggtttattattttccggatcgaattgccacgtaagggccacatcagtgccacgtcagatcaaaaccgagtcaaaattagccacgtaggtgccacgtcagccaaaaccgccattgaaaccgccgagggacctaatatgcaccggttttgatagttgagggaccaattgtatctggttttgtggttgaaggacgaaaatcggattcgttgacaagttaaggaaccttagatgaacttattcccaagaacaatcggtacgatccaacggcccagaaaccaccgcatcgcaccggaccagcccaaccatttcgtcgagcacctcacgcacgcgctcccctccaagccctaaacccattccccaccaccatgcgagccatcggcgccgccgccgccgccgcgaggcggcacgcgcacctccccacctcctactccgccgccttctcctccttctccggcatcggcggcggcgccgggcgcgggcgtgggcgcggcctcccgccctccgcgacgccgccgcgcgcccccggtagccccgtcccggacgacgacgacggcggcggcgcggatcccttctcctccccggcccccatcggccgcggccgcggggaggccgtgatcccgtcggtctcgtcgccgccgcttcccggcgccggccgcggccgtggatcgccgccgcccctcggtgaggtcgcccccaagcaaccggtccccgccaagctgttcgacgcgccggccgccgaggcctcgtcctcagagccaccgccactgccgccgccgcgcacgctcccttccgctggcgctggccgcggcgtgccgcggatcagcaagccgccagtggagatgccgcaggaggagaaccgattcatccgacgccgcgaggagaagaagaaggccgcgtcggcggcgcgtcccgctcccagcgggcagccgaagctgtcgcccgaggacgccgtgaagcgcgccatggagctcctgggcggtggcggcgacgacgatggcgggcgtggcggcaggggtcgtggtgcccgtggtagggagcgcgggcgcggcaggggacgtgatggcggccgcggccgccgctctgctgatatggaggagaagcatgggatctacttgggggacaatgccgatggcgacagactccagaagcggctcggcgaggacaagatgaagatttttaacgaagcgtttgatgaggccgcagataacgcgctgccagacccgaagcaggatgcatatctggaggcttgtcacaccaataacatggtctgtgcagcaatgcggttgaatccgcaaaattgttagagttgttagatctggccgttcatgcaaggttcctgaattatttgtttcctgtgggtttatgtatgcagatcgagtttgagccagagtatcatgtgaatttcaataatccagatatcgaagagaagccacctatgtcattggaggatatgctacagaaggtgaagccattcatagttgcgtatgagggcatccagaaccaggaggaatgggaggtgatttctttgatggaccttgtactatattatttttctccacagaaatgtttgtgcgagtagatgttttggtacatatgttctcttgcagcattgaggaaccagattgcattagaaaatgccggagaaagcctgcataaatagtgtaaatgatactttgtttttccagcaataggattatagcatgctcaacgggtgcaacgctgcaagtctatagttggatggcattagaatcctagctgcattatcaagttttcataaataaactgatgaactcgagcatgttaatagacttgttccctgtttggaataatcattcagcctgattgaggcttcagaaataattctaatgagtttgcagatgcatattgctgtggtacgtaagtatgttcacagccagattggcctagctttgcactgatatacctagatcgggctgaaaatgatattagtagattttgtgttgtttcacctttcagaacatgttatttggtaagctgatttatgcattacaaatggagcggatataaggtttatacaaaggatttattatctttgttgcatgaacgctgtccagctgattacttagtaattgtgcctgctcctttctgatgaggttaaactgtaatctccagataagtttcaacttgttctaaaatccaagtaaagagggactgttggctacgttagattagagattttaacaggattgggtcattctagcttttatgtatttcctgcagtcctggacttattgaactaaaagaatatctattattccgcttccatgtttctgctaatcagctttaagtccctgtttggaaattcctgtatgacaccacattagacacttgtctcataggcttctactattacatgaaccagtacatgcttgaacttgcagctgtattcgccttgctgctaaaatgagtttttttttttttggtgatgtatacaactgacccagtataatgtaccgtatcactaataggaagctgtgaaagatgtaatggcaagggcaccccatatgaaggagctgatagatatgtacagtggccctgatgttgtaactgcaaagcaacaagaagaagagctgcaaagagtggccaacactctcccaggaaatataccctcttcagtaaagcggtttactgataaaactctactgtctcttaaggtttgttttcttgttataattgatgctctgaacagtatacacatttttatagagaacattattcataatattaatggtctgatatttgaatgttgtcatctttataattcaacttctgatttctgaatctccagtggtgatagaataacacaattcctgtctaattttctaacttgatagacatgtgaaattatagtatcaccctttctaagcttgctttcaaaaatagagctgtattcaattagcatttgaaatttgaattctagctacacaaatgatcaatttagctttttttaatgcaatgtatctacaatttaatggttcgttccaaccatcaaggcataaagtccctctgtagtctgacatgccctgtggtctggtcttactaagctagttctataacatgtctgtgtttatcatcacttgccatctgagatgatatatttgatagtttcttatcctattgctctcaaagatggcgaagtgcacatgctttaagttggctagttcacctgactgaagtactctacatgttggagattctgttatcatcacatgtgcaaaatttaccatact

SEQ ID NO: 56904 - DNA, 1061 bp, Oryza sativa
aatgccaattcatggacaagtttgctcgtgaagtttcagagctatacaaatagaaaactcccatacactgttgtaagatctcacttagccccaggaagattttgtggtttattttttctattttgagaaaagtgaggttttctttagtctgtgcacttcttttcctttgtattggtatgctaattagataaataaaatcactgataaacatgtacatttcttttgggagatgtttacttgggtgctctagtatgagatctgctatgatctcagcccttcaattcctgggccatccaaacaacgctgattgcaactcccctaccctttttgttaatattttaagttcttaaggtgctatatcgactggtcatattttgaattgaccatggggttgatctgattcctgcctcatttttatatttggggtagtctagcaatagatggaattttgtgctcaaggccagctctctgcagggagtgctccttcagttagcaagtaatggaaatgtttccaacaaaacctaatctggtaataatgtcctgcccaataagtgccactgaagaagaaggttttatgatcactccacatggccctgatcaagaatcttttattagatacttggccgtcggccgatatcatagcccacaagaaaaccagcaagtgatcaactctcttatcatggatttctgaaaacaagagcctggtgttttcaggaaagcatgccaaaacaactccaaatagacagaaacaccttattttatggtttttgatacaccgccatccatatttttcttaatatggttatctatgactatgatacaccgccacctgtatttttcttttctaaaaattctgtgtgtattgtattgtatgtcgttccacatgagagcagaaatgcctacctagctacttctctattgctcaatcactgtggctcggtacaaaccatttcttttactatacaaaaatgaagctaaaatcattggaagcacacttaagtatctgctgagtatggtctgggatcaccataactagttcccttgaactcatagcccatctt

SEQ ID NO: 56905 - DNA, 3432 bp, Oryza sativa
aaaaaacataccctgagtctgtacttgtagaacacatagccggcaatccccacgccggctacgcacgacgccaccaatatagtgatgaaccagccgaaccttgacatgctgttggctgcattataaacccaaaatttagctatgtttcatattttcatgtcgaaaagcaaagtgtttcatgccatcgtcacatgaaattggaactatcttcatccgtttcataatataagactttttaacattgctcacattcgtatagatgttaataaatttagacacgtgtgtgtctagattcattaacatccatataaatgtgggtaaatgctagaaagtcttgcattatgaaatggagggagtagatttttatgtgatgtattatcacctatgcatgtgtcctctcctcttatgtagatctggttgcccttgcacttgcactcgtagttgccccaggtgttcttgcagtggcagttagggcaagtgcacgcaagcttctccttgcattcatccaaatctgaaagggtaacacatggagcacagaattttgttcagtatttcatcagttctgttaatctacacccaccactactagcccatcaatcacttgatagtccagtagtaattgtatgccaatatgtcagtttcagaagttatttttcttcagagaagtttcagaaatatgtttaccttcacatttgtggccatctccttggaaacccggggggcatcggcatccagtcaatgcagtgtcctatgaaattgtgcagagagtgattagcaaagatcataacaaacaacgagaggtttttctgcaagtgaaggctagagagttacagagcaagcagagaacgtctgatgacccctagtctctgaccagcagcctccgttgtccaccgtacacctgcctggcccaacagctgaaacaaaaagaacaaacatgcaattacattaaaattcaaaacatggtgagcctgaaatcgaggttcctttggaatgcatgaattttacagaattttcatggcctatcgaccaactatacctttgcaaccgatgtacccgtcgccctcgtactggacgccattcaccactgggcactcgcacaccctacccctgaacgtgtcctgcgtattgttgtgaacacgacgccagaaaaaatcagattaaaaaagctttatcgatatcagacaattacatcgagatgatacaattaatctataaaaccatgtagtaccttgcaagccgtaacgttggttttctcgtctctccagcaaccgccgttcctgtgcaggcactcgttcgtctcgatatctacagttgaagaaatgaaaacagagatttcattagaatttcattccaatttttcagaattccacgaaacaaaacaatatgtttctctgcgttttctacgcaccattgctcaagcagacgcgaggttcagtgccctccttgaagccggcacagacagctttcagcacggccgtcctctccagtttcccttcatttttcacaaccatttttgtttttttaataatggaatgtaacatctatgtctttactcaaagagctacagttaattattacagaaagctatttttattgttgttaggaatctctaatcagcttcagtgtttgcaagtaactaatttgttcttaattatcattcttggcgaaagagatgtgccaaccaacctctgtactggacgttgttgatgacgagagtaggcaagatggtcacatcccctcgcgatccacggccaatctgatcaaaggcaccaaaaccaccgacgttaatggcttaacacatcatgtaatgcaagagacctgcgagattgtgactggccaacatctctgacacctgaagattaaaacgctaaaaaaaattcttctcctaatgacaccatgaacagtatagtttcagtcactttgcatatatacctgatcttcctgctctttggccaagacggcgttgtcggtgtcggcctctggatcgcccatacattccagcaccttgtcaagcgacagacctaaggaaagaaaaaggtcaagaacaaaagaacatttgctattataaaagcaccaaattcaaattatagtgtctacagataatacgcatgtgcggatatgtttttaatacggagttaggaaagtggatcttttttaaaagttacatatgaacaattgcacatatgtttttaatatggagttaggaaagcggatcttttggaaaagttacatatgcagtatgtttttaatatggagttaggaaagtggatcttttctaaaagttacatatgcacatactacatccgttctaaaatatagtaaccgacgcatcctagtattcatatttatccagatttatagtagtaagatgtgttcaattcagctttagtttgatacacgaaacgatttaactattttttgataaaaaatatgacgtcataaatataaaccactcccattagtgaatttaagtactttttgctggcctctatatctttgtagacatactcaaggtacatgcgtgtgatatgcataatactccctcctttttaaattgatcatcatataaagaaatctaaattttcttaaattgatcatcatataattgcatggacatgaatttcatcggaatacaattaatatagcatgggagaatctgtacatactagggtgtaattgatatggtgttttaatcgatacatacattgtgagagaatgtgtatatgatgtcttgattgatgcaatttaaattatccttgatcttgatgcataagcatatatgatgatcattttgggatggagggagtataatactcaaggtgcgtctttcgtgtaatggcaaattagagcaagtaacgaagaacgatgaactgatcgatgagcatatgcacactgaatgtatggtaccatggatctcattctcacctagggccttgacgacgtcctcggcgcagcccttgctgtacttcttctccttcatggagcacctgatcttgtagtccatgacgtagtcccaccacgcccatggccgcccggtctcgttggccacccggtgcacgcacagctgcctcaggttctccaccaccacgtccttcccctcgtacccctccccgaaatcctgctccgggtccggcgcacaatacctgcacgcacccatcctcaccggagctcgatcaaccactccatcgattcatggcgcatgatggtgtccccaccggagacgaagaagaggatactatgatactctttccgtttttcagtttttcagtgtatgacgtcgttaacttttttttatatgtgtttgatcatacaccttattgaaaaaaaaatgtaatcaccatttatttcattgtaacttaatttgtcgtcaaatgttttgtaattaagcatgtcttaatttttttaggcaaaattggttatatagcatcgaaa

SEQ ID NO: 56906 - DNA, 5860 bp, Oryza sativa
cccctcattgacatacattatacttatacttgtgaggggtacaaacgtcatatcgtatgtgtggctggatcaagacggacggaaaacgatcgagaattgacggaagtgttaaaaatgggaacatggtgaactttgggtgttcttaaagtgaaccggtaactttcggtgctataaaaccaaaaacgtgaactttcgatgttatataaccaattttgccttttttttatttgcataattttttttaataaaatgaatggtcaaaagtttgtaaaaaaaaagtaacaatgtccaatattttttaaaaaagaggtacttcatattataagtagtctaagtttaaccaaatttatagaaaacttagcaacatttccgacacaaaagaaaaatattatcaatatacataaatgttagttttagtgaaaccaatttggtgttgtagatgttactaatttttctataaacttaatcaaatttaagtttggatataagaaaagtgaaaacgacgtaataataatataaaatgaaggaagtatgattaaaaaaaaagaaatcgaaacgatttataatctgaaacgaaggaagtcacttgcctgccatggttgatgcactgggacttgcactgctgggtgagcttgaaggcctcggggcagtaccaggtgatgtagtgcggggtgaagagggcgtagccacctctctccatgatctgggcgtggccgcggaagccgcggacgaactccatctgctcgtcgcaccgggcgccgcactcgtcgttgctgttggtccacagctcgtactccacccgctcgtcggggtggggcatcgactcgcgccagtccagcttcaccaccacctccaccgccgcctctgacgacggcgacggcgacgacatcctcttgagggactcgccgaacgcgcggttgaccagcgcggacgggatgctgatccggtcgatgtactccgtctccggcgactcctccggcgtgtccatcgtcagcagctgctcgtccacgttgtccgcgatcagcaccgccgccgcgcccgcctgctgcgcgttccacgccttcagcgcgaagtagcactctgaatatcaacaaacggaacagtttgtcaggctcacatacatacagggggcgtaagtggctaacccggcgtaagcccacttataggtcaaaataaacgggctcgtggtttattttgatttactacagtggatttcgcgggttggtcacttacatcccacatagtcatagtatgtaaggttatcaccgacaaaagaaattaaaccataatgtttattagcgattaaaaataatttattggtaaattttttatatacatgttcttagcgatttaaaagttaatgctgaaaaataaattacggtaaaaaataaccaaaatatacttaaaataaagatttaaaattcaaatagttgactgataagttaaagaataaaaattcaaacgatgaagctgattatctgcattaaaaatattaaaattgcttcttctttattgcaactaaaatgcactgaattgagtgagaatttcagtatattagtacagaataagtgggtcaatttgcaattcctatttcataatctgatggtaaaagtgtcctggtgcagagttcagaatctgatggagagtggcttggaaacgaaggatgaacaggttgttcagtgctgcctttggcttgaaggaattgagagacacctgctgattggtagtggaggagttgtgatcaagtgcgttgcagtggttggatcaaataccgaatcaggtatgagattcaaaattcaaagttgcaatggataaatgtacggcatatgtatcaagaacctattctcgctttccttggttcagagttatctgaaactctgacggaaagaaaggaacaaactcgtcgaaatgcttaaagttgagccgaatcccgaaagtaattaaactaagtgtgtgtttgaatcttataagtagtgaataagaagtggttaacatgtcttcaataatggctctgaactaagattccgtcctagttattggtattatgttaggtagtattctgcaatattggacttgtttttccaggcgaaacaaacaaaacaatttgattcagagtaagtgatctcagttctcaaacaatttcaaaaataaattaaaaagttttggtctaccatcgttcaactctgctttcagaactgaattataaattcccttccctcgccacaataaaaaaaatatatatgaatgcaatctttcagacttctaaagttggacaacaatccacatcaaagaattaaaatactatacaacttaaccatcatgcctaccttgatactctcttgctaaccatttcttttgttgtttttttaatcagtggactagctaaccattggattgacacaacccattaacagaacaaaaattggcatgacttagaacattggaatcaaatcatcaccaaaccaaactctcaaaatccaaataatcatcaaaaactaatactacttctcaagtttgttcagttcagacttgcagactttggaacacaaatttcttgaaaaatacttatgcaaatcaaaacaagcacaaactaattgaatcaatcattggaagtttgaaatcaatctcctacctccacggtcgagcaggaggatgaccgggcggcgagacttggacttgaacttggcgtcgaactcggcgcagccggtggccttcttgtcggggtagacgacgacgccggtgagcgtgccgccgtagtccggcacgccgaagttgccgatggcggcgtcgtggtgcccccggatgtgctccggcgagagcaccctcacgctgctcttctccaccacgaacctccccatcgccggcacggcggcgcccaccaccgccaccacgacgacgatcaagaacggcacggccccaatcccggcgagccatggcgccctcctcgccattgctgcaactcgatcacctctctctctctctctctctctctctctctctctctttccaagaggcgacgagaggaggagggaagaagacgacttcaaagaagaagaagatgatgaagcttatgcttggtgggcaccaagattaggtggctctcgctcgcaagtagtataaattaaatagaaatttaaggaaaaaaatgttcttgctgttaattaacaactgtgagacgagctcaaccgtgcaaaggggaatggatggatggatgaaaaaaaacaaaggatatcacgagaagaagatgaaaaaattgtgatcttttgagaggaaaaaataaatgggattggattgcttgggttgtactgaaatccgtttggttcgagaggggcaaaggtgtcaacttttgtgacgtagaagagaaggtgagaggaggagaggtgtgaggcagcatccaactactagcagatggggtggtatatagagtaggagcgcgaaagcgacaatttttttttgacaaactgatgaactggaaattttggaattgagactgttttgagatgaaattcacttggggattattaattgatgatgctttcatgatgttaagagttggagtaatatctacaagatgaggtcaacatgaccctgacctgttctctgatgatagaaaaacattttttttccaggatgcaggtatctatcagaactgctgctacacgccggggcgggctcacatcaagaatgcttacttgtaattgcagcaaaaacaaggaaaaacaagggaaaaataattaattaattttgcatgtctgatggttcacaagttcgatcatattgtccatatggaatatatgccttgtagtgatacgatatttcttcagatgtaacactgcacttgttctgaaactatattatttgagggggtgttatgtgggtgattgcttaccttaatggacacatcatgcccaactaaaatccgtctctgaactttcaatttcttgttgaggacacagtacgtacttgcattgcttgcttcaaagacaactcttgtctgagagagagaggagatccagcagcagtgttctgcaattctatgcgtatggtagaagggaaaagatcaacacacttcctagtctgttcttctggatgggcatattgcaggaattgtgtggatttcatcagaaacaataggtgaaaaatgttgttttttttctggtaaaaagggtcgctttggtaattaacttggtcggctgagtcttgatcgggtttggtctcctgttattagtgcaaccgggcaaagcacggcaggttagagtcgagactgaccgattcttcagtggacacgagtgggttgacggtcacgcgtgctcgttgggtttgggtttgtactgctccgtattcactatctattgacattttaggaagacttgcaaaaagtgatagtatactactacctccatcccaaaatatttgacgccgttgacttttttaaaaatatttgaccgttcgtcttattcaaaaaatttaagtaattgttaattcttttcctatcatttgatttattgttaaatatatttttatgtatacatatagttttacacattttacaaaagtttttgaataagacgaacggtcaaacatatttaaaaaagtcaacggcgtcaaacatttagggaaggagggagtagttgctgagttgagttaggaactccacctccacatacggaaaacaaatattattattaacacatgattaattaaatgttagtctaataaatttaaaaaaatggattaatatgatttttaaaacaactttcttataaaaaaacttgtgaaaaaaaaacatatcatttagcaggttgaataaacgtgtgggcggaaaaaaaagtgtgttgggaaagaaggacgaccatagccttaaaggagattttcttccttctttctcaacttatctccctcgttttctatgcgcgtgcttttcaaactgctaagcagtgtaatttttttttaaaaaaagttatatacggaagttgctttagaaaatcatattaatctatttttaatgtaagccagctctcttgcacactgctatttctaaaagtctggtctcattctaaatgttaggatttgagtttaagattaatttttagtggattttttcggcgctcttaaaaaaattctacctaaacttattctcaacaatcacatttaaaaatgttagcatttgagaaaaagcattgtcaagcgacgccaatgttctaggtatgattccttataatgatcgaatggtagatttttagatatttttttaagaatggttctaacttcgaaatttaattttaggtctagaatgaaattttgaagttacctaaacgcagctatgcctatctaatttattttgtgagagctcttcagccaactccattctatttttgagtgaagtttggttaagcttatgatctaagagtgatggagctgaagataaagccgtgcaaaacgggcctaaatatgtcttaaaaaatactacaatgaaacgtcttattaaaaaataaaataaaattttgtaatatatttttccaatttttgcaatgaaacgtggagggcaatatccacacgagccacgcatcatccagcaaccaaccaaccactactaccactggctacactatgccgttatcctctctctccctcctccccctccaccgcgctccgctcccgccaacttcaaattacccgccaccgccgcctccctctcgcgccctcctcctccccctcctccgccactcgccgctcgcgcgccgctcgcccgtctcccgggcgcgtgccgtagcagccgacggcatggccgcggcgaccgcggcggcggagacgccgcccacgctgctcgagtacatgggccaggctggcgcggccgacg

SEQ ID NO: 56907 - DNA, 2425 bp, Oryza sativa
acgcgcccaagccgctcgacgaattgtcggtgcgtgcagtgtcagggttgcgtgggttattattgtctgcattctggttctcgcatctatctacatgcatttcatccttcttcttttttttaaaaaaaaaagaataggtccattttttgtgagattgttatcacatctcagtcatacgcttagcagctggagtagcactcatttggagtgtaaaatgttcatttactaattaagtttacttgaggtaagttgtgcaaagtgcacacaagagactttccccacattttcattcttgcattctcaacaaaatactacttgcatttgtggtgaaccatcaacagaagcacttcctatttgcaaaaaaaaacagttattgtttgtctgatgctactaacttgcattatagcttccaacaacatcaagactaacatatttttcaatttagaatgagatcatcttgtcatcactccgaagatctggaaaggttgcagtgatggcttctgaagaaaatcatctccccatttgggtttccaacgacagcccgtatgttgttgttacggatccgcttgatggttctcgcaacattgaggtatccattcccaccggaacaatatttgggatatacaataggctggcagagcttgaccatctacctgaagaggagagagctcagctcaattcactgcaaagcggcactcaccttgtcgcttcggggtatgtgctgtattcatctgccaccatattctgtatcagcttcggtgcaggtacccatggcttcaccttggatcacttgactggagaatttgttctaacacatccttccatccaaatacccccaagaggtaactaataagctgtaattcaataatttgctaattcccttagtcttcattaaatgttaaccagatgtcacctaaattcacttacactagtagcgcaagttttctcaatttatggattggtggatgaacagtttatcaatgtcagtaatttgaggagatgttttagttgaacagcggcaagagtgcttgcattgtgtttgagaacatgacgtagagaaatttcttataactgaacgactgaaatattaactgtgttgaacttagaaatgcatgctttcatctttgctgaaaagctgtaatcctgagctatgccaggacagatatattcggtgaatgatgcgcggtatttcgactggcctgagggcctaaggaagtacattgacacgatcagacaaggcaagggacagcatccgaagaagtactcggcacggtacgtgtgctcgctggttgctgatttccaccggacgctgatatacggtggagttgccatgaaccccagggatcaccttcggttggtctatgaagcaaatcctctgagtttccttgctgagcaggcagggggcaggggttcagatggcaagagcagaatcctctcgattcagcctgtgaagctgcaccagaggctgccattgttcctgggaggcatggaggacatgcttgagttggaaagctatggagatgtgcaacagaaggttaatcctggatatgaggtgtgaagatatataaccttagataatgaggtctgaagataatgtagcatgcgaaaagagaacagggggacctactggagaactctgtatttgcaaaaccgatgtttttacctgtcaggttttctgtttttgtctccgcgactatgcggtttcactgtgtaatatagcagaaaaattaggctgcatttctcccggtacgaaatggaagggacaacacaaatttatatgtaatgcatcctttggctacatggacacttttatctgcaacgtgttctgaaatttcttttgtctctgcagtctgtacacttctctgcaatgtggtccggttagttcgatttaagagcagcaataagagtaacttttactatgaaccctgcaactttgtaaagcccttgcttactatagaacttggtgtgattagccttcagttgaactggtcctacctatgaggacaacctgcagccaaattgctgttcttattaggcagtgtaaagagctctcttatcctgaacttgaactgtttttctcaggcaggctggctgacggaacaatcaaaactagagggcatttccggacgtgtgattgcgatgagacgtgttgcaatatccagaccagtggctagacgtgttaattttaacttgatgaaacgtaaagaaggctggatccaaactttaattcttttccatcacatcaacctgttatacacacaatttgttatacacacacaatttttcagtccaaaatttacgctgaactaaaaacagccgaagtttgagttggaaaaaaactttatttggatttgttgtgatatgcccattaaacaacttaaccaagcgattaaagactgctgctatacgtgtgatccagttgtat

SEQ ID NO: 56908 - DNA, 4469 bp, Oryza sativa
ccggaaagccgccgccgccgccgcccttctacttccgccgcctcctccttcttctcgagaaggctctgcaccacagacgagagctgagccgcggagcacaatgtcggcggactcggcggcggcggggagggacgctctcctggacgagctgcgcgcgctcatggcggcccactccccgtcgctccacgcgctcgtcgtcccgtccgaggacgcccaccaggtccgtccgcgcccgctgccacctcccgcggagtcgatcagatcagatcgggcttggatttttgttgttgttgttgttggattttccgttttgcgcgatctcttcttcctctcgatgatggttgaggatttgggtgtggttttgtgggtgattgattgattgattgcagagcgagtatgtgtcggagcgggacaagcggcggcagttcgtctccggcttcaccgggagcgctggtatgttgcttcctcaattcatcccttctcgtttcccaggcgatgaacgctgtgtattgtcctagaccaccagccgatgagtctgttgcgatgagttcattatacaatagtgcaattggattatgcaacgttgttcagggttgcaatttttaccattttggtgatacacaaagtggagttctttttgctctgcctgacatgaatcagaaagcagttgactagtaatagaggctaatggttgaaattttaggagcagttatgatttatgacactgttatgtttttggaaatttaggtgattaacagacatttttggactggattgttttatacattgcttcgaccaagcaaatcgtaataaaattattgatagcttcgctaccatttatagttatggtttaatctagctggactaaagtatggaatgataaccacctttgtactgggaggagcttaattgattcctattttgtagtaggatggagttgaatatcataaaatgtggatgtaacatattgaacttgttgatttcttttgttttcccccagttgtcgtaatcagagagttgcattaatttctcagaccgagctatattgcgttgctacacaggtttggcgcttatcactatgaaggaggcgctactttggacggatgggcgttacttcttgcaggcagagcagcaactcactaatcgctggaaattgatgcgcatgggagaagatcccccagttgaagtttggatagctgatgtaagtgttgacatctcttcttgatcatgttcatgagtttaatttcccaagtcttacataataaaaatattggttcacaaaacttgtccatggaaatgaatttatttggttataccctctcatttttttttgaacagccagatcaaaggtttatccttgctttttgaattctgccacagtttttgtgttgtgaaatcccaaaagtggttttattcttgttaattttagctagttttatctcccaaatatggtccttttcattttgttaaccatattcagttgttttgttaataccccaagcctactatctttcttcctgtctgctgtagattcaaggaactgcatgatagttggtttgatatatgggagttccttccaaaattatcagaactaccagaattttgggcacataaatttattttgatcataccaaatgcaagcagaaatttaaagatctacttgaggcttttattttgctagggagaaaactaagaatagtcatgccaattattcaatgattagagagaatgggtttagttatttgttgatctgcattgcatagcaatactcatgattagcgtttaattttattctgaataatgttgtttctaactaacttttgtggcttgtgtttgttgctgtgcaatcagaacctgtcagatgaagctgtcattggaattaatccatggtgcatctctgttgacactgcccagagatatgagcatgcattttcaaagaagcaccagacactgtttcagctttcttctgacttggtagatgaaatatggaaggatcgtcctcctgttaatgctctacctgtatttgtgcaacctgtagagtatgctgggtgtagtgttaccgaaaaacttaaggagttaagagaaaaattacaacatgaaaaggctaggggcattataattgctgcgcttgatgaggtactattagacttatttatttcttggtttcttatccactacaatatattcaattttgatttcttgagaattttgtcaactttgccagttttaatagttgtccttttgttattcttatttaggttgcgtggttgtacaacattagaggaaatgatgtgcactacagcccagtggtccattcttattctattgtaaccttgcacagtgctttcttttatgtggataagagaaaagtatctgttgaggtcagctaatccactgaacacattttcttcaattattccactatgtcgttcatagaatcgtagtcatgattttgaggggcatgtagtgaactgtggctcttgtttggtccaggtccagaactacatgactgagaatggtattgacatcaaagactataatatggttcaatcagatgcaagcttgcttgcatctggacagctaaaaggttctgcagtcaatggtagctctcatggggaaaatgatatgaatgagaattcaaaagtttggattgattcaaattcatgctgccttgcactctactcaaaactggatcaatatcaagttctgatgctgcaatcacctattgctcttccaaaggctgtgaaggtttttttttcttttgtttttaattcataccacgcctgctgaaagtttcagaagaacggggatagaacattttacactagaagtgtattttgttcaagtattccttttgtttcattctatttattttaggctttttatctatggaaaatctgctatctgacattaaaagctttatcatttattaatctatctctttttttatttcttctaatgatggtatactaaaatcctgtcgagctggatggtttgaaaatctgctatatttgcaagttttatcatttattatgcctatatttttaatttcttgtaatcatggtacagaatcccgtagagctggatggtttgaggaaggcacatattcgagatggtgcggctgtcgtgcaataccttgcttggcttgacaagcaggtcagtatgaatttgtctctcatgcggcgtattagtcttggacttcaagcaagtgttcttttgcagctgcaaatttgtttagttgtgatgtagtccttctaattattttctactagctcagatgatcttgttttaatgacagatgcaagagaattatggagcttctggttactttactgaggccaagggatcacagaaaaaggagcatatgtgagtatgcactgatattaaacttatggttcttttgggaacatactccctctggccacaaatgtcatttgactttcttttccagtcaaacttttgaaactttgtcgatcaataaattttaaaatacatagtttgaaaacatagaaatggtatgcatagatattgtcttgaaaagtattttaatattatcatgaaattattagaatttaccataataaaaaaatcatggtcaaagtcacaccctgaagacaaaagagtgtcaaacgaaattatatcatcattgtatggagtattgaccttttattcacctatacaaattggaaccatctattatcaaaagatgcccagcttttctttgtagcttaggtctattatcctcattaggcccagcttttggctgtcagaactgtctaaatcagtggtttcatgccttcctgataattataaattttagaatatttttctaaggaggttgtgatagagttttcttgaacttcatgtgcaatactgcaacgtaacttggttgcaaacttgagacgcattttttttaatatacgttgttactgtcattgttcctttttgtataatatttaaaatgtagttccttcatttttttttcacttctgcatctcagtagtgtgtgcttactctgaacacgctttcagaaaaaaaaatcttctgtattcagatcatagaccaaggttgacatgttccttctttgttttacctatctggaatttttgtttgtccaattttctcatttacactgcccatttatttcctttgggaggtgtgcacattgttttgttgttttcactgaccatgatagtatgacaccgtgtgctctgctcagacagttgtatttctctgcccccttgtgtattttttctaaaattcaatgttgtaccaaatgtacttggtcttacttgtgggctcttgtactattgctacgataatacatatggagtacgacttttacatttggcaaatcccctgaagtctgaagtttcaatgctccatgattcctttgttcttagcctgatttttgttatatatataaagaatcttaccattttcttgatacgtcatttgttctatgcatt

SEQ ID NO: 56909 - DNA, 8335 bp, Oryza sativa
atcttttgcgtaaacagtccaaaaataaggcctattttttgcacaaaaaattctacattcactgacttcgctctgagctcttcattcaggaatcaggacattgagggtcttgagtcgtcccctctttctctgcttactgtgtgtttatgtcaaagtaaccaaaaaaaaagacttgttttcgtggaacatcttttctttggttgctagatgaatgtaggctgtgttcgataccatgggttgggaacccaaatcctgtgcacggaaaacggagcggtctattagcacgtgattaattaagtattagcaattttttttcaaaaatggatcgatatgatttttttaagcaactttcgtatagaaactttttgcaaaaaacacaccatttagcagtttgaaaagcgtgcgcgcgaaatacgagggaaaggggttgggaacctcctcatccgaacgcagccatagaaactacagagccaaatgagggcattttgcagttcatagtctcctgctatactacatcttttgactaactggtaatatttctgcagcacttcaaaggtctgagttttcctacgatttcatccgtgggaccaaatgcagcagtgattcattataaaccagaagcaagttcatgtgctgaacttgatgctgataaaatatatctgtgtgactctggggctcaggttgagtacatttcagtcaaactcaaattttgtggtaaaagacttgcttgagtctaattctttctatggtggtatgtttgcagtatcttgatggtactacagacattacaagaactgtacattttggcaaaccctctgagcatgagaagtcctgctacacagctgtaagtttattttttcgtcacttgctaaaattttcttttatttagaacaaatgacatgtcaaatactaagttctatttagaacgaatgatatcctaatagtgtaattgttggtcaaagtaatatgccttatattttgaaatggagggagtatatgagtgtccaataatcagttgacttgagctggagccttaccagtgtaaccgcttcatgtgttttactaaatacggtagaccagcatgcaggacatagctgcataactgctagctatctttatttatttgacaactgtagtattattttccatgaatttaagagcttagtggctgacatgcaacatgttgaaagtttgttttctgacacgttgcaatgttattggtttcctcatttcctgtattgcattacttgcccctacttaatggagctgaaaattccattgttgaatattatgtcaacagtggctggtcaagttttctttacacacttgttactttatttctcttgtagaaataaacatcatattaaatgcttgaatctaatagtttacaagatattgtctgtgaggttttaattttctttgctactatttaatctatttctaatgcaagtgatatcgaacattggaaataggttttgaaaggccacattgcactggacactgctgtatttcccaatggaaccacaggtgagtgagtgttttgagcttttatacttccatctatatgaactcaggagatttaacattgatcatgtgtcccaatgataaaatagctgccagatgtaccatggagttttaacatcacctaatagtgtagtatgtgataacattattgttctttatgagtgcatttacttataaacatgcgacatcatgttttctcaaagcctcgttgcctcagagatcatgtccatcgtttctttaacatttagaaactgtaagaagattccactaatcacaaatgttatttagtgatagactccattgtttctttaacatttggaaactgtaagaagattccagtaatcactaatgttatttagtgatagactatctcactaaatttgaaaaaaaaaaagatgacagaaactagcaagtgatgaagaaaatgatttatactaccatgttttgacaccaatttatgttcattgtgttatacttactttttcaagttatatttcaacaaaatccatgatatttgtgcgttacttaaaccttaacagggcatgctattgatattctcgcacgaacaccactttggagaagtggtcttgattaccggcacggtacaggccatggtattggatcttatttgaatgttcatgaaggtcagatactcaattgctggttcatcctcttctatgacagtaaattatctgattgtagtgctaccttgaaatgtttaatccattctgtttgtgcttacaacccaggtcctcatctaattagcttcagaccttctgctagaaatgtaccactacaagcatcgatgactgtaacagatggtcagtaaatatcctaaattaaccactatttattttaataggactatcaacagtttaatgtgaaactactttgtaattcttacttcgatgatagtccctcttgctgcaatgatcgatgtaaagttcaacttgcacaatcttttcttgcagaacctggttactatgaagacggaagctttggtataaggttggagaatgttctgatagttaaagaagccaatactaaatttaattttggagataagggttatttggcttttgaacatataacatgggtaagtttcttcaatctccattttattaaattattaactttctctttggtaatctccaagtctccgtatcaatttcacaagatatcccggttgataatacattgtattcttgttttgttgctctgtttatacctgtatgaccattttaaagtcagcctttgttgccagttcgactggcatttcatgatctctaaatacaaaatgctgctcaccatgtatctgcgtcatttgttttgctcatgttcatgtattgatgaatttcttgtgctatgcagactccgtaccagacaaaactgatagacaccaccttacttacccctgctgagattgaatgggtaaatgcgtatcactcggattgcagaaaaattttgcaaccttacctgaatgagcaggagaaggaatggctgaggaaagctactgaacctatcgctgcgagctgttaagccatcaatcaactagctggttgacgctacatggacacatgacacagggtcccaaccggttgcaactattcgtgctagatgtgcagatgatttctggcatgccatgcgcgtagataaataaatggctatccctcaatttaattacttgcaataagtgtgaatatatagcagaaaacatcacaatcgattcttttgcgttgtcattctgctaatgttgaatgtgaggatggaagtagagataataaggccgagtttagttccaaactttttcttcaaacttctaactttttcatcacatcaaaacttttttacacacacaaacttccaacttttccgtcacatcgttccaatttcaaccaaacttctaattttggcgtgaactaaacacaccctaaggccttgtttagttctaaactttttcttcaaactttcaactttttcatcacatcaaaacttttctacacacataaacttccaacttttccatcacatcgttccaatttcaatcaaccttccaattttgacgtgaactaaacacatccaatcaaacttccaattttgactgaatttgcaggttgcatttgtacagttattcagatgcttgcttgaatgccctgagcagtttggttggactaattaacagtaatcgcatcatttcaaagcttaaaattgaacacggtctgtttggaaaattcctatcccaggggcggcatcacactgaagtttaataaagagtaaatatcacattggaatttgaccaacattttcacttgacaccacatatctttacagttgcagtttggaatatcataggtgtttgtcagagaatgtcaaagaaatggttcaaaccatcattcttagtgttgtagtatcacgataaatatctttagaaactcagaaaatcccatcaaatggtcttttagaaaatcagaaaacaaccttttttttaaaaaaaatcacactaaaatggtgatgtgaatatgtttaaaagtgtcacaaattaatctatacggagggcaactgaataaaaatagaatagaaagtataacttaattagataccactcaaactaaatagaatgtaaaaacatagtacaatgctttgttttttatatgtatccctgtgtaaatctcatatgaagttccctcacatatttcgtcggtacccttacccttaatccaaacaaaatgatgcatagtgttaagtgaaaatgttagtttaactcttggtcaaaataaatgaccagatgtgaaatttaccctttaataaaagatgagccttggccccattcgtttctaataaaaatgaaagttaggatatggataaaacaaaccaataacacatgattaattaaattttaacacataattaattaaattttaatcattacaagcttaatttgaaacagatttatttgatgttttaaagaaatttacatacaaaaagttttttcgcacgcatagaatctgtatcctaatcagaagctaatggggcctttacttgggccgatatttgcacgactgaccctccaactattcgcattttgcatttcgatcctccttttgcctttcctctctcctctactccacacggcggcggacctccggcgaaccccgccgcgcgaggccggtccacgggaatcgatgcagccatgcagggttaacgagcgcactcttacctgctgcgcctcgcctgctcgtccgccggagaggcttccaggcgacgggggagcctccgcctgctgcgccggagtccgcggggcagctgggggatccgacggcggcgacaaaaaaaggtacagtggagtacaggtgcaacctaggattcagaatatccattcgaaattggtgttgcctgtgataatcatggttggttgattagcattctagagaattgaaatcgagaaggagcttttttatccaataattagaaggaattatgagtgtgtttagaattaaacacggaatcaccccccttaacgctacaatgaacaagtgcatctcttctattgaactgatttacctttttgaaattcaggttacttgattggatctaggagcttttttttttttttgacatggtgatcaaggtttcatgcagagatagaacacacaggcgagggctgaaatggtcccatcgatcgaataatggtatcacaacatgcatttggccaaaatgacaccatggtgatcagcaacaaagggagcaactgataagctgaacccttacatccatccatacagcctgcatactactacacctttggaaaggaggaggatcacaatgttgataatgatgatgatgtacaaaagatggcagtcaaaatcaactcaagtatcactgctccaaggcaagcttcttgtgccggtcgagatcgttgaggtaacttgagcgagtataatcctctgaatcgccggagtcgaacatgaggggtttcatgagttttggtctttgcatttgcatcatttcgagtgattccctatcccccttcaagaaacggaccacctacaggcatcaaaccaacaggtcagtttacaatccaaattgtttcttttttagcctttacaatggccgtatagttagcgtgttcatcgcactcaccgatttcatgctaggccgcgagcttgagctgtggtgaatgcacatggatgccactgctaggatgtgagccatttcttctggatcatatccaacatcaagagaaggatccactagttccttcatgttgttcgagtcgagcaatggttttgcctatgcacatgacaaacaacagcttgtgaattcaagggcttcagatgtatgtgattataccagttcatgttatccattcaagtattgtagaattaacttttgatcatcacttgcctctctcaatatgaccagacaatgatataaaatgagctgatttgaatttttgtataatggagcatattagagatttgcttttattacccatattactaggctttgtctggaggaatccacggctttccgtcctgtcactagttcaagaagcaaaactccatatgcaaacacatcagtcttctcatttatgatcccgtgcatgaaatactctggagacatatacctaagaaagggtgtaaagtctaagttaaaaccaacaatggcattgtttctttttctgggtacgattaaatcattgtgatgaaactgaaaaaaacttatcgaactcacccgaatgtcccttcaatggggaacacaacatgatgagtccatttgtcaggaagccactttgcaagtccaaaatctgagatctgtgcaatgagggagtaaaaactgttgcatttaaaagaaccctaggaatcatataacagataggactacggcaagagactggtagtagaatacatacctgaggttggtaatcttcagttagaaggatatttgatgctttgatgtctctgtgaattatgcgtcgatggcagccttcatgtagataaagcagtccttcagcaattccaagagcaatattgaacctagccttccacttgagggctccctttgtgcctgttcagctgaactccattttatcaccagactaagggtattctaagtattctcttatattgattttttttttagaaagaggatgatgcttgagttcagatatgtgatacggcctatagtatatgcatttaagaggcaattgaaatgagggctacaagaagtgataatgtaaaatttgtatgaagcctaccaaaatggaaatcacaaattcgcacatacttattggagaactacatttcatagttcagatactgcctaaatgaatatgttgtactacatggtagcatgaatgtcaagagatatctgttctctagttgattcctaatagtaaggtctatatatttcttacttttctaaaaaatgatatatgatgtaacatgccaccacatagcagcaatgcagcatatctctcagaaattggattcattaagtaaagaatatttagaggaaaccataccatgaagaacagaagccaggcttccatgaggtgagaactgaagaaccaagtgcaagcccccttccacactgaaccccaagagctgtgccgcatttggatggttaacatgagctattattccaagctcagataagaaatcgctaatcctgtcctctttgttaccaccttttgttagtctcttcactgctacaaattgtccatcagcaagatgtcctttgtacacctcagcatgcccgccttttccgatcaaattttctagtaatatcaagcatgaagcaaaagattcagagaatatttaacatagatgaagataatataattaggccaaaagctgtactttgtatcacatgacccttggagctatgatatagaggcagagcataacagctaagatttctgtattatatgctagagttaccgcaatgtagaacaaaatcaggccctatttgttaatgatttggtattacagtgttatgcacttatactttaatacttctcacttttctaacttctaatcagtaatcagtcatcattacactaaataacagttcatgatttgaatctcaagccctatgtttccttggtgaaattatactgctgcagttataaattcatagcttagtgttaaagctacatcccataagttctgcaatgatagtaacatggcctaatcgagtgacagcattgcagcaacaaagaagtaagttttgcatatcacctgaactgaatttgtcagttgcagcacaaagctcactgtagtcgaagcttctccatgatggcctccacttgctgatctcaggaaggatctcaggagcaatggcgccgcaatcgatctggttcttgccgctccgcatcctctccaggtacctcttaagccctgtggtcttggttctctgagggaatgtccccgctctcgccatcgacttcctcctcctgagtatcaatccactgatcaggttcctccactgcgtattgtgattcgactccgctggctgctcaacggaggagctctcatcggagtcgacactaccggataccgagatgtctagcaccgcgcgaggagagctctgatcggtgcactcgctgctgtcatcgttaccggccttcgaatccatcttaggcgcctctttgctacctccatcagaatcagcagattggctgctactgtcaccaccactactactgtcactgggttcttcagtactgctcctgtcactgggttcttcagtgctgctcctgtcactgggatcttcgcttgatacgacggcttcggttactgacccgcta

SEQ ID NO: 56910 - DNA, 1295 bp, Oryza sativa
gcttcgtcggaatctctgatggtgttttcttggtgctcccctggccctgaactcagcataggagatgtagacatagcatgggctattatcataggtttgttatgctacaaaactgaattttatcaagaagacaaattaactacctactactacaaacatcaagacaaacaaagtgcaaagcaagtcaaggcaagaaacacatcatcatcacacacacaaacacaggctctcagatcccttgacagtggatgataaggggggagaggcttgtgtttgtctcgtttcccatgaaaaccacatgctgccagtcgacagtatctgaggcatttctataattcagagatttgcaccaagaattgacatgcgcaccaccctctgcacccttccaaaattgatgctttctttctatctatcacacacagacagacacacaactaagtctgaaaataacctgtgcatctctgtgatttgcttgcaatttgcgaaagatcatcaagagggtgcttaaatcaacataaatgtcgatttcaaagattttggtttggtgagaaaaattggaagaacttgacaatctacccatcttctatatgatgatagggaatggaagcctgcccaacctaatagcatatttaaaagttacaaagaagaccagaatccagcagctgacatctctcttttttttaatctcttgttgccctcttagaaaatgacatgttagagcttcaaagctgtgagcatgcctggaaaaaaaagccatgatttttccaggactaatggagcacttagactaaagcaagaaagaaagagaagatacagacaagcactaattgtgccacacatgcagcaaagagatgaggaaattaagcagtaaaaaaaataatcaaaatcaccacagctaaccttccttaacaagcagatcctcctgcctcccatcttcattaccgacctctgcagattcaatcaccaaatactccttcagtttcgtcatcaccaacaatttcttcttctgaatttctctctctctctctctctctctctctctcttccccaagacggacagaagaagaagagagaagagagcagaagaagaaagaaaaaagaggagcaaacttgtatgcgagaaacagaatatttgagagagaagagaagaataccttcgttggaggccatggacgacattaatccctcctcctcctcctcgtcgccgtcgccgtctccttcgctttcaaacgacgacgaaaaactcaacgggaggagcaattgctgccgatgctttcttgcattgaagtcgacca

SEQ ID NO: 56911 - DNA, 21238 bp, Oryza sativa
caatgcaatgagagcaatgaggctggtggtgtggtggtacaaccttttgtaggagtgtgtactactagtgacctctagacctttgtaggggacctacagcaacatgccaaagggagaagaagaaaaattattcagaaaacataaaaagaaatggactttgtaattagaaaaatgagctttgtaataatggaatggtttctcttggagaagagaagaggagatcatctggttggtggtggagaaagaatggatttggatgtgtctttgtctgtgtgtgttatctctgtactctactactcctcctcctgttcagtaattaatcgtcgtggtgcatgggattggatgttgctgttaggggacaatgaggttgatgtcgtgtgattaagtaataaacaatgatttattagtgacagtagggttggtaggtgtggaggataaatatctctcaaattagagagcctctcttccagtggagtatttattgtcctttgctaattttgctatggctctattttaggtgaggccttggaagattttgtgatgatctggtttttctcacaattccacctcttcagattttcaattttagaaccaaatttataagtttattcgcttgttttttgttacccaactctcttttcataattgcgatgaagacgagtaaaaattatacctgaaattatttttaaaaaaatcaaatttcaaaattatactcaagcatgtgtattgaaaggaacaatgaaaatgcagtggactattttattgtagaaagtcggcaaagtttatggatcatgatttgctctaaaacgtggcagcaatcaaggttcagttggaaagcttgcctaaaccattccattctttgaagataatgtatcatactacggttttgtctaaggatttcatgagaaaatcgcatgagaatgagatactatcattttttttacttggatatgccagcttattcccagtaatttttttttttgaataacctaatgagtgtgtatcataacagcgataccgttgaaattgtaagtgaagtcactttacagaatacagatactttagatttgtaaacaagtcacgagcaggaaaaaaagattcactcccttaggtttgcttgttggcttagaagccgcatcaacctttaaaatttcaaacttaattttaattttaaattatcctagatgttttattttcaccatttttttggcttctgaaccgttaagaatataaatataaaaagttttattctaattgtttttaagaaaaattatattctattttttcgttacttctttttttttctaccgcttatcaaccaaaatcaatcaatgatgctgggaaaaagaagaaaagaaaaactggttccgttagtacaggagttgttcggaatattgggcgcggctacagtaagataacgtttatctcaaactcaaattccacagttgggaacttcaaattccaaatcttcgtatctcaaaattccaaatttcgaatcccatgggagcatttaccccacagaaagcagaagcaaggacaaattgtagcattctcaccggatcatcagaataaatcctcatcagaataactcccatatctaattcagatatgagaagattcacatgtcctgcacagtgcagatcgccgacgtttacctcgcggatccattaatacgtcgttcataccacgagtatacactattgattgcatccgtagcactgttccttcttctactacttcttcttcttgttctgatatcttcttctcatcaataattcacaagactggttcttgaaatgttcccatcaatctctgtccagatgctcacccaggtcgaagatttttgttttttggaagaattttggtgaaatgatcgctgaatgcgagccagaaaagattatttcgcacattgattccagcaataaatttcacaaagatcacgtatgaatgatggcaaacggccccatcttttcgcttaagctcatgcttatcagccaaaattcaaattttcaaccttaaatttgaagctgattttgaggtttttttattgaagtttattttcaacctttatctttaggtcgctaaaagcatgtatataaaagttttattcacaaattaattctcgtttgtaaatatgctgtttggccaaataatggggccgaaagcttcttcgagaatactattgaattgtggatgaacgagtattcagctatagtatcagacatcgatccatggtttggtgtcctgccgttttcaggctcaaagccagttgacagagctcccattcgaggacgaaaatcaacgaaactccttaaataaccaccgtttcgaattgacacgtgcaccatgaacacgacacaaattctaatccaaatcgcctctcccaatctccattctccgagaatggatacaaattgctgtccattattcaactctgacggctgacgatggcaacgatgcatgcatggcaatatggcatgcagaagaggcaagttggattaggtaggtagtttagttaagtttaacagtgccatcaaggcatcaactaacctgaaaagtaattagtatgcagagttaagcaaagggattattgtactagtactgcaccttttgctgttcattgctgatgttgtactgcttgtactgaacctgtgtcgccaattaactgaagaatcatgtatggcagagaaattattttccattaataataatagacattcataaatagatatacatacatagttaaagttataattggaatacttagaccccaaaccttgtaactaaggataaaaaagctattacaagactaagctatatttgcttcaaccttactatgttcttatgcaacaccaacccattacatcgctcgtctacgtagaaacctggatattagaattgttgccagagaaaatgcgcaggggtcttccggttagctccacaagttggtgggatagacgacctgcgttcaaagcctcacccccttctaattatttgataatgatcattccctaatattcgcgttttattagaattgttgctagaaaattatcatctgttgctactcgaaccatgttgaatagaaaccacattgaggcacgtaatcgattggcagtgaaaagaatggagttggcggaccgaatcctcgccgtttttaatcgtgtcgatgcaactcgccaactgaaactgaatcaacctgtggtatcttcaagggatctccactccatcgagcagcatattttctttctcctcctcttcttggtctttggtccccttcttttaagcgaaaagtagcatcttttatgttctgaagaaacatgctaggaaaagacaaacaacaataagaaaaaaaaagtattactaactggatgctaaactgctaatgtttttcattgctcaataaattatccatgagaaaaaaaaagattataactgtcactagaatgcaatgatacccctctattcttttttacctttagttttggacatggacatggacatggttctctaatgtatatgtttcattcatcattacgttttctagttatatgtttataaaacttgttaaaaatattcccatatagtgttttttatgaaaaatatattaataccattttttccatatcaaatactaatgttttttaatctctgaatgttctaagagtttaagatttgactgcatgcatttaggacatcatccttttaaaaacagagtgttaaaaaaatttccatattaggtcgctggtttgtcattgaagtgagaggtaagttgcagcggcaaaggagaattagctcgttttttacagtagaaaattagccattccaacaaatcctagtctcagattgtttatgcattgaaaaacgtcgagaggttttccagctagctctactaagacattgcctgagttcaaagtctcaccttttctatttatttgatattatgtcattttctagtatttgcgtttttaattgtttacgcgatgaatgataagctgtacgaaataaacgaaacaacaaaaattaatctatagaatttattttcttttgttcttaaaagctgatactgaaaaataatttttgatgaaaagcctccaaaattaagttttaaaacttaaattttagtaactgctgataactcaagaagcagtgtgctcggtgcaaaccactgttttcactccattacctacatggtgaccaacgcatttgagcgctagcttattcagttgatggcaaagcattaatgcaatgcacgacatatataccaggatacagcttcctctgtcccaaagaccattatggataatcaattttttaggagaggacacaatatggtcctagaaaaaccacaattacaacacgcccagcactaatactgtcttggtaccattagcacatggcttcctagtgataggaaaattaaataaataggcctcatttttaaggcatcacccaaaccaaacggctccttaaattgccttcgtactgtactgatacccccttcacacgtcaacaccaaagaaaaaattagctctcctgatggcatcaaaagaaaattcagaaaaaaaattaaatcgagggaaattagctggcaccaaatttaaagaaaaattaagatgtcaagagatgacgccaaagaaatcgaggacaaaaaaaaagaagcttgagtttttttttaggaaaatatattgctagcaagtttcctgagctgctaaacagtgtgttttgtgcaacaatttctatatagaagttttgcaaaaaaattcagcatatctatttttaaaatttaaagtaattaataattaattaatcatatattaacgatatactccctccgtttcaaaatatttgacatcgttgactttttagtacgtgtttgaccattcgtcttattcaaaaaatttaagtaatcatttattctttttatatcattttatttattggtaaatatactttcatgtacacatataattttatatatttcacaaattttttttgaataagatgaacggtcaaacacatgctaaaaagtcaacggtgtcaaacattttgcaatggagggagtatctgttttgtgtttgactgaagagttccagtcattcgcttaaacgaacgcaccttaaataatgtgtggtggaagaatgtctttttttagaaaacttatgtttctaagcatgtaataaataatatgttttaataattcggtgaataagtcgaaaagagcaaatcaagggaaactagcagcctagcaagctccaaaataaaattaagatgtcaagagatgacgccagtgagatccaggaccataaaaagaaagcttgagattgaagtggtttggtgtacttggtagtgtcgcaacagcagccggtcaaaatacagttgagcaggcctgccgtctgcactgcactgcacttttgtccctgaaagactttttttgggtgcttcagtggataaggatagtatagctttggtgcatctggattaagtcaccttccgctaattaatcactggattttgacatgacatacacaatgctgctttgctgatcactaagctaaaaattggttgtgtggatgctcctgtcatggtttctgaaacatggagttggagggctttggcatatgcaggagaagagcagatgatctgagcttctgacttcatgtctgtgtgtgtggttagcaaaacaacaacactaatctttttgagtgcaagttttgcattagtacaagcttaagatgcagtgaagcaagcaacctaaagcaacagaagaagagagatgatggatcacgagcaggtgagcgactccaattatccattctggtaatctggcccaagtcctgggctgtgtcacttgactcactagatgtcagagatgacgatatgctcctgttaatggtgccgctgtttgcaacgcatgaaacctaacttcgcaagattgtctctcctttcttttctttttatctaaacaaagtctaaaattgggaattaatcatttcctacaattgtcaaggagaagatcagaagagaagatgagcatcaatcaccatgagttacttgtcaacagaacggtagtactgacaccgacaagtactggattttggaccacgatcacaggagtgatttgtgatcaaactgtctctccaataacaaagatttttattttgtttttcctcgcagaccagttcaaacgaaagtacaaaacctgacttattaaccgatgtatcgatggatgtggatcgagagtttggtcaggcacatgctgcagatcgagccattactgcggcggcggcgtgtgtggaagagattgagagatcagaattgcctgtgaaaatgaccgaaacctaacgaagttttgctacgccatttgtgcgtgcggatttgaaggctcacacgccgaactccggtggctcgccggccgaagcggcggtctttccggcgagatcgtgcgttcgtgtaactgaagacagcgacggtgttggatcgccatgagtgtactgtatacgaggatatcgatgggttttattatatcgcatttgttcagaatcacgttggttgcctgcagaaatttgatgaaggatgtcaggtttgggtagttgtatgggctataagatgaggtgtgttgggtagatgggccggataatgttgagcaggccaggaaggctttggcccagaaattttcagagatctagggaggaataagtccattttcattcctcaactttccgtcgagtttaattgataactctaaactgcaatatcagacatcttcaaccccatcatagtaaaaccattcaagtcagatcccgtgacaatatggatacttgtttttgctgacgtgtttcagcaaaaaggaaattaaaaaacaagtgggcccacatataagtggacttccacatctccccacctattccatctctcccctctctttcataggagctcgtcggcaaggagagcggtgacagctggctagaccgtccgcacgaggcaacggtgggaggtcggtgatgaggtggctctggtggtcagccatagtggaggaaaagagaagggaggcgagggagccagccatccgcgagaaggcatcagtgaaggagaggatccaatgccccagcaactccgccttaggtactcctgcggtcctgtgatgctggagtgggctcttccccaccactcatgctcatcctcgtgggacgttcctccccaccactaggggtgggctcgccgcctccacccaatcatgttgagaataggaggaggagccgtggaggtggaacttgagctttgagtggtggttgcgtcaccatgtcctagttcccgtcccgagccgctcgttctttggcttattcaccgaatcttggttcgtctccaccagtgggacgcgctccacagcgagtcaacggtggcggtccggccaggcacctctttgtcgctcctcgactggtcgacagaagcgatagagctgatgaggtcgaaggtaaaggtagcatcggcatggtccgccgtcttccggtaagacactcacactgtttgctagataagttcaaaggggaggtcccaacatagatgacggccgcgacttctccttcgattcggcagcccttgctccaatttgaccgcgcgcccccttaggagagagagagagagaagctagagagaagaggggaggacagtgatgatgacatgcgggggccacttttggttttgccacataaattcctagttagcacgagtggaacagatcaacttgccaattgccatgtcaacaaaatctcagacctcagattattggttgtggattactcgtgccatgctccaaaaaaattcgatttctacaaaatcttttcgaaacatacatacgcatttgctcacaatacgtgtactctcactcctatgaatgcacacacgcacaccctaccgctatgacctttcggaagactatgtcgacatatctcgagattgacgaagtcaccatgttgtctcgctgtcggcaggtacagcacctaccactgaaagaataattagccgtgaatgtgagtacatgtgtcaaatctagaacttgtacccaggtaggctggttccaccacgaagaatctaaacaattgagcaacgcttacttcacgatttctccgtaaactttaaacgttagaactgttcattgtttagactgctttgtgtttaaatttatttttaaggtttgtaatatataatatttgactaattcacataaacaaatccatcatctttaatccaaattacatggttctttgaaacgtagtattgaaaaaaaatggaataatggaaaaagagcaaaggatttaaacgtgaacataaatgcaaaatagagtacaacaaaacataagaaaaatatagaaatagtggtttgtgtagaccgcggaaaaaacacatgaatcgaattagataaatagactcgcatgaaatttttcaagggtttagagttcttgtaattttcctctaaattttttttgtagaattgtccattttatatgattttaaaacaaaagtataggattaaatctttgtttcgaagactttcctacgattttcctataatatagaaattctccaaatttatctccgtttcaggttataagactttctagcattacccacattcacatatatgttaataaatctagacatctatatgaatgtgtatctagattcattaacatttatatgaatatgaacaatgctagaaagtcttataaactgaaacggaggaactatatgtttttttttagaaggaagtatatgtttttggtacggttcaggaggccctcatggggaaaaactaccaggacgctctccaaaaggatgaaaaagaacattactttgggcgcgttggatccaatacagatggtcgagattgacccacgtcgtccaaggattcgtccacgattcagaagacgttgaaccttatccgtttctgcaacgctacgctgtgtttctctggtttggggagctttggaatgaactgaggcagcagcagaggacggagccggcaagccatggctccctccgccgccgccgccgccgccgccgccgccgccgccgccaccgcctcgccgctgtcccgtctcctgctcagcctcccaaaccccagcgtgaaacttcccgtgtcttctccgagccggaacgccggcgccgccgtggccgccaagaacagcacccccgtcgtcgccctccgccggcgcgaggccgtggccgccgtgctgtccgcatccatcctctcccgcgtgctccccgcggcggcggaagcgtccggcggcgagtgcccgctcgaggtggcgcccaacggtctcgccttctgcgaccgcgttgtcggcaccggcgccgccgccgagcaagggcagctcatcaaggtcagcacgacagcacgcacctgcccgcccaccggccgccgccggcgaggcgaggtctcggggttcttgctaacctcgccgtgtgtttcgttcgtcccacgcaggcgcattacaccgggaggctggaggacggcacggtgttcgacagcagctacaagcgcgggaagccgctcaccttccgcgtcggcgtcggcgaggtaaacacgatcaatcaatcaagcacactaacagattctgcaagatattcaaacattgtactaatcggcaacagattacgcagctacacgatgaattagactcatctctgataccaagatcactcacattgcatattcactgataattcttcaggtgatcaaaggatgggaccagggcatagtgggcggcgaagggatcccgccgatgctcgccggtgcgtctccctgcctgaactgaaccctgaaaaatgacaaaaatctgaaatgaactcaccatactcgatcagattcacctcgattttgtatcaatttagagaaatggtgaagctgaatggaaatgtggttgaatgttcaggtggaaagaggtcgctgaggctgccgccggagctggcctacggcgcgagaggagccgggtgcagaggctgggagcccacctcctgcgtcatcccgcccaactccactctcctcttcgacgtcgagtacgtcggcagagcagtcggatgatctctccctgcagatttggtttcttgtgttgattgatgtatgcagaatgttcagagtatatatcgataccgagttgagagtttcagactgagaacatttgcagagagatttaagcagcacgatcgtggtctacgggtttgaaataggttatagattgtgaaaattccaaaagctttggtgagtttgggcatgatcaagcacatcatgcccaaaacttcaattccaaactacaacattatcctttttcattagcaccatttctcgagctgctaaataatgtgtttttgtaaaaaaaaatatttctgtatataagttttttaaaaataaatcaaagaaatatttttttttaagaaggagagcagcgctctcccatttcatttactgaaatgcagattacccaaaatcaaagaaatctatttttgaaatttataatgtttagtaattattcatgggccgtctcattttatgtgctaatatgctataatctaataaggagtttcaaacgggcctaaaaacatttagggagagaatttaggaacacgaccatgctgagcgagtttgaacaacattgccaaaatgcccaaaaaaaactttggtgactgatttcggcaagatcgtccacaccatcaagctttcatattctctcaatgattggttatacgtacgagttctcattcagatgattttcgaagaattttatctgaaaattgtagtatgaacgaatccggaaatgaaacgattttgctaaatttttgccgggtgattttttttcatagtatttgacgtttttctagccgcacgatgttttccaagatttgtgcaaaagcagggtcagttgagtccatgaccaagtcaacctgactttatatcgatggattcatgtacatcacgcatgtcagattgtcagtagccatttacttcttctatctatttctttctttcttttttctaggtaccaaaatttacagtgcacttgtactaaaataaattacagtacacttacataccatatctactgtttttacaaatataattttagttataaagcactgtatttagttataaatgcaatatttaacacttcagatatctgcacggtttctcaagcaatgtatttatactaaaacgacaaatattctagttacccaaatttacaacgcacttgtactaaaattatagtgcacttacatgccatatcaactgtttttacaaatgtaattttagttataaagcactgtatttagttataaatgcaatatttaacactttagatatctgcacggttttctcaagcaatgtatttacggagttgctagaaatatggcgccatatgctacagtcgattttttttcagccacttacacagtagttacacctcatttacaccccaatttacatatgtaattttagtacttacatatgtaattttgagacttacattgtaaatacactaaaattacatatgtaatttagggacttacaatgtaaatacataccgactattttttgatgaaaaatatggcgccataaatatagctacacccatgtatttatactaaaacgacaaatattctagttaccaaaatttacagcgcacttgtactaaaattacagtacacttacatgacatatctactgtttttacaaatgtaattttagttataaagcactgtaattttagttataaatataacatttaacacttcagatatctgcatggtttctcaagcaatgtatttatactaaaacgacaaataaattatagtgcacttacatgccatatctattgtttttataaatgtaattttagttataaaacactgtaattttagttataaatgcaacatttgtcggtaattttagttataaatgcaacatttgtgttaatctttattgaatactactctactaataagtacaatcacatgctacttggacggtttctctgtattgttatttttttttttaccgttggatgcagatacgaggggagaaaaaaattgggtgatttttttctcaaaaataacacgccacatgcctagacagtcccatcaggaaaagttcttcgaagtaaaggcccattgtatgacatatccgggccgcaattgtggcccatccgtcgcaagtttcccgggcaaagcgagatgggccgagattgcgatctgtcaactctcttttgtgggcccacctgtcagtctccgtgtctcgctgacttcctctgcatctctcgcgccgcctcgccggcgaaggtcgcctctccggctccgccgccgccgtcatcacgagggctgccacggtcacgagcaggcgggcgccggcgaggtggaggacgggagtagcggttgcggggagaagaggaggccggtgaaggggaaaaggagagggtaggcttgccggcggcggcatcgggcgacggcgacgtatcaggtgagagaatctcggcgagttctctcgccatccgattcttcgattctcttccctgtcagtacgccccgcaattccacagtgctcaaattttacggttcaagacaaatcattatgctgatgcagaacgcagctagaatttttcaggtttgcagccgtttttttttttttttggatttccggaccgctgtgcaagattctgcaggcttgtgaggaacacaagaggaatggataataccccacgattttcaggaggaggagatgattgtgagttgatgcagcagaaacaagaatgggccaagtataccctcagaaccattcaccaatcaagaggagtcagttcacatctcatgctggttttttcctgtgctgtagaacacaagacatgctaaagagcaagctcattcttgaggatgattttgggtggaatttaccttcaatgggctcaaattcagatcagagcaatgctaataataagggcaacctgaagtatataggaggtgttgacattagcttctcgaaagaagacccttccacggcgtgtgctgcactggtagttttagatgctggtaccttagaagttgtccacgaagagttcgatgttgttcggctgcaagtgccatatattccaggatttcttgctttcagagaggtattgtgtgtcctcttattttggcgtgtttggtttgatcaaaacatatgtttgctagatcatgagcaacagtttatccatgccttctgtattattattcaggggcctagacattttcattttctgtagtgatgaacaggcagacaagcaaacaatgaaacaaaatcaagatgggtacattcatatttattgtgtttttgctaactattctttcttcttatctgtataaccatatatgggtctagcatgttcaatgcaaaatcaagttatgattggacgtggataaactgttgttatatgctaactattcttttaattattctactttgttagatggtttaaaatatacatcaagtatattgttatacagctaaaagtgtcaacatgcactacttgttacaggctccaattcttctaggactcttggaaaaaatgaagacaaacaaccagcatttctaccctcaggttgctttgtcgttgcaatttacccttctgtaaataggtttactgtggctttatgctttgtagcattccatgttgtcatatgttgtttccattttgactgtgaaaacagtgtgaattgtctgcgctgatgtataatcatttgtcatcataaatatcatttattctagaattttgatctggaatgcttaatggcataagcattggcattaaattttagatatgttagcgtcttctagttttacatttaacactagttatgccagtgccttctctatggtttaacttgatgaactgacaggtactcatggttgatggaaatggattacttcatccacgaggtatacctcattagtgattagtatcatggcaatcttagtttgtaagactaagatgattcatgtgattagaaaaaaactgcagaatcacacacataacatgattatattatattcttttagaacgaactaccttgacagtccttgtagtccctagtcaattgacttggtgatagcgtacagcatgtctagttatgcatatacactgcaagctgcatcaataaactacttgaatgcatgaccctctaacttacatatgttcaacaggttttggtttagcttgtcatcttggtgtccttgcagacctgccgaccattggagttggaaaaaatgtattaatattactgccattgcaactactcctatggaagttctctcatctagttgttttccgaccatttcaagtacttgatggttttctgatgttctgatcctctgagagaagactaagtcctcagtgttttgaatgccccagctgcaccatgtggatggccttaaccaatctgaattgagaagacaattagaagcaaaagaaaactgcaacaaggagttaattttattgactggacagtctgggacaacatggggagctgtaggagattctatattggacctctgaatgcatccttcacttcatttctgtcatatatttcctgataatgaaaaggtttctattgttggaactaaactattaacttatcccaggcaatgtgctcctgccctagtttgtcgaagccgatctacatctcagttgggcatcgcatttcacttgactcagccattgggatagtgaagttctgtagtaattatcgcattcccgagcccattcgccaggtagaattttgtaaatagtatacctcaagtttcatcttgtcagcacgttgtatcttgggtactaatttgacgtttcgtttcatccttcgctaggctgatataagatcaaaggtgttccttcaaaagcaccaaaaacttgaagagtaataacaagattgaaatgggagttttatcttctacctgagtcaaattttccacagcatgaagtaacttttccgcagctctttctaatcgtaatagattgcacattgcgccgtcgttttctttttcttttcctttttttgtacatgagggtgattgtcacttgtcaggtcagtgttgtttgtaaaatagactgcaggtcacctttgaacaatctgaaatctgttcagctgttgatgtccgcacacttgttagctaatttaatcaaagatttcaatttacgactgcagaaatattgctctgttacaatactaaacagtggctcataaaccagctgggggtgtgtataaacttggaagtcattttaattctgtgaaacgcaatagtaaaaccaaatattatcgtgctgatgtagtgcaggcatcttaattccataaaggtaatatgaacctagttgttctaaaataaatgtgaacctaatttgttaaattaaatataaaaataggtggttgatttactctgccatgtgtcaaattgtcaatgagtctaaaaacggtcacaaatagtcacatggtaaaagagccctagcatggttatctttggcacataattaagtgccttatccttgtcgtatctaatctaactaatagagacattatggcatgttaaacttagaagagtcataaatgcatatccttctagaggcttagattagctgaatgctactattcaccaaaattaccctctttatttactatcgtgctgctatatatacacatgatcagagatgactgcgatgcagcatcactcaaagtctcaaaccatcttgcttccaacaaatccaatcagaagagcattcagcagtgggttgcaattaacagcgagatggctgccaccttctcttctgttatgtggaagatccttgtcattgctgtagccattgctgctctccttatcccttcaggtacacattgcaagattttctaagattagcataatgcccgtgtgttgcaacatgcttttttcttctaattgtctaatatattatcattttgtttatttttctatcattttgtaaagatgaaaattttcataatattctattgttatatttttctttctataagatctatagcatgtgggggctaagagataagcaactcaccgttcatgggtcccgtatggtagttgggtggtggtggtggcagactcatcaccaccactactatcttttatattagtatagatatagataatattgttcctctcaaatcactattacgattctgatttttacggttcataattactcagtatcgaaagagaacatcggagtttcaaattatgatttactctgtttggatgtggctgatttgtgaactaaacattggcatttttcttttctgatggatgcaggagagggcaagttcgtgtgccgaggcaagtgcgaggatatacgtgactgcgacaactggtgcaagacggccggaggctacccacagggagggcagtgtgtgccgcccctctaccaattctgctgctgcatcgagtagcagtatggatctccatcgtcttggcctacaatgttggctaaattaagagcttgatttgacaccaaaatctgcaaaaaatgaaatggaaattaagtaagtaggccatgattgagattaattacaaaacgggaatcaatttcagagaatcgcgagaattattcatgttttccatacgaagttttgttccgaccctagctgcattcgaggataaagatttggaaccttttggaaaacgtggtagctcattatcacatgattaattaagtagaactttttttgcaaaaaaaataacaatttaatagtttggaaaatatgcatgtaaaaaatgaaaaagtagagttgaaaaggttcgatttgaacacagttttatcgatttgaacacagttttatcgttaaacctatagtggcttataaaacgtaccgttttttagcggcaaaagaaaaaaatctataaggaaaaacctttttcatatgtattcttagcatttaaaagctagtactgcaaaatgaaaaacatcaaaatcaactgtatgactatggttttgaagttaaatttaagctacggcataaaccgaaggagtctatacggaagatgagaatcagcagctcatttgcgtcactggaaatccggattctgtcacgttgatatactagtttttggttctgatttgcttctgattcatgactaatttactcttaaaaaatgagcaaccttgtctcaccatttaaaaatgcccacgagcaaaattcacgtggatgacgtggttgccgttcatgtcaacagatctctccgaagattcaattaccgaaaatcgcaatattttataaccaaaatttggatccgcttacacctcggatctgacctaaaagcggtagctgcgtcatgtacacatgtgttgcctctattggcagattttgattttgccgaatcaaagtagactcacgtttcattggttttctcaaccaggccaatcaaaattcaaacaataatgaattcaaaatgttcaaatcatctacactggacaagtggacgctggacagtgactcatcaattcatcattcccatttcagggtctatttatatatgtttctctttatgcttctttaggaaataattaaagttagtttattgggtaagtggcagaagaaacctagtactgatttcttatttttcccttttaatatctagaattgtacttttctggtgcaaacaacaaaatggtaagtgtgcaatactaagggcacaaaaaatatttaaaaacttgaataggtattagaaaactgtagggtaattgagaagcaagggaaaaacttgtgacaatgggttgatcatcttatcatcgtcattatcacacataaaccctcctatcaaagaattgttcttatttttcacgacgaaaagacaaccgaaagaaacggaaaacgaccaccaatgcctccttttatgatgacaatgattttatactctactgctgacataggcaattatttctcaacaatcacatgagcaaattctacacgtttaagaaaataagagaagtcgatcggcatgatcattttcatgtctctataggatgcatgaaaaaaaaagtggtgaaagccctctttcctagtacaaaacatgatacaaaactcgtgcagaaatttgatgttcgaattaacagtgttgtgtttgaccatcgagattatatttccatgaaaaccaagaaagagaaaaaaacaaaaagactcgttattaataaaagagtaaattttacgcaattacagttttttttatcaaaatatcataaaactatagattatatataaaaatgtatcttaaaattacagatttagcatcaaatttatcattatcactaaactaaataattaacatcaatattaccacaaaattttagcttctgtaacttgaaaaaataatagtgctatagatctaaatttgaaaatatctatagttatatgataacttcatcactaaatatttaattttctgaaacgatctaaatctatagctttgtgataaatttagagctaaatctatagttttataatataccctttgaaatctgtagtttcatgataatctagtcagggaatttgctcttaataaaagctagcggattttcatatgcgtctcaatgatggtcaaagtattgtatgactatcggcctaactactagtagctcatgcaacattgagaggcatacgatcagcaactaccaagtcaatcttcttttcaaaaaggaaaaaaagaataaaaaatcctaccaagtcaatctttcgcatttgatcaactagtagctgaaccagagcctcccaagtcccaagtcctaagagcaggtataatagcaggctataagccagttataaacatattttaaaaagataaaggaaaagagagaagagcagcgggttacagatctgtagccagctgcagcacatgtttcaagacataatgtgtgtatgataggtgggaccaggtattaatagtatagtaagcaattattgtatgaattggctattatattggctatagatgatttaaagttagtaatgggctatactattaaaattgctctaatgtccaccttcccttgtgtacatacttgttcgagaagtcatgaaacatcctagttattgtactgttcgcacagacattccctccctaaattggtcgtagcccctgtacttgtcatttgtcaaaagaattgaaaattttctccatctcttgagtcttgaccggctccatcttagggtttttttggcacctatataatgcaagatgcattccgttctctgaactttctgagttactccatccgttttttcttaatatatgacaccgttgatttattgagatatgtttgatcatttgtccatcatttaatttattgtgacttgatttatcatcaaatgctctttaagcataacttttttatatttgcatttttgtaataacatgaatgatcaaacatttataaaaaaattaatggcgttacatattgaaaaacagagataatatttaaaaaccgcccatacgacaaagaatggattgtaaatctcaatgacaagtgagctccaacactagtataggtcaatacattacacaaccaaaaatctatgctctctcataatgtattttttcattagcatgagaaatattcctttacatcctaccaagtaccattatcaataaaaggttagtagcattcctacataaggcaataggttctgaaatatagcagggtacatttttttaactatagacattccctaatagttgtagaattgtagttatatactctgggtattccatactatcaagtacacacgcaaccctagttgacaacgaaaatactaaaccatatagttctgtgtctaaatatgagcatactgccttgtctacatgttttaatatacttcctttcgaaatcatgtattgcatgtttagatttacaatactagaatatatcatatctagtgctagattaacttattttaaggtaaatgtggtagcaccgtgcatgaccttctagaaggttttcaaagtttagagacgggttgagaactgagctcagaatatagatattggttaggtcgttactgctcctcgttgacatgcataatatagtatttgacaaaaaaaaatcatatgcacatcagcgtcggcacacggtttgaaggttttttttttatggttttgtcatggcctattgcatttttattttccttctatagctctatgctatatgcataaactaatacaaccttatataacaatctctgcttacaaatactatataattgtcactgcttacaaatatttaacgtttagagcaaaattcggtcaaacttttaaacttttatcatcaattttatattaaagtaagtttatgaaatctaataagtttgtatattgtggtattacttttgaagaaaaaaaatataggcatatcgttttcttgtttcaaaactaaacatttaagaaaatatttatagcaaaagctttaaaattttaatcaaatattatcataaacattaaatatttatacaaactagtcaactgcatccttgtttgaatcatctcaataaattcaatgtacgcatctaatagaataaaagatctcgagggtagaggactaaaaaataattttagaagatagagacgtgttatttatgcatacatggatggtttataccaaggaaaatatatagtttaaaccatatacacagtgaaaactgaaaactaccgttgtattaaaaaatagacgcatggtatttgtccacatcaccaagaattaaaaacaaatctcaagcatctatttttttaatccaatgatagttttcaagtatttactacattgcgatttacacttacatattttcccgaacaaatgtagtctattttggagatagagggagtaaaattaacactatctccgttttctaatagatgacgctgttgacttttttgaacacacatttgaccattcgtgttattattaaaaaaatttatgtaattacaatttattttgtcgtgagttgttttatcactaaagtactttaagcatgatttatatcttatgcagctacataaaatttctgaataaaacgaatgattaaacatgtattaaaaagccaacgacaccatctattaaaaaacagagggagtaataaatataaagagctgatttggtttgaggccctaccaaaatgttggtagtgtcaagcgtagatttattactagctaggc

SEQ ID NO: 56912 - DNA, 12026 bp, Oryza sativa
gcggtggcggcggaggcgccgcggtgccaggtggagggctgcgggctggagctgggaggctacaaggagtactaccgcaagcaccgcgtctgcgagccccacaccaagtgcctccgcgtcgtcgtcgccggccaggaccgccgcttctgccagcagtgcagcaggtcagccactcagccctcctccccttcccctctcgctctcctctcctccaataccgcgcttaagattctgagaagcatagttggtgagaatctggagaagctgacttctcttaggagactggagaaactgcggccgtcaggaagctctctaaacaagccctaaagttctactagtaattgattcaatcgccccgttagtgattcgattgggcgaattcgcgccctgtttgaattgcttcgatatgcctaagtgcatagtagtaatcattagtacgactattactatactacctgtgcagtaaaagatagggtataaatatgtatgtggccattttgtgctggtacagtgtgaaactctgtgcatgactgattggtcacaaggttctctgccccttgcctgatttggggaggtaagatcctgtttccccgtcgatagtactgtgctagaatttgcctgtacgccctgcatctggaaagctgccaagacagtgaattgtctgtgcaaggcaaggcttcctgaatttctggtaggacggcctgtggcttgcgtgtctatgtgaatgtgtattttcagcaaagaggtgtgtgttagtacaatgagtgattgctatgtgtagatagtagtattttgcatagttgcattcttgcatctgcttttgccagaaactccctgtgaccaaattctgcttttaattgtggttataaacaataattcattacgttttgcggcatgtttatgtcgttttgatgattttttttgttctatcttgggattatcaaggttccacgcgccttcggagtttgatcaggagaaacggagctgccggagacgactttctgatcataatgcccgtcgacggaaaccacagacagatgtgtttgcttttggctctggaacactaccgcgatcactgtttggtaataccctcgtgacctatataaactacaaaagtcaatcacagtgttgtttgtagtttctgtctagtaatatattggagaaaattgttggtggttggctgatgtgatgcatatttaatatctgaaaaaaaatcaagattatatctcacgatgtcatacactgtatttccctgaaataatgcttagctggatccttcactattttctatgaaaataatagcatgtatggccatatgggatagtagccttagccactactgtattatattaatgccactttagtttgggattttgtcaatgcaaaatctattggacggtatatcaaaacaaagagcatgcatttattcgttctcctgacatgttttctttgaggaatcaaaaaatcatttaccattgaccttaataatgcttgggtagtttccctccttgtctttgtaattttctaaaagtttctctttcttaatttcaaatgttattgcagatgataggcagcaaataagtttcgcatgggataataacgctccacttaaccatgcaaacaccacttcaagttcctcgtggacatctgacttacagctctcccaagtgatggacataagcaaaaggtcacgaaaagctggggcagacagtgcaaatatccgtttgtcaaatgctttgccaactctttgtcatgacacaaatgagctcttgccaataaaaggtatggctccatgatctttttatatcatgaatggaaaattaatctactcgaataattttacttatgctgacaaagttagtttacttcacttagcattcatgccatgtgcagtgacaggcttaaaagataggctacaatgctaaatttgacagcataatatgtatctctactaccttaaaagcgcaaccattctccttctgtcctcttcccactgtgcgcagtcgcctgctccttcatgtgtgcgtaaccaccgtagcatccagtattttatccttaatccatccacccagccaatcgcccaatcctcaattgtatgagcttggtacgttgcaaagcactggcatattactagtaaaaagaagaaataaaacagtaaaatccatatggccactacccaaaatgggttgatacatcaagtttgttgatactggcatctatcccgaaacgaactttaaacatgtgtaggtacattgatatttgaattttgaggtttatagttcagcattctttctgtaaaccaaactcccaatttgttgtttcacaacattgcaagtttcttatgcagtgccaaaatcttggctgcagattttttccccccatctttgaagttaggaacatttgaaatgaaaattttcctagttactatgtatatttgaatattcacaacccatgtaggactagcaatccagcattccagttacacttgtggcatcatggcagatacctatagcctaggtatcacaccattgaccactatgcacgagtgaacttatgagatccatcctattgctaaatgctttccatcctccgagccccttgatatgctcaatacaatcagataccgtgtcttgagagtagtattttctctagttttatttactggcgctgtatgcttgatttttcatttcatacgtttctgttatcacttaccactattttattttctttcgactgtcgctctaatgctttgatggtccaattttgcaggtgcagatgcatctgaaactgcttcaaaactagatggagcactagatgttcagcgtgctctctctcttctgtcagctagttcaaggggtttgactgaccccggacaccaaacatcttctatcatccaatttacgaattcgaaccaaaacagcacattgcccagtgtaccaagcgaaggaaactctaatgtacccttttgggttgatggacaacatcaagcagtagagcctcaggtgtttcagttcacaatggacaccggtaacactgtgtttccggatctagagcggatcaaaccttcctacgagtcttcaatgtttggtctgaaccagatacattgaagcctgcaatgatcaccagcacggtcgctgctagtatggatgaataagcacacgtcctggactatccaagatcgtccaagacttgccccaatctgccgagtgtcaatgctatatccgtgtgtttatttaccttcccataattcagataaaccttgtgaacgccaacatctaagtatcaagcgttcacaaagtgtgctagtttcaaccttatttctgtcaaaatgtaattgctgttgtgcaattctttgttcttcgtgttgtacaaattattcattgttcttggcgttgtacaatctactgcctaaccatttgtcagaatattagctctttcgggaaacaagacatgatttttccctgtgcatactgtttttcagtgtctaatagtataatttgaaatcttaacatgtttaaagtaattttatccctctttaaaaaagggagagagattttaccccgatatgccgttgcgcttgacttctggtcgcctggacagcatatggtttctttctgactggtgcggtgtactatgtgcatcttaccagctttttacacggtggttaacgttatattttttttatcattaatttctgtcataatgcattatcaattactacaaaattaacatcatatataaatattttaaaatacgaataatgatactacacacatgccaccaaaaacatttttaattcatattagttaaaaaaaatattaatgtagattttatggaaaataaaggtttcttatttttagcacaaaatcttgtcccaaatgaatcaaaataaagctatttcttcacccatcatcttctctcaaccaatcataataattcttcatctacattctttttgtgaatcaatcataatattcctccaatattttcacctacttttttaatatctgttcctacaaaaaaaaatgccaacattttggaacagagaaagtattttagaacggagtactccaataagtggaagttcaacagactataggtgtttagaatttggtgacacaaaaccacttggaaaatctgcataatttacctggataatcaaaaaccggagtggaaccggcagatacattttagatttgacttcgacatagatgataggcatagataagtatcatggatccatatggaaaacaacacaaggagaataatatgaaatggatttggaggcgcaaagaatggcagcatatacaaccgactcaaatcaacaagaccaggagatgatgaccacaagtaggtcgacgcttcagacaaagaacacacaacagctgctgatcaaccagcaaatacagctgctattatttcacaagatagctcatttcggagaattacataacacggctctttgctaagatatacaatcatacaaggtaccatccatatttgataaagtagaaatcagcaattttaaaccttgaaggccagggatgagacttccatatcggcacgcaaacgcgaccgatatcatggtgtcctctctcttttcttttttcttttctgtactctatcctgcattagtttcagtctgtggtcattggccccgcaatacaacagcggaaacgtgccctgcggacatttctcataacctctatctcggcattctcaagcatgacaacgatctcggcaaatgatgggcgaacttcagggtttgcgtcccaacagcaagtcatgatcttgctcagagaatccacacaatcctgcgggattgcaggacgagagcccctgtttacgacagcaaatgcagcctgaacggctgtcatgtttgtgaaggggagcatgccggttataagctcccacaagacaatcccaaagctgtaaacatctactttatgatcataaggcctgtgctggatcatctccctgcatgatggcaagataagcatatttgacagagatttaaaaaggtaaacagtaggcaatgagcgtgaatgcgtgattatgacttacggtgccatccaacggtaggttcctgtctctggggtcattccctcagtttgtacctcaattcgagcaactccaaagtcagctatcttgatggatttgtctgctgaaattagaaggttatctgattttagatccctatggataaatcgcaaggcatgcacataagccatcccccgagcaacatcaagtgcctgcttcacagccagccccagaggcacagacttgttctgccttcgtgcaaggaattgccgaacagatccaccttttgcatattcagtaatgatacaccaaacaattgatttccggcacgccccaatgaaccttacaatatttgggtgcctcaacgtagacaacatcataacttcctgcacaaactgctgttccatcaattgagctctctctgggtcattctcaggcttttccagcagcttaatagcaacgtcttctccattgtatgttccccgataaagcttcccaaatgccccttgagcaaaaggagctcccatgtcgagcttacccagatcaatggtccactcctcgtaattactaagtatctccgtcggatggcttggatccatcaatacccgagccaatgcatcctcattcagagtaggcgccatagcccggttcggatggatgacgctattgtgaaccgaataactcggcgccggcatatcacggaggccagggtgtttgagcatgaccgtgcgggactcgtttgatcccacgctgctgttatccaccgacatggcaaccgaaccaccaacaaagttcatcatgttcaggttgtcggcgttatccacggacatgtgggagctctccccgaccttgtggtagtagggcatattgtggaagccattcatctcgttttcttgccttcctctgcaacctataccacctccaattccagcaccgcccaacatattctgaaaccttgacccctcaatcatcttcaaacaaccaacactaacagtagggttgctttacgaaacagtagaatcgctgaaaaacatccatttctcagttttcttcagtgctcccacggtatctagaatcaaaacaaaaaactgattagcgcctaaatacgcatatagtaaagtataccatcaaaattatgctaaaacaggggcggatctaataaactgaacccccaaactatttggggaacaaccaaactactattcgtatcaagtttcaaggcaaattaagagaaaagcttcctccgaggtctagaagagaaacaacaagggttcaacgcaaaatttggggaacaagcaaactactattcgtgtcaagttttcaaggcaaattaagagaaaagcttcctccgaggtctagaagaggaacaaccaaagggttcaacgcaaaattggagggaaaaaaaaagtgagtgggtacacagcgatgaggaagaggatgaatggatgctcaccgggatgcggcggaagcagcaggacgaacggcggcggcgcgcctcgcgggatcggcggcgcaggcggcggggcgagctcacgaggagtcggagtcggagtcggaggcgacgacgaggggaaggggaaatatcgtcgtctcgtcgaggcaccgcacaacgatctcctttttgttttccctttttttttcacaactacgctaggaaggatgctgattatgaaacattggtactactatcttttacggggaatgcaattaaaacgtagaagctcatggcacctgcaaactcactcccacaatataagttattttaacgtgtgtacgcttcgtacacacgtacatccatgtctacgagtaccttcggaagattgagctgatatatcttgagattaatgaatcattaaaatttcataattttaatataaatttgttcttctctatactgggggtaaatatctcagtattctttcgctattttattttgttttgttctcatttttctctattttcgacgatgatattgtttaaccttacgtgttaaacacggttagcaaactcgagtgtccacaatatgtactacatatttgtatttagtaaaacataataatttattctagatgcctaacttggtatttgttcaaatacatcacggatacgtatactaacacaacaacattcatatgagaatttgtattaaaattccgcttggaatcgacttaatctgagaatttgtattgtttttgaacttttaaatatctaattttaaagtagactattttttaatatgaacttttagtcataccaccctatctaacgtaactgaaaaataaccaatgctaatgttatcctaccaaactcttaaatagaagacgatccaagtatttttttactattgtagaaaatcttttatatattttgtgatgaagatagtaaaatattccatcatctcgcatcatggctgcattagcactttatcagtcaacccaaagtctcgaacctactgaccagagcacacacattagattcatcaaaccatgtggtccaattcatcccaattgatgagtagattaactagggaaatcaagcaaatttcgccgaatttcttctgccaccaccgtcgtcgtcgtaccgtatcatcatccataattgtttacgcgtgtttggatccggacgcgcacgtcgtcgatcgtttgccggccagcgattttcccccgggtttgaagtcaacaaaagcgatcggctggcggcttccgtttcgtcaggtcctaatcgcaaatctctttctccatgacgccgattaataaagtatatacaacttcagatgcaaattggaatctttgttcttgtttagtactctttccgtttcacaatataagtcattctaacatttcccacattcatattgatgttaatgaatctagatagatatatatgtcttagattcattaacatctatatctatctagattcattaacatctatatctatctagattcattaacatcaatatgaatatgggaaatactaaaataacttatattgtgaaatagagggagtatttttttagtgtgactttaattaaagtgagcgtgggacgattctgattcgcatcggcgaataatctgcgtgattttatgcaattatttgaaacgatttgagttcaaaaagaaaatcaaatgattatagcccaaaagaaacaaaggaatacaggctgatgatgagactgcgagagatcatcaaatcccacctatctaaagactaatgggccggaattctggcctgttaaatgggcctacatgggccgcatgattaataagcccaaatcttagggccgaaacataataggccgtacgtataacgggccgtaagttaaaacggcccgcagattaacaggccggatttttccacgttgacttgtcgcacgaaaaggtcatgtcaatgggcagcttaatgagctggcacttcgaagccccacaaatacttagcaggccgaaattttgtttgaaggttaacaggccgaaatttgacactcaaattttcaggtttttggaggaaaacacaaaataataatccctccgtttgttaataattgataattttgactttctcattaattatttttacattgttagataaatgttaatagatttcattgtgtatcatttcattaaaagaagagaacacgaaaggaaaagtgtccaccaacctaatccaaaacaggccaaagcctttacaacacaagcaaaaacctcaccttcaaagggctatccacttatcaacaaataaaacaagtgatcaaatttctaaagcgaatattacctagtgctagttattaagaaacgaagggagcagtcttcgacgatgcttatatgggtagagttggtgtgcgtacgttcatagagataagtgcacgtgcgctgtgagtggctgcgttgtactatgtaactctaaaaaaaaaaagaaacgaagggagcagtattaactaatccaaaattacgcccttttttggcacggctctaagctgtgagttctagagaaaatagtttgtagattaaactaaagtaccacagtttagtactttttatgtaaattctaaaacatgaaaaaaaatgcctcactctaataagcagttctaactcaaaaaatcattttggcaggtgaggctgcgactacctataaattgcgacattgtttgtattggttgcagcgcaccaccaagcatccaaacagacctagcaacaaaatccaaacacaggattttcaagtcacatgatttttttaaaaaacagtggaattgcgtaggaatgtatatgcaatactaaggatcaagacatattttttttcttttagtgagctgaacaaagaagatggagtagatgtttttattcctatggaaccaatacattttgaagatctagcacatgattcctatagaaaaaaaaatcatttaaatcgtataaccgaaccgaacaaggcatatataataagaaaaaggagcccgtatggttgaaccatttggattctctctgaagtactatggcagttggggcatgtctgctatccagtgctacgttttgacaaacacgacgttggaactacacgagaattacacggtactggcatttgcaggctgcagccggcgttgacatgaatagcctcctaaagtcgccggtaaactaattacgtactgtaccagcaagcacgacaagttgccaaccgaccacaaaaccgatgagcaggaacaaaacagtgggactagtccactctctagctggctagcactgtgtatatatactccgtatttgtgtgaaattgttgacttgcatcgtccatggcaggctaaacatggtcctccacacacactccagtacgcgtagttcggtgtacacaggtcacgcgtttacaatgtcatccacccggacagtccacgacgagctctacccgtacagttccatacaccaaccaacagacgcctctactaatctgtccaataaaaaagcgagcctcactttggtgctatttagttgtagaaaataatctgaaccgttgatctcatttgatcgaagggttcatgttgctttctactgtcatcctagttagcggtagtagaaatttagaggggaaaaaataggggtatagttgttatttagcagtgagccattgactaaaggcatgttcagattgtattcaaaataaaccttttttttttcaaaaatcgagcgttgtttcaccaagtagatcgagaatgtttcactaagtagttcgaaaatgttttagtcttttaaaaagctgaaatacaaccaaatcacctcgtggaacattttgctacaacgtatgatacaaacggtttccaaaaaatcagacgttgtttcactctatataaaaacaatatttcaacaaatagcaaaatactatttcaattcactgcaacatttgatccgtacatagtgaaacatcacgagtacactagctgaaacatttttggtggaacaaaaaatgaaacggattcctttactatagcgtttccgtaatatgcagttgatttgttgcaacaacgtctgtgatggtgcacttggtggaggcggcgcgcaagcgtgggaggtgcgggtgcctgatgcatgcacgcaattttcgaaataaaccttaacaaattttggcaatgccaaaattttaggaatttggtaatattgccacatctgttagcagcgaaatttgataagccccgaagacatcatcggactagagtcagaattggcttcagaatcctataatcggccaatcaaaattatcacatcgccaatagtcggattcctgctatattcggttaaggaaattaatcgaattaaaggaagcttatccagaagtgaccgagttcaagaaggatacaacatggcaagttatctattaattaggaatagtttgttagttttcttttatctttaggaaagtgtgtttagtgtccaataaggactttatgtttccgttttaactttagaaaagtttctttcttgtcctacaaggactagtatctatccatgggtgtaaatatgtacacccgaggccattgtaatgaatctctagatcaatactactctcggtgcatcatcaccctctttcccgaggtttttacttatcaaccagcggaatttggcacctaacaatataaaataacaatataatcaccatcttgcatctatttatagcaattgtacaagagctccgaacgaaaaagccggccaacgatatccatgcagcaccgtgcatccatgcatggttttcttacccccccacccacccccaaccaccataaatacacacccagctgcaacatggatcacaaaacacatcgatccatctaaagtttatatagtactacgagaatatcaatctattgcaaagtatctaaagtaaatacacaattggttccaaactttaaatagaaaaaaaatctttacactaccaacgtgttaaaaggaactagaaaatatatcattagttccaaactatgtatgtaaagaactaataaatccttaaggcctaaaaaatgtagtggtggtttatgatccctcgtccatcgtaagcccatcctcactcccatgccctctcgagcgagtcctgcacgcatgatgtcccttccactgcatgaatggaatgcccccgacccccaccaccgatcaaaatcaatcaaccatcattccccggtgcttggccatggacctcctttcacgtctagctctcaacctgcaggatgtaacgacatgtgcacttgccaataaaaaattcaactgaatttatagtgtactcctttttaatgtacaatctacacccagacctagaattgttggattattttcataaggtcacgtgctcctccccacatacgcctcatcgagttgtcatcttgtattcctatcaaatgtattgtatcaactgccaccaccgctcgatatccagctagctgactaggtgtgctctaccaatttacttagcaccagccccatctcaccataaatgctaacctatgtcccctatcg

SEQ ID NO: 56913 - DNA, 8852 bp, Oryza sativa
ggatccccctattttcatgtctggtccatatcctccataaacggaacatcacaaatttttattatttgtaatttaaaaaaaaagtacagaaaacatggaaatgcataactactttttgagaggtctgcatgtcctgcaccagcgaaacaatcggaactaccaagtttgcatctatttataggaattgtattagacttgctcgacgaaaaagccggccaacgatctctatgctgcatcatgcgtccatgcctggttttctttgccccctgccaccataaatacgcacccaactacaacatggatcaccaaacacctcgatccatccctctacccttcaagaaacaagaaagataacaccaacaaactagctagctcgccaatggcctcgttgtcctccttccggctctctgtggcagtggcggcattgttggtcgtcggctcgtgcgccactgaggtcaccttcaaggtcggtgagggttctagcggaaaaagtctagagctcgtcaccaacgtcgccatctctgaggtggagatcaaggagaagggcggcaaggactgggtggcactcaaggagtcatcgactaacacctggtcgctcaagagtgaggcggcgctcaagggccccttctccgttcgcttccttgtcaagaacggcggctaccgtgtcgtcgacgacgtcatccccgaaagctttacggccggctctgaatacaagagtggtatcaacgtctaattaatagacatgagtattcttgcattgggttgcatgataattattaacctctaaataattttgtcttgaaagagatcatgctatgcgtgagcaagcaaacaattaatttcttgtggttattttgttgtaataagccagtggcaaaataaggcatacatgtgtccttccaaaacattgttgtggagctatatgtgaacacgatttcaaatatatgctgtttatagtggatgtatggaaaaatgttatatttggttagctttcattaagacgattgtgtgtatttgatttctcaaaattttagtacatatatatgtccaaatcaatgtagcccatttctcccttttagcttgtcataaatattgtttacagttgtttttttaaaaattttgtggaacaaattgttgaatcgatcacaccgtgacatgaaactataagtataaagaatcagtacatcgtttagcttattcagatgctaaaacaaaatgtaagtcacattaactaatcatatcttctggacccccgtttttataacaggaatcattcgtgtaaacagtaccatttccctggatcaagtagtctggtacacacgagttcatagctgaaataccaaaagcacatacacgagagtctagtgctaattattacatcataagcccgcaggcattgtcttaaatcatcggaccgagcagttcggaatacatccaaaatgcagaaatagataaggcagcggaattcaggcgcagcggcatgccattgccacaggcaacgaccgtactaagacctactgagcgccatcgtcttcatctccctcctggtagtaggcatagggatcctccaaagctttatctcctgcttctgattaattttatatttgcaagggtgagtaccaaccgtactcagcaagccaccacaacaacaatgcatatgaaaaggggtatttcaaaggatggctatggctcttttgcgctaagccagttttgtaattcttttcacaaacctaagacctagcatagactgatcaagttttaataccagtgttcacattaaacaacgacggttctgtccaccatccattgtgatcccaaggatagcttcccgccattgagtcgtcatggttttctgaggacgtccaccttccctcctctcaggaagtggctccatcagcataaaaaatcatcatgcaatatcccatcccacacaggttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagtagtgagaggagttctggcgctcccaggaaagagaagtctcacacacatattaaattatggttcaagttaagttctctctctcacatactcatggcagtcctaccaatggcgacaccgatgtagggcacgcttctcggccctacctcaacggctgtcccatcgtagcgcacctgcctcactcaggggtgaaccatctatgcagggatactgcctccgctcggctatctaatccgctaggtctatacccattcgagaagtacagttgtacgggggtcgtttcatgcttaacttcatggctcggtccttaattgactggggacggtactagccttttccagataccacccaaatcatccgtccgccccagtcgaaaacagttgttttcgctttattttcctttcacaaatcatgttatcaatttcatggcaatgtggcgctcatgtctccacataccgcatctcaattaccttcccaaaggtaattgcccaagcatttagcatttgataaatatgagtatgcatgatcctagaatagcatttctaagcaattgtcataattgactagggactcatacgtaaacatggttacgaaggaataagggataaacaataatcaaggcatggcataatcacaagtaggatgttcatcattgcatgcaattttatttataaacaaaataatttcgcaattgggatcaacatgttcaaggaatagtgatgacttgccttgctcaaggtcttgggggtcttggccttcacttggatccgcaactccctcgggctctatagttacgtgcgaaaactgatttggattcgattagaattcaaataaaaaatccaaataaatccaaatggaagtcgaacgcgaaagtcgattcctttattttaactttattattcgcgaactaaggcaaacccaatttcgattcaaactattttgcgggtataaatgttttgttgtcataagtttttaatttaatctacccgagcattatatccatataataggttagagatttctatcgcgagctaaatatcggacgaaatcctagaaatattatatgatttaatttagtctatgactaaatgattaaatataatatacggctaaaatccctagtaaataaatccgaatttctaccgtgaatcgattacttatagagattacccaaaataatctataatagtctataagaattcatctaatcgtttagttcctaattacagttaaactactaccgcgaattgatttcttgtagaaattaccaagaataatctataatttatattaaattttgcaattctatgaccataattaatctataattaaattctaattattttagattttcttaaactattaacctccttaatttcttcctaattttctatttatttttccttttctttttctccattctctcttctctttttctttctttttctttcttttctctctctctctttttctttcttttctctctttctctctttttctctctgccggcctctcttttcctctccctctctctcttggctctctcccaccagagcggcggcggcggtggacacgagggggaaggagggcggctcaccggcggcagcagcggtgacgacggcggcagcgacggtggcgcacggcggcgcgggagcggcggcacggcggcacgggaacggcgccgcggcggcacgggaacggcggcgtggcagcacacgggaacggcggcgcgacggcacgagagcggcggcgcggcggcacgagagcggcggcgcggcggcacgagagtggcggcgcagtggagagggaagaggggaggaagggtgagatggggtgggggaaaatggagagagggggggtatttgtagagaggggagaaggagagggggaggggcggcggcgtaatggcgacgcgacggcggcgctcggggcgggacgacggtgacgcgcgggcggcgacgcgatggcggcgcggggctcggagcggcgatgcgacgggcgacggtgcggggctcgagacgggcgacgcgacgggtggcgtggggctcgatgcggcgatggtgacggcgcgcggcgatgggacggcgacgcggcgggtggcgagcgagcggcgtgacaggcagggcgacgcgacgcgcgcggcggcacggggctcagcgcgatggaatgggcggcgcggcagcgacgcagggtgacggcgaggggacggccgcgcggcggggcgcaggcgcgaggggacgggcgcgcggcggcacaaggcgcgaggccgacggcgacgcgacggtgacggcgcggcagcggcggcggcgcgcgcgacgggcgggcgacgcggcacacgcggcagggaagggggcggggccagggggaccacgatcgaacacctatgccgcaatgaacagtaacttttcctatttatcccgattttagcccattttctatttaaatatagtcctataaattctaacttttgcataaatgaagtttactccatatttgtgttatactaactaaaaattcaccctaatttaatatcactcatatttattttatataatttatttgaatttttattagggttaattctcattccatcgtactaaaatttaattattgctaatatggtcgcgataatattttatatatttccaatcccacctaatatttattttaatttatattttaattatttatttagccaacttgatttttagggtttattcctagttagttattcattatccgcgattaataaattccgagatcaaaatccaatgaaataggcgaataaaatcggcatgatgcaatttattacttaaaaagtttttgaaaatctgtatttttggtgttttgatttcgttggtcgaattttcagggtgttacatatctccaacatgaataagtggtaatggatagaatggaagcgaagccagctttgagaggtgctaagttaagcttcatttcatatagttggccaaggccccaagctatagtcatcaacaaagtttatataatactacgagaataccaacctattgcaaaggatataaaataaatacgcaattagttccaaactttaaatagaaaaaagaagcttacactgtcagtgtgttacaaaggatctagaaaatataccattagttccaaactataaatgtaagaaataataaatccttaaggcctagaagtatagcggtggtttacagtccctcgtccatcttaagctcaacctgactcccatgccctctcgagcgattctcgcacgcatgatgtccccttccctgcgcgaatggaagcacacccctgacccccaccacccgatcaaaatcaatccaccatccttcaccgacgctttctgcggagattatgagtaccgcatacccacacggctgggctatccgactggttacaggggatagatcatgtatatagaatatgtaataaagtaggactcggtcgctatgttgccttgtattccaaggcagggtataaagccccaatcgggtactaccatgtactccctctatcccaaaatataagcatttttagcatagtgacaagtcaaacatttttaactttgaccattaataacaaaacaataaaaacgatcaatcatgtaaagttgatgttattagatttatcattaaacaaactatcataatatacaactctttttatttaaaacatcttacttctatagatattgttagtcaaagtagcatctcgaagaccgtgtcagggtccaaaaatgcttatattttgggatggagggagtaatagattaggatactgataacgtgtccggctaggtttttcctttgtaaccctgccccccaacctatataaggcgggcaaggagccccctccaaggggcatgggcagagattcacaatccgatcgtcagatcaatactacaacccgacgaattcaaatccctaaataggagtagggtattacctctcattgagagggcctgaacctttttaaattcttgtctccgcatccatccacttttaggtctcgtgcgctaccccctttataatgccgaattctagttcttcccgtggaccttctttcatgtgtagctctcacgctgcatggacataacaatatatgcacttgctaattaaaaatcaattgaatttaaactatagtcttgttttagaaaaaaaaaagttagaaaaaaagtatgttatctctcatttttcgtcggtgagatactggtacataaaagactagtagcctacgcagacagcagcaacaccagccctacaaagtacgaattgaatctttcggttcccgtgaataagaattgttaagtagcatctacactaaaacctgtatcattgtaggattattctcattatgtccacgtgctcctccccacctatgcctcatcgagtcgtcatcttgtatctctgtcaaatgtattacatcgactgacgcaccgctcgatattcagctaggtgtgctctaccatattaattagcaccaaccccatttcactatagacgctaacctatgtcccatgtcacatagccgcaacaggccatcacgtgagcccctccatcactgccacggtggcgttaacatcgagtcgttgatggcccctctaccacatatactatgtgtgccacagtgtgcccctctgtgccatacgattactcctgattgttagctttaccacccctttgtcttccactagcatctttgatcctaatttgttcatgcgttggttcacatcctccataaacagaacatgagaaggtgattaatttgttggttgtaagtttttaaaaaatagagaagagatagaactacataggtgctttttgagaggtctacatgcccttcgtcagcgaaacaatcagaactatccagtttgcatttatttatagcaattgtataagagttcctcgataaataaactgttagttccaaagtttaaaagtaaaacaactaataaatctttaaatttaaatgtagtagtacgttttttttttacaaggcagacgtgaaatgctcgatcaaggtctccgatgtaaaatcggcggcgccggttcggcgctgggttggcgctttggcaggtggcgtacgtcgtcgtgcgaggcagaacgagcgcgcgtggcgagacgaggcgaggaggaggggtcggcacgcgggggaccgggagaagaagggcgagagacaaaccgcgtgcgcgcgcgcgtggtggtggagtggatggcgacctcttttttgggcgttttccgccccgaaaatcctccgttcccgcgtcctcaccaaagtacaactccagattggtttcgtatctatctactctaccaccgcaattaccagtattttctaagatttcgagttattgcaatgatgatgatgaagctgtcacacttgtaataacaagttgtgtactcctgctggagttagtgggcagaggatgtgattggaaggcgtacagaaatggattccgctaagcacaaacaaaaccgagtggagaaacgggggtggtggcgagcactttgacacggtggttgattgattcatgccatgctgccgcccactcaaaagcatcccctctcctcgctaatgccatttcttaaatcattccatggaaccttccaaacctggatctcgcaactttgggcaaccacaaaacaactcgttcccaaagcatagcaaatgcaatgctactccctccgttccatttgaagtgcatctacaaatttccgtgtctaacgtttaaccatccatcttatttattttttttataattaatatttttgttgctatttgatgataaaacatgaataatattttatgcataacttattatctttatttttttaataattttttaaaataagatatacggtcactgcatttaaaatggttcggggagtactagtagtactacaatacagatggctctgctcccatgtggacgtacgcctcgcgcccccatgtggtgtcttggatttggttcggatttaggcgtaccgagtccatgccaatcacattgtttttccacgccaaattgcgtctcccagaacaccaaacatatggtggccaagaaaatgattgatacgcacggtggatggatggatggattggtggcgatcgatcgattggtttgatgatgaaaagaaaaacaaatccgaggagcacctggaatcggggacatgcgctgaaccgggacaaggaaacagccccttgttttgcgaacttgtagttgtagagttcgtgtggagttgctgtttgctgttgccgtgttggggtatttttctgccgtttcttggagtctttgggcagtaggttcaacagctaaaggagacaaacctctctccggccgtgttgcgaattcgcaatgcaaaatgcaaccgacggtctggtctggtggtgttgctagtcttccatttcaggtgccattgtcaaaaaactcaaaagggcatcacaggcacagcacagggatttctgtccctcggaaactcattgataaatttattacaaagacctagctttgttttgttcttgtgtcttttaatcgtgtcaaatgaggtgtttaaatctatgggtgtaaagttttgacgtgtcacatcgaatatacatacacacatttgaagtattaaatatagattaataagaaaacaaattaagattccgtctgtaa

SEQ ID NO: 56914 - DNA, 3285 bp, Oryza sativa
tcatgggatctaaacaaaccctaattttagccagacgtgtcacgtatatgatatttccttggctaattaaatttaagcatttgaaacaatctgtcaaaaacataaacatgcgcatatttgaatcaatcacataaagaaaaaaatgagtaaaattaagtgaaaaatatgatgctatatttttaccaaataaactcatatggccatatatcacttaataaccaattaaccatgatgccatcagtcaaaaaaagaaaaaaaaaccatcctaactaaaacccaaactaaaccactgtcacggccaaatcctcttttcaaccatgcagcacattaatcaaacccccataaactccaagcctctccaatccaaccataaagcaacaagagagaaaagaaaaagaaaggaaaaaaaaaaccaagcctcagctcagctccccagttgcttcccctgctgcatttattaatccaaagcagcttccttttactctcgcttccctctggcacagctaatccaaatcctcctctttttcttgttttttttttctttcttcgtcttctccaacgcccaaagtaaaacaaaggaaaaaagaaaagccgcatccaagaacgcaccagaaatttcggcgacggttgcgcgcgaatccatccatccaccggcggtcggagggcggcggcggcggagcaattccgcccaaccaagcggcggagtcggtgcgggcgaaatttccgggttggtgcgcggggcttgggttggtggtggtggactggtggtggtgtgtgttcttgggagtggatctggcaggaggctggcgatggggaggcgggagtagggggagcggcggattggagtgggaggcgcggtgttgggggctcccatgggcggatgcttctcgctggaggagcaccggctccagggcaagacaggttcgtccgtgttctttcttgcctcgagctatatatatcttacttagtctctgatgtgtgtttttgcttgtagtagtagtagtagctgtgtgcatgttgcatggaagtgaagtttttgttgtaatttggttgtgaatttagtcgtgcggttgggtttttgggcgtattgggggctatggattttcagcgtatattcagcttcagaagatttggtttttgagcgagaattgctgtctcgtttatgtcagagttccgacaggatcaattttgtctctggggctatatcatgtagtaactcgtgttgcaaattcgggttttttaggcatcgcgtggttgatgtttgattcttctgtgactgagtgtcgagtgtgaggaatgccattctctaagtgctaaaagttttatcttattggacatcgttacattcaggcctctatctgtagcttagtttctcttttttctttgacaaagacgaaacttgcatggtacaaactttgctctttgatggctggtagaggacacgatattatgatgtactggtatgttgtctatgaaatttgcagtcacggttcctgaaaagtcaaactgcagcaagtcaaatttagctcataacttggtttgaactacattggcaaagctgctagaagattttaagttggttggatggaagtatcgagtaaccctataacttagatgcaaatggtctgttctgcatagaagattcttgttcagagactggaagagatgacaaatgttgtcctgcatataggaccatgagcagcaaatgcgtgtttggagctattctagaattttattgagataccaaattaaattgggaccttcctttgtcatgtcatggcctttagctgcacattaacctgccacttgaacgtggaggatgatcaatgaatacttttgttgctgtagagctattgcaaaatgacattgtagcttgacacaatggaacacatgtttcttaagttagaagatgaacaccattttgggtaggttagtggtatttacaaactaagatgttatgcttatcagattatcattttgacataatgcacaacaacattacagagactgcacagcaggagctgtatggggggtgttatatgaattaaaaaactaaagtactaaggcaaaataatcacgccacattgtagctcttaatgttcgtatgtaattgattattccctgatgttttttcttttctattaattctataagcagaagctggtgggccagatgggttaaggaaatgcaaatctgattctaaagctacagcaagtgtccttgcccctccaaaagatgtggaggacctgcaaatcgaaggatacggaaatgttaatattttcacatataatgaactaagagcagccacaaaaaacttccggcctgaccaaattcttggagagggtgggtttggtgttgtttacaaaggtgtaattgatgaaaatgttagagcgggctttccatccacacaagttgctgtgaaagaattaaacccagagggatttcagggtgacaaggaatggttggtaagtatccttgctttatttcattttttttgaaaccatgatgaactatacacaagtctatcagccttcatcagctaattagattttacgattcaatttaatgatcataatagttgtttgttattgtagtttctatattacctgacttatttacattttatgattttaagcaaggacattgaaagagtacttttatactgattagtgtttgattaaacagcatatatcagatacttatagttttattatttgtttccaggcagaagtcaactaccttgggcaacttagccatccaaatctagtcgaactgattgggtattgctgtgaaggctctcatagactgcttgtttacgagtacatggcttgcggcagccttgaaaagcatctttttcgccgtaagctgaccctttccttcttgacagttatcactcccacctactgaatggccgttgtccatggcagcagaacctgcaacatgtttattgtttttgcattttcaaaagtaaaaaggaaaatggtcagtttggtgcacgctgcatgaacaaaaacactaatttattttcaacaagatgagcagatctatcagtagaattaatataaatgcattcacacttatatttctttcagtgctcgatttactggtgcaatttaatctaatgagtagtgaccactatatacaatttagttgtatctgtgtacccgttccctccatgtaattttcaaaaataaaggattttcttttgaaacgataatggttagcatatgttttgaagttctcccaagtcccaactagctactccctccgtttcacaatgtaagt

SEQ ID NO: 56915 - DNA, 3277 bp, Oryza sativa
cttacattgtgaaacggaggaagtatttaatttaccggccgtatcatcaagttggccagttgattttgtctgagttgaactgtttagttgattctacaatctgcatgcacatgctaactacgctactagtgaaaaaagaagaaacgattttcttgctgcatggcttgctcacctttgattgatctattgagagaacatgtatttttccatgctaaaggacacttttgttgatttatcttcttgctcgtatgataattgataacaggggtttgccttaatatgccatggtctactcgaatgaagattgctctaggtgctgcaagggggctggaatatcttcacggagctgagagatcaattatatatcgagatttcaaaacatcaaacatcttgttagatgcggtttgtacttcatctactatctgaatactttgatatcattaccctttttcaatcacttgttataggaattccatctcatcaggctctagcaactttgttctttccaacccagacaagattccatttcctacattgttctgaactcttggaatgacagaactaacagttaaccggataacttagcctacatgctagccataaggcccataactgtctttacagaatccaagattctgaagtagtgatagaatagtgtgcttgccctccaaaccgtcatggtggtttcagttgctgccagcatggtcaaagctactaaatcttctgatgaatgaatgattcaattctttcagcagtaagattctaaacatcagcgatctcaataacgtaccagtttggatctggtcccgcttgctcttcaacacagtcctgtttaccactgatatttcgactgaaatctttttaatattctcaatttattagtgtgacacagcaaaaagtatgtaaggacgattacaaatgaaacacttgatcaatcatttatttgtccctggtcctcctccatggttccactttaaatagtagatattatgtgtgccctcatccatccaattaaaccatgcaactctgcacaaggaatactgatctaaatatcttatttcagatcttgggatgttatatgttgacgattatcttatgatactgccgcagtctcactctgtgtcacctctgcaggattataatgccaagctgtcagactttggcctagcacgaactggacctagtggagaccaaacccatgtatcaactcgggtcatgggtacttatggctatgcagctcctgaatatgtcatgacaggtgagcaatggaatctccctgtatttttagaatgccaacccgttcattcttgagtgcatttaatgttcttaagtatgaatatgcatatcattgtagctgacatcatgtatgttaaattgttactctaaccagtttgatctgttacaggccatctgacagcacgaagtgatgtctatggctttggtgtcgtccttctcgagatgatcataggcaggagggctgtggacaagagccggcctagccgtgagcacaacctagttgagtgggcacgtcccctcctcgtgcacaatcggaagctgttcaggattatcgatccaagaatggaagggcagtactccaccaaggctgccattgaggtggcaggccttgcgtaccgatgcttgagccagaatcccaaaggacgacccaccatgagccaggttgttgagacctttgaggctgtgcaaaacatgcctgaatgccaagacatactcttgcagaactgcatgacgggtgcagtgacactctacgaggttgcaaaggaccctacggagagcgtcgagccggagaagataaaacaagaacaaccagcagcaaaaacggtcaccgtggcaccggcaccggtaaatggaaaacccgtgcctcagagcaggagaacacggccagggaatggccggagcaagagcgagccgtctttggaatgcaagctgtacatcccatctccagactctgatggccagcagccaggcctggaggcattgtcatccccttccagagatggaagcataaaggatccaccggacgaggatttgtacaagatataaaagtcacacagaagttttttatgacgattcaagttttcgctaccggcgatttcgcattgccatccatccatcttgttgtcaagatcgatcagagtcaaagttggtgttaaaattttttctgatggcggaagaactctacctcgttaggtttcttgctgttccgactagcaattgtatgtagagaggagcgttgtggaaagcatttgtaatgtgagatgcctgccgcgacgaaaagttcgtgttgtaaacttgaaaccattctctgggaagaggaagatccacatcataatcgatgtgtcagtgttgttgttgctcgagtgtttttgacttttctgtatagatgatgatgtccttgcaaacttggtacagttctacaggaaatcaacaagaagatggaaaaatataagatgaatcagtgtccgtttgttgacagtttgtttttggagtatggttttgttttcactgcccatctggaaattattaggaatgtgagatacaagagtatgcttgaatgacacatcactatcgaggatatatcatctaccactgaaacaataagtaaatgtaaatgcgagcatcccctagtgagttaattccactaaaaaaagaatctaacgaatataaccagttgaggtagctcactttacatctatttattatattataataaggatagttaaaaaaaaaaatcactacattgacggcctataaattatcacatagaataaaattttattacacaaaatatgaaaatagaagctaagaattgtataactccaatgcaacttaaattccttaaatttttactgagactatttggtagggtaatgttgctgcggcgcagctgcagtcacgaaaccttcattgttagcttctaactgcaaccacacgtaattaaagtaaaaaagaaaactgaacaaacactgattcaagcctcttagttttacgagtactactaaatacactgtaggttaagacctaagaaaaaaataatttgaagttgtataagaacccagactttcacttcaatgggctggtttagtttccaactttttcttcaaactttcaacttttccatctgtcggtgatatgggaccgggagtatcatgaccagaggcttgaggcagacgcaatcgcccacgtggcctggcaccttcggggacgtcgggcccgagggctgaggtgtccgccctcctcctgatttcccccgaggggg

SEQ ID NO: 56916 - DNA, 4597 bp, Oryza sativa
gaggaccttgcccatagagaggggggggattcttttcgagatttagagcttagaacgggggatttttggtcctttcggaaggctgagaggaaaggaagtcgatcctttgtaacttgtccatacacaaatccacaaaaacacaggagtagggtattacgcttcgcagcggcccgaacctgtatacatcgtcgtgtctcgtgtgtcttgcgggcagacgatctttccagatacagagggagagcgagagcttgagatttcaccctaagcccccggccgaaccggcaaaggggggcctgcgcggtctcccggtgaggagccacgagctccgtcatctggcgcgccaggtagggggctcagcgtgtgttttctgagctctcagactcttccgtgtgcgccaagtttttcttgttcagcctaatggccgagcagggaaaagcgcacgacctctctccgagtgtgagcggcgacgacggggagccgaatccacgccgtcgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcatcaaggcggagggcgcggcgagcggcggcggctgcacgtcattcggctgccactccctcgtcgacaccgtcgactcgggaggatcagcatggggagccggatgcccgcctcaacatcgagcgcaggcgtaatagccggcgtactccccgtgcaacggagggcgcctcctcgtccagaatgtcacctcgacacggacgtgaagatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggcccattccggcgacgaggggcacgtcctcgccgtcgagggcgctccgcgggccacccgaaaggggaggcctgcgagcgacaaaaagaaagaggctggtactcccaaccgggagcgcccagccagcaagtggtgctccgtccacaacacctccctccacgatctcgcggactgtcgtgcagtcaaaaatttggctgagcgaacgaggaagtgggaggaggacaggaggcaggaacgccgtgagggcaagtccgcggcagttccctccggtagacggcgaagtgaggccagacagaaggcccccgccgttgaccccgatgacggtgatgatgacctaggtttccaagaacctggggccaccattgccactgtcgacgggggagcgtgtgctcacgtttctcgccggagcttcaaggctatgaagcgagagcttctagccgcggcccctactcatgaggcgacgcgtcgggcgcggtggtcggaggtggccctcacctttgatcagaccgaccacccaccgtgcgttgcccggggagggcagattgcgatggtggtttcccccactatctgcaacgtgaagttggggcgtgtcctcatagatggaggagcggctctcaacatcctttcccccacggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggagacccgcgttggtgaagttcatggcggcggtccactacgcctacctccagatgaagatgccgggccccgggggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggattggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttatacatcaatgcccttcgggttaaagaatgcaggtcctacttttcaacgtactactcgaatttctttgggtagccaaataggacgtaatgttgaggcttatgttgatgacttggttgtaaaaacgcgcaaccaagaaactttactttcagatctagcggaaacttttgagaacctccgctccgcccgcataaagctgaaccctgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctccgggccgttcacttggacggaggaagctgaacatgcccttactcagttaaaggcgtatcttagctctcccccggttctagtcgccccggagccaaatgagtccctgttactttacttagcagcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccccgacgaccggagtcggccctctgcccgcttgtcagacggtgctgggtgcccccgaccctcaggaaggccccgaggccactgagggaaggccgcacttatcgccctttggccccgaggctaaccctgtgctgactcgacccgggagagagcagggagaagaggcccccgagccgaaaggaggcctgaggcccctgacgaccggagctggccccttgcccgcttgtccgatgacgccaggagcccccgacccccaggacggccccgaggccactgtgggaaggccgctcctgtcgtcctccgaccccgaggtcatcggcacagaagacgagtgcaccccgagaggccacttggatgaagaacgccccggggatacggcccctagcgaaggggatcggccccgccgaaaggtgcagcggcccgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcgggcaaatct

SEQ ID NO: 56917 - DNA, 14568 bp, Oryza sativa
  unsure (1)..(14568): unsure at all n locations
tcgagcgactaacaatatgacagagtacgagggactccttgccggactcagagtggcagctggactggggatccgccgcctcttggtattaggcgactcccagctagtcgttaaccaggtctgtaaggagtaccggtgctctgacccacagatggacgcctacgtacgccaagtgcggcgtatggagcgccatttcgatgggatagaacttcggcatgtacccagaagggataacatagttgccgatgaactctcaaggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcctggatctctgagatccaaacatacctcacagataagactctacctgaggaccgcgaagggagtgaacgtgtacaacgcatttccaaacgctacgtgctggtagaagggaccctctatcggcgcgcggctaacggaatcctcctgaaatgcattcctcaggaacaaggcgttgagcttcttgctgacatccatgagggcgagtgcggagcccattccgcctcgcgtaccctggttggcaaggcctttcgtcaaggattttattggccgacagctctcaatgacgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctctcaaattcattaagggcatcacggcccgttttggagtacctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctctactacttagaagagcgaaggcggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctgaaagggggggggtcgggtgtcaggttttggctcgggccaaccccgcacccccctcgggtgtgcaggattggccgggggctaccacacatgcacatatatccctttttcctttatttcagcatttcaataaaagcagtttcaattttctaaaggttgtgtctgtgccgttttttccttttgaagaatcttgacttgaaataatgtcactcgtgctcaaccttgccctcgggggctcggttcggtcagctaaaatcgccaaacggggcccagaaccgagccgtgccccggggcgtggtgaactccgggggggaatcggcaaaaacccacaattgggtcacccataaccctcggtcaccacgttcccggcctggccagtctcgacatgcggatctccccaggcactagccccgacccgcgcttttcgaggactgggacttgggcatgggcccttatttcaagctaagacgcaaaaagaccacggcacagatcatcctcatctcacatatagcaaaataaaactaacacaaaaattttttcatcatttctcattgcagattaagttaaattgtacaaaaaagaggcatgaaggccttagaagaaagaacaagaaaaaagttaagattggcgggggcctgggggctcattcaaatgcgcccgggtcgccggcctcgtcgccaccgtcgtcctcgccgctggcgtcgccctcctcgtcggagctgggggcgaacgcgagccgaggggccgagccctcgaagccgttgacgatgtggtcagcagcatccccgacgcgcgcgcgcgcgtcgtcctcggtcccgggagggaactcctccagcgccatccagggagagaaattggggtcccgggcctggtaactcgctagcacgagttcaaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggcctgcttgacgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgctttcgcccgcggccgccccgccgataggcgcccttgcgtccagctccttttcccgcgcctcgaggtcagcagcccgctgctccagtgtggctctctcggcgcggacgcattcgagattgcggcgcgcctgctcctcctgcgccgcctcgcgaagggacaggctgtccgccagccgtttggtcgtggcctcagcctcctcgagagctcgctcccactcagcgagtgcgtcctcgcggaggcggagcgcgcactcctcctcggcgcaggcggcctcatgcgccgccagcgtcgcctctcggagaccagcggcggcctcgcggtccgtcaagcccctctccacggcgccggcgtgttcttccagcgccatggcacgggcctcaagggcctcctcgcgccgctgaaacgccgcttcagtctccgttacccgccgctctcgggcagcggcggagtcaaggaccccttgggcggcgtcgagctttttcttcagctccgcctcccagcttgcgtgctgaaggcggagagtgtcttgcgcctcgatcatcgcggtggtggagatgagggcggccgcccgctcctcctccacctcacgggcgatctccgccagcgccgctttccgggcttcaagctccgagacatgacggcggtgagccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttggagaaaaggcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccaagggagtaggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaagaaaaaacttctctttgggagaaaggtggttgcaatgagagtgagacgaacctgcgagggggtcggttgaatgaccaccttggaggagaaatcaggttcccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccggcgcggggcccagaagcacgaccccctcctggggcagattgttcccctcggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggagcccaatcccatctggctccctggtgggtccgcatgtagtcttcaggcccagtgtactcccaggcgttccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggacgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattaggggtgaggtgcgccatctggaggtcatagaactccaggacatccatgaagaaatgagaaaatggcgggaccagcccagccatcgcaaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttgcggcgcattgagtggatatgcggttgtggcaatcgaaatggattgtatcgtgcgcgcgttaattacgctcgccgaccgaagcggcgttaccatatctccgggcgagacaaatctgctcacccagattcgcgcgctgctcaagtggcgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggggtctggttgcgcttgccccggccccgagggccgaggcaccccgaccccttaaggaagtctgcgccacatacatgggataagtgatcacagctgtgctcacctaacagcatttattgcagtctggtcaagcgtgtcacgctgcatgcaacgcagtacagcgcgtttctttatccggtctgtgaccagtcacagaccggtcagatcacgggttaggtggcgactggcggtctgacgcacgccttgccccatcccgtcaagacgaaagcctctaggcactcgtctcaagctggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcagcaacgggcagccacgatcccacgttgcgcctgtctccgccgggagtggaggtaggtgtgggctgtcccatcggagtgtcattcggacagcaaccataccaatctccgtccataaagagaagaaaagtccagtttggaaagggaagggtgcatgtggtatccccttgaagtataaaaggaggaccttgcccatagagagggggggattcttttcgagatttagagcttagaacgggggatttttggtcctttcggaaggctgagaggaaaggaagtcgatcctttgtaacttgtccatacacaaatccacaaaaacacaggagtagggtattacgcttcgcagcggcccgaacctgtatacatcgtcgtgtctcgtgtgtcttgcgggcagacgatctttccagatacagagggagagcgagagcttgagatttcaccctaagcccccggccgaaccggcaaaggggggcctgcgcggtctcccggtgaggagccacgagctccgtcaccatcacatcaaaattttcctacacacataaacttttaacttttccgtcacatcattccaatttcaatcaaacttctaattttagcgtgaactaatcacaaccaaacacctgttttcttggtctttttttgataggaaaccatgcagggaaatacactgaccgacacatgtaggaaaggaaatttgtcaaatctatacctaataaaaaaattcttaaggcttccgtcattatttttggtccgtcgccgatttcccacacgcgcacggcggtttttttctgtccgtttttttttcgcgcggttttttttgtccgtcagggtttttttcgcacgcggttttctgtgggcccatccaccttttttttgcgcacacgctctttttagtgagtccgcctttttttcaatgcacgcgtttttttagctgtccgtctccagttcccgcatgcggtatttttgggcccattgcccaggaattacaaattcagtccagcacataaattacatagaacccaaacataagaattacatgaccgattaggatacaaacaacttctcaacctatatatagaataaaactgaaagcacaaacaagactaatatatgcacccagaatttggtgtggaactaagcaatctctgctcggcgctactcatatacccagatatttttttgaaactgagcaattcatgttcggtgtgagactcaatctgcttttactgcatttataacgataaaaggtaattctttagaccttaatgatgtatacattatttatgacatataacgaacaattaacataaatcagtcaatcttaagagggaaaaaatacatggaaataaaactaccaagctcagcaaggtaacaccagattgatcggatctcataccttatttaagaggcaaccatcttttattagtaattctgaagaaaaaaccatccatcttctattagctaaaaaaaaggggagtagctatatttatggcgccatatttttcaccaaaaaatagtcggtgtgtatttacatcgtaagtttataaattacatatgcaattttattgtatttacaatgtaagtcacaaacttacatatgtaagtctcaaaattacatatgtaagtctcgaaattgcatatatgtaattaatatataatcatctctcatcatgatgtatgtgtggaaataatcttcaacctcacggaagcacagttgggaggcctcaggcctgtgcggttgtgtggcatagcgcataggcatgcaaaccgactgtaatcaatggaattttatggtgccagaaatttagcaaatccaaaaaaaaattatcacaccaaactattaaccaaaataataccactattacttcattatatttttatttgctacacttatttctgatttcggatgtatagtctgccaaacaatttcccttaactacgcgcgcacacaaaagaagacctacgtataaagtttaaatgtttggcctatagcttggtgttttgtgtacataactgttgcttgagttcccctattacttcctagggccataacgtgaaaggtatttcaaatagcataagtaaagcataaaaaaaaacttaacagtatttgcatatagagaacacataaaagaatattatggaacattagtaaaacaaaacaataacgaataacttgcctagaaaatcaagtggaacctctatcgcatatcagaacaaaagtttctttagatcaagcatcatggcatagcaaactaagacatgaaatttttggtactacattggtacatgtcagaattgagtgtttccaaacagatgaccaatgaagcatgcacatcgcaaccaaaacagagcaggaaacaaccatgtgatcagatattacattggaagagaaaaaaaaattggttgcagtagtatggctgtagtttgcacaaaattgataactgaccttgctcaggcaagctatctcaacattgagatagaataatccccaccaaaagaattggtgtattaattgattccatcgaagtccaacacatatataaacacatcctgcggctcatttaaatgaacaaaatcagctgaaaaaacataagtgaatgattaaattatttttgcttctcaccgttgttttcgagaagatacatcatgcttttgttgttgataatgtttatgtacagcttcatcttccaagctagatgcgccatctggatcatcgtccccattcttagatcccaatacacgaagacagagacacaaagctgtatgcgcaaaatgcctgacgaaaagaaggaatacttaagaaacgtcatgacgcctataagcgaaaaaaggattcaaatgtccttccaaatgttaaggacgcacattgcattaattatgaaggtgatcagcaaagctcatcgcatgctaaatctaataaagttaaacaatatatgcttcaagtttttttactaacagataatttgacccctctaccagaccagtttcaccatcatatgtagtcacaatgtactcatgacttcagagagaagcaaaaaatcacttctaatttttaattttgtgatgaaaatatactatggatttaacgaataaattatatctataacttctagctcattacaaagaataactcattatataagaatgctgaccaggttagatcatactgtacttgcatcaaatacccagattattttctaaaaggaagataactttgagttaggataaaactaaaacacattacattttggaacggtgggagtatcagagtgaaaatgtaatgctgagaatcacaaaaaataatacttgaaacaaataaatgacagtggattcaactctcaatttagtttaagcaaaggaaaatatgtaacatgggatgtaaatgatattataaacaacataaaagcatgatcacaaaactgttgtccagcaattccacatttcaaaacacaagctcagataagaaccgtattctaatttctaagcaaccggattactactatacaagatgatcccaaaatttcacatcaacaacatgatatattgtcttaaaaaataaagcacctgggaggcagtggctggaactgacggcgagtcaaggacgtcggtcgttggcaagcacggcgcgggccaactctcctcgaactcagccggccgcagcctggcctcgaaagaaattcagtataatgcggacattgtttctcccgtaaggcttgcctatcagcatagctccagtgagccggatgatgtttctgaagatctgaagaaatgtagattaatacacaactagattatctgcagtgtatgtagcttggacactatgactacataaggagtgttgtcaaacacggttctccaccagaagaagcagagacaaatctgatgagctaatggaatgtggtgaaccccataaggacttaaaaagaagttgcatcctcaaatgcgatgtgcttagcaaccaacaccgggtcccctgacttatcggtgaaagcacaaaccaaaagatagcaccaagtatcctggatagaagagaaaatcaaaagaggatgcagaggaaagtgtctggatgattgggttgaggactcacattggcgtcgttggactggtagatggtgacctcctcctacggcggcgctgtcagatcgagatggatgaggaacgcgccagcgccatcagtcgctaggataagggatgccggatccagatgctcgacggaggtcttggcgaccacctctcgccaccttcgcctccatctcatcgaccgcccacttcttcattcttcacccaccggaccatgcgcctccccttcatatcccttcctctagcgcctcccaccgccgccgccgccgccccttatcgcagccatcgaagacggcgtgggggagaaggaggcagcaggggcgggggcggcgtaggggccgcgcgtgcagaggcggcggcggtagggaggccacgaccacggtagaaccgccggatcttgaccctcccgttaacaccggcggcggatctgcgtgagcggggcacggagagacaacgggatctgagcgggagaggaacaggtcgccggatccaacccctcccgtcgcagctgatgacggatctgtgcgagaggggaccggaaagacgccgcatcgaattcgccgtcgccgtcccctagcatccgcgccgcccatacacccatcttaccgatctgcgttgccaggccagttagccgccaccagaattgccgtctccgaccccgatctacacctggacgccccccctccttgcccccgtcagccggcttgaagagtaacgagagagagagagtgggagagagagagaacgagagagtgagagtgagaggataaggatctctaaatttctctccaaggtaatgtacaacaaccatctttcttttcttttcttgaaaaaaattacggtcaaattgtgctaatccatggattcaaattgtacaacaaccatctttcttttcttttcttgaaaaaaattacggtcaaattacggtcaaaaagaaaaagggaagaacatgctcgcgaagctccggcccctcatggcgacggcggcggcggcggcggcggcggcggcgaagccagctccggctttgtcgttttccacggcggcggcggagggagacgaacacgcgcactacaaccacaccgacgcgtgccaccacctccggtggacagccaagtaacggctcccccccatcacttcctccatcgtctagggcttatctgcggcttggggcttgattggtagtaactgttttggttttggttgggcactgcggctgcggcagggagagctacgagtacatgtacgcgcggccgtggagcagggtggtcgacttctacgccgagctcgtgcgcaccggcgccggggcagcggggctcgccgatttgtttgggaaggatgaggtgagaaggaatgatattattattttttaaataattatccatgtgaaaccctgaggtagtggttcttcgcattcggtaaattggaaggggaaaatgtgttagtgttagttgcaattcctcttagtgtgccaaatgttggtactttccccatctaagtagtacacattgttttagagaaattgaaatcttttgggtgaagacatttttttcttggaggatagattaagattttggaatttgtcggtgcaggcctgtttctagaattatccatgtgaaaccctgaggtagtggttcttcgcattcagtaaatgggaaggggaaaatgtgttagtattagttgcaatttctcttagtgagccaaatgttggtattttccccatctaagtagtacacatcgttttagagaaattgaaatcttttgggtgaacacattttttcttggaggatagagtagattttggaatttgtcggtgcaggtccgtttctagtacttttagtttgtttcagtaagatttatcggatttttcttcaacagaatggttacagccttgatacgaatggagaagattacacagcaccatcagaaaatcaaacatcaactaaatcatccaaagatcgaggaggacgatgggaaagagtaaccttcaagattgtcctttcatatcatggggggtcatttgatggttggcagaagcagcctggcctcaacactgttcaagggtaaggataaataagaatggagttatgtcatttctatagacatatctggcacttttattcttcacttcctttgcatctcaagacagatgacaggataaaaccatttgttgcactctgtatttcttgcaggttagtagaaaaacatcttggccagtttgttgacgagaagaaagctaaacagcttgaagcaagatcattgccattagaaggctgtgctgttgttgctgggcgcacagacaaaggggtgactgcccttcagcaagtttgctcattttgttagttgcacctgagaacacactattgttttccagtggtccttcaactaattatccacttttatgaacatgtcatattacaaactattccctttgttccaaaatttagctacctttccacctctcaaccaatcgcaccaatccccatttagtttctccacctacttcctcatctcaaccaatcacaacatccatcatgtttacctttttctttaatatctgtggccaactctaaaataccttatattttgggatggagggtctacttctcaagaagagcttatgtgcagttattttgtagagtttttttttttttggttgaaaattttgctttgtttacagaagcatttgaacaagtaatttgcttctgattataaaatcattaacacaacaatttgtcaataccaaatacaccactgttttcctatcaaagaagtaatagcctggagatatagcagtgcagaactctggcctacgtgcaatgaactgctaaccttcttatttgactaactccaccaatgcatgccattcatttcatttgatatgacatgaagaactcatttgcacaaataaatagacaatccttgtgtacttatgtgagaaattaactctaatggaatgctgagatacaccatgggactagatacattacttctcctgatagctgacatgtgtatttacttctaatttccttagatacatggaggaaggatgtaaagtctagtgatataaaggatgcaataaacaaggctgcacctgataaactaagacctttgcatgtgtcacaggtatttttcttttgctttttcagaatatatgactgcacttgatatgtatgctgcattgctgctagtggtagaattgtccatttttcatgtaaagttcttagaatgtcaagacatccaccatgggtgatgctacgcttgttattaactgatggcataatttgcaggtctcacgtgaatttcaccctaattttgcagccaaatggaggagatacctgtatatatttcctcttgacgaggatgtaaaactaatctcaggggaagaacagtccgctaaaacagtagagggtcctgagtgcaacataaaacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56918 - DNA, 4038 bp, Oryza sativa
  unsure (1)..(4038): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgagttagcccatatataattttttatgcttaacacaacaagctaacttgtcaaataggaaatgccaatttatgtgtttcaccctactttggttgattctctgataatgctaagctaactttgttgcagtggtttgaatacataagctgcggagctttcttgctttcttgtttttcttgcttgcaatattagtacacatggtaaacaggaacccaagttcacagttcatgtagttgggattgatcatagaattcactgtagcgaattttatatgattgataatggagtggccgcctggccggtggacactcatgttgcgccgtataaatatcaaatagaaacttacacattctgaagagcgaacaattgttttgaatctttctgacatgtgctaccacttgttttgcagagcaaacatttcctgtccctttactggttggcaaggttggaagacgtccgtttcctgtgcagtgttctatagttcgatgctgcttgtcatcaactgatgccatccattctacaagtgatgacatccatgaagataatggacacggccattttcttatgaagtctacatctgaccttcaggtatgatggtgagtcccatgatatatatatatttttatcctgttatgtttcacctgattcttaattatataatgctgtaaaatacccctttattcatttgcattatttttcttaaaatagtattgtatcatctcgatttttagtacaagtcaatctttactccttgggctaatgtttactgataacatcaaaacatcttttttcttttcagaaagtgatatcttcctgttttgggaaagcatgtcttctcagttctgtcatgcttgttctaccacccagttgtttcgcagaaccgtgtgagccagagtactctctacctaacatgcctttgctttttgcaattgccatgattggagctaccgttggaggtaagatcattacaatatgaagtacagaaatgatggaggcatgtagaaacatgttgtggatagcaaactggatataacattcagccttccagtacacaattttcttatatatctacggcatgatacttattgtgcagaatggtttgaagaagattaaggtaatagaagagagtgagagacaaattggaatgagagaattagaagtattgagatatagcaaattgaagaagagaaatagttattatttcttaaccatcatccttgtattgaggatgttgctatgaacacatagaccatatctccaaatatccattactcaagtctccctgaaggttgttttggcctcttgttagtccctcccatccagccatggtgtcctaaccctcctttttattgtgtttatccccataagtccactgtggtgcgtacaatcctttcactttttgaaaaacacatacctggtacaccaaatgtacattaatgaaaatttcaataaaataattccaaaggagttcatatgtacagtacacaactaaaagctaatactttcaaattaactgttcatatttgattggttgattggttaatatttaaagtacaggcatacccactttacctaatgtttgacatgtaatcccgtatagtacacagaatagaccgattcatatggttatcatttacacacatcctaagttccaaacatccaatcttgttttgtttcttcaatatattgttatttacaattgtaaaaaaaaagcagtaaataacacaactctaggcttgaggcatttcacgacccttagagaaatattaataagtgcatgtgctgagaatgtgaattgtcgctcaccaatgtgggcatatgctaaaaaaaagagtttaatcctattttttaataaaattgcaaaatatgcattatagatgcctcaaagcctcaaaacccagagttttgtgaatttgactgtaaaaaatatcatctatctgtgtgtattctagatgtcttgcctcatatatctttttagcttattgttgcttttattcatttctgatccagtaccagttataaagtcttaaactggaagtgtgatatcatcagattattcaattcgcatgtttccatttatctatgcaactatgtgggccagtatagttggtacatcatactacttcatcctctttaagttggttttactatttcttaatatgttgaaaaatttagatatcctgtagggctccttgcaagacaacggagaggggagcttaaacgattgaatgatcagctacgtcagataaatgcagcactgagaagacaagccaagattgaatcttatgctccttctttgagctatgcaccggttggtagtaagatacctgaatcagaagtcattgttgatccccagaagatcgcttaatttcatatctgagggctgggaagaactatctgagaaaccaagcccctgataaggcatttcctgagtttaaggctgcttttgatcttgcacaatccttgggtgatcacgtcgaagagaagaaggcggcacgtggattaggtttgcttcccatcaataatttactttcatgcctttttccatgcacgtttgaaactggatgttataatagccaccttgattgttgtagaatcccctatagattgctttttttatgaatgaacgtttttgaaatgctcgataatgagacacatgttcatatttatgctgattcctgaaggatcttttttccatgttcaataaaaattcaagaaatgcgacctgcaaaaatgaaaacagcaaacaatctactgatgttcgttttttatttgcattctttaggagcatctttgcagagacaaggcaagtacaaggaagctataaagtaccactccatggtgttgaacatctctaagctgaccggagaggacgcaggtgttacagaagcctacggtgcgatcgccgactgctacactgagcttggtgagctcgagaaagcaggcaagttctacgacaagtacatcgcaagactggagaatgactgaacagatttaaagaaccgtgtgtgcaacctttgagagctcaagtagggctgtgtcccatcttttgccttctttggcctgtcttgtagcaacgtttttgtagtggacgctcagttcatggctgtaactgaggcacatgccatctttcaagttatttctactaaatagtgtcatcagattttttttttctttgtctggtcaagatcggcaccatgttgtgtaaaatttctccatctgttccaagttataagcatggctatgtatctggctatgcttgtcctgaatcaggaatgcttatgttttgaaacagaggggagtagttgtagcagcaggaaggcttgttcttaaccttgttttagataaaaggtttgcaaaaaataatagctttaattgttttagataaaatattcgcttgagattttggggagtgacggatgacaccgttacctatgttatgcagttttttccccctaaaaaatggttataggttttctgtgagtttgaaataattggcctagccaatcatcctttcagcgatacaaattcatcgttctggaaaataataggttatatagctgctagtttatgtcccactaaggatgcttggatttgatatgattttgcccggaaattcttgagcaattcaatcacaatactacatggagattttccaacattgcaacgtcaaacactacatatgaagtcacctaaccgaatttggtttagtataagttataaccaaggacgcatatactgtgcacgccagagaaacttggaggtcaaagatatcttcttatctgttgaatgaacatgtacgcatgtgcatactctaaataaatacggactaaataacacaccttcgtagaaattttgccatcaagggtaaatatttcttgagttcacaaacccacatgacgctttaagtgggccaagggaccatttt

SEQ ID NO: 56919 - DNA, 5115 bp, Oryza sativa
gtgatccactttagtattcatcaaatggaacgcagaaataacatggcagcagatctctcagaaggaaaaaaaaaaagcaagcgctgcatcagccgtcaatgacattcaaaacggtgatcaggtaaactgaagtgtggtcagctacgaggccaacccccaccagaagagcctagctgtcggtacgggtattgtggaacccctcgtgcactgtagtttgtatcctctaaaggtggagcatacttgtccataaccgagcttccagatgcacttggaaccagggcgtacatgtccataactgagcttctttgtgcacttggagccaagaatccaggagcatacttgtccataatgctatatggtgtactcgtaccggggagtccatatgaagatgtttgctgaccatatgtagcacctgaagatccaagggagtattgacttgtctgtaagtaaccatcagcatgtccaacatgcgttcttggatgtgcctgctcatgcaatgttgatgggaccctactggtttgtagataattatcatcaccaacttgtcgactgtaccttgtggggtgtccatgcaaaggtgcatcaccagttgtgctctcaagagaattagtgttcctgtcttctgagcgctgcgtcctataaaacctgtcactatctcttagagattgcaaactgtacacgttgccagttggggcagtgaaatgctgcctgttcacttcgaagtcagtaccagggctgaacttcctggagatatcatcgatattggtatgaaatggaggatcaatcttcccttcaaatgcattgttgcattcattattgcttgctaaatatctgccctgataagtagcctgcttagagacaagatgttcttttggaggataactaataaaactatctcgacctgtactcttatcagcagggtgtccaattggaataaaaggggaaccgcttctggatttgttttgagcattactggagtcagaggatgacatgctcatgtcagagttcgcttgttctgtgaatttggcacccataatctctgatcctctatgagcatttaatctgtctcctgcatctagttgtttttcttggtgagtactcttcttgataggaatagccattctttcctcataagcaacttccacttgtttttctggagggaggctcccatcaacctgatcaggggttcttttcctgctcctgttatgagtgctattgctttcatccatgctatgctctttctcctttcctgattgagagatttgctggtaattagtctcagcttgtttcttcacaggaaggctatcggatctatggtactctttagctttcacttgtccatatccagcttgtgtcttcacaggacgatcatctgatagaataacctctctgacatcgcatgatgtcttctctgtagtctctttctctttgcctggtccaacatttcgtttgttgccagcttcagcctgtctcctcacagggagatctgatagattggtccctttgagattgcatgaagtttgtcctgcattctcctctttccctgatctagagttatgtataccataagattcagtttctttcatcatagggaggttatctgatagattatcttcttcaacatgggaagcgatcctccctatgctagtgtggttatgctcctcagctactttcctgtgcttccttgtccaatcaggatggctccataaatggagaggtggtgcagaggcattccacccttcaactactttatcattaacatcaacagaaccaggcaaataaaatgcctaaattacaagaaaaatgttaggaagaacgggtatatgataaaaaggggaagtttaaacttcaataaattttcctgacggtctttacctttcccgaaagacaatcactatcctcccaaatcaaatcataaggtgtcttcttttgatccaacctgatggccaaagagtggagacagatatggaagtaaggaacatacgttacaccaaaataagtgatattatgtcattatgtgaaagcaatatcaggtgaaatctattttttttaaaaaaaacatagttaaaatccaatcagccccaatttggcccaggcgatcagatgcttcacattaaatactttagatcttcacctgatattttgccatgtgttagtaagacaagttcaactcaattttctaaggaatgggtacgtgttggttacctttttgtttcctttgggacaatcaatataacgagcttaggcttaaaggtcaatgccttgtcaataaatttgttcgcaagagatgctttgactccaaaaggaggattaagccccattatctaatcaagaagcaatcagatgttataattattttaaattagcaaatttgagttaaataatgtccaaattaaacatactagtttggatccatgaggcaattcttttggccgtacagtcatccaatctttcctttcgaaggcgaagcaattctgcaaaacacatacacaatgcatgcttatcagaatgtgcatgatgacctgttaaatgctaatagacttcactttctggctatgataatagagtttggaactggctgagttctaacgcatttgcattgaggagttctatttaatataaaagaaagcaatggcattccaaaggatcataaaactcagattttttttccccagaaggaaaattgaatgaaaaatgattgatggcctccattttacctgcggctggataagatcataattcttgaaatgacacttcttctggactttgtcaagtttttctttcatcaatcggctgaaatcatttgcaccacagcagaagtccactatctacagttaattaaatttaaaatgatcaaggactggtgtaaaacacagcattggactagtaatgttatatatctgtttcagtcaagggataatttttttttaattagaacaatattttcagaccaaagaccatatggtccagcttctattaaaagctgcaaggaacaagtttcttttgcacgggacaccagcttacagtgccgggctgaaagcacagggacctatttggggacaaccatccatacaccattcgaaagacccaacagaagaactcagagataacccagctcgatttttatgagaacagtaaaggtgagccatactcaaatatttatatcaatataaaggtgtacaattatcatatgataccagatacaaacgtatcaaaattgaatattgatatggataaaagctctaatcattccttaaagagcaccaactaagataacctgccaaattagacagatcactactactatagaagtgcaggcactactggtagcttattaggccacagccattttattgtattacactcatcatatggaggatgtaatctaccaatgaataaacatgtgattcttgtactaaaaaatacataccgtgtcaccaggttccacgtagcaatgaagcttatcaacaatctataccaagaaacaagaaaagtaaagttacaactatattacccaatcaagagaaataacacataaacaagaaaattacataaaccacatgctaaaggttatgttagcagaacaccgcagatttattggctaatggcactcatccccaaggtattgcattcggttggttttactatggatcaatgaacgttgtcaacaaatttgtccctgcctccaacaaaatcctactaagcttagctttggttgagacacaaccacatgagacaatggtacagtactacagttgttcaccttgctagcagacatcaatttgaacacaagcatatgctacattttggctctggttaggtctatgaaaatttatgaccacaagccttgtttgggtgcatttagacatgaaatttggggttctctagagctatgaccataaatgtgcagttttttttctcgaaaatgcaagagaactgcgtttcatttcattaaggggaagaaaacaaagcgaagataaatgtgtggttttaagcgatgtattataagaaatcatggaagtatgcatgaggtgatgactgcaagaaatcagagtcaggttttatcatttgtgtttagaagtaatatccttgacaagtttatggtgtccagccaaaattttcctagggaagatccagtttgttcgcacttgtttccttctccttaagtcattgtatgtatagtgaataataagataagtctttataagacatcaacatagcatactgacattcttatttgatgatctacagtgaggataagaggattaggaaaacatgtcaaaaaatctgctccctagccagatggcaaaaaaacatattctacaatgttttttttttaagagcaagggttttcaagattctatatttgaatcaggtatataacacataaaaaaaagcatctattctacaaggaagaaagatgtcatttatgccttgaattggacctttttaaaaaggcaaaaaatcagacaggatttctggtttttctctactttcttaaacctagtctgcaatatttcatttttttttgaggcagaaaacacttctcaacaaattgcacgcaagtgtgtgtgtgtgtgtgtatgtatatgtgtatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatatgtatgtataaccgcagttaaatgccaatgtggttatcataactcataaagccatcagccatgctagaaaacagatgagaggatatttgtttacaagagccatcacaagatgacacttagattgagactggagactttcttttcaatgaatctctgcatctaacatccggtttgtggtgcctttccaaatagatccggagggttaataggtatatagttacgcatttatatacaactcactatcaacatatatctggattcaagtatacctcaacaagcttttccacctttgtaaaatgccgaccaaacgaactgtagcgagtaccataaatgaaaggtgatatatatact

SEQ ID NO: 56920 - DNA, 28641 bp, Oryza sativa
  unsure (1)..(28641): unsure at all n locations
aatgtcaaataagaggcttctctttccaccaaggccattaccctataagacaaaaaaaatcttgtttcagctccatgaggattcttaaatataaacactacatactgtctcataatcatttactctgcacatgacaagatagaacaaaacaatttaaaaagaacagaatatgaaagaaaactgtagcaatataaatataaatgactaaaaaactaaaaatgcctaggtacaaatagttgtgacctcgatccccagtaattatgtagaagcgactcacctcttctctgtttcgctatccactctaggaaatgaactttggggtatcttcgtagaagtagatgatgaaggcatagttaccaacagttttccctgctcttttgcaggttttgtaatgcctgtagaagcatccttgagcagacatggatcaggctgtggtgtatctttcaagaacctggcttttttcttatcgggtttgacaacaaattgctcagatgaactcctagcactaatctttctggctcgatcactttcttgaatgcaaaccatatctggcagttttcgaagttctgttgaaagttgatcaggaactgactcactaaaaggcctttttttcttaaccactttggttgacttctttagaagtcttgcaggtttttctatgtttggagtacgagggaactttatatggtctctgatcggtgtgtcaatgtcagtatctatctcatggtccctgtaacagtttgcaaaaaatcattgatatgaacaatgttgacaaagcaagtagcaagactgtggataagtcacatacaagcaatagatcaaaattcttttcgaaagttcccaagcacgtgtaatagcatcctcattttcactatcttcaaaggaaatttctctgaaagaatttcaatttccatgagataaatagaagatattataaatgaaatggaacttgaaaagacaaaccacttgtttcataacagcacctaggcaaacactttctgtgatacgactttgggcagcgtctgcaaacagcaaactgtaattcctcttgagttctgtcctccaaacctttgcaatgaaaacaccaatggctggggcatgtaaatgaatgtccatttgctatcttcatttccagttctgaggcttcatttttgtttttagaatgaagttgtcgcgcaacacattttgggtggtaaaagtgcccacacgtggcattattacaaagaaacacctaaaagaaagatgacaaaattaacaaaacataactagaacaaagccctgaaaaagcatcccacacttagaatttatgatacggacttccaaactgctgaactatatagcgttacttcctcttgagtgaatctaaaataatcaggtgttaccatggcggcattaaattggcccgactgataattgctacatcgttacacaacttctgtcattagggcccatatagaagcagtcaacaaatccagggccagcggtactgtacatgaatagtgcccacgtgatactgttcaagcaagttgtgtacattagatcgatttgttagctatttccatcagtaccatcacctcagcaccatagcgcgaggcactacaacgctacatgaggtggctgaggcatgattagtggaaaatattggataagcaagagaaaagggaaaattgaataaaggcccactaaaacttccgctagagattcaaaagctgcagcaatctgctagatctgatagtagtggcgtggaatctgcgacagcaggccagctgtggcaaggaagaaggtgactgcacacttaaatcaacaacccgctgctttctgtcccctttttccttggagctctaacccttccttctcctgtaagacaaggcaccaacaccttacttcctctgtgtgttttgctgctgtagcgacaccttaaccatgataaagttccttaagggtcaagtcatcccagctatataaggatgaggtcgtatctcaattcattattcaaaaaaataaacaagtctttgcatctccctcttctccacagccattgtgatgcggctgccctcatggcaccatcgcacccgctgcatggacagctcaaacaggcctatggggcccttatcccaaacatgccattagaactttggagcttacaagtagaatgctatagcactatgccactatggccatattcaacaataaaattcactgtatcataaaaaaaagaataataaagaaacagtttttttatctaattagaagtgagcaatgacagtataccttagcagctggtccatctgaaggttctaaagctccacatataaaacactgatgttgcttatgctcacaatttttgcacaagaaagttttcattgcctaaaaatcagtagaataagataactcaataaaataaaaaaggtgtagatttagagctctctttatcactcaaaatgttcaagggctacctgaacttctgcctcagtgtacccaagtgtatcacaataggaatcttcaccagtaccgatttttgcatggaaggacctcatacatggaccatcacagctacagtaggataatatgtaaggattaagaattggtattataggcctgacaaaactactccacagtatttacagggaatttcatatggcaatgatgaaaccagaagcaaaatatcaatgaaagcaaagtatgcaatgttgttttaagcaaagtaaaaatcagtaagaggaactaaagaaaaacaaaattgtaccattgtactatcatttttgttgaacaatggataacaccatagcagacagggttcagtcatgatcacatattccatgtagactaattatgtgagcgctaaaacagttagaaatcaactaatttaagtgcagactgaatggacaatctttctaacattgcatggggcagaatcactagatggttcattacttcatttggtaaacaactagtgtttcctgataaaaacaaaatggtctgaacaatttgctagaagaacatgcagaggaaagttccaataacatttgaaattatcatctacaggcaaaatatgttattaataaaagtaagaaaatgatggagcagctgtacaaaaatgctcaaattcttgaatgtagcagccttgattggatctgttttgggggaacccaaaacctacttaaattcatttgcattcttagtttcttgtagattgttttttttggaaaaagtccaaatacccacctaaaatttggatggaaatccatctagcaccctgaactttaaaaccggacatccaaccccctaaactttgaaataccgttcatattaccccctaaggtggttttagatggtggttttgcatattttggaagattaaacgaacaactttgaataactaatataacatatgtgcatatcgtcagttgcaagccattaaatttatatttatacagtgataccatactatattatgttggtacttgtttgtaagtgagagctaacaaggggtaaagagaaagatttaggtgatcttaatatacaagcaaaatcttcaagctcccttcaccaacccgctcaccctatagaggaagcaaaaccagattgctcggccagccacagcagcctccttcctcacctgacctgacatgacaagccacctttaccacacaaaaatatgccccctcggcccaccgggcagcgatcccccggtgaccctgtccccacccacgtgaccccaagctccaagctcccttcaccaacccactctccctatagagcaagcaaaaccagattgctcgcctagccacaaccagcctccttcctcaccttatgtgcgagccacctttaccacacaaaacacgccccctcggtccaccgggcagcgactccatccccacccacgtgactgccccagtgacatacattaatgtgtgtgtgtccaatcaataaatcgtgttcaaaaatagacatggtattgagcgttgacatgtaatttcgtgtgtttagagtggaaaggttaacaaagttttgttttggatagctttatcagtgtcccatttctaaaccttcgaatgaaccatgccattatacatatggtaaacatgaattcatggtcaagctcttacgttattgatgtacattgccttgcatcgtagaataaatatattaccaggaaagatgttttttattacttttcttggatggttttaaaaactaaagagtgaacgtgcttgatatatgagttgagagtcagattttaaacatataagatagttgataggagcatagacttattccttccgttttaagtatatgattagttggcaccctgtgccttgctgcaggatttgttagttttatcgtcaaagaaaatcaatgttttaaatgattaggtgcaactctgtgcatataaaaaataggtgataatgtggcttcataccctatgttattacgatacaatttatgctttacttttcaaagctttattgtgtattgttatttccatgtgtaatgtggatgtagtaccaattagattgtttggacctctctgcttcatctcaagtttgttctgaacatgggtttagtatgctatctaattgttcctaataaacaaagctcgcatctaagccaataatttatgttgtattcaggaaaaaagatatgtttgcgttatctttgaggactttgggaggaaaaaacatggtgttaagtgtagaatggataacactgtcgtaggtgactgtgaggtgaatggataactaatcaatgattgagttagatgaataaggctgtgttcgttctgttgagttgggaactcattccctccgtacggaaaacggagcaacatattttcttatgtttaattaagtatttactttttttgaaaaatggattaatatgattttttgaagcaactttcatatagaaactttttgcaaaaaacgcaccgtttagcagtttgaaaagtgtgcgcatgaaacacgagagatgagttgggaaaaccgggggaagaacacaacctaagtaccttgttgatccaacagttgtatctttgtaccaatgcgatctaatggcttaaaattagtgatgacatggcttcttgcgtgtcttgctttataggagtaagtgctacttagtgggtaccaattatatggtaagatacgatatgtccagtgtgtatgtcatgcgatcaaactcatccaacttatatacaaattagataaaaaacactctgcaaaccaccttgaggatttatataaacggcattgtaaagtttaggggggttgaatgtctagtttcaatgttcagggtattagacggaccttcatccaaagtttagggggggggtagactttttcctctttttttcaaaaaaaaaaaaaccctatgtagagggacttttaatttcccttgaataatttaaatacctaagggcctgcatggacaggagtgattcagattttaatcaaactatttaaccaggaattagtgataccatcacctgagtagctactttatagaatccaatttctcaaaatctaatcccaaagaccaagaagtcaggcatgatctcattgtacatgagacacaggcttcaataggcgaggacatgttgttgttggacagctagaaaattcagacattgctaagcagttaaacctgatagctgacaaagtctttagaaaatgggagcaaaactttcgccaggtaatatggaccttcctgagcttgacatcgcaaataattcctatttctaaaagcaagtatctgtgccaataatgaactctccccgtgtatgttcaactgactaattagactagaagtcgcgtacattctgaagcaatgggaaaggattttggatgatatatcatctgtataaatatcaaacttaccataacagatctcctccattgtcacatatgctacagattgaatcaaataaatcttcctcctcttcttcatcagattcaatattgttatccacgtcagccatctcctctatgtcctcatcatcagcaatgaatggaactttgatttccactttatctgaaccaacctagacgtaattataataagggtaataattaatatcatagatcagtttttcaaaattttctagagaaggcacagtcccaacgtacctcactaaactttttcctagaagtttcttgagtgaagccttgcaaaatctgtaaaaaaaaacatgataagatgtcaccgtaaacagcaatcaagcacattgaagagttgttacaatcaccagagttaaattacactatactggtgttattatccatatcaataatcagatggtgcgtacctctgatttagccaaggtcgagtctttctcagcaaaatgcttaattagtaaacggtgatttcttaagtcatcctctgagggtctaacctcaaatttgctgcaaaatgaaaatgtttcaacaaatctgagtttttgtcatcaggcgaagaatggacagatagtgaatgaaggagtactcgaaaattttacgaagatgactccacaggttcttttcaggctcctcaggcttctttttgaggaagtgaagcatctgcacggtgatcagtattgtccgaatcttctcctcatagctgttcttgggttttgtaaggctaatccagctgccttctgctgaaagaacagaaatctccggctgcttgccttgaaggcctagcttccaagcgatcactttcctgtatactttgatgccaggatcagcagttccccacaagaagacatccttcttgcattcaggaacctcatcggtgtctttgaactgaaatggcaagactgataaacagacaggcacctcccgtgcatcaagaaggtagtaattatccaccgcattcaactgaggctcatcgtcatcatcgtcgaacatcatcctggataccggattcttcgccattgattctcaccggatgagttggacctagcgtggggcatgtgggttcagttgaaccccaatttttttctgggaacaattgaactgtttattagtactagggttaaggcaaattagggggaaaagcagcttccagatcttaggggagaagctagggctaacgcaaattcgagaagtagcatgggtgggtaacggatggatgctcaccagcgacagcgagctaggatgcggcggaagcagcagcgacggcggcgccgctcctcgtcgcgggatggagatcgacgcaggcgggcggtgggcgaaatccgaggaaacggccggccaccgaggggacggggagattgacaggctcttgtcttgcacgggcgcaccgccgcagcccgcaaggagtcgtggcttttcctctttttttccttttttttcttaaggaatcagaggagtcgggagtcgggactcgggagaggagagacgagtaagggctatgagattagtacatgataattgtgaagcgagtatgggctatgggattagtacatgataattatgcacgtgcaatgcacgttgtggtcaatatttaaactaaaccaaacatattgcacctaaagatttttttattgatatatattaagagcaggtacaatagcagtctataagctagcaataaatataatttaaagagataaaggaagagagagaagagcagcggtctacatatctgtagtcagctgtagcacggactacaagatataatatgtgtatgacaggtgggaccatgtattaatagtatagtaagtaattattgtatgaattagctattacaaaggctatagatgatttgaagctagtagtaggctatactattaaacttgctctaaattattttaaggctactatgtttgcgcataacatagtgcttactattgctttagaaaatgaaaagataagaaagatctatagcttcttttctatactttatactctatcattgacccaaccaactaattttattttcaaacctaaaagttcaaataacaaaactaaaagagggcaagatgcatatcatatggaaagatggcaaatgccacaagaccaaacctgtgcaccaaaatttgatcatattggtcatgtgtagttgccaactgatatatatgtgattgtcataaggacaccagtttctcttacataccaatttacacataatctcataagacttgaatcctggatactccaattaattaactttgcataaataattttgtaactccataggatctaacaataaagaaataaaaagccattgttctttgcataaataatccaaatgttcattgttctcataagctccaggtcctgccattctgccccaaaggatttgattacaccaacttgaacttttaaccatgttcaatgctgtctacttcgaacaatagagctgcttctccataatatctgattcgagatgtcaacttgcctctcacatgaaagtatagaaccaaggttataggaataatatataatttctgaaataacgacaaacctgaaaaattttgtagtccacctgttgcttcattccgttggcctttaccaaatttagaagttagacacaactgagctcagaaggttcaaactacactcttttcccttacttgaccacaacaccaacatcaaagattcctggcgtaagatcagattagagaagaggcaattgcttaagaaaattctattatttaacaacaatatcttctacatcactattttttatttttgtggagcatggtataaagaagaaatggaaaccattattcatatttgtctatacatatcatgacactacttagtgtgttcaactgaatattcactaaataaatttgtaatcgtgttgtttatgtgttgtgagctgagtcaagtagagtagcatacatatattcataagaaaattcgctgcatgagattggcactggatcaataaaagaacatgttgaactattgatcgatgcaatagtttgacacacatagaccaccacatggcccctcatgggtgaaaaacataatatagaacaattggattatgcctgacaattacggggtcatgttctttcttgacctggaagaaagatttcagctcttgcagtttaatcttgcatcatgtgcagatgtaaaagaaattaacagctacatctataatttcttttagaatttatcatgttaatttagaacgaaagtgaaacagtacctcatagttaagtaatgtcaccatgtgcaagcttcattttcaaatcttcctctgaagtatatcttcaagcagcataattttgctgagaaatcaacctgagataacagcttggttgagcatatttcgttggacattatcctataatagagaacttttacggtgtttgcattccaaaaagggtaaagatccaacgctcctcaatcacaggtactatgttaaaggtatttaagtattgatataggtatttaggtactaagggtaaaaatataattttgctagtagagtgaaaagggtagaattgtcctccaaattataataggtaccgcataggtacgctctacacggtatcagcgtatcttacacagtatcagcgtatctttacgtggtttcttgaagatttacgttgtattcgagttaagccaccgtagtgttctttgatgttctctttgcgtagatttctctagatttacattgtattgttataatacattagtagcctaattatgtgaattttttctacatttacattttgttccaacgaacacatgaaaactcataccttaattctgttaaaaattatagtttgtttctagcaagatatttatattgtgtttcagaaacatgaccagttaaaatatcacccaaggttagcatcaatttaaattatacatttcatcaatttatgatacttgcttccaattgaacatgctatgtcaagttaaccaacaacatacgaacacaagtagtctgactcatggtgagcatgctcacaaacaccaatatcatatccgctagataaatatgttatacaaacttcatcaacaacagcctttttacaacaaaaggtcataggttcaacaacaggctaactctaatattagttcaacgcatagcattctgtaccattagcctatttacattccaacattcgcacatatacaaccaaaaggatgcttctgggacatggcggttaaaaaggtgcttagcagccattcatagcccttaacagtttcctctgcaattatgccacaaccaaacacaacagtgctccggtgctgattcaatcccacaaaaggaataaatggcagtttatacctgttggtcatgtatgtactgtcaaatacaacaacatcaccaaaagcttcataatctaaacgagattgactatccgcccaaaatagtcgctttagatgtcggtcctcatcggcctcaaatctgaagaaaaaatctggatccctttcctctcgtgcccttaggtgtcttaaaacagtttcagcatctccttctactattgtttcaatcttgtatctatgacagtaattatatagatctgtatctataaacccaacattctcataacctccatattgcttttccattatattcataatatggtgctttcgaactcttgcaatttccatctcgattatttcttctttttgcacatcactaatgacccgatgggaacggagaaaacatgtctgatctggggcagctaacggatgattatggtcatcaacaaagtctttcacataccactgacctatgtccttgtttagctattaccagtttggccttacaaccacaatgagtgatgtttcttgccttccttatcctgttgtccctcttcacatgcttcgattctcgatacccttgcctactacagacaatcactctccgtttgacctcttttgcggcatttcttctttcagcatatgattttcttatgctaaagcctttatcccaagcgtacttgttgtagaagtgaattccttcatcctcactattgaatgtcttgctgacaatttgttggtactccaacaattcctcaaccaatatccatgtatcctccatcagtgcttaaaacctacaagaaacaacatttaatttttagaacaccctttaccatcttgagttaatttataattttaactcaaattgtacatagcaaattgctttgtataaacaaatctacaaaagctaatttagtgtacaactaatttgcatgcggtacatacgaaagaatagtgcactgcattaacaagaactaaactatgtaaataagaaaattcaatatgtgtcaattcaggccctacccaagtaaacttagggatccatgaactcggtaaaaactataacaattgcgtaaataagcataggagatcttacctatgcacttgttacgtacttgtcaatcagattatgtctgatattcaaacacaaaacagtgccaatgcttctccctcaattatgtcaccaagcaagttcacctattcaaaccccaatatgaagaacatattaggatatctctttttgatcccttgtacgaagaaatttgtgaactacataaataactaatcaactacaggttctcctttcggtgaacctgtctccttccggtgaaacatccaaaccctagaacaagaacgaacccaagggaaagaagaatggagatgcgatctgttacggatcgatcggattgatatccgtgatttactcttttctctgatggcttaccgatctggatactgacttaccgatctgaatactgacagatggatgttagtattcaattaacgtataatgcccatgttttacaagttaattactccactgccatcatgttacaatatttttgttccgtaccttgcccctctcttgatcaacggttcacgttgttccacctccaagtacctcgcaaacaccgtaaaagatcttcctataatatgtaacaacttgattgagcataatcatgtatatagaaaatttctaatggaaaaataacagcatactattctgctagcctatatgtaacaatcataactattacgcacctccatgagttcctagactgagtggtggtagatcatcactatccttactattattcccagtcatgaccagactaaaaaatcccaaataggtggtcatccttgctgacttgccgttattaacagaggtaagtttgtgtttcaccaaaagaaaaccatttagcaagtagagtagtgtcataccaatcaaactcacaaaaaatgggtagaaaaatgtcaaaatccagcatgtagagcatggtgcacaatatttattttgttcatgggatagtaggctaaaaccgaaacaccatcaaacttctttggcaagaagcaaagcgagcagcagaataagagctaaacatatggatctaagacatgactccctggttgcatatcagttaggcaatagttaaatattcctggtcattgctaaaaccactacaacaattggttgatactctaggccgagcaagccccttgatttgttgatcaaacatgaatgatgaatcagaatatcaccactagaaaatgttgcaagggaagattgggggagagtaattgacggagcgtggggctcctcaccgggagaccgcgctggcccctctttgccggttcggccggggaccctgggtgagactctaagctcccaatctgtggaaggttcacgagacaggaagcacacaagacgccggcgatgtatacaggttcgggccgctgagaagcgtaataccctactcctgtgttttgggagatctgtgtatgaaggagctacaaagtatgagccagcctctccctcgttctaggttcccaatctagaaaagtccaaaaaaatctcccttctctcagtgggcaaggtcctccttttatatcttaaggggataccacatgcaccatttccctcttttttgtggggacttcccccaccttttcataaatggacggagatttgtatcgttgccgtccgagtcaccttctgatgggacggcccacaactacctccactttcgccgggagcagatgcgacgtggaatcgtggccgcctgctgacgacatgaccggagtcagaccagtcacgtcggtcattcttgtgcaccacatgtcagcttagcaatctacatgttcgcccttcttcacacaacatcttgcttgtaatggttaggatgaagcttggcatatatctgatcaggactaacgtgccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcactgcactgcgttacatgcggcgtgacacgctcagccaaaccgcaataaatgtggttaggtgancncggctgnnctcacctaacccatacacncnnancnaaaacccacnangggtcggggcgcctcggccctcggggccgaggcgggtgcggcccgaccccctcggggggactaagaggagggcaaacacatcaccctcgggcccgacgtcccccgagggtgccaggccacgtgggcgtttgtgtctgcctcaaacctctagtcatgatactcctgatcccatgtcaccgacagtaatggactctgtaattgtccaaaggttggtctacttctcttttattttcagtgaaactgaatagcgcctctagttgctcacttacaggatttggagtgcaaaaacttgagatctatgtcaggaaacatgcatcatgattacagagtataagtggatcatactgttggaatcaaacacccagtgatcattttcatccattatcataaagatcatctaagagtaacttgcagttccttcaatactgtttctcctccttgcaaacatcatacacaatattagatctgttaatgaaataaaggtcaaaaattattttatttgagtaaattttatttaatacaaatattattaaaaacaaaaagatagaagtaaaaaaccaaaaagtgtgtatgaggcacatttgcagagagctgagcaacattaaattctcaaaaaaagaaaagaacttgccttcttttgcagtatgatggcacactgaccagaagatgagtccgatactcctatttctcatctggagaggaaagagtgcatctaacaaggatggtggctagtaaacagtcgagcacgaacatcagtatatggtagcaaatcattggagtctatctgtacatagtcctgaaattcctcccgtagaatcaaagtgtttttgcttgttattctgtgatgaacaattggcacatgtgattattggttttgatatttagagattattggcgaagtggttttggagatgattgattttcaggtgatgaacagggttactgtttttatcgggtccggtcagaccgggctggtgctgccagtcagactggcatgtatcaagcggtcagaccggccagcccgtggtctgaccggccgactctgtgtcggtttcggtttcggtttcggttgtttgtttggatatccgtgattgtttcatgtatatggcttctagatagatactatgcgtatgtaatactgttgtttgctactaatgagtcaagttggagatagcttggtctcggaatatagtttctttgtttgattcatatgcaggtgacttgatgcctcaggagagtattgccggtgatggatcgggagtcggcttggggataagacgatgtccgcgacggtcagatatcatgtgggatacttaggctagagttcaatacacgtggttggtgaagattccacatggcatacgatgaaggtattgtgtgcgtatgggatgcggagtcgaatttggaaagagtccaaatttggtatgattggagtttgtaaagtttgtttcttgtacgggaaggtttcctatgtggattaggacttttagtatgagtttggttcgtggctttaggctgcctacctcatgtataaatagagagtgagcgtgagacttcccggtatcgcttttgagagcattgagttgatagtttagttagggtttcgagtttagtcgagattttcatgaggagtgttgttgttgcactttataaacacaaagagaagtaataaagttgtcatctactttgagagttctttgatttatgttttctcgggtttggcggtctaactggtgagacaccggcggtcagaccggcggcattgtggcggtcagaccggcagaggagtggcggtcagaccggtgacggcttcaggaggcataggcgatttcagggcggtccaaccgggcaatctacaccggtcagaccggcggcacaggcgcagtcagactggcagatcaacctcggtcagaccgatctacatcgaatttgagggtaacttttaattccgtaaaaagttgggttttttttagtataccaaccctctagttggcttagttcttgtgtttcaatcctacacctcccttactcctctatgcaagctgaaacagaaaacacaaaattttctcatgtgggaattccatcaagcagctagtacacatataggacgttacctgaggagaatgaaggcaagagtttgacatatccatcttgtgagatgacaacatcagaggaagcaaatctatagaaaagaaagagcaacatctctgctttcacctgacagtaagttgagaactaaagaagatatcgttgtggccttggaggcagaagctcggcatggatggagggccactacagctcggcagaaaatcaggtatatactttccacataccaaaacaaaataatattcgaacagggagttcccaagagaagctgatccaataaacttgatctatcatacacaacaaaaaactgccttttctgcccaaattgcagcgcaccttgcgaatccatccaataatactaaatttctgtcatgctgtaacaaaaaaaatcaggggctacaccattatatccccaaatcaacggatttacctcctcaattttcctcattgaacaaccccgtaatctgcaactcgccaacccaaccaactcatgattctagtctcaattagaagcgacattagattcgcacagcacggccgcaattgcatgagaatgagaataaacacggaatctagaaggatccaatacctgggtgagatgcctccaccttaaaatagtccccaaatcaccagttcccaagcatctcgaagaaggtttggcggaacgtcggacaaactcggcgccggtagggataaactcggaccagcgtggcgtgcgcgaatttgcagaacgtgggactgcggtggtggctcggcgctatggtggtccgtcggcactggtccggcggtgcgctggtacgccgtcgctggtcgagtgccgcagcggcttcggcagtagagggaaccacagcggcgccatcgggggtagtcccgagaggggctctggcggaagggggatgcggtggtgtgcggtggttcggcggtggaggcgcagcagtagcggcggcgctggtctgtcacgaggataagggagctccggcgttgtgctggtccgtcgtcactggtcgagcgccgcagcggcttcggtagtaggggaatgtcacgccctcaaaatcgcctaatttaataatttattctttaatgcatttttagaaattatttaaaagcctacaagttaaaccctaataaaatcttggtaaaatgcaacataaaactgagttagataaaatatcattaaatactttgcttgtttatctgtttcctggaattttctgggaattattttagcaagggaagtatattttaatcaacaaaatagcatttcacgaattatttaaataagaaaaagttttaaaacctttctctaggcaaagcctcactcgggctgcaagccatgccagcctgctgctccattcccttcttttcctttctttttccttttctctgaaagtctacaatgcctccctcggcactgttcatcttcaacctcaggccagccaattgtgtccgagctgctgccgcctccctttgaatccgcctccatcagttgctcccgagaccgactggatgaggggaatttatctcctcgatgttctctatctttacccttaaaaaccggagcttaattccttgtatttcaaccgaatcaaactcgtttagagtttatctctccaaccaaaccatcggattttccggtttcgattcctttcgttccgagttcgatctccttaatccgagcctataaatagcatcctctagtcgccctcttcggtttgcctcgtgttctagttgcagccgtcgctcgtagcgccgccgccgtagccgcttcagccgcctcgcgccgtcgccgtggtggtcgtcgccggtcgccgtcgctttcaccgggttcgcgaggagaagccgcagaccgtcaatcccttcatcggcgttgcaacccgccggaaagccgtcgtcgccgtcaacccgaagccgccgcttttggaagctcgtcgccggccgttttctgtcgtcgattgtcgtcgccgtcaccaccggtgggttcctctcgtcgtgctcgttgcgatggtgctctctgtttgcgccgttgtgccttcgttcgccggcggttgtgtggtccagaaccatgcccggcagtgatgtcatcctgacatcataaattttttatttaaatcgtaataattttctgaattaggtgaaaaactgattaaacttcggaaattcatagctaaatcatcgtaactcggattcaagtggttcaagttgctaaattcatctaaaatcgagatctacatgttaaaaatatccacatgtactgtttatgcttgtttttgtactgttttgttgattttgttcatttgctttagtttccgatgttcccgaggagagcgtttacattgagtaaggttcagaagtgtttaaagaagctcaaggcaagtcatacagatcccaaacaaccctttgagcatgttgaacccgtttaaagctaatgttttatttcaacttatgcattattttcgaatgtcatcgggtggtgagccttttcccaattaattatggccgaagatgactttatcttactatgggtaataaattgattagctcgaaccttatatattggtttggttcagctagcctaaatgctatatatataattgcttagccatgcttagaaacattagctcattaatgggataaatcacactacattactacttatggttatatttaatggtagctcacgatggttaatcgtgctatgataattaaaatttgattaatggtgggttgtgagcacatggttttgatggtagtctcatgacaattaaggaccggttcgcgagctactgttgtgaaatatttaccgtgccaaccacaagccagcgtgggcaacggctttaccttcagtatagcatggttcattacggggtgccagactgagaagcggcgagaagtctatgggggtcgctggggagttcatgcctctggttgtagagggggtgattatgatccaggattggtgcactgtggtgagttgtattgtgcgagggggtattgtcacagttcctttccgagataccgtggtggtattgaggcgcatggtgacatgtcgtggagctgtgtcttgtgggtaaagtggtacatctctggccagagtaaaactatttaaatagctgtgcccgtggttatgggcgggtctaataatgtttttcgtgattagtctcacactactcattattggtgataaactgtgataattaaattgactcctggtttggaatggtacattcctggtatggaggtttgatttgtacaaccggggttggttgttcagatgagtttgggcctatgcaacacgggtgtgttgtatagtgtttatttaatattgcttaatttatacaattgttttactattctctcaaatgtttattaaatgttgtttatgcaaataagctatattatgccatcctttgttatcctgtgcatttgcatatttgctgtgtggcttgttgagtatgtcatacgctcattcttgcaatattcattcatcagaggagtacttcaatgaaggtgctgttcaggaggattaggctatgttcgggtcaagatgcttgtggagtggagtcgccatagctgtttagtcttttgtttttatttccgctgcgtagaatttcattcttttgagaggaactatccacctctataataatttaacattttgcgattattaattagctgtttgatagtgctctattatcaatttgttattgtgtgcctcggttgattcctggacgaggatttaacacacatgtaagcgtttggaattttggatagaaattccgagtgtgacagggaaccaccgcggtgccatcgggggcagtcccggttggggctccggcggatgggggatgcggtggaggcgtagcagcggcaacgctggtccgtcagtgggcaccggtgtggtgatggctcagctctggtccggtgttgcagtggcgctagtctattgcaagaagcgaaagaggatgcatgcaacggagtcattgtggcagaatcatcacgtggaggcgaaattggtggaatcagtgggaatcgcggaggattgacataggaaggaggatagacccacagtggacggatgagattagatgagagggcggatggaaggatgagatgagatggaatgatttcattggtaggattgcaagggacaagtcctctttatattagtatagattataattaattattaaaaaaagtctatttcaccttatcaatttaagggcccctttgatttgtaggaaaaatgcaggaattttggaggatttcaatcctatgaaaaaaaatcctatgaaggcctttgaaacaaaggattgaatcctatccaatcctttaaaattcctatggaatgggtaatcctatgcacattttagaggaaagttagcaagaggtctaacctcttggaacatttcctctgagtctatctctctcatctgattcctgcgtttttcctgtggtccaatcaaacagccattcctgtgtttttcttgtgttttgtaatcctctgttttacaattgtattcctgtcagaatcatgtgttttttctattcctctgttttttcattcctacaattcaaaaggggccctaagtattgggttgatatacttccccctctgaaatatgaaatcaggtcttttactcctgaagttaaccaactcaaataagctccttaagtgatattttatgtggttttgccatgttaatgataacgtggtagcggtattgtttacatgacatgaagatcagtccactaaaccaaagttgatccaacagttttcttttctctcgctgattggcaagattatgaaatagcagtatatattagcacaaatgtatatcattctcaaaccgtttcacatgtgaaaaaaaattaattgagtctatcaccatgtcattagccacctaatgacatgtggctaaaaccaccgtcacgtcatcatgttcatagttaaacctcctaaaaaaccactcaagagggttattttagacagttttcatactttatgggggtaaaataccagatttcatgtttcaggggttaaggagaccaaccccatactttaggggtgaagaaaaaaattccattagttattagctaaaaagttaaagtatggattaatgtgattctttaaagcaatcttcttataaaaactttttataaaaaatacaccgtttattatttcgagaaacatacgcacggaagagataatagaatttgggaaaggatagattagaactcatcctaaggctgtgttcgggagtagcacgtataacgaagcaacatttagcgcatgattaattaagtattagctaaaataaatttgaaaagtggattaatatgattttttaagtcacttttatatagagaatttttgtaaaaagcatactgtttagcagtttgaaaagtgtgtgcgcatgaaaaaagtgataggtgagttaagaaagtagagataagaactcagcctaagtctaccacgggctgaaatagtaatgattagttgagatacttctaaacatgattatatttttcttaaaatagcattatcaaattgttactatcggattgctaaaattatgacgtcacattttcacttaatttcaatcacttttctttcattttaattgctccctcttctatatataaaaacaataaattgtgttcaatcccaattctcttatatacattgtatattataaaaattacaatattgaaacttacaattattacatcataagttttgaaatttatagcataattataatgtaaggtacataatttacacgtataaacaatctactccctccgtttaaggttataagacgttttgactttggtcaaaatcaaactgtttcaaatttgactaagtttatagataaatatagcgatatttataatactaaattagtttcatcaaataaatatttgaatatatttttgtaataaatttgtttagggttgaaaatgttactattttgtttttacaaacttggtcaaacataaagcagtttgactttgatcaaagtcaaaacgtcttataacctgaaacagagagaagtaactatttttatttaaaaatatggcatcataaatatatctactcccatcaaccgaaattattaattatggttggcaaagagaagataatatctcataaaaaaggacaaaattgcttatcaccattctatcctccactacgttctcatctaccacatttaattttatctttaactacttaataaaaataaaacttgtgttgtttagtccaccgtcacgcatgacgcgtcatagaaaaatcatgatatgttttttttttgtagaaatggatccacatgaaagaacaaaaagcatacaactacttaaaaaaaggcctccggaaaggatccactatttctcttgctgttatccaaaatcagatggaaattttcattcaactttttagatggtgtctttaataaggagatgacacacaaatgacgatgttgtcgagtccagaagaatcggatggttttcaccacctctcccctcttcacactagtattccatgcctttacatgccccaataattgcatcccatgcaaaaacaagcagacatgagtcactttttttttttagataatagacatgagtcacttatggatgatctagattgctgaacctcatttagtcatctgtggtcggtcttctcgatcataataggagctacttctctaaaggcacccgcaatagttatttataggctctctacaagatatccatgtcagcatatttttctacatagaagagattaaatgaagagagagagcaaaactatctactaacctggagatagtctatagagaaaaacgaggcaatgcattagagagctatagatacccatgtagacatactattgaggtggtttactattaatctagtttattgctgagatgtacatgttttatagagagcaccttattttaccattgcgggtgctctaatcgtcgtccctcgatgattgtcgacaatcaaaggtcctagtaaaaccatctagtagtggttgttcgacaaatgaaaaactaagagccacacgcaatgagaatggtgagccatcgatggagggtgcgttcgaacgtaccaattcggctgggttgaattccagctagcccatgaagctgatccaaatattgtgtttatgggctgaaaagaggatggtccaggattgtggatgtataacgacgtcaaggtccattaggtttccatcgcctgccataccccgtgttgaccagcggttcctcgttattcccattccttcgccacacacccttgcgactgctggtagttgaggaggcagaaggtaatggcaacctcccctacagatttgtgtccccgtcctccttttcttgtgcggctacgatagagccaatatgtgggcgacattgaaggctcgagcaggggtcttcactagctgcatcgggtagaagaaaagggatcaaatctcttccccgataaggaggagaaagatggtctgcgtagctgctgcttgaactagcattgtttactactagaaaaatcatttttctcgatgtggcggtcataacccttagagccaaataaccgcctacaaaaatataaatcggggtgaaatttaccgtccgcctgcggaccactttcgcaggcgccgcttaagtggtccgcctgcgaaaatagacttgaatataaatagatttggataggagtagatttttttctaagtttcaaaacctcacctctcctctcacccacggctggcctctcctcacctcacctctccacggccggcctctcccacgtagggatggcaatttccccgacgagggcgggtacccgccggggacccgaccctacggggccggggtcggggctatatttggccccgcgggtgcagcgggggtggggccccgaaaatatgcggggacgggggcgggtctaggttttcacccgcgggtgactcatggggacccggaaatatggtacatgcgtagattgcaaattaaaaatgtggcccaaacaagcccatgttgtgaaataacttttcctatcccatcttatctaccccagccatacatacagtcacggagccatccatccagatcgagtcaatgacctttcaaatcaaaagaataaaaaaagaaagatacagtcaacgagtagcgactgcatcggcgctaccgcagtcgttgcaagctgctgcgcctcgtcagctccctgcgaggctgcgcctctgcccaggccggctgctgcgcctccgtctcggccgcgggtcgccggccgttgcactttcgctgcgtctccgactgctgcaactccgccgcgtgtcgccggctgcttcgcctttgtcttcgtcgcgcgtcgccggcttctgcacctccgccaaatctccgcgatgctagcctcctcgatgagccacttcatcttagctgctacaatcctggttttgtcctcttttctctatagcttgtggggcctcggtcggggtcggggacccgtaggggttgggggcgggggaagcttttcacccgaagatggtaccggggccgggggcggaggataaagtcgggggtcgggggcagggccgttcctgtccaacccggccccgccccgccccgttgccatccctactcccacggcggctacgcgcgcggggcggcacggaaggcggcggggcggctcccctccctccctcccctcccagatcaggccggaggagggaggtgggaggccggcgggggcagcggcggcgactacggcgcgcgcggggcggcggcggcggctcccctcccacctccctcccagatccggccggaggagggaggggggaggccggcagtggcgactacggcggctacgacgcagggcggcggcggcgacgacgatgcggcccggcggcggctcccctcccccctccctcccagatatggccggaggagggaggggggaggccggcggcgacgacgacgacgcagggcggcggcgacgacgatgcggcccggcggcggctcccctcccccctccctcccacatctggccggaggagggaggggggaggccggcggcggcgacgacggcgcggggcggcggtgacgacgatgcggcccggcggcggctcccctccccctccctcccagatctagccggaggagggaggggggaggccggcggcggcgactacggtggctacggcgcggggcggcggcgacgacgacgcccggcgcagctcccctcccgcccggcgcggcgacgccagaggagggcggcggcggcgagccgccgcccgtgatattttttgtttatttgaatggattttcgcaggcgggttgttgccccgacgcgaaaatcgatgattttcacggtcgttgagctactggcggtccaactctccgcctgcaaaaatctattttggccgtctgggaaaatattttttctagtagtcgtttccgagatatttaaccatttgccacatttagatgtggcaattaactttttgtcactggacccacatatcatagacacatgtagacccacatgtcattgagataggggtggcaaatacaccctccgtcctataaaaaaccaacttctagggatgaatctggacaaatgtttgtccaattttatccccagaagttgtcttttttttttactgagggagtagttatttgccaaatctaaaagtggcaaatagttaaaagccctgtggtttccagcgactggtggagcaacctttctcacgtgtggttgttgctctgatgcggtctcgtgcaccatgtgagcggagattatatgagcggagattgtcccacctctagctttcaagggggcaccattagaaattggaggtccagacctcgcctattttagggccctctccggagctcccatggcaaacaaagacgtgaagcagaagcttgtgctggagcagtttgtttgccacagacgccggtccatctagtttgccttcatcttctgcctcgccaaaacgatgcgtgctagtggcagatttagaatcaagtaaggccctgtttagttcccctaaaatttttctcaaaaacatcacatcgaatctttggacacatacatgaaacattagatgtagataaataaaaaaaactaattacacaattagggaggaaatcgcgagacgaatcttttgagtctaattagtccatgattagctataagtgctacagtaactcacatgtgctaatgacgggttaattaggctcaaaagattcgtctcgcggtttctaggcgagttatgaaattagtttttttcgttcgtgtccgaaaaccccttccgacatccggtcaaacgtccgatgtaacacccaaaaatgttcatttcctcaactaaacacactctaaggggtcgtgctagtcgttgcaatttgatggcatctctggcgccactgcagaggatgatgtaaaggtagtaagtagcacatgcactcaccgccaacagtttgccagcttttccaccacctcactccggcaaacggttgctcattcgctcaattgggaggccttcttgacttcaagcaactaatgctgggtttaatttctaaaaaaaagttaaaagtttaaggaaagttggaagtttagaaaaaaagttaaaagtttatatgtgtatgtaagttttagatgtgatgtgatagaaagttgaaagtttagggtagttgagggtgaactaaacatggcctaaggtataacatgcattagttgtatcagtttttctacaccaatttttttttgctcgacttgggttgttagaaaaaaatgcaaaggagggagagtagtaagctacaggtgttggaagcttcatggatgacggcaatttgtttgcttcttctgtgaggaagaatagatcgataggaggagctaggtgggtcccggtagcagcgaggtgaacgcaagggccagtgtggtggggtcgtgggtgagtggagaggtgagtgcaacgagagcttgttgttctcgttcctgctatcatcgcccggcgagcaaagtggccggatttgaaagagaagcactggaaggataactcgagggcaatttgcaaaccaggggtactcaccgtcattttggaagtttcctctcccctaaacagccaaaaacatttaaatagtagcaaatattcactttttaccgatgcattccacaaaagattcactactgcggtgttctacagctagtacgtcacggtgttttatagcaaaatttgccaaaaaattgtcataattttaaaagtttaggggttgattcggtccaaatttaaacttgagagaaagttataaaaggaagattttttccctatgttacttagaaatttaattagaagattcattttaagaacgggttaattttcaggatcaggcttgacaagtctagcatttcccatgccgggtcccaaaaccttaattcatcccagcgcacacattcaggcatttgtttatttggcaaaaaaaaaattttgccctctgcatgtcacgtcggatatacggacacacatttgaaatattaaacgtagtttaataacaaaacaaattacagattttatcagaatactgcgagacgaatttattaagcctaattaattcgtcattagcaaatatttattgtagcaccattatcaaatcatggcgtaattaggcttaaaatattcgtctcgtgatttcttggtgaactgtgtaattaattttttatttacatttaatattctatatatgtattaaatattcgatgtggtagcgcgaaaaattttgttgaagagctaaacaggtccgtcctcagtcttacaacggtcaaccactcaacccaagctccaatgatgcgacctcaacccaaagctctcgacggttgaggaacaacgtggttgtcgctcattttcctcccgtacgttccagctagctcaggtcaaagctgtcaaacctactataaataattctcgttgattagccttggcggccaagtagacgatcacaacgaacgagaccgtggctgccaagcaacctcaacctcccggccggcacgggcgcagactataaatgcgccgctggccgcgcctgcacctacaccaaacctacagcaaactgagcgaggagcagagccatgcgtcgcgaggggaggcagcgcgggtgggtgtgcgtgtacgaccgcgccctggtcgaccccgaggggaagcgccgcgtggtgggcgcggtggcggcgccggcgacggtggccaacggcgggttcatcagggcgccgcggaagccaaccaaccactccaagttcaccggcggccgcgccttcagggagctcgccagcggcaagggcgcctgcagcggcgggccggcagcgtcgacgacgggtggtaaagggaggcacaagttcaagcacgacgagatcaaggcgtactacctcgaactcgaagccggcgctgatgatgctgtcgatgagctaggatcgctatgagtgacatggattcgtggaggcagatggcatgcatcaccggaacggcggcacggcggcatgcagctgccaccgtcgataggagaattgcagcggcggcgctaattgacatggcagtttcctgttttggtgtgtatgtgtgtgagtgtgagtgaaactgtgttgtgaatgtggatctttttagtttggtgtttcgttgaataattgaactttctcgccacaaatgagtttgaattcaggtcctatcacatcggatgtttagacactaattagaagtattaaatatagactaataacaaaacccatttcataatcctaaactaattcacgagacgaatatattgagcctaattaattcatgattagcatatgtgatgctacattaaacatgtgttaattatagattaattagtcttaaaaatttgtctcgcgaattaactctcatttatgcaattagttttattattagtctacgtttaatacttctaattagtattcaaacatccgatatgacatagactaaaatttagtcactggatccaaacaccacctaaatgtttgtatgtgcatttcgtactccaaaatgttgttcattcaaaaaaaaaactccatgtttcttattataagtcatttttttaaaatttgactag

SEQ ID NO: 56921 - DNA, 2414 bp, Oryza sativa
gaccccaaaccaaataggctttagggttgggggtgggttacaagggagcggaggaacttggggttttcctaggtttagtgggaaggttgtgggcagcgaaggaccgatggtgggtggtagacataagcgggtggtgccgaagcgtcgggagcgatggggatggatgggggtgtttggctgccattggaggtggggacaagggaaatgagagggcttaggaagcaggggagccctcacagatggttcaaaaatttggaatgaaaatttgagtctatcacccccccccctttccaaaaaaaaaaaaacctgaaatgattcacccggttttgtgtgttgtagcagggggcaaatgccatcccccccccccccctcctattcgaccgaaacatggcaacggttttcagcttgatgcattttgttccaaggtaaatgctttttgagtctttgtgattggtaaacagaagacgcccgagaggttcaacatggagaccttcagttccttttgttgtctcattgaataaagggtaaattgaaaccatgctattataattttgcaaagtttgaataaattgaactttgctgcctcttgtgcaaatggcatcgcctgtaattgtactccagatgtttttttgatctcaaagtaatgttgaaatttcaatcatgccagttcaaagggaaatttactagtgttttaacatttcgtcttttttttttcttttggaaagcgccaaagtgttttttattcctgctgcattaaaacacgttgtgttcttcaaacagcacgtaatatttcggtactgaatccaaaagtagagccgacaataagcaagaccacggatcaaaaggacattggggaccaattactcgcagcaagaactacgataagacaccatgcaatacgaaggtgaaatcatgattccctctattgtcatgctcgcaagtcacaggaccataaaaagaggcaacaaaagggccttaggtaaagaaaaattataccgatacattactgcaactcctcccgaattttcaacatcatacacactacatcgcatgcagggaacatgtgccgctaccaagagaccgacaaaacctcattcctcccaatgacaagttactcggatatattcattggaggttcaaggctctcgacaagaatgcgcaggtctaaatccttatcctcaaacttcttgatgaaaggatgattctgcaagaatatatatgacagttcagaacaagatggtcgaaagatgttattacagttaagttcgctacaaaaattattaaatagaaggcatgctgaccaagagttctgaagcagacatccgctccgcaggatccttttgtatgctgcaaagcaatgtaacaataaataagattagactatgataagctgatgaaatgaatctttaatgataagttggaagaaactgttatttaccctcaagccatgcttgtatccttatagattagtcatgaaatcagatataggagcacacaagacactgttatttgcatgcataatttgacttaagcaaagaagttcaaaagtacttctgtaaacaacaatctgacagcaacgcaaattgatactagtcatgatgtgggacactgggccagggtgggtatactactgtttagtccgtaactatctcacagcaaaggttttattaatctggaaaacacctagatattttgctgccctttaaataacttgatttgcaatcaccctagaaactaattgataaaatgccaccaattagatgtgcttgatctagaatattgctattttgtacctaattgcatctaccttttttttttacacaatccccaccacaagttctcattttgcccttcttactccatcatctgacctcaagtttccacccctcttcaattcagagatgccagcaatagcctaaactgccttccacacccatagcgccgcatacccccaccatctacttttgtctggatttgctgcagctagggctccagctccccagcaccatggcctcttccatcgactcattggagagctcctctgacctaaccaagtgcatcaagctcacctggcttatctcctgtgatttcatcacattgatgactacttttgtctggatttgattcctttgtggtaagaacgagcaatattacttggtgcaagattctttcttgggttttagtcattcagatccattataacctttaattgcttggtgcaaaattcttgctcatgcttctgttctagatacagaaagcttgccaagttctacaagttggagctccagatcagctttttgtcaataagtaccactaacgtttgagggtgaccatggacactgaaagatttgctgacttctgacctccagctttctcccttatcttcatcaaatcagttattccacttgttcttt

SEQ ID NO: 56922 - DNA, 22777 bp, Oryza sativa
catgtaggtatcacgttaaaatgctaagaactatggtctacaaaagtaaaccaaaggttgcttgctcaaacccactgctacatgttttgcccactgagccattggctgcaaagttacactttaagcctcttggtatgcaaagtgatctgacaaaattgcaggaagttacaactttccagtggataacattgcaggatcgactgcaatataaaaggttgtagaaaatttttaaaaaaaaggattgtggatttcactaattgtgtccatcaacttcttcatgatcacaaatgctaacaataaagctaagcatattcaaaggttaacaaaaggaacactttggtacagaaaatacatcaacttcctggaagagggaattgctacacatatatacaagttacaaatagcgttctcaataattccaaacatttcttttgcagttccagttttttttttttttggactcacacacaaaagactaacaagactttgaaatatagagcaaaacagccaaagtagtatgcaggggaatactcaggaaagcagtaataaaagctaatttcatgtgtaatttcagagagatgattatcataccaggaggagataaatgcacaaaattctggagagaactggtccgctggtgcagagggtggtggctggtcaacaattgcttctaataattcgtagaagcttaaccaaccttccccttctgaaggtatataggggaaccgaccaatggcacactcgagtattactaagcccaaactccatatgtcactcttgtagtcataggagcttccactaatacgctcaggctgaactaggaagaaaggtagaaactatgagaacaaatttatgaattccagatcagatcactgtcttgaacatagactaaggggtacataaataaagcaggtcattatttcaacataccgccatatagttgtaggttccaacaaacgtatcccgctgacccattgaacttgctagcaccgcacttaccccaaaatcggtaatctttacttcacctttacggttaactaacaagttagatggctttatatccctgtgaatcacatgcctttcatgatgaagatacagtagaccctccaaaacctgagttgtcaaaatatcatgcaatgtttttttacgttagaatactttttcaactggatagatgcgacaaaattccaagcttattccgaaaacagggaaagttagaaataaaaggctaagtttatgctaacctgtttgcaaagtactgccaggtatggctccagaattgttttgacttgtttaatgatatctgcaagagatccacggtccatgtattctagaacaagatatattacaccattatggtagaaagattggtggcaaaggactatatgtgcgttctgtgttgcttgatttattttgagctcttgtactatttgtttgcgaactgcctcttgaatgttcatttgtatgccctgtggacagaattgcaatgctagttaattaaatgccacagcagtatgaataccagggacaatgcacagaattcttgattgatctgaacatcataacatgatgttcttcattagcatcaatattaattgaaaatcagagttcaatgtagatattgcatgcaacacgtaagctgacgacagatgcttctgctacaccatttatgtagaatgccccacctaatttcaacagggaacatactaataggtgccaacactaccaaattgattaaaaaatcaatcaaatgctatgatgcagaataatctgattatgataaacatgttcaaaatggaactgagagattgacttccagctttccatgattacaaacataaagatagagaaacagttcaactgaaggactcgcagcctgatgcagccacaagatatacattttccatttaagaattagtgtggaacactagatggattttgtgtaatggaaattaccttcaaggcatataatgtccccacccacttgtgccgaactagttggacgataccaccactccccttaccaatgacttgaatcatctcaaggtcatccattgacaactgaacatcttccaccttcaggtttgttgactgctggaagacataaagatgaaacagaaattgagaaatgtgaacaatgttatatccatggataaactctgaaatgtttacacaatgattccttagcactattgcagcacataatacattgcgagaatgcatgagtggcatggatcccatgcattgcaagtgagtattgcattcaatcagccaaatgaaaatcaacagaagcatgataaggtttgactgaactagtcaacctgtacatgtgcttctacactaacctacatgtcaccataaggagtacgataaagcagtttacatgaacccagtagggagatatgaacaaacaaaaaaagtagccatggcaccaggaactcacaggttcatctgcagtttcctcggatataagctgcaaacctctttgattaagccgcagttcaccatccttgaatgtaccactcgcggtcctaaaggagcaccagcgatcagtgacagctattaaattttaccacgaactcccgaaacataaatcaacgattaggctgatggataaacaaaataacaaacgatctggaaccacgaatagcatttcagccactctaagtgaggattgaagagtcagttcagcaactcagatcatagatatttcaagcaaaagatcagttagacagtataagtagacctacgcttctgtaaatcttatctccatctcagttcataactaaccccaaaatcacagtaagacactatgcaagacaattcgatctgaactccaaaatcgtcaacaaataactaaaaaaaaacacagaagcccttctataccagaggcaaaacctcgaaagttcatgacacccgatcgctccaaaggagaacacacaaaggaaaacgaaatcaagtgacagtaaaaaaaaaaagaaaaaaaagagcacgtttcaggcccagggaaccgagggagggggaccctacaggaacttgtcgacgggcgtctcctgcgcaggcacggagagcttgagctccttgtgcggcttcttccccctcatggcctccccctcctcctcctctccggttagggtttatccgccggtaagagacgggggaccgaagcgcgagcgagaggcctatcccggcacggatctgccccgcggcggctcgagtaatcagccgggagtggcgggacgcggcgggagggagggaggaagcagcccgcggcggcgagggagggaggaaggagaggtgaagtggcgtcggaagaagcgaagaaggaaggaaggaaggagagcgtgtggggaagggagtgggatgggaagagaaagaaagatgctgacgatggggaggggggttgctctgtgggaacgcacgagttggaaaaatcaaaaaacttgcggggcccgcctacgtatgcggctgattctgggacacggtcatctcgtcttcgcaggcaatgaccttgggcacttaccgttattcccttcattctcgattcttgaccttgacattcccattctttcaactacacatatatatggtgtgttttgcgaaaagagaaatttataggtgtcacattaaacgttgatcggatatcggaaggggtttttagatacgaataaaaaaattaatttaataacttgcctggaaaccgcgggatgaatttattaaacctaattaatccgtcattagcacgtgtgtgttgctgtagcacttatggctaatcatggacaaattaggctcaaaagatttgtcttgtgatttctatgcaaactgtgcaattaatttttttatctatatttaatgttccatgcatatgtcctaatattcgatgtgacgtttttaggaaaaaaaattgagaactaaaaaaggccatatatgactcaccaaacaacatatttgtgaagggaagataatttataaataaaatttttatatacgtgttcttagcgatctaaaagcaaaaactgaaaaataaactacgataaaaaaacttcaaaatcaactctaaatttaagattgaaaattcaaattttggcttataagcataatcatgaggctgatacttccgaatacaagaatcattttacggctttgctattttgcactcgcatgaaaattcgtaatccatctccctctggtcgtgaattctgcttcaagatctgtgcacactatcggactagtgtggaaggtttttctacatggacagttcttcagcaggcctttttttcccaagcccatggccttaccctatcggaaagtcctttttttttaattggatccatgccactaaaaatatgccaattcaaaaaaaaatactactattatttactactatttaacatatcggttgtgtgccactgaaatttaaaaaaattggaaccatactactccatcacgaaattccgtctctctccttccctcttcctctcttagcaggttagtgttgctgatacggtggcgcgtggttggtgcgacggcagatgacaggaggtcgatggcgacgacgactcctgagccctcctaccgccacccgcaccagcccaaagacaaacctgccaataaaagcgctatggtggtgcttggtgtggcgtggcagggaggaggtctcgacggcgctgtcgcagttggtgccgacgatcttctctatgtccatgaaggtggagaagaggtcgtcctcggagtcgatgtcgtcgaagccatcgccatccgcgctgccgacgaggcccaagttatccgggaagcggaaggctgcctcagatctggcgtggcgacaagggcagtggcaaccacggccggctgcgtgggcccgtcacgccgctaccaccgccagggatgggtttgtcgcgcatgtacgccaccactgtctcctcgggaagctcatcgttggagcccctgtgcacgatgttgaacagtcgcggcgcctgcagtggcgccttcgccattcccgctgcgcctccttctcctcccccgaccaacgatcgtgcccccgcgacatcgcagtgcacaagacaagcaccatcgttgccgtggcccctgcacccgacgatggtggtggagaatgagaagcgtcgctggagggagagaccggagagaggtagggaaaagagaagagaggggagggaagtgaagaagatgaaactgacagctaggtccctcatgcagttgaggttaacggagattttcgacatatttttgacagattcgtaaccgcgtgccacacacattttgcaaaattggaaaccatgccactgccatgcattttccatccgtcttcttccttctctcttctcatcttcttgctttgcgagcgtcagacatcggtagttttgtgacgattgcggcagtcagcctccgcggctgtgaggaggtcagcgcgagggctctggcaacggcgagggagagaggcaggaggggttggcagagagcgcggtcacccaacgggctgacacgggggatgtggcctccagatctaaagaggagacaaggagctagagagagaagagaaagggacaggggtggagagtggaggggggcaccaccggcgatggaagggagcgtaggtgacaaatggtagcgacggtggtggaggaggaggagcgacgacggtggctgtgaggaagtcggcccgaaggtgggagcgacggcggcaaccagcggcggtggtggagggggaggaggagcgatgggggcggagggagcaaacgactcaaccgggctgcaccgcccgcccttgtgtgcgccatgaccgtttgccaccaccccgtctccggtcgctctggcctcgacttcaacaccgggtgaggaggcaggagaggatggtgatgcgtatcgggttaaggagggaggagcggatgagatggattgctagggaggctgagaggtggtggagagagatgggaaaaacaagagggaaggatggaggaaaaagatgaatctgataggtgagacccacatgcagatgagaaagaagatagaaaatgtgacggcagtggcacggtagtgacagcaaagatgttggccatcgagatcttctgcgattacttcacatcatagttcttcctttcagccttgatcacacacagaaaatcctaaacgcatgtaaacctgtacacaaatatgacacaatgcatgtgaccgaataaaatttgtgcaaacttattaactttggtcaattaacactctaattgcatttggtcaattaacactaattgcttatcagtacgaaaaccatcagaagctgactaaccaaatcacagtgaaccaatatttatcatttggctaattgtttggctaataaccgaattgtgcaaattaaactctcacggctatgtatcaaatttggctcagtgtgattactatattggatgcgtgtaatacatgcaacgagttcctctttattaatgtataatatggtttcggggaactgctggtttcattttgcattttagacttcacacaacttgcagcagcctcttacgagacaaggcagtattttttttcaacaaaactagaccaaaaccacatataaaaaaagcacagagaaattaaaagtatgccgaatctaattcgtacccttatcagaaaatcaagtaggatggctcccataactattgaaatcggtgtaatttaaccctctcagcggttttggagaacggtttcactgacgtgatgtttcaacccgatccaaccgactggctcaacatgtgggacccacgtatcatagtcacattttttttcttccttctctttctctttgtttcttcttttacccaccatggcgacacatggcccaaggaggagctgcagctaggccgccctgatgcgtagcgatgacgctgcctcgaggtgacgctacatcagcctcccctccagccagcgccaccgccgctgctcatcttcgtgttggggagaggggagaggcgacggcaaagcaaaagcagcgctcatcgatgtcgtcgaggttagggccgaggtcgttgagagaggcaatgcgaacatcccaaggtggagaggtcggctcctccctgttgagcgacggaaacagaggggtggtccggtggagcgaagaggagctggtcggcggtggcccaaaccgacggacggggacagggtcagcttggagcagagatccaagaggcgctcctcctgttgtgtcgagatcgataggggtggatcgcggtggaggtcgcggaagccggcgggggcggcacacgtcctttcttctctcaccgcaagcatcttcccccttccattctatccccgtgtcccgttgcccatgtcggcgaggtgctaggagctcgagcttcgactcgctgacaatggcatgcaacagcactatcgtagctccggcggtgggcctcgagggagggcggtggtggcatgctctcctcttcaccagctcggtgacaacggggacatgaggacgagttcgaactcgaggagaccacccaactccacgcgctggtgcctccgtcctcccgcctcttgcgccatgctcttagacgccatgggtgcctcgatgtcaagctccatgacggcagcggccatagccatgctactctaggccggagacgtgcttcggcggtggactcggtggtggtgggctcgtcgcgaccacccctgcatcactgttactgcgtagaacatcgtgcttgaacgccatgccgtcagcgacagccccgctgccgacttgccggccgcctcacactgccgggctagaaagaggagaaaaagagaaaaaaaaaagggagaagaaaatgtgacactgacatgtgggtcccacatacagagtcaaccagttggatcgggttaaagcgccacgtcagcgaaaccgccctccaaaaccatcgaaggagtcaaattataccagtttctcagggtcgttctacccggttttctggttaagggatacgagttagattcagcctactttaagggagttaaagttgatttttttttccactaataaaacatcatacaggcccattgcacattgcctagaaaaagacaaaagcccaatacggagaataaaaaatcagaccccaaaatgggaccgcaaaaggagtgctacgggcccactaactccctttgtttctttgtcacacgcccgttggatgcagatcgaatgctcacacaaattgactgacggattcaatttttttctggcgaccaacagacggtcccttcaattagtagtaaaaatcattaagagatcatgtcttggaaagaattggctactagtggctttcttaatctggcatggtataggattgggtgtaacatagttcggaaagaaaatcagcatgtgacaatgaatgcaggcttcaagctactttgtactcccttttgcttgcttcgagcaccaaaaactatcaggcacttcgaagctacgatgacgctagcggaaaagttctcattggaacggactatcaatccaacaaaagagttcgctcaccattgagtctgagaagtgatttttgtttgccctacgaaaaacattttacctagaaaaacagttatttgaaggctcctatttttgacgctcgatggtgcatctaggaagatgtaaaggggagccatctctagtgctatggttccttaagtaccctaagaaaacgttctaaaattattagagatccctaaaccaatggatccatcaaacatgtattttgcaagaggcatggatgagttagataatgtttagttgtttcctgaaaacacattgccatttgtgagatggttgctagttgctacattgctctgggcccatagctactgttgctttgcttaattcgattacaatcatttttttaaggaaacccgattacaatcactggtggtatcttgttgtccttcatttttaatccataatttttgattgcaaattacccgccgagtagaaaccgtgataaggttctttttctcaggctattcatgatttgcgttcatgacatggttcaacaaaatgatactcatactctcctagactgtctaacaaattacgatttggccctctctactgttccctagcagcagaaaccacgattggtttgtcattcgggttgagctcggacctcctgcgcaatttcgattgacagggctgttgttaaagttcctcagattcaatgacaaacctcgtggggattctttgttgagtccggtgatgcttacaccaatatcttcggctcagcaatcaacctcaatctggtgccattcccgtggaggtaactgaaggggattaacggtttgtcaagcggtgtgcacttctcatgaggcccatggcagcagtcgacacaattttaagacgtcgtggctttgcagtagtcatggctcactgcagctccctgtcggcttgctcctttttctgctgttcggtttcatctggaaggctgcttccatagttcggttcaccctctcttttcagggttgtcacttttgctttcaatttctatctttggttgtgtactggggtttatcccttaactctgttcttgcttaataaagtcatttgtgtttaaaaaaaacaaatttcaagtaaatatgaattacaaaaatgtatctgttatgagttatcgaaagcatataccagtgctcaggcgaatgaatggtgttaatggttagtaatttctgaatacaaataaacttcctaccactgaatacaaatctccttcaaccctacttccctccaaacttgtttagctgcgccctgcctcaccttccctgaactcctgcggctggtcgtcgttgacgacgctggtagtatttaccgtaacgagagtccacaacaattggcttctctcgacgttgacgacactggtagtatctctcgtaactagagtccacaacaattggcttctctgatcttctgtagtttcttccaagagaagtactaagctgttccacaccacccatgtaacgagctttcctctccattgccttgtggagagcactctcatatctttcccctcttcttttttccaaacgtgacatgctccttttcgaaactgggacttcaggccccttcatgatctgattcgatcattgtgaaaatatgcagagttgtaatgctttgagtaacaattttgacagagaaacaaatcaggcagcaattgctaaatacctcaggtttttcagctactgactggttttgtgcttcagtagacctgactaatttcaggtctgctgttaccaccaaggtctccgcttcagcagccatagcttgttgtgcgtccagtgggccatgtggttccaataccaaatccaatgggccctgcatgcatatgtagttactagttacagattatcagaacaacacaaatttcacaaaggaaactctgaagctgatctttacctctgaattcacaacatcagttctctctgcagcaagattaacatgtttcatcatgttctgagtagcgatcatctgaagcggctccacatattctgcagattgtaaaggaatagccaaatccgctggttgaacctctgtagggtatacaaataagctaaacaatgatttttgtacggttgagcatcaatataatacaggaaaacagcatactattccattcttaactacttgactctcagtcatacatccagccttcccctcctactgccactgtataccgtactgaacttggcactaacattactaccatgtaataagtttctctagtgctttaacaccatgggaatcacaagaacattgctgaaaactactacatctgtcccataataattgtatttctaggatttgaatttgtcccaaaataattgtcacaatagagtactaataggtctcattaatcacttctcatttaatctttttctattttaccctccactacccttccactcttacctatacaccatttaataaggggcatcatagtatttcttctcaaaccttaatatatactccctccgtactcgtaaaggaagtcatttaggacagcgacacggtctccaaaacacaactttgatttcttgtttctataaaaatatttattgaaaagtgatatatgtatacttttataaaagtatttttcaagacaaatctattcatataatttttacattttcaaactcaacaacttgagagttattcatgatttatattcccaaggtttgacttaaacattgtcctaaacaacttcctttatgagtacggagggagtactaaacaaactagaattgcaatttatatgggacggaggtagtatataagaacaagggaggaggacattcaagcaagctgcatcttgtctgacacctcaagaaaaggtcactgtggtttaaggtgcattggatcagcatcgagtggatattttttgtttagcaaaatgatgaaaatgaatcaaccttgaccttgacttaggccaaaccaactgaaatgcaacaaaacaataacgtcaatttttcgttagtgtgatgcctactttttgttagccactaaaaaatgaccacataaatcttatgagatgtctaaacagctgtgtgggtagcatttttatgagacatctaaattactttccaaaacaatagatgcctaattgaacccagtatgcctaccatgaaatgcggccattggcaggtctccatctaaagtctaaacatgactttacaaaaaacatgtacatgttcttcataactaatagttcggattaaacagataaaattagccaatttgtagttctgtcagttcagttcaggaagcatgaaaccaaagagttataattcagtttaattctttaagaattaaatccaaaagttgctgttgaagtgattggaatgctcgccctctaccaacacagtgaccaaaactacactagcaatcaattaagatcaactcacttctcatagcaagttatccacagtaagttccaactcgtagtctaaagaagcaatccactcatatatttggaagtacctaagtgatgtgtgaaagacttaccgctatcgaccaacaaagcgggtggccatggcgtttggaaaagataagtctcgccgctgcacctaaactcagccatgaccttcatattcttcaggtcaatggcaaattgaggatagcggtcatcccaggaaaccgaaccaatccactagccactgttcggacttgtcgcaccagggaatgcctgtcaagcacttcactaaccggcatttccttctccaattcccacctcctgccaccaccgtcctcctccatgagcagccacacttgcatgtggacgttgtccatggtgccatcaaggcatacaaggcagcacacgccatcctccatctcccctatggcgtacttggaaggctggaacaagcttacagggagactgagcatggagaattccatcgtgagcgtgtcaagcaatatcacaaaattgtcctcgcatttccagaagataatccccgccgcatgcatcgcctggccccggcgaggccgcctcatgttttccacccacgggtggaagctccactctcgagtaccggagttgtactccgcggcgcgcatcctccggccatggcgctgcacggacaccacgcggaacgacgccgcgccgttgtcgccgcgcccgtgcagcaagcagtcggcaatgtaggcgtccgagaaggggtcgtcctgtgggcggcggatggagacgcgccggcgggacaccgggtcgtagacggcgacggatctacctccgcagaggagcaggcggccgttgcggcagtcccggagttgccagcggggatcctcgccgtccccgacgcggatgagcgagaagtcgcccccgagtaccgcggcgccgaggtcggggtcggagcggacggtcgcggcggggtggaacacggggaggccggagctcccgtgggagacgaacaggccgaggagaggcgacgaggtgtggcgggcgcggaatcggcggaggaagtcggggccggaggcgacggcgagccagcacttggaggctagcgcggcgcgttggagggaggccgccgacgggaggcggagaaggatctcggcgaggaggtcgtcggtaaatggctgcaatgccatccggatccggaggagtgggggcggcggccggcgcgctacgggaagaggccggaggagacgggaggggcgcggagttcaccggagtggcgaatagcaaggcagaggcccgcgacacatactgacgcacgacgcaggtcgccgccgcccgccggtgaacccccaaaggaacggtgggattggaccgttgagcagtgaggtgagcacttttcacttcgcacgagtccttgtcttcggtcgcctttcctttttttttttaacgaaccgcgtgatgcgaggttccatattaataacagaaataaattactccacaaatgtaaaaaaaaacaagaaaaaattattatctagattacctcaataaatacaatgaaagcagccaatgatactagagatattacagttgaggattaaacaaacaaaatttaagggagacgggtgtgctacttaattgcattgcatgcatacatgcgtgttttttttattatgaaacataagaaaaatagttgtcttatattttagtataaacattaaaaaaataatggttatgtcttatattttgggataggggagtagtagaaaaatgattataatagcttggaaggttataataaaaggaaaaaacaatacgtcatgttgcattcctacaacacattgctcactgttgagggacaaatagataaaaacacgtcagtacgtcaaccaaaatgcacttaaatttatccatgctattgtatggagagggagagggcaattgataaggatggagccgctcttccccgtgcaaaaccgccaatatggccatcttgagaagagcggcgcgggcggcggcgtcgggcgctggggcctgggggagagccgcgcgagcgaccggtgttgagggctggcggcgactcgtgtgggattggggatgaggagtagagctagggttttgatgcatatatggcccttcaagcacatatgggccacaagtccacaacagcatgggctagctacctcagctcattaaggctcgcgagcagctcgcgagccagttcgagctggctcgttatctctaacgagttaaaaggccagctcggctcgttagaaaaatgaaacgagccgagctgagcttggcgcgagtcaagcgagctaacaagccacgagcttttcgtccaggccttttgatgggtgagatagctgggcatggtttgggtggcttggacaccaagcgtccgtggtgatcacgagttcacgacaaggaacaacgtcaggaggagatgaggagattggatcttgtatttgcttgattaggaatgacactgtcgagctccttaaatatactatatatatagagagtatatgtttgaaagttttcaattaaataacttgctataatatttttagatagtcccaaaattttccctattacctccgtcttaaaatatagctatttctagcacaataccttatcccaaaataaaactatttcttcacctacctcctcctctcaaccaatcacaaccattctccttcacctacccatgacacattaatcaataatacacttcctccaatcattctcacatacttttttaatatccgtgtcaacctaaaaaatatctacattttaggatagaggaagtaatacattatcaacaactgcaaaattaacaccatacgaatgtgctttcgaatgcgaatacgatgatatcatatgcatgccactagatatatatatatatatatatatatatatatagttagttagttagttagtttaattattataaaaatgatgcaaatgttgctttttttcctaatattataggcgccttagaatagagggaatagacactacttttattattaaaatgaccaaaacgtcgaaggagggattttatattagacaaattttgcgacagcacactgctattgtgtggttttagccgtaggacaccgcccgaatatacttttgggagaagacactccataaacgtggtaatttatcaatggacaccgcgccgattagaataataattcctggttgaagagtagacagaaatcacgtgaaagttctaaaatacccttgagtccacatgtcatatatttctaacatctctcttctctctatcccctcccacgcttccatagccgatgcctcaccgatgacgccatgcctcaccaaggacgggggagtcgagcagctcggtggggctgagccccagtgggatggcgaagtaggacgacggcgacactggtggcggcgagagcggcaggcttggtggctgtgcggacttgaacttgggcaccgaccaccagagccaccgcgccacgaggaggtgttctccaatggcctcaacatcccggacatcatcaacgagcacctcggcgccgagccgaccctcccttacctcagcccggaccttcgtggcgccaagctcctcgtcggcgccaacttcgcctccgctagcgtcggcatcctcaacgacaccggcatccagttcgtgagtgccactgactgatcactgatcgatcgcggtcggtgagatgcgttcatggcgttcatggcggtgttcttgcaggtgaacatcgtgaggatgagcaggcagctgcagttctttgcggagtaccacaggagaggctacgcgcgctggtcggcacggcgagggcacggcggatcgtgaacggcgtgctcgtgctcatcaccctcggcggcaacgacttcatgaccaactactacctcgtccctttctcccttcgctcccagcagttcgccctccccgactacgtccgcttcctcatctccgagtacaagaaaatcctccaggtctgttagactaagcctgtcacatttagctggttagttattcatttgtttgtgcatccgtggcaggtcattggattctgtcacgagttagtttctcttttacatgttgcatgagccagaggcgcgcagagttcgcgtcatggccgagagtgcgtgtgtgtgtgactcgccgagaatgcagcgttgatcagcacttcgtgggatggcgcggaggaagtggtcatagcggctgaataggtgaagctgttagtttgttatgcatgtaatcgttggagaataaatgagataaaaaaaccagaaaagctgcaagacgttgcgcggcaccaaaaacctgtgttcttgtgttcatctctgttcgttttgctttcacgcgcgtctacacttttgtttttcctgtgtttatccaagtgatcgcgtgtgtgagggttttgccacaacaagtggtatcagagcctgagtttaacatgtcttccgacagcgacagtggccgctacactcctccggggcggcgtggcgccggcggcggcggcggcagcggcagtggcagcaagcagggcggtggttcaggcactggcactgatggtgctgaagtccccatcgtccaacaaccagcaccgagggatcctagcgtagccgtgcgctatccggtgctgacgagaaccaactatgccgaatgggcaatgttgatgagggtcagcctcctggcacaaggtgtttggggagcagttgatccgggctatgctgagttcaaggaagatcgggtcgcactagcagccattttgcaagctgtctcaaaggagatgctacgaccgttagcaaagaaggactccgcaaaggccgcttgggatgccatcaaactcatgcgagtgggtgttgatcgtgttcgtgaggcgaaggaacaggcgttccgtcagcaatacgaagcaatgcgcttcaaggtaggagaaactgcggaggagttcagcttgaggctaacatcggtggtcacggacatccgtgacatgggtggcgtgcttgatgatgagcatatgatcaaaaaattcctacgtgttgttccaaaaaggtacaagcaggtggcagtcgcacttgaacaattccttgatctgaagacaatgccaatcgaggagcttgtcgggaggttgtcgaccgccgaaagggatgataacgtggacgacgacgatgatgcgccacgcggaaatcgtctctatctcaccgaggaggagtgcttggcccgcatgaaactgaaggaccacgatgggtcctcgagcgggtcgaagagcggtggcggcggtgagaaaagccgtcatgacaagccgtgcagcggtgggcgtggtgaccgcggccacgacaacaaaagcggcggtggatcatcgtcgaccagaacgtgggataggtccaaggtaaagtgcttcaattgtgataaacttgggcactattccaaggaatgtcgcaagcctcgccgcgagtggcgggaggaggcaaacctggtgcaggttgagaatgaacagccggcgctgcttttcaccgaagtgcaccagacggtgttcctcaacgaggaacgcgtgattccgaaggagatgcctgatgatgtctggtattttgatactggcgctagcaaccacatgattgggaaccgagcgatgtttgcatcgcttgacgagaaggtgactgggactgtccgcttcggcgacaactccgtggtcgagatccagggcatgggcgccgtcacgttccagtgcaaaaatggtgagcaccgtgccctgacggaggtgtactacatccctcgcctgcgtagcaacataatcagcctcgggcagcttgaggaaggaggatgcagaggtgtccttgaaaacgccgcactaacgctgttcgacgcagagcgtcagctgcttgcgtgggtgccacgcaaaaacaggatgtataccctgtccctgaaactggccacgcctgtgtgcctgctgacgaaggcagatgatgaagcatggcggtggcacgagcggtttggacatctcaatttccgctcattgcgtgatatgagtctgaagcatatggttgaaggcatgccactggtgaaccacgtcgagcagttctgtcaggggtgctcccttggcaagcaccacagggctccgttcccgcgcgcgtctgcattccgcgcggagcgagggttcgaattagttcacggcgacttgtgtggaccaatcacgccgacaacaactactggtaaacgctattttcttttgatcgttgatgattattctcggtacatgtgggtcgagatgctcaggagcaaagatgaagcgttcaagtgtttcaagaaaatcaaggcagcagctgagaacgagcttgacgtgaagctcaaagctttccgcactgatcgtggaggagaattcaactccaatgagtttaccagctattgtgtcgagctgggcattcgtcgggacaccacggcgccgtatacaccccagcaaaacggggtggttgagcggcggaataggacggtggtggagatggctcgaagcatgttgaagagcaagggcgtgccggcacatttctgggcggaggctgtcaagacggcggtgcacgtcctgaaccgtgcgcccacgcgcgctctcgacggcatgacgccctatgaggcgttgtatcgtcggaaacccaaggtacattatctgcgtacttttggatgtgctgctcttgtgaaaaaggttgggcctggggtgtcgaagctatccgatcgctccatcccaggcgtgttcatcggctatgaagacaatgccaaggcatatcgggtttatgatccggttgcaaagaagttgtatgtgtcacgtgatgtggtgtttgaggaggagaagaagtggaactgggaaaccaatactggcagacaagatcctgactggtctggcacgttcactgttgtgtatactcccagggacatgggagacagcttgggatccaacggaggcacccaagaggtgtccgacgcaccggggcagcagtcgccggctacaccggagcggccgccgccggccacgccatccatgccgaccacctcgactggtgtggagtttgtcagtccgccgatgggaggttcgtgtgactcggaagggatgccactccgttaccgttcgctggaaaatcttcaacagacgacgctgccggtcgatgacacggtgatgtcggacgtcaacgacttcagcgggttttgcctcgtggctgccgaggagccagacagcgtggaacgtgcgctggccgaacccaattggcggcgtgcaatggaggacgagatgagctccatccgtggaaatgaaacctgggagtttgcaaggcttccagaagggcatcgagccattgggcttaagtgggtttttaaagtaaaacgagaccctgctggtaacatcgtcaagtacaaggcacgactagtggcgaaagggtatgcgcagcgccagggggtggactttgatgaagtgtttgctccggtggcacgcttggagatggtgcggctgctacttgctttggctgcacatgacggttggtcagttcatcacatggacgtcaaatcagcgttcttgaatggtgatcttgaggaagaagtctatgtgcagtagcctcccggatttattgacgacaagcagggcggtgcagtactcaggctgcgcaaggcattgtatgggctgcggcaagcaccgcgagcctagcattccaagttggacgccaccctggtgtcacttggttttgatcgatgtcccatggagcatggtgtgtacaagcgaaagactggtgatgatctactgctagttggagtatatgtggatgatttaatcgttacagggtccaaagatactgatattgaggagttcaaggctcaaatggggaaattgttcagtatgagtgatcttggtctcctgagttattacttggggatcgaggtacaacagtctagaggaataatcaccatgtgtcaaagtagctatgcaaagaagatcctagagatgtctgggatgatcggctgcaatgcttgtgcaacacctatggagaaccgactgaagttgagcaagaaagatggcagtgcagctgtgaatccaaccgagtacagaagcatagtgggaagtctccgttacttggtaaatactaggcctgatcttgcttactcagttggcatagtcagcagatatatggaagctccaacatcacagcatatggctgccgtgaagcatattttaagatatctgagtggaactattggatttggttgctgctatcgcaaacaagaccagtctgataatggcttgatgggctacagtgacagcgatatcgctagtgatctcgatgatcggagaagcatgtcaggtgcagctttcttccttggagcaagcttggttacttggacgtcacagaagcagaaagtcgtggcgctctcatcgtgtgaggctgagtacatcgcagccgcgtcagctgcgtgtcaaggtctgtggctatctcgcttgcttaatgacttgattggaggtgcagcgaagaagttcaagttgttggtggacaacaagtcggccatagcgcttacgaaaaatcctgttcatcatgacagaagcaaacatattgacaccaaattccattttattcgtcagtgtgttgaggaagaaaaggttcagattgatcacattggcacagatggtcagctagctgatttacccaccaagccacttgggcgtgtcaaattcctggagttaaggcggaagctgggtgtcgagaacgtgaaggtgacaaggcttaggggggtgatttgttagactaagcctgtcacatttagctggttagttattcatttgtttgtgcatccgtggcaggtcattggattctgtcacgagttagtttctcttttacatgttgcatgagccagaggcgcgcagagttcgcgtcatggccgagagtgcgtgtgtgcgtgactcgccaagaatgcagcgttgatcagcacttcgtgggatggcgcggaggaagtggtcatagcggctgaataggtgaagctgttagtttgttatgcatgtaatcgttggagaataaatgagataaaaaaaccagaaaagctgcaagacgttgcgcggcaccaaaaacctgtgttcttgtgttcatctctgttcgttttgctttcacgcgcgtctacacttttgtttttcctgtgtttatccaagtgatcgcgtgtgtgagggttttgccacaacaaggtccgtatacacttcgtcttcttcctctcgatcaattcgtctctgatgtgttcgtccgttggcatggcatggcattggaagaggctgtacgacatgggggcgaggcgggtgctggtgatggggacggggccgctggggtgcgcgccgcacgtgatgcgcgcggcggagctgttcaacccgcagctgtcgcgcgcgctgcaggaactcgctggagagcctgttcccgttgaggaacacgttgcagagcgccgtggcggaggcaaggtctcccaggagcgcaccagtgagcgcattgaggtggaggctgagcgtgtgcagcgccgtcaaatcgtcgtggcggcagaggacgacgccgacgccgcgatggcaacggcggacaccgcgagtccgcgagctttccgacagatagagagagatgagagagcggtggtggtgtggcagcgcggcacgcggcacgcgccatggaagtgtggccgtgggcaaccgtaggccatggacgggatagagagggatgggagagagatatgacatgtgggcccaagggcattttagaactttcacgcgatttctctctcctcttcaatcggaaattattattctaatcggtgcggtgtacattggcaaattaccacttttatttagtttctttcccccaaaagtaagttcgggcggtgtcctacggctaaaacaacacaatagcagtgtcatgtaacaaaatttgcctttatattattacttgaaataatactgtagagacctctatagttctaatggccccaggtaatgttatgctttagggctcgtttggaaaaaaaaaagaaaaagtgaaggatttctagaggatctagatctttagggtacaattaaaacaaaatattgatgcttaaatttctttcgaagatcctatggaaggagccattctatgctggagccattctatgctggtattgaaggaaaacaaacataatgtcttccctgctggaagacctaaattagtagattattagatagtctacagaaagaataatctgtagaaatatcttaaaagcctacctgatagaaaatatttatagtgccatcttattatttataatttatagtaccaccttattagttctagtatagtagacgtctagtcacttgaacaatgtggtaagaattagagaaatgtgcatgctcgtacccctcgtcaggccgggctcaggcatggggctccaaatggtcgcgcatacgccgcttttttctatagctctgctttattgtatttaacgaattatccgatgtttgtttgttaaactcactggatggtctgctgcgtggcgtggatatcatacaagcctcttgatcacacgttgcagtatctctataaataccaaaccgccgtctatatgcaacttacatgaaaacaattgccttctcttttgtattgccccattgctcattgtttactccatcacgcccgccaccatgcacgggcatccgggagagcagctatatgcaacagttgcctttaacatcctgcacctagccagagagggcggataagatttggaagtgctccgcacgactgctcattgttcatccactgtggctcattttcctatgttccatcgatgtgtgttgtcatcaatattttgtaccgcacgtcgtatgggcagtgagtgccgcgcctcg

SEQ ID NO: 56923 - DNA, 10468 bp, Oryza sativa
cgagcccggggatttggggaaaatgggagggggggccccggggatgctttttataggtccgggaggtggaaatcgggaccgagaaaggcgggaaccgaccggcgatgtggggcgccgacgtgggaaggttggcggcggttcggcgctgattttgcggggaggagtgggggaaatgggggaggaggaggtggggatcgagtccacgtgctcgcgaggtgaggtggagcgcgggaagcgcggcatcgtggggcgaaaccggcagccatggcggttgcagccggccggatggaggtaaggggagaagctgacgagtgggcccgcggtcccacttgtcggcgagagaagggggaggaggccgatggagggatgcaaagaggacttgcgggagagggagggggaggagctgggccggcccaaaagaagggagaacttgggccgaaaggaggcccgaaaggaaagagggggattttaattgtttttctttttatttaattggttaaatgaactttgtgctattaaaattatttcttagaaaatttacagaaaaatccggagagtatatttaggcacagagaatatttcaaaatatttccggccaatgatttttaaagaaaattttaatttcctttataatttcccttgattaaattactttaaattttaatataattcctagaaaatgcattactaattgatttttaatccccaacgaaaatcggggcgttacactcaacctcctgctgcaggatcagaaggttttaacgaggtacgccggccatcacccatcgggttggctgcataggctgacacgcagcctcggccgctgccgatggagaggatctcggtcacaggacaggatcggtgatgttgtcgagggcttgcagttgcaatagcctggctgacttcaatgtcaacgccagcacgaccttatcgatgagctctacaaacttggcctataagcctgatctgcctgtacgtcttagtccatgatctaaaattgtgattcctgatttatgagggactatgagtctgatctccctgtatcagactatcagtccatcatctattttgttttttcttcctaatttgtcagggttttttaacaggggaagacaacgaggtgatggaaaacaacaccgcctgccagatgcagtatgttagcagcgtgtatttgtttgacgaattgagtttgcagcgcatatgtgaaggatggttattgtaatgtgtgaaggctagggatcatggtcacttctgtacatgccacaacacggtatttgcactcttctcatttaatctactagcccataggccccatacaaaactaaatgttagtacatgccagatacactattcataattttgccactgtttataggtcaattttttccatgattgataaaagttcaccttcacatctttttttaatcaacgctgacattaactaactccttaattatttacttgcatcctgtacattgactgagcagttctcttcaaaaggaagaatgtcatcacaaacaacaatgtgggcatgatctactgtcaatgtatgaatactaattgaatatttgttttttttttcatatacactaattgaaatagtactaggaagagagctataatacagtaaggtggttgttcgtcacaaataaaaatcaaggatggttattcaacaaaattatttccacgctgattcggcacttcagatttctactgcttgcattgtatcaatatttttagatgattatattactaatattattgatgtacctagaaattatacatgttatgttgtaatgtgattcgtttgttaatgacaggaattaggaaatatgggaagtggtgtttgatgttttctcatacagccatatttatattatatctggtctatgcaagaccaaattttgcttaggaaaaaatatttgacaaagaaaaccattttgcaagtccaaaaaagaccaggggacttacatttttgggctagtctcatattagccaaagagtcttttcaaaggttcggttccttcttattacaagatggctcacaagtaagattttgggaggattgttggataggagttcaatcctttgagaaggagtatcctaacctctacaatctagttagaaataaaaataaggtggtggccaaggtaatgagtggaataccgttaaatctgtctttcagaagatcaatagtgggaagaaacttggaagcctggtatgagctagtgtcgaaagttgttaacactgtattgacagatcagaaagatcgcttcttttggaaaaacaataaagaaggcattttcacagtaaaatctatgtacaagttcctcatgtatgaagggctggttcctaggaagaatttcatttggaagctcaaaattccacttaaaatcaaaattttattgtggtacctcaaggaaggggtaattctcactaaggataatctagcaaagagaaggtggaagggtagcctaagttgctgtttttgtaactctaaggaaacaatacaacaccttttctttgattgctcaatggctagatatatttggagtgcgctcctttttacatttgggattaggcaaccgtgtagcatgtctcaaatgtttgggaattggctgaattgtgttgaacctaggctcaagagaatattgtgtgtgggcatagctgtatttctttgggcaatttgattatataggaatgatgtggtctttaatggctccaatcctacatctttcttgcagatcattttcatgggaacacattgggcaaggacttggtctttgcttcttaagggaaccgatgaagaaatagttaagaactattgcaaagtgttggagaagcatgtggtggaattcttctccgtgtatggctggaaccttagaagaagattggaagcctagtcttttcttcgtttgttgttcttaaaacctttgtttgtgctgtcatctcttatgtaatgggagaggtcagttgatgcattttgtacccttttattagggagagtcttatgtactcgtgttcggattttggctgtgtataccccacaaaggtgtagaggccgggtttgataatcctttatctaaaaaatgcaagctcatgtggttaattcattctaagaattcttccttctgcctggctgctctgatcttttcttactacatcgagataccgtcagatcatgacatgtcttctcttcgtccgttgcaaaattgtgtgtgtgtgtttttattaatcactccatcttctgccaaattgtaagtccatacctttcatttcatctggaccctgtgaacgggaccggatttcctgtctagatttgtcttttttaactaatttttaacttttttctattcagtgtactgatggtctagatggtgcatggatacaggaggctgttctacactggtggagaaacatctttcgtcggtcggccgaattccacaatagtttcggttgcaataaaaaccggggctaaagatgattttagtcccggttaaaaagggtaacggacatatttaatttttagtcccggactaaagatgatctttagtctcggttcaaatgctgtcagggcctgccaggcctcccccggattaccaaccgggactaaagatcgtaactttagtcccggttagtgttaccaaccgggactaaagatcacggggatctttagccccggttcataacaccaaccgggactaaagtcccacccctatatatatgtcttcttcctgctccagctgcccgagcaagcttcaaaatttcttcaaaaaagaggggaggtcatgccaaaatttctagtgaatttattttggtgattatatacaaatcggaggtgcctaaaaggttagtaacttcatcctccaatgtttttttttgtcatattacatttggagctatgttttgcacacttttttgtctccaaaatttagttgtaagttgatgagagagaaaatttgtgtgggggaagaaagaatatatagaaatttagtttatttgctaaagaaggttttataaaatagttgagaaggaaaatatagtgaaagttaatcttaaataatagaaaacaaactaaaatgaaaattaaaagaagtacaacacattaatattagtttaaaactttagaaatagtaaataagaattatttggtgtaatattttataatttttgtatgaataatgatatgtcattattgtatgactgttgaaagagtttgtaattattttataattattgtatgactgtcattattgtacgaataattatttatgtatgattttttttcttttcatgtagatggatcggcaatggatgtacgctgaccggcggtccaaagagtttattgacggcgtgcattattttttgagagtggccgaagctaacaggcataagggttttatttgttgtccatgcaataagtgtaagaatcagaaggagtattctgcatccaggactattcatttccatttgtttgagtcggggttcatgccaagctataactgttggacatcccacggagaggaaggggttgaaatggaagaagatgaagtggaagacgataatattccggactttagtcaggacgctggatttgaaggaaatcaaatgggcgaggaggaaagggatgctgatggtaacgacgttgcggatgatcttggtcagatgttgcaggacgccaaggaggactgcgaaagtgaaaagggggcccataaattggacaagatgttagaggactacagaacgtcgttgtacccaggttgcgagcaggggcacaaaaagttggataccactctggagttcttgcaatggaaggcaaaaaatggtgttagtgacaaggcatttggtgatttattgaaactcgtcaagaacattcttccggagggaaacaaattgcctgagacaacgtacgaggctaagaagatagtctgccctctaggactggaagtttagaagatccatgcatgtccgaatgattgtatcctatatcgcggtgaggagtacgagaacctagaagcatgccctgtttgcaaagcactacgatacaagattagacgagacgatccaggagaagttgacgggcagctaacaaagaagagaattcctgataaggtgatgtggtatttccctataataccacggctaaggcatttgttcaggaataaggggaatgctagaacgatgcgatggcacgctgaagagcgtcaacaggacgggatgctgagacaccccgccgatggttcgcagtggcgaaacatcggcaaaaaatttaaagactttgaaaaggacgcatgaaacatacggtttggtttaagtacggatggcatgaatccttttggagagatgagcagcagccatagcactttgtcgcgccccaaaacaaccctaaaatacatcctctaaattatgcctagaataattaaaatccttgtgaaagcctttaaaaattaaaatgtgcaaagttaaaagtcaataaaggcttggaggattttttgtatatttcctaaaagcctaaaatgtgtaaataaattttagtggaattttcagagcacaaataataattgttaagaaataaacaaagttaaaaatgttttataaaaagaaaaaccctaaaaatcccccttccctctcttgggtcggctcggcccatttccctccccctctcccttctctccccgcggcccatccggcctctccccacgcgcgcgccgctgacgggtgggcccgcccgccaccctcgctgacgggtggggcccacccgtcatctccttcctcccgccgctcccgccgcctcgcccgcgcctagcgccgccgccgccgtgaatcccgccgcctcccgtcgtccccgcgtgaaatcaataggggggaattactccccgtgatcccctccccgtttccccccattttcccctctctctctctctcgcattcaaacggctggatttgctcccgcaaatctcgccggcgccattgatggcggtcggacctcccggccggtttccttccttccccggccgccctctcccccttccaaccccatttaaaccctccccgcacctccttcgcccgtttccacccttttgccgcaccttctcctcgccggaatcgagctcgcgccgtcgccctctctctcctccgtcgccgacgaccttcggccggctctctccgctcgccgggaccgtttcccgcccagcgtcgccttctccggcttcgccgcaccgccgccgtcaccgtccacccccttgtcgagctcgccgaccgccagagcgccgccgtccccgtccgcccgagccgcgccgctgccttcctccgctccggtcgcctttttcgtcgtcgccgtcgacctagagtgagccgtggaccgccgcctcgtttccccctttccctcccctctctcggacgccgctccgccgcgcctatggctgccgccggcgaccataggggcgcaggcgcgccgcctcccgccggccacgccgacgtggccgccttcgggcgcgccgagcggctgccgcgtggggcccggccgtcagccgcccgcgccctcgggtgcggctgacgcgtggggcccacggcgccggccggtgcgagcccgggtgcgcccggtccaccgtggaccgtgaggctgccacgtgggccccactcccgtggacccggtccgcgcccccctccccctcggctgacgcaataatccatttttaaattaaaatttaaatgaagaaattcgtaaatattcatttaaagagcatataaacctcaaatggccataacttggccatttgaactcggaattggaccgttcaagtctctaatttttccttaagaagtcaagaacccatttttgtgctttgttcctacttgttatatgaagtttattagagtaaaagcctttttattttccattggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattaatgcattatcgctttatttaaattcccgcgttatcactgttttatttagccatgcctatttacctttgttatgaccttattattattgctattattattattaccttgttcaccctagactaaacaaaacctccaactagtgggtaccctatgcgtggtaccactagtatgaatttaggtagatgcttcgctggttaattaggcaacattaggtggttttacaactctagactttgggagtattcatatcacctggacactatggaatggttggattattgtggaattggattcacacctccccctctattcaaaatcctcaaaatggttttaggctgggctcggggtgcatggttttgatagtagcgcctcggccatataaggaccggtcttcgggcttctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcctggtagtcgagatgtcatggcacagggctggtgtcctgctgctaggggctcagtcctgcctacctgtcccggaggttccggccgtaggtggggttgggtcggtactcttgtctatggctaggatgggttggaaactatgtcacatcttccgtccgtataccgtggtggtatgtggcatgtggttacacgtgaggaagatgtgtcttgtgggtaaagatgtacacctctgatcagagtataacctattcgaatagccgcgccctcggttatgggcaagcctagcaatgtacccaagttagtgttttaattcttaaaacctgcttaacaactaaaatatggaatggttggcctgggttggcttgggacgagctgggacccagggtcgggttgccagttcggtctgaatcatcgtaggccttgggttaaggcaggttcgtgtgggttcatggccttgattaataatcttgtatagctctaggatcgtatttacaaaataagctttgagcaactaagtgtcttttaatgctgtttactgcaaaccctaacccctcatattataacccccttgtactcccttgcatttattctgcacttgtgggtgtgtcttgttgagtatggtggttgtactcagtcttgctcaatttttcccaaacccagaagaggagttcctggatgatgaaggctttggtgtctagctcgtgcctgccgtcaagcgcctatggtcgtcgccctagtcttccgctgtttttcgtttgtcttcttgtgtgctgggccttcgccgcccatgtaataaattaattatttacgcttccgcttgttaaactctgaattgtatcaacttttggtgtaccttgcctcctaggacaaggaataatacacgcacgtaaggaacgcccgttgggttatttccggtcgtgacacacttggcccgttacgatgtgtatctacaacctccctcctggctatgtatgaagaggaagtacataatgataccaattattattcaaggccccaagcaacttggtaacgacatcgatgtgtacctaggaccactggtcgaagatcttaaactgttatggaaaaaggaaggtgtccccgtgtgggacgagaacaaacaggaggagtttaacctacgagcgctgctgttcgtaaccattaacgattggcctgcacttagcaacctttccggtcagtccaacaaggggtacaaggcttgcactcactgtatggatgaaacagaaagtacgtatcgtaagcactgtaggaaggttgtgtacatgggtcatcgtcgattccttgctgcaaaccacccggtacggaagaaaggcaagcactttgaacataaggcggaccaccgtacgaagcctaaatatcgcagcgggaaaacagtgtttgctatggttaaagaccttaaagtagtgttctgaaaggggcctggaagccagcctatagagagcgaaggtggtcacgcagcgatgtggaaaaagaactctatattttgggagttaccctattgggaattcttggacgtctgccacgcaattgacgtgatgcacctcactaagaacctttgcgtaaaccttcttggcttcctaggtgtatatggaaagttgaaagatacattggaagcatgtaatgatctaaagcatatggaacaactcggcgaccttcacccggaaccaaaggagaaaggaagccattacttgagtccagccagctacactcttagcaaggcagagaaggaaagtatgtttgaatgcttggagagcataaaggtactgtctggatactccacgaatatcaaccgaataataagcacgaaggagaagaagttcataaacctaaagtctcatgactgtcacgtgttgatgacacaactgctaccagttgtaataaggggtatccttccagacaatgtccgggcaacaataacaaagctatgtgctttcatgaacgcaattttgcagaaggttatcgacccggatagattagaagcccttcagaatgatgtggtgcaatgtcttgtcagttttgagttgatatttccaccttcatttttcaatataatgaagcatatgctttgtcaccttgtcaaagagaacagtattctcgggcatgtgtacctacacaacatgttttctttcgagaggtacatggcgtgttctgaagaagtatgttcgtaaccgtgctcgtccagaggcaagcatcgccaaggggtatggaacagaggaggtcatcgaattttgcgtaaaatttattgaaaaccttcgcccaatcagggtacctgaatcacgccatgaagggagactacggggaaagggaactctcggaaggaaagcaataatgacggtagacaacaatttattccgtaaagcccatttcacggttctgcaacaatcttcattggtagctccttacatcgaggagcacttggctctagttcacgctagaaacatcggtaagtccgatgcatggattacacggcatcacattgatactttccccgcgtggctacgacaacatctcatgggtaacgagacgatcaaccaacaactggccttcctggcgaggggaccatctgggtcgatcgcgacattccagggatatgagatcaatgggtacacattctacacgagagcccaagacatgaagagcatgaaccaaaacagcgcagttcgtatcgatgccatgggacacgatggaacaaccggcacgtattacggtgccatcgaggacatatgggaacttgactatggtcctctcaaggtccctctgttccggtgccaatgggttaggttgactggtggaggcgtaatgattgatgacagtgggatgacaacggttgaccttaacaaggttggatactcggacg

SEQ ID NO: 56924 - DNA, 28084 bp, Oryza sativa
  unsure (1)..(28084): unsure at all n locations
gctgccgccacgtgaacgaacgaacgatcgtgaacgaacgaaacgtacgtgaacgtgaacgaacgaacgaacgtgaacgagaacgtgaacgaacgtgaacgaacgaaacgtacgtgaacgagaacatgaacgcgaacgaacgtaaacctaacgtgaacgtgaacgaacgtgaacttaacgttgtatgtgaacgtacgtaaacgaacgaacgtgcgtgaacgaaaagtgaacttaacaagaacgcgaacatgaacttaacgtacgttaacgtgaacgcacgtgaacgaacgaacgtaggtggacgaaacgtgaacttaacaagaacgcgaacgtgaacgatcgtgaatgaaacatgaacttggtgagaacgcgaacgtgaaatacaatatatgttactttgcgtttatcctaatacatctttttgtatgttgcagaaaagacgtagtcgtcgtcgtccctcaagccggagtggtagctaaccctcgaaggaattcgcgcaggcaagtgatgtaaatatatgattgttagatttttaatgcaattaagactattagatttaatatacgacacttggacttagcatatatgattatctaagtttgaaatgtacgacacttagacgacttagcatatatgattacctagggtcctaatatacgacacttatacttagcatagtataagattattagatttgtaataagacagcatataagattgtgtagggttctaatatacgacaattagacttagcatatatgactatttgagttttaatataagattattagagttctaatacaagattatttgagttttaatataagattattagatttgtaattagacttagtatataattattgtctagggtcctaatatacgacacttagacttagcatagttgactattacagttttaatacaatattatttgagttttaatataagattattagatttgtaataaaacttagcatataagattgtgtaaggttctaatatacgacagttagacttagcatttatgactatttgagttttaatataagattattagagttctaatacaagattatttgagttttaatataagattattagatttgtaattagacttagtatataattattgtctagggtcctaatatacgacacttagacttagcatagttgactattagagttttaatacaatattatttgagttttaatataagattattagagctttaatataagattattagatttttaataagacttagcatgtaggattgtgtagggttctaatatacgacagttagacttagtatatttgacttagcatatatgattgttagcatataagattgttaaagcaaaaatgacctatagacttagcaaatatttcttgtatgaacagatggctgatcgcgatgaggaacagatactgtacaatacaatcgtggagggaagcagccagtactggaacgaagaagaggggaacgaggatccaaaccagtacttgaacgaggaagggaacgtggagagggaagcggaggggaaccaggaggggaacgtggagagggatgtggaggggaaccaggaggaggaggctagtggaagtcaaccctccgctggacagaagagggcacgcaggcaacgaggtgccacgaagaaactagagggtcggcacatcataacggaagtggacgaagatggccgacctagtgccccagcggaagcagccaagaactacgtacgacacagctattgggttgtgcgggataacgtgcctgtcagtatggtgtactggcgcagaacaagggcacgcggagatcatgagagctttgtcccagattcggagaaagagatgctgtggaccacaatgctcgagacattcacccttcccgcgggtacagaggacaaagtgaaaaggtggactctaaagaaaatggcagaactgtttcagagcttcaagggagatctgtaccagaaatatatcctgaaggggcagacaccgaacttcgacacattcccaaagctaagggatcactaggacgagttcgttgcatataagacaggtcaacaagggtaggcgatgatggaaagaaacaaagaaaatgccgccaagaagaagtaccatcaccacttggggtcaggcggctatagcgtcgctatgccgaagtgggaggagatggaggcaagcttgcttgagaggggtatcgaactggccaccgctaaatggctggatcgatcgaagtgctggtactatgctcacggtggaatgctcaacccagttgatggctccctggtcttcagcgatcagatacgcgaggctacgcatcgactaacggacgcagtggaagcctcttcggggggcacgttccgacccgacagagagaaggacgagctgtcactcgccctgcagactccagagcatccaggacaaacaagagggaaaggagtgattccttggaagattggattcaaggaggacatccacacgtacaggagtcagatgaggagcaagagagataccgaggcgaagattgtagatcttgagtacagggtatcgagctacgagctaagcatgcaagaggaggcggcaaggaaggttggtgaacacatggccgcacatcggtcccatgatccccagccgaccattcctcctgcaatggtgagcccttcaggcaatcgtagcagctgcgcctccacggggcaggtaggatcacagagcatggacgccatgcaaacccaggacgaaatcacctgccccgttgatgacatcactcagcggacaccatgtgagctgcatattcccttcaagaacttatcaataaaggtaagctcgtagtttatagattttagatttgtccattccgcaagttgctgcttatatatgttgattactaataaataacctctcaccacgtgaaggtggcgtcgggcatggccatcccgacggacccttcaggtacttaccactgcaggccgattccagcaggatactccaaggtcgaagttgagttggtggaaggtgcgtacgaggacctcgagttggattaccctggaggagacggtgagtcgcatctacgagacacaagccacgccattatactatggcgcaagcggtatatcatcctccctggctgacaagcagcgtctcgtgcaccatctcctccggctccaccatctcctcctccgactccgccatctcctcctcaggctcctgcaccgtctcctcctcatgctccagcaccgtctccacctcaggctcctacaccaactcctcctcaggctcctacaccaactcctcctcaggctcctacaccaactcctccgcaagctcctcatccggtaccttccaagtcaagggccccccaagctccaccgcatgcccccacaagggcaacgaagaaggcgaaagttgacgccacaaaaaacaaggacccggggtacgattgcatgcaagaggagcttgacgcttatgtggcatcataagtcaggagacaattgaagcctcgaagtccagaaaagaagattcctatagacccgagtgccaggaactttttcaggggtatgtctgcacctaccaaggaggccataaagctatcggactatgagcaaaccagtccctcagcttggagaggaaccaaaccaagagatcgagccgttggtgaccggtgaagattttggaatacaagaatttattaatgacaccgggctaactatggatcaattgctacgaggcgcaccaatcgaaaaggcggaagtgaaatacatgtacgaactcggtaaaccgcttgtcaagcctgagcagctgcagtccctacccagacaaatatacaagttccatcaactgtacatggagatgagcgccaccggtagagagatgatcggagcgaggatcagggacacggacttcttgcaaggagatgacattctcttgatcaatttcaagggtatctacgaactataccagctggacgccctcgacgtctctattatgagttgctagattttgtaagtatcgttcagttagatttcttattacgtttcctttaattaaataggtccttgtatataagtagactatatataatatatacttccttttatcgttgtagaatggagattcaaagggcccgacggcgggggggttttgatactggattcattgaccctcggaaagtaaacgtcgcaatgctcgaccagtatccgcaagccacagaggacaatctcgtccatctcttgaaggcgcagcattacaagacgttcatactattgccgtacaacacagagttagtttttactgtcttcctataccaaatatcattcccgcacgaacatgctaagtgtttcatatgtaatgcatcccacgcacattgcagattccactgggtccttttactcttcgacctagaggcctgcaccgtcaacgtatatgactcaatagataaaaaagtctacgtttgacaatgttttcgaacttatagacaggtactgtcataagttcctatgttaattaagaatcttgttataattaattgctactatgaatcatagctttaaactgcatgtagggcttggtatcggttccgtcatttggtccgcggcaaatggagagaaagacttaggcagaagttcaattttcctgtgagtacacatgctctacatttatattcaatctccaattcaaatacatacaagtgtatattaattagatctcttgccgtttgtcatttatttatagtgcgcaaagcaaaagcagggaactaacttgtgcggctactacgtgtgcgagtattgccactgccttgcagaccaaatcatcaccacaagagagctcgatgtacgtacaaataaattcaaaatttcattgcgtacatatcgatttgtttttaattactaattaatttcatacattcatatagtttattcgtatgagggataacctgatcacacacaaggaatttatcgcggcggttaaagaacaactcatgggattcatcaacgaataaatccttgatcccaagggtgaattctactacgacggaaatacaattcattggtccttagcttctgagataacgactacgactactactacgtcgaaatcgtagctagctaggacatcataatggattgtaattaatacatgtctatttttctatatgcatatacacattttctttaatgtaaatatatattttggtcatatatatatataaaccatgcagcaacaaggccatgcaaacaaaaaggtcagctcgatctttagtcccggttatttcacccgggactaaagatagcgatctttagtcccggattggtagtcccggtttgaaaaccgggactaaagggggttacgaaccgggactacaaacgctttctccatcagtgctatccgccaatgaggtgcctgccctgccaactacttaggagtgtgccagcattctacatggttgtcgcctccatgatcacttagcaggtcagtttcaacactcggcctctctcccttttcccttcccacgttcttatggtgctctttgttctcatgtgtgtgttgcaaaaagatttgctcgatagaatgcttattcgatgtaatatcgttcattgcaatttttagatttttatgttcattactactgcatggcttgatttggaagacaactactgtgaagagcatcagaagtggcaatgacaacaagctatggtgtattatcccagaaatattgccatgtctgcgtgttgtatcttctcacacttatcttactttcatctggtgtaagcaagcactatgtttcttcacttatctgtttattatgtttctttcaatcagtttttaatggcaaagttcttctttgcgagaaattgctttgtaatctgtagtgtgcgttgttctgtaaggaatcatcagtggatcacaatccagttgtatatattacaataatagtattgaggatttgatgtataaattgtttagaccatgaacattaagatgaaaaaattaatttgtgtcccatgatgaatccaaaattttgtatttagttattttgatcacttatatttacattaaccaacatatagtcccataagctttagatggtatttttattaccacgattaatatgggttgtgcataataaaaatatttcatcttgcaatatggcaagtttggtttatattagttaaagaaaatatgtccgatttaattgatattggcttctacgtgcattgcacgtgcatgatcactagtaaattgaataagatataagtttagtttacaatttaattatatcatgcaagggtaattacaagaaaatcataaccagcattcaaagcacattaaataagttcaatttagcttaggatatagcacaagaataaatcaaaaatcatcagtacatggacattcataataaaatttcacgcacattaagaggatgtttggttgagtgccaacctttgctaatgttgtggcaattaagtttgaccaattaagcttagtgtttggtcatgccacaagtgagttatgccacaatttttcagtaagctgggccacttgtcattgagtggttttttttgccataacttaccacaattgtggctaataaattcttttttttaaacaacccgcacaagatagtgtgacgtttctattaataaaaaaggaataaagtacaagcctatagtcctgggagactatagttaggaaaaagaaaatatacaaccacaccacgcgtctacgactgatcctactgcttaaacaaaacatgcacacaacaccccaaagcaataggacttctaaacgacgcctccaagaaggaaaacgacgccaaaagcgccgccgccgtccgtgctagataaccaagacaaggttttgacatgaagaacccactgggaaacaatagaaaacacggcaacgccccaaggggaaaacgacgcctacaggcgtcgccgttgccagcccaaaggctaggcctttgcctgttgttctactctccacgttaaacagtgcttgccattttagcagaaccaccatctaatccccttcgacgtgcagccactgcgccgacgcctcgccgagggccaggcatcaaacaagagtctccaccttcaccgtgcttcacgtccatccacgtggttgggttggagagggagagggtgagagagaagaatggatcccctctcccccgcactcgcccgtctagcgtggccatcttacggcggcaagccgccaccgcaagagggcagacgcctggaaggaagctcgccgcaggcttcaacacccctgtcgacgtttgatgtcgcgattccggtatttgcatagtatggggatcgttggtaccagggtatatgcgagattgtaataaaagagatggggacgaggatttttatacaggttcaggcccctgaattgtcaggtaatgaccctactcctgttggccgaagccggtcgttgctcttattcatcataatcacaccagtacaatatttagggtagcctatctatttgttgtcgacttggcgttctgaagtgttgactcgtagtcgacaacagggtagccttcctcttcgaatccgcatccggcgagatcaaaggcagtgcttttgtctctcctgacagtatctgtagacaccataggggactagccatgcttatctctgaagtcgatatccggcgtcttgtcttggcgtatgttggcttgtatgttgatcttgtgtcttgatctattgttccgtgtcccctctcctcctagggggccttgtatttatacccatagatgtccccttgtccaagtagaacttggaaaaccaatatggatacaatccttgtcgtttccatgtagaacactattcatccttccttatgcggaactcctcctatatctaaaggttgtttctatataagacatgctatgtggtgggtcctgccaagatttagtcaactactattaggtatatggtatccataaccctgacaaccccccgcacagcatgaccgtcgtcgctgcctcgactagaccacccgtgttccaacgggtgcttggtcgcatcatcgtcgcctccgtcctcctcaccgcagccatcgcctcaccgttaccaccgccgacgggcttcaccaccgcccccggccgctccgtcgcgccgtgcagccgtctcctgtcgccagctgtgccacgtcaccctgcgccatcatcggccaagcctccgctatggccgccactgcggcctcccgcgcgcgccggcctccgcagctcccggccgcatcaccaaccacggcctccacgagcgccggcctccaaccgtgcctccccgcgcgccatcctcctcagcctccgccaccgtggcctcgccatcaccactgcgtcctccacatgtgccggcctccttcaccggcggccgccagccgccagccgccaccgccaccttcggctcccatcgtcgtcgcccgagggcttgctccggccagatccgtcatggaggcaccggatccaaccgcggggaggccagatccagccgcggcggcgccggatctgccgtctccaccgtctccacgccgcgtcgtcaacctttcctccacgcgtcggcccgccatccacgcgcggagacggggcgccgtcgggggttggcctcgccgccgccatcccggctggccgcacggttctccggcggcgcgctccgacggcggcgaggggagggagagaaggagagagtggtggcggcgacgctagggtttcccctgtgtcgcccgcgtgtgggcgacgcgggggcgagagaatcctggttgccgctaacaaattcttagccatacaatgtgtgccatgccacactttgacaaatattttggcctaccttcctactttctccgtcccaaaatgtagacattttttaggttgagacggatttaaaaaaagtaggtgagaatgattggatgaagtatattattggttgaaaagagaaggtaggtgaagaagaatggttgtgattgattaaaagaagaaggtaggtgaagaaatagctttattttaagactaggtactatgcttgaaatagtatattttaggatggagacagtagttaattgtgacagctaaaaaaacacagtagcgaggtttagattctcgcccttttctttattcgacggtacgcacgttaattttggtttgcttgacgtggtgttcaacagcacgttgccgtgacttggatagcaaaacagaacgctacggtgccccggctaggggagtaaagaaagggtggaagaaagatactcgagcaatcagcgataccattccaaatgctagatgacaaatctccctttgcaggctcgcgcagcgtcattctcggagtcatcgcttccgtccttctgacccatcgcctgctttgggaaaccaaccttttactactctcacttcacctgctatctgaagtatcgaaccccttttctttcattcctgtcctacgcagctctcccttggacctttgccgccacaaccaactactgagagcaagtttaatggctataaactgaaatataaccttatacgaaggaaagaaaatttaagaaaataaaaaggttggctctcatgtctaatagctaactattcacatactttaaaatcaaaacattaaatgtataggtgagagataaagataataagaaaaatagagataatcttataacttatctactatacatgttaactctaatatacatgttaactctaatattagttataagcttataattgactctattactaaactggctctaatataagttataagttcatagttgactctattattattactctcagagtgaagtaatgtggtcgtttttacagtgtggtacttgttgagatctagacgcagcggcggagacagcgtgggggcttgggggaggggtctttagaccccctaccgtaccattagagccccccataataccccctaaaattataatccatatatttatactttgtattaaaaatatagctaatttatatgagacatgtattagtttttattgaccactttgtttaaccctgctataattttattctagacgtacctacacggaggcaaacaacgttccatttaccaaaaaaaaataagtgaatataaaatcttggaacacaaattgcttttcacaagttaatgcacgtacgctaattggggcagctgtctatcgatgcaacaatcgcattttacagtgccaacatcatttctcttcatcttcagcgagcagctgggattgcaatctgcaattgctagcgtctggtttgaagtttgaacttcttaaaactcagcgaacagctaggaatacaacttgcaaagtttcaagtttgaacatttcgctccgacgatgaaagaatgcagtgcagcctctttgaggtggttgggcaaacgcgagcacccaaacaattcgaggagccagcgtcattaaagtcagtgaggacatgagcgaggcagccaaaccctccccatcttccgcggttggcctttggccggggctgacgccaagccacgctgccgggccaaaacggctgccaccgatcgatggcgacgaacggaagcggccaagaaccgctcgcgcgaaccgcgcctcagccgcgtactactaggagtattataacgggtggcctttttgccatccccacgcgcggcggccggatccggatggatctccccttgctttttgatccaacaacaagcaggagtattgttctgggtggggtggcgaccgcgggaacgccaaggctggcgtattgggcgttgtcaaccgtggtgcgtgatcgtggtatcggtggtgtgaggagagaaagtcaggagaccgccttgtcgtggcgctctcccgtctcgacgtacttcgggagagcacgagcttggggttggacgcggacgacgacttttcagcggggaattaacaagaaggaattcgaactgaaatattcgctatatgaatatgggttaggtgagatgaaagttgggtttctcttaccgaaagttgggtttcccttaccgtcggtggtggggttaccgcgccttgacaataagcacaggtacaacagtaactgtgacaaaccgtaagattccgtataaaatttatcaaaatttttaaaatttatttaattttatagttaccatgattttaccttttatcttacctagtggtaaactcaattaccacgaaacatgcgtagttaccggattttataaagcctgaatggaaggtgcaaaacggaccgatgatattttagaaggtttgttggaccaatgaagtcttcttaggccctgtttaaattctaacttttttcttcaactttcaacttttccgtcacatcgaactttcctacacacaaattttcaattttttcaattttttcactacatcgttctagttttttcaaacttctaattttaacgtggaactatatgatacgttgaattttacaaggcagttgtttttcatccggaatataattaagagaaatccatgcgtaggccatgtagtatcatatactcctacgtcccgtgtggtggtccagatgagtgtgtgctcagatagtcgcactgaccagagtctgccgtccagggcgatggttccattggaccaccggcgagtcccgcttgaccgccacggcgccacccatgaagttcgcctcacagtcacacgcgctcagacaagcatcctaccactactagtcgctatactccagactagtgccaccgccacggcgcccgcggcttgctccgtcctcgtggatgttaaaaaaataccccttgcagccgtccggggctcccgtcgcatgcacccccagccacagctacaggccacagccaggcaggcagcgaagccagcgacacgcctccgccttcgccgcggcccgtaccccccgccccacgctgcttctcccaccacctgcctcctctcctccttcctgctcctgcctcctcaaccccacttcacctcaccctcctcccgcgcgcggtcacggactagccgcacgccacgccgccaccactagctcgcttcatttccaccgcacgcacgcacgcacgtacgcgcgccgcgccggctccctcccgccacaggtacgcgcggggtaccggcggtgtgtgtgcgtgtacgtgcgcgtccggcggctcgcacgcgtcgtccgtccgttgatgaggcccgcgcgccggggctggggagtgggtgccttggcgcgggcgttcctggttctgctgctgctgctgctggccgcggcaacgacgacgacgatcggcttcggctgccgaggcgcggaggccatccgcgtcatcccgccgcacgggccggcgccaggcagtgcgaggagtagccggggccacggccatcgccgaagccatggcaacgctgcccgggtggtggatgctgcaatgccggtggtggggacgaggccggtgcccgcgctgtcgccggcggcggacgaggagagcaagcgccggatcccgagctgcccggatccgctccacaaccggtgaccccctgacgcattgaccaccatgctctggcacatgtgctcgccacgctgctcctgcatggatcgatcaacccttttgtctttcttgcctgcttaatcctctcaacttctcttcttttgttttctcaacttctctgtaattagtaggcagccagctagatagggctttgtattggaagaatctcccaatccattcctcctcctagcggtaagaggggatcgagattcttggcatacaaagccctatcatgcctcaccactttatttatgatcgatgatgatgagaaatcaatgaaaaaagaatgcaaagatctatcagattcagaaaaaggctacttccaacggaagaagaatcagttgtcgtattgaccgtctcagttcatccacgaaccactccagtgcaaagcacaaccttttcacagatgcgacagccttccatgatccctttttcttcagatacaactcccattttttctgtttgttcttctgccttgtaccacctgccggctttgcttcttgatcgatgttgctgtagtaggtgtgttcgatcgctgctgtgcactgcagggctgactgctgctttgctggtgggagttgcggctccctcgacacggcattaaatgcgcacgtcttccgtgtggccggaaagagtcgagagcgccgtgctgcgacgcgacggcgagtgatggatgggacgggtggcgatggacaggcggatggaccgatgggggcgcgtcacgccgtcccgccggggccggcctctccgtttacctgcccaattttcgctggacagccgggggttttcatgtgcacggcccacggtgtgacccggtctgactctccgtcgtcagcgaccaccgaccatatgcgcggcgcagtgccagtgagtgtgttcacgtttgagttgtgtgctgtgtttgatcggtttgcttccgtcacgctgttgaggttgaggaggggtcgcgttgcagcttgcacgctagctagtcaggtgctttggcgggggcaatgatgtctcatggccatgtgggtatccaggcagggttggtggtagcagcggcagattagcagctgtagtagcacagaagagggaggagggggaaggaagatatggggcatgtttggaaaaccagtttacaagaatttgaaaatgttggatttctcggggcttattcgtttcaaaggaattgcaaaagaaaaaacataggaatagggataggttttaaactaccattcgtttcatagaaatgcaccatagaaaaactataggaaagttttccattcatttatttttgaaggaaaagcataggaaaaaataatcctaaagatgaagatgaagataaaagattaagtgtttcacgcaaaacgaggtggtaataacgtgtgattaattgagttttaatttttacaaacttgaaaaatggattaatcttatattttagaacaactttcatatagaaagttttcacacgaaatgtaccgtttagtagtttgaaaagtgtgtcacgagtgtccaaaagtttatccaactttagttagagaaaagaacagggctgtcactaatgtttgcattccgttggttggcttgctcaataacataggaaaaattcctgtgtttttcaatccataggtttgcacatgtattcctgtactattcctacgttttttttattcctacgtttcgaaaatcctgtgaactgaacgagccctcagcttttggcttttagtttattttttggattctaaattataagaagcaactggttggtaactagtttaggccccgtttagttcccctaaaattttcttaaaaacatcacatcgaatctttgagcacatgcatgaagcattaaatatagataaataaaaaaactaattgcacagttataagggaaatcgcgagacgaatcttttgagtctaattagtccatgattagccataagtgctaccgtaacccacatgtgctaatgacggattaattaggctcaaaagattcgtctcgcagtttccaggcaagttatgaaattagttttttcattcgtgtcaaaaaaaaccctcccgacatccggtcaaacatccgatgtgacatctaaaatttttcttttcgcgaactaaacatgcccttataagaatctgaaaaagttggatttctcagcttttggtttttactccgtggtttattaagctagagtgtttggggaacctctgattcctaaggaaactgtagcagtcagaagccctcctaaacaagcccttgatcagtctctacgtcctattttaacgatgagattttactgcaaaggaggacgtgagaatttcacacaaactttctccatgcatactgtacaatgattattaataaagaactcttaaactgtttaattataaatatttgctgacataaaagagagagaaaaaataaaatatcacagctatggttaaaaaatcaatatcgactcttagggtgtgttcgacagtgcagcatgggaactcatccctcctgcatgtaaaacggagcggccttttatcacgtgattaattaagtatttgtttttttaaaaaaatggatcagtatgatttttaatagcaactttcgtatagaagtttttttttgaaaaacgcaccgtttagtagttgaaaaaacgtgcgcgtggaaaacaagagacgtaggttgggaagatggagtgctgaacttagccttagcgtctatacaacataaatatagttgtatgagggtgaaaattaagaaataagaatagtagtgaaaaatattactctttgagttaataagttagattctttgttatcttaactattataaggaaacggtctttaaataatttgctattttctaaaagaccatactaagaatgtactgatcatgccataactagtgcaaacaataaatattgtcttatcttctcattttctattcgcacaaatggtcattattttggacagtgatgaagatatttccatttcatccaacgcaatgctagccttttggttttagtgtggaaactagtatctcccttatacacccatccaccaatcaaacgtactagatttacatttttggagaaaaagtttgaattgccctctgttttattggggtgagtatgaattatctttctagacgcgaaaataagatatatttcactctcaacttataataccagatgaaaaaaaactaattcaattcgaaatggttttgatactatgttagtagtccagtcaacatttttgtaataaaaaaaatgataggacccacctatcagattctctccttctcacctctctcttctccctcccctagcgcgccgattcggtggctgcagtgggcagcgaggtagcgacaagatggcgttaagcaatggaggctattggggccagtgaacggcggaggcggcactacacagcggtggggtagaggagctcgagtggtagaggcggatgggggcggtgagagatagaggtgggagagggggcggttcctccttggcctccgctggcgtgcgcctccttcttttgcctccgccggtgcacggctgccctccgtacaagctcgtgcaggcacaggggcaatcaaggatatattgagacaggggggaggggggaggtgagagagagaggagaaagtgagtagagagaatttgataggtgtgtcccattgattcttttctataaaaatgtgctggctatactatcacgtaggatcaaaaccgtatgcaaagttgctcgtggtttttcatccagtattaataactgatagtgaaagatgtttggttttcgtatttatggggtaattatattgtcccaataatttaggggcgtaatttagacttattttcttgcattctttatatttgaacaaaaaaatgttgcacaatgagctatatgtgttacaaccgctttgacctaagtttgcacggactatacaagttgtgatgttagagcaaacaaattcgcaactagcacacaattaagttcaggcgccacgaacataatttactcaaatttaaatctttaggctgtaaatccaggaagcgtgcaatcactatggtactgacgatgttactttcgccagattttccagtatggttaatcactgtaccggtggacaagtagcgctgatgaatgattctcactatagattcctagtaacagtagtttccactcgctatactattgggctcatgcgcaagcaactactaggggttattcaatgagttgaaaatccagttattctgactgcaaagtaacaactccattcttttttcgtgaacgcttcaaattagatacgctacagtatttttgctacagtgctgagaggaatcatatccttctacttgatatcatacagtactacagtgctagtaggatcgcttcggctcctttaggcccccctttgattcaaaggaaattcataggaattttaaaggatttcattcctaaaggattattttcctataaagacctttgaatcaaaggattgaatcatgtacaatcctataaaatttctatggaatgccttttctcatacaagttttggaggaaatttaacatgaggttctacctcatgttaagaattctttgagtctttatctctcctcaaattcctatttttttcatgtggctcaatcaaacagtcatttaatgactatatttttcctgtgttttgtaatcctatgtttcacacttgtactcctgttagaatcctatatttttcctattcctctattttttcattgctgtgatttaaaggggcccttagaggataccaattcataggaatcattccaacacatgttctttggaacaaaggattgtagcatacaaattccaaaggaatccattcctatatatacattccagggaaaaatatatgtttttctttttctaagggctcctttgaatcgtaggattgagaaaatgtaggaatagaaaaaacgcaggattttgagatgaatgtaagtgtaaaacagaggattgcaaaacacaggaaaaacacatgaatgaccgtttgattagaccgcaggaaaaacacaggaattagaggagagataaatactcaaatgaaaatttccatgaggtagaatagaacctcatgttaggtttcctacaaaactagtatggcattaggcattctttcgattcaaatggctatataggaaaaattcttataggaatgaaatacactaaaatttctatgaatttcctttgaatcaaatgggcctaaatttgcatgaaggtattagattcaattttttgtgcacaaatatatcgccgtcacagcacagagacagaagggccagttcgtaaatgacatcgcatctggacgagcggcaaactcgtgaggtacttcaccgtggcggcttgtgaaagtgagacgcggacgagttctcgttttttttaaacaagtttcgtattgatatagcaggaaaaatacaaaattacaaccctggggattctaaccaggaaaagaaaaaacaccaccacaaccacaagtttgtagctccttgcttaacccaggagaaggtgctagcaccgaactgaccacagctaagtgtgaccaaatgtcactatacctacaaaggggttgtaaacaccctgccaaagaccaactccacacagaagataatcgacgagcttccggttgtcctcacgtagaatggttgagttgaaggacagggtgagagaaaaggagatccactcgtccctcgctccaacctgatgatgaccaccaagcaactccgacgatcaaactgagagaatatggtaatggtgaggaccaaaagacctcctagacaatggctctaagaagttctcgtattggaaaagcgaactcgcaattgcatgacagtgtgatgccgcgtaattaacctgtgtaattaatataatttaaaggcaacatatttaattaactggtgtaattaatgtaattaaatttatctttctttgtttacaatttcgatattcacgacatcgtgtagcatcatccggactagttctagcagaaggaacaccaagttgacacggttcggacgagttcgcttcaggcatggtgcaagtttgtggccacatggtctaatttggataggaagaatgcgatcccgtggcctcataaaattactttgcttcttgtccatgaactcattgcaaattcgcggtgtccgcacatgatctgttgataatgtctagtttgcaccgttcttttgcaaactggttcttttgaaaaacttatttcgaaactaaaccgcgccaaaaatttcatccaaaaataagtcgcgggctcaacgccagggccgctggcactgaggttagtcaaccgccatggcactaagacggttaacctcagcctgcgtccggcttggacgctagttgacatagcggatgaccaggagcaagtggagaggcagaatgagtaaccacggtctagacgggacctgttcaagacagagtggtgagtatcctttgtatttacttatttccactttccgtacttcgtggttataacttcttctacatgcacgggagttggtcggatagtgaacgatgcgagcgtggcgctgggcacggtccctggctcgcaagaagagagcagcgttcttcgcaatgctctacatgtagatttctaaaattcacgcaccctgcacatatttggaactaacgcctacatccttctcttggtcgtagactctacgtcagcgatgcaggaagttggtggcacggctgggatgtagggccgacaatgccatcgaaccagctcgacgggccgaggaacaagagggtcaagagaaggaacaagagggagaggaggagggagatgatgaggaagaggaggaagaggagggggagggaagacgaggagcaagtggagctcgggccctcctagctataggacacaccacagttgtcgcagggggaggggcatctcgaccacagcgcaagagagcatctacttatgtgtggaggtacactcctaccagcctcatgctcctaggtgacttgtatggttgtgacttgtgtacccaaaacttgaacttgtatggttgtgacttgtgaacctatattttgcttatgtctatgaatgggttgtgatggatctgattgtggatggatgtggatgtgtatgcatgtggatgtgatggatgtgtatggattttggatggatgtttactccctccgtcctaaaaaaaggcaaaccctaggtttacgtgtccaactttgactgtccgtcttatatgaaatttttttataattcgtattttcattgttgttagatgataaaacatgattaatattttatgtgtgatttgtctttttattttttttcataattttttcaaataagacggacggtcaaacgttggacacggaaaccagggtttgtctttttttgggacggagggagtatgtttatgtgtgtggttgaattgatggatggatggatgtatatatgtacttgaatgaaggatgtatatatatggattgatgattactctgaattgatgaattgcggatgaaaactgggcagagagctggttgtgagctctctacctggggccatacctcagtgccagggaaaatggagctgagatgtatgacctcagtgccaatgctactggcattgagacctggccaggtccaacacaggagcagtgttggacgatgttgagcaactgacggctaagtctcaaacatcagcgccaaacataatggcattgagatcatggggttcaacgacatttcaattggtgccgagattagccaggttagcgccggcgggccacccaacataggagtggtgttggacagcccgggcgccagcggctaagtcctaaagctcagtgccattacggctggcgctgagctttggggttcaacgccaaacaaaatggcgttgagtacctgccatgtcagtgaggggagcgtcctcgactccacgtggataggggctcagtcccaatgtagctggcgcaggtatgttcaacctccacaccagctaccatggcgctgagccgacgacctatttttggttgaagtttttttgtacggtctagttttgaaatttataaatttttgaaaagggccaatttatcaaataaacggtagtttgcatgccgttcttgtgacgtctgcatattattgtgaaaaaaaaaatcaatattgatattttttgagaaaaagaaatgaacaatataattttaattttttttcatactgtcggtgttatgggcccggggtacctgggctaagggaaaggaagcctttccctgtgctacgtgcccgggtggcccagaccccccctcgggggattggacacttggccgataagtggccaaaaagcggccgtgtgtccccggggggttcggggtgcctcgtcatacccctcgggcccgaggggctgagtcatccccgaggccctagctcggccgccacgtggcagccacgtgggggctagaacgggcgggggcgctgtccgccagaggcatttatgggcagcgccccaaccgcccccatcgcatttaatgcgacgtggcaggtcgcgcgccgtccgccgatagacgtgcgccaggtgacctgctcttgaccggtctgcgacccggtgatggatggatgggacaggcggcagcgcacccacgcctcattttgtgtcagacggcgtgggggctggtatgccccgtcccatcatctgcagagaatagacatgcgggtcaatactccccacgcacgtgagcccacgaagtcaccaagaagttattagggaatgacaagggatgttcgccgtgtcaggtggaggacttcggtggggaccacccaagggcggccacacgaatcgcttccggcccaagccgtggaccacttttcaatctaggcatgtgtgggcccctctcccagaggagggcgtaggggcggtgcatgtggtatccccttcaactatgaaaggaggaccttgccctacgagcaaggggacgactcttgatatatcagatttgaggcataggctagcaaaaccctagtttgttcacctgggatcctagttctctgtaactgttcaaagatcaacgcacacacaggagtagggtgttacgctctatagtggcccgaacctggataacccctttaccttgatttcttcaccatccacctcgcaaaccaaatcactgcggatccgactcgcttgggtgagatttcgttcctaagcatcgcttccagtcccttggccgaactcatgaaggggggcctcacagcctcctgctagagaggatcactcctcaacacatacattccacaaggaaaggatcacatcagctcaaacctattgttatttgttctttgagaagtccaatgcaacttctctctttgtttgtcttctcactagaacggataccctcatctcaatcgagcggtaagccccatctcaatcgggcacggcgctcgtcacaggctagaagtcactgatgtgaaaagtaatctcaatcgggcaaatggtcgtcactgatgaacctatctcaatcgggctctaattgaagcccgtcatcgatagctttgacctagtctaccagttaaactatagcccgtcatagatgacctatctcaatcgggccacaaataaagcccgtcacagatgactactaacctcagtcgggcctaaactatagcatgtcacagatcacactcatcttaatcgggcctaaactacagcctgtcacagatgactgctggcctcaatcgggcctaaactagagcccgtcacagatgaccatcatctcaatcgggtatttagttatggcccatcacagataactataatccacaaaaaaaaataatttttgttttttggctagcctcaagcctttgctagccatgcccgctgcaaaaatgacagaaacaaacacagatatcaaatatccccagatccccagcatcacccattcatatacatatgcattcacatacatagacatcaatatatttcacacaaccacacattcacagtcatctcatatttcacatccattcacatatttcataatcattcaaatatttatcatatttcacctgcaaaactgagttaattggatcaaatatttatttagcaagtcttaacataaacatatgaaatatatacatagatataagcatcacagttacatcatcacagttacataataagtgttcatcattgcctaaacataaaagttcaacattgttcatcattttattttaagcctaaacattcctttgggttaattatttcgcggaagatgaagctggctatctcctcgcgaatctcctcaaagctagtaggcagagacatggtaattgtgccctacattgtcataattcgagattagttcatcgatcatatataagtactaaaatgtagttactctatcacaattgagaccaccgacctcaaaatcagccaaagtcttcaccttttctgtgtacagaaggcgcatgttgtggcacacatggaatcggcactggtcacctatttgttgcttcaccaggaagtcttttttgtggatgagggtgtcatgtcctgtcttcctgaggcctcctctttgcacatattgggcccgcgcttcatctatcgctagttgaattggggtccaatcatatgcgttcttatcaattctggagttcaggtagtgacatgtactccacttaggtgttatgaccagaaggatccaatgggcactgtggcattaatatagtgaaagttaattaagtactgaaggaatgtgtcatgctattgtgtatatttagataacacacttactattgattataggcgcacataatgtactccttgtctcggcggggccacaaggtgtcgtagatgtagttgacaattccttgacggttattctggagatttgtgacagtgaccacttgtggatcaaggaaggcaacttccggtgaattcttctgacaccattgccaacttaacctacacacaagataaacgatcttgtaagcgagttaaaccgattgttattaccagattgagttgggcgacaatacttacaaggagtagcacttaaggaggcttgtgtccaccgcttggagcctgtagaggtcgaatagatccttgaagtcgaccacgatataatttgttggaccaaggaatggctttccatcgtgctctccaaggatgtcgatagctttattcggcctcctggcgttagatttctccatgtagtatacgtgaaggtccttgcaagtggtgcccattgcggcaagcacgtcatctccaaccaatggtatgcctagttggaactcctgtggagcgacgtatttcttcttgacctctttgcccttagtctcttcctggcccttgcccagatctagcttccttggagctagaagcgaggcctgcacctttcctccccttcctctcccctttgcttcgggtttatcgatagtaattctctgaggggaagagtgtgccttcctgctcttcttcatcggtgggggttcatgaatcgccttgctgccggcctccgttcggtcctccccaaaatccatgtcatactgcaactgcacatcgtaagattatgcatgacgatcttgagcaggaggggttgaaggagcagatgcgggtctctttggtggacgaccgcctggtgcagtggttggcctcgctgtaacccttatctcaatgaggtccttgggccattggatgaaggtaccacgggcatttccaagtgagaggacctcgtcgttcggtggatacttcagtgggaacagctcgtattcaggcttcaccgagtcgacttgaacttttgcatagtcgcccctaagttgcgctccatgcactcttgtctctggggttggcttgtacgcaagtccctcggctgctggaaccgtgaaggtcggcatcaccctaactgtgagggtgcagctcgttggttcctgcgatagattcatcaatttttttagaatattatatatcatatggattcgttaagtttttcatgcattgtggacaaaacttttaccgttatgtggtcgacggcgctgtcgaccgatgttggattttccgccaactcagttgatgcacaactgctacgtttttgggtgggacttcctaactcttcgtgtacagcagcagcggcgccctaggggttctgttgctcttctcggatctcttgcctatcttggtcctcatcgactcgagcttttcgtcgaattcagatgtcagctccgctcttatcgatgcctggatcttggtttcaaggcgtgcatctttctccgccttgttggaagtccgcttcttgtactgccacgtatagtctggaaatccatacttccagggaacggaagacccaacgccccgtgttcgtccacggtgttccttgttgcccaacgttttcgtgaggaggtcgtcctcgcgtctttgagagcaggcctcttgcgaggcttgttgctcggcaaccaactccttctgcattacaatttagtgtggttaaataaattgcacgatgggaaacaatgcgaacatctattttgactagacacttactatagcatcgtacactcgttgatcttctggatttggcatgaagattgtgccatgagcattcttctggtacctggccctggccaagttccttgctcgagggtgtgggatatcgccaaacatgagcggcgtgttcgattcctccgcttgttcatcctcctgctgccattcctcttccttaccgacatatccggcggtgccaagccggtgcggatgctggttcttggtctggagcaagcgatatgcctcccttctagctctggactcgggggtcgacttcttcgcatggaattcctcccagacctattccgtgatccaaggaaatttctcttttggatctggattcgccgggttgtagacgaactcaccgactagcttagtcttgaagttcttccaagcattgcccataactttaaaaacagtctacctgatacggtcctcatgctccgtaggataatcgaagctctccttgaacgttagccaagcaatgtccttctctgcggccggcacatgcttgatgtcatcttgcagaatactaaatttctgcctccctatgaccctgcagatagacctaaatcggctcaatattttccttggagatgtcggcaaccctacttggtccaccgctgttatgcggaaccgttccttagggattttgttccttgtcctaggagtacgtgcccttgaggactcactagttgtcatcgacattggttcgccttgctgagacatcgtctactttttttcaaaataacgaaaatacacaattcagtgcttcaatggcttagaatccaaagttctaaaatcacttattcacgtaaataaactaaattgcacatctcacaaatctaataaactgaattgaatatcacatataaataaattaaacatttcatctattcatccacattcatctatgcataaacattcatctattcaaacacattcatctaatcatctattcatcacattcatcaatcgaaccacattcatctattcatcattcatgcgcgatggaggactcacctgggggtcggcgtcgggctcggtggaggcggcaggctcggtggtggtggcgtcgggctcagtagagggcgtcgccggggtcggtggtggctgcgccgagctcggtggaggcggcaggctcggtggcggcgtcgccggggtagatggtggctgcgctgggctcggtggaggcggcgtcgggcgtcggaggctcggtggaggcggcaggctcggtggcggcggcctcgagctcggcgagggaggagtcggcgaaggaggagttggcggcggcggatagtctcgatggcggcggcgccgggctcggtggagggcgtcgctggggttggtggaggcggcggcgtgctcggtggaggcggcgtcgggcgtcggagaggaggaggcgacgacgatgacgaaggatgtcgccaggcttggtgggggtcgtcggtgaggaggcggcggcggtccgaatggagggcggaggaggctcggtggcggcgggctcggtggcgacggcggcgggctcgacgatggaggacgacagcagcgctagggttctaaggaggcaggaaactgtagcgggacttagaaaaaaattcgatccgatatgagaaaccctagttatagtagagtgatgagtcatctcaattgggcattgccagagggcccatcagagatgactcatcggtgacgggctccatactaatgcccgattgagatgacactcaggcccatcacggatgactcatctgtgacgggccctaagataatgcccgatagagatagattaatctctatcggacttaaagtaaggcccgtcaccgatgactatttttctatttttcccatcaagtctatatttgtgagtgcaaaatatatagctgctatataataattcaatttgttagtcataatacattttcggatagtaaatgatttcaaatcgaaatatggtcaacaacaaaattgtagagcttatcaaggacaacttttattttggtcatttgactatataattttgttcccaacagcttgaaattgattttgaaaatatgacaaattaaaacagcatttgtaaatattaaatgatttcaaatgaaaaagtcaacaacaacaaagttgatcctctcatcatgatctacaacttttatttgggtcatttgtctctataactttgttcccaacagcctgaaattgaatttgaatatatgacaaatttatacaacatttgtaaatattaaatgatttcaaatggaaaagccataaacagcaaagttgtaaaacatatctaagatctacaacttttatgttggtcacttcttcatccgacaaagtgatagtaccaatgtttacaaaattgacatatctgtattgatgtttataaaccagatgagagaaatgtgatttttgtgaataatataactgtcattttgtcggatgaagaagtgaccaaaataaaagttgtagatcttaataagttgtacaactttgctgtttatggattttccaattgaaatcatttaatatttacaaatgttgtttagatttgtcatatattaaaattcaatttcaaactatttggaaaaaagttatatagaagaatgactaaaataaaagttgtagatcttgatgagaggatcaactttgttgttgaccatatttccatttgaaatcatttagtatttacaaatgttgtttaaatttgtcatatattcaaattcaatttcaaactgtcaggaaaaaagttatatagaaaaatgtccaaaataaaagttgtagatcttgaaaggctctacaagtttgttgttgaccatatttacatttgaaatcattttacgtgatgccgaaagatatgattaccgaccntaataaaatgaattattacacagcagctatatattttgcactcacaaatacaaatactggaaatggaaaaatggaaaaatagtcatcggtgacgggccttagtttaagcccgatagagattaatctatctctatcgggtattgccgtagggcccgtcacagatgactcatcggtgac

SEQ ID NO: 56925 - DNA, 4534 bp, Oryza sativa
gattgagatgacattcaggcccatcacggatgattcatctgtgacgggccgtaagataatgcccgatagagatagattaatatctatcggacttaaagtaaggtccgtcaccgatgactatttttttatttttcccatcaagtgtatatttgagagtgcaaaatatatagctggtatataataattcaatttgatagtcataatacattctcggatagtaaatgatttcatatagatatatggtccacaacacaattgtagagtttatcaagcaccacctttaatttggtcaattgattaaaaaaatttgttcccaacagtttgaaattgaatttgaaaatatgacaaatttaaacagcatttgtaaatactaaatgatttcaaatggaaaagccataaatagcaaagttgtagagcctttcaagatctacaacttttattttggtcacttttatgtataactatattcccaatagtttgaaattcaatttgaatgtttgacatatttaaacaacatttgtaataaaacaaaattagccatataaatgactacacatattaagtctttgtaataaaacaaaatacttcattcattacaatagatacgtacaaatgcatcggtcacaaggttatgccttccgtatgatctgaatgagcatatgccacacgctcttcgggatcatcgtcaaggtcaatatgaggtcttacatgaagattctggttgtattctttttcatcgacgaggttgtcaactcatacaattcggcgcttgccatacctcacgatgtgtatcttcttgtttgaagggtcttttatgtagaatatctgctcgaactgtttcgcatgtacaaatggttcatcggcgtatcccacccttgatagatctactaaagtgaaaccttccttgtcggctttgacaccagtgcgtagattcacccaatgacagcggaacaaaggaaccttgaacttgatgtagtttagctcccagatctcctcaatgcggctgtagtatgtgtttgacccaacttgatcctggaatgcatctatacggacgccgttgttttgcactgtgcttttgtcatcttgtttgacggtgtaaaatgtgtatccatttatatcgtatccttgccatgtgtctacagtccaagacggtcccatccccaacaactgtactgtttcatttgggacatccgtggacattgtcacacgattcttgaaccattcgttgaaccgagaattatgttctctgttaatccatgtatcagatcgccccaagttctcatcttagattttcactaagtgctcctcaaagtatgggccaacttctaccatatgttggagcacagtgtaatgagcctgcgcgtaggacgcttgatcgggcctaattcttttccttccgattgtgccaacacctgacaaccttccttcgtgacgagatgctggaactccgataggatcggcatcggacatgaaattgacgcagaactcaatagccttctcggtcgtgtaaccttcaatgatgctcccctcgggtttagctctgctacgaacgtaggacttcagaactcccatgtacctttcaagtggccacatttcccttagaaaagctgggccacatagttttgtttgcttcaccagatgaacagggagatgaaccatgatatcaaagaaagacagtgggaaaaacatctccaggtgacagagggtattcacaatatcggtctgcaacccatcaagatcttctggatctataaccttctgtccgattgcattgaagatggcgcacatgcgttggatcgtgtgacgcactttcggtggtagaatgcctctgatagcaactggcaagatttgtgtgattagcacgtggcaatcgtgagacttcattccaaccagttttagctcgtccaatttaacatacttggttatcctcgctgaatagcccgatggaactttaatatctttcaagcatgataacattgcgattttctcatccttcgacaatgtgtggcaggctagagggaggtacactctttttgtctctacatctcgtatgggctggagttcactgcgaatattcatgtcctgtagatcaaggcgcgcgtttaacccgtccattgtcttcccgtgaatattcaacatcaggccaaccaaactctcacacacattcttttctacatgcatgagatcaatgcaatgacggacatcaaaatctttccagtaaggtagccgccaaaatatggattttttcttccacatacccttctcctttgtcttgctacgttttcttttcttcccaaactcattacttatgtccttgaccatattgtggacctcatctccggacaaatcctttggagcaggttgaagttatctcttaccgttaagaaaattcttctttcttctaaatgcgcgacgtagcgggagccacctccgatgacccatgtataccatctttcgtgatttcttcagccaccggcttcgtgtatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacaccttttttccaaagaatctcaagatcatcgataacaggttccaggaatacatcgatatcattgccgggttgcctcggaccttggattaacaagcacaacataatatatttccgtttaaagcataaccatggcgggaggttatagttcgcagtaagaaccggccaagtgttgtgagtactactcatgtcactgaaaggattcatgccatccgtacacagacatatccttatgtttctagggtcggcagcaaattctttgtatttttgatcgatattcctccattcaatcgaatccgctgggtgtttaagcataccgtcattccttctctccgtggcgtgccaacgtactaacttcgcttcgtttgggttggcgaagattctcttgaaacgatcaattataggtagataccacacaatctttgccggaccacccctctttgacttctttccttcgtcaacacttttctttcgcttgtatcgagaagccttgcagacaggacaagcatccaagtccgcatattgcttgtggtacaatatgcagttgtttggacaagcgtgaattctacagacctctatataaccccagtggacacagaacctgctttgcttcgtatgtcgtctcgggcaatgtgttctcagtaggaagcatagccttccaaattcctaaaagatctatgaaactcttgtctgtccatctactacttgccttcaacttcattaggtccaaggtaactgacaacttagtgtgctttgctttgcatccagcgtacagaggcgtctcagaatcactgaccaacctgctgaacttcatggaatctctctcattctgggctgggtcctcaacgtcacgtaacatgtcttgcagcagatcgtgatccacatcaaccatttcaccgcccaatggagaaggtataaacatgtcatgctcatcttcatcttcctgattatgtgcaccacttctgtctgctgctgctccacttcctgattcttactctccatgcttcacccaacatgtatagcccttcatgaatcctcgttttatcagatgatcgtgaacatcctctgcgctatcaaacatattctcattcttgcaatctgcacatggagaacacatgtaattgctgtttcttcttttcctatcctcctccgcggcgttcataaaatttattacgccatttctgtattccagaaaatgacgtttcatatttttcgcatacatccaacttcgattaattgctacaaaataaaaaaaacaaattagaggtacatcttataagatcagtattgctaaagtaagacgtgatgaaattgctcaattaatgattaatattactcacttgattgctccattttaatcacttttgggaattttctgttttccttgcaaaaaagacaaagaaccaccccctataccctcccaccaaaatagtgaacaatgggatatagttacactaggttgtggggggtatttatactatgcaacaaatatctgtaacggccctaaaacaatcaaccatgacgggcatacaagtaatctctaccgggccttaattaaagcccataaaaaaagagtgtcatctgtgacgggcattaaacttatctcaatcaggcctctagttggagcccgtcacagatgaccctcatctgtgacgggcttcttttagggcccgattgagatatggcacccttatctcaatcgggcctcaactatggcccgtcacagataagtgtcatctgtgacgggctctagttttatgccgatctaccatggctatgcgaccatatctcaattggcgaaactttgacccgattgagattacttccttgtgacggcccacaaattctagtcttgctaggggccgtcacagatggaaggatcggtactagtgtctctctctaaaatcca

SEQ ID NO: 56926 - DNA, 7371 bp, Oryza sativa
  unsure (1)..(7371): unsure at all n locations
tacctttcgtccaataaaaaatgaatgtaggactagatgtgacatatcctagtacaatgaatccggacagaggtatgtccaaatttgttgcactaggatgtgtcccattaagtactaggttggttttttatgggacgaagggagtatatgatatcctaatccaacgtttttcctgtttccatatttctaaaatcctgtgttccaaaggtgtccttaacttagcaactgcacaaaagtcgaattccaaatttagtcttgtttgggaaaacagatgaagaaaaacattggaaaaaaatctatttaataggaaagtatggcaactcatgggctgagcctcttcttatttttcatttgagaattccaatgcaactactctatttgtctttcttctctcgttcaaaaatctatccgaatttgtttgttatttttccatgagcaatccaaacacatcatctttcgaattcccatgttggattcgtacttacgtgacagtctaatgatgtttttttttcactattcctatatttctaaaatctgtgttctaaagaagccatacaactcaatattagccatcagtttcattggagaacttctattaggcctcctttgaaacaaaggaaaaatgtaggaattccaaagaatttatactctacaggatataatcctatgaaatcttttgaaacaaaggattgattcttaccaattcctttgaaattcatatggaatggactattgtaaagtaatttttgaggaaaataagcatgaggtcttacctcatgttttgttcttcttgtgtgttgaaatcttacgtttttttttcctgtcactatcaaatagtagttttaaaactttcatctgttttcgaatcccttaggtatccaataaatatgatattctatttctacttttttcctattcctgtgtcagtgaatatgatattctatttttatgatttttttttctattatcatgttttgacaattctgcatttcaaagggcacttagccttcacctcgtttctattttgctttgaaccacaagaaagtggaaattttggttgagcaacttgctttcctccattccgaagtccaaacacctccatatgaggagtgaaaaataaaatcttttatagatcgttgcagtaactatgtcccaattaatgtctcgtgtagccagccgtgaaaacttttgtcaccaaagtaaagtggcaatatttatctttgcaaatgattatacatctgtaggtaacatatatgtttaccaagtaaaaaaaacataaatattagggaagtgcctaatatcaaataaataaaaggggtgaggctttgaatctaggccgactaggccatcatattgtggagctcctaagcgtttctcatatggtcgctaaggaaaattttgataatttgacacttttttcgttgcccaattgttttaattgatatttgtgaggatgacatgtgaaaccatctaagtaaatgaaagtgggtcatgatgtcgaataatcgaaacacatttaaaagagtgttaaactatcaaatctcttgccaaccatgcttaaccaattatagacacacccaaatccctaattacctatgcaattgattaccactcgtataaacatatatctaccgtgcttgtctcggttgagtagaaaaagaaatatatatctacagtgcagtgctatgtacagttcctcaattcaatgtactatcgaatccaagtcttcaagcgctcgcggcgatccggcgcctccgccgaccatggtcgagacagcagaaagtttcaacccaaacaagagacggcgcggcgcagggctcgccagggtggtggccgttcgcccgtggtcttgcccatgcgtcggcgagcgtgaagcagtcggtcggagtcgggagagccttgccgaagaggggatcgcggatcacggggttctccgggcgctcaggaggagggccagtgaacagaggagcattcttcttggacattggttcgaccatctgcagaaagtccaaatgcttcatgggtcagctccgtttatcagcattgagattcgttaatcagacaaaatcatatcaatattgtagagatcctgccacaatattcatctatagataaaaagggaaatttaaaaagtcatttgaattttgaaaattacaccccataaatcattttgttgtaaatataaatgcgcaccctctagccagttcgattgcaaaaatcatctcaatacgcgcgtgcttaactgaatcaatatatttatcaatgtaatatttaacaaaactaaataccttaggagtatagtcttaacacttttctttgagatttcacaaataaaaatgctgatgagaatttaaacattatcgcactgagattcgcgttaattagaattcaatgaaacatgaagaataaatctaatgtaagcacttggataagattgacttagctatcttagtggtcatgcacatgtatattgggatgattttttgcataaaatgaggggatgtgtatttgcaacaatatactccctgcatctatttttgatagttatatttctaaatctgaaaaatttatttttgttaggcatatttcaattcaacaacatatactcttaatgactttctcggatttaatgcatggctctctattctttcacacaagattgactacatgggcatcgagaaaggtaaatattaatgaatcggttgtttacgaggaatgactagcagtatgtttaaatgaatgataagtagaattacttatctttgatctgtgtaccaagatgaaatatgagtatcaaaaggactcatagggtgaagcaatttcagtacttccgagacaaaagatcatgaatgtgcaggcaacaacaaataggtccccaactaaacattatacccatgactcaaatatattggttgtagctctgttgagtcaaggccgggatatagattccattatctaaaaaaaataactcaaatatatactaacgtgttttggaaaagcctatacagcaccaaagaggagctagcgttaattagttttagatttgacaaaacctatcgtacgttccaaaattttattctgaagataaatcgtacgtttcatcatagtgctgcagttcctcctgtcccaagagttaatggccaaatgtaccgatttctgaagccatattatgtactgtgcacgcgacgaatgcatgaaaacagagaacagaagaatgaatagtagcaaatgcgtagcagaactgcagtatggcgaggcgaatccagaaggatcagaaactggaacagcggcagcacgtacctcgtgtaccaggtcgccctgttcagcgtcagataccacgcccccatccccgcgagagacggccaaggacggcggctggtggggtgtgggccggagtagcagcaccggcggcggctgggacgacgatccttctgcttccatcgaaaagcttctcgcaatgcaacgcgaactgcagcgtgcgtcgtcgccggccgggtcggtttgcggtggccggcggtgatggcgtgtagggaggaggagtactcgcatatggcgcggggtgggggaattctggaaacccgcggtgaatttatggttatgacgagagagatagaggcaagtaacggttggtttggaaagtcgaaaccgaggggtagggaatccgccattgaaggagtctccacgtcggtgtgtacatggccagttgtccgtccacgcccgagattccctctgcctcttcgactgcgaggatgtgtacggcgtcgtccgtgtgttgcgctgcggagggaatcagatcgggggcttcattagattgcgctctaattatagcagtggagcatgcgggaagatgccccctgccgcagaaaatctgcatgcgggtaggtcaacacgttggatgcttggagtccaaataattactcggtatgtctcaaaatataagtattttttggctgtgaatctgaacaactgtgtattcaaatttataactaaaagttattatattttagaatagaagtagtaattagcaactatttgcacgctcctccccacgcagcgcgcggcggatcgagccatgtgactcgcgcggagagggccgtcttcggaacggtgcgtgtgcctccgtttttttcctgtttatttttctggtttcttttctttttttatgtacgtttgtacacgtacttatacataaaaatatatacacatctcttctctatctctactattactagccatctaatttggtaaaaaaaatatttgtttttagagaaataatctgctatatatttgtggaatatacatgatgtttagtttggatgatttgtagcatgggaggaaatgaatggacgaacaatgcatgtgcataaaaaatagattatttatttatatctaatatatggattgacaagatcatcttgtgatatatttgccaaaaccttttagtacctgatgtgacaacaattttttgggtgagcctgtatataaataatagaaatttaatacaaattattcctattttttaattttttgttgaatacaaaaaaattaaacaataaaaataaaaaatgaaagattatatttagagttcatatagaaatgaaatttagaaataatataaattataaattatattggatgaagtctagaatattctccaaaagaggctagagtgcatataggaatacaatttagaaaaagaattgaaatttgaaataaaaaataatatttttttgaaagaaaaataaaaatggatattgaaaggagagtttacagtccatataaaaatacaattaaataataaaaataaatccatatcaagagatacatttaacaaaatttctcactacttcaatttagatagaaataaattaataaacagtcataaacaatttaaatgatattaatgctatttgtgaaaattaaaaaaaacttaaaatcaataagagagaaaaaactgatttaagcccgacccaatagagcggccttatgtgcttcacacatgcggtcggcccatgggatggcccaatagcgcagcagcctaaaacgtcgctcggcccgacgtgggagaagcatggactgtccgatctgatggacagtctcgattggtcctgacctagataaatacccgcaaccctaaccctaaccttaaaatatctctctcgataccctaacgcgctctctctccctttctctcttgtaaagtgacggtggcggcagcgactattccaacgggtggtgacggcagcggccttccccaccgagcagcggcgacgacgctcttttgccccgcaagcaggaagtggtgccctaccctcttgcaagtggcggcggtggtgacaccgctccctctccccaccactggctccttctctcctcatcgggcaatggccgccgccccgctcctcgccagatccggcgggtcgacggctctccaacagcacggcggctcgggatctagctccttcctctccttctcagcatccagcggaacgacgggttggtagctcctcggcggcgcgattgcacagcggatcccccgagttcgcgacctccactacagcgaggtggcgaggagcagcacacgacggcctcatctcatgttaatattttgaatgttctttgatttgtattgtgatgatttgagcatcattataggtgcccctttttttataaaaaatagcacttataaacccgacccttataaaatcgagccgagcttagccagggagatatttttttctcccgtggggcccacacccacaccggcaggaggggataaggccgtgctccattcctctctcggctcctcccctcatttctcccccactctctctctcccccacttctccctctctctctctcctctgtgcggcggtggcgggaggagcggcggtggcgacggacgacatggaggtggttgcggcccggctggggcgggaggggcggcggcccggatggcgtgggggcaaccggccggacctcgccttcgctagatctggtggtgtggaggtggctgtggcccggcgggggtaggaggggcggcggcccggacggcgtgggggcggcctggtggacctctgctccgccagatctggcggtgtggaggcggttgcggcccggcgggggcgggaggggcggcagctaggacggcgtggaggcggccggccggacctcgcctccaccagatccagctgtcgacgggggatacccgtagaccggatatagagggtattgtggtacgttggaacgaggatctacgtaatacgacatcaagcaaacaaaagataaggattatactggttcagaccccttggtaagtaatagccttaatctagttggtatgggattatatgatggaaaccacagattacaaagggaataatggaacttggcgataacgacgagatcgtagtcgagttggttcgactagatcacccggcgacttggctcctgtaggctccggcttcgtaggctgtggtggatgtgttggcggtgagattcgatgccctaggtcctgcccgggggatcccttttataccacgggtcagttgatctccaagtaggactcggagatattagacccctcacgatatggtaacgacccagtcttgtccaagtaggactccttccatctgtggactccgcttctgtcagatgatagatttccttaacgtatacaggaagtatctgtatatgcgtgggtataccgtatcagcatacaacgtatatatatccaaggatagagggtatacctgttgatgaaaaacatgaggcatgggagatctgcttaactccagtgcaggtccaaaactcgccttcgggtatgctagcgtgccagttgatttgatcctacaatcaacaagaaacaaagacaaggaaccacttcatctgatttgatcctacaatcaacaagaaacaaagacaaggaaccacttcatctgatttgccttcgggtatgctagcgtgccgacttaatagatcaaactcaactgatacagcattaagtatgaaaagaagaacaatatctagacaatcaagccgctggaagtttcagagtggtaaatatcttgcataatctaaatcaacgtcagaatctaacctaatcggctgccctctactaacagatgttaaccgattgtagattagatagcgatattgccaaagattatgtgagatatatgataactcgacgaattacataaacaagattagagtgtcataaagatggaagcactaatcccgagaacgcaagccgtcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56927 - DNA, 1161 bp, Oryza sativa
gttggagagagagggaggcggcggcggctctcaccctagagatgcggcggcggcggaggtggcagaggcggcggaggcggcgacgacgacgcccgcgagacaacggcgagatacgacggcggcgtcggcgcggggatgccctaggcagtggcggcgaaggagaagccgagagagatcgatcggggaaaaaacttctaagtgttggtggagaagacgagggcgcgcatcgggaatatatatatacccctaaatctttagtcccggttgatgagaacaagaacaactgggagtaaagatcttatcaatcgggactaaagataagatctttactcccggttgttctcaacaaccgggagtaaagatatcattactcccggttgttctcatcaaccgggactaaagataatttccctctattttcaaattctttttaaacccggttagggttaagaaccaggactactgataaacgcactgaatattgatttccattacatatgtgtttctaaaatagaaaataatgcactaaaattatttaaagtcgaaaaattaatgacaattacttcgaaaaattattgttgtctgtagtaaattaagtggataaaacgtaataagcaaatatatgatttaaaattaataaaaattctaataatcatatataattagcatatgaatgatattaaattaattgttaaaaactctaattaacatatgtaaatgccacatgtatgatttaaaacttttaaaaatcctaattatcgcatataactagcatatgcatgatttaaaattgttaaaaactctaagtaacatatgtaaatgccacatgcatgatttaaaacttttaaaaattctaattatcgcatataactagcatatgcatgatttaaaattgttaaaaactctaagtaacatatgtaaatgccacatgcatcatttaaaacttttaaaaattctaattattgcatataactagcatatacatgatttaaaactgttaaaacctctaataatcgtacgtaattaacatatgccatacaacaattgatttatatggataatcaatacatccaaaatagtttacatcgtgtatacaataattacggcaatacatcggcggtgacggttgaccgcacgtactatctcctcactattgttccc

SEQ ID NO: 56928 - DNA, 915 bp, Oryza sativa
ggacgaatcccatagaagttgacctctttttggtaccaagggtgtatgcttgagagtggaatcattgttcatagcccccgcaaaaaaaaaaaagaatcattgttcatagcaatagcaagtagcagtaacaagtgattataaagtagaacaagggacctataaagtgtatttcctgctgccaacttctttaaaaaacggcttcagcacatgacgcatcccaaggctcgtgcgacacagctccacaaatcgaccaaaatctcgtgccgaccacgacgaggcaggtgaacatgcccgcgagttacgccgcgcgcgaatattcgctaattaggacccacacaccgcgactcgatccacacctcgccgccgccgccgccgctttccccgtccatatccgctccttgccggctcagtccccgccattcgctaccttccacatctccgctcagcaccgagccgctgcttctctccacaggtaaagcatttggggctcttctttcttcttctaccttggccgcactgcttctaacccaacgacagccaccaaagctacacgccaccggagattcctacagcctggattactactagtgcttgttgctatcttctttggttgattgggaaagaaagaaagaaagaaagattcgtacggtttagattattggggtaggaagaaattttgttccatgctgtctgagaaggggggaattcgattcatggagatagccgaacagtaagattggcatttgaacccgacaatttctaccggccataattatctctgttcgttcgtgtcaaccccgtcgacaagacgtcaagacaccgtaccactaccaaaccattgtactactagtactgctgcggttgatgaatgatgatagagagaggaaaacgaaagaaagacgcatgcgtgcattg

SEQ ID NO: 56929 - DNA, 6665 bp, Oryza sativa
  unsure (1)..(6665): unsure at all n locations
tcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagttgctgaagcctatggcgtctgcctatcaggctatcagccctaggtggtagaacatgtagagaggctatgggccaagcaaggcagcacgatggtccaccataccatctgacagcccacaccctcccccgtagggatgatgaaagcatggcggccattcaagcgtcgtcccgtggcctcagttacacgtcgggtaaatatatgtcatattgcttttaatgtaaggtacactcaagataataaatagcgtttttagctgccactatagcggtagcggaccctaccactaccggtacgacgtatactagatatagcatcttggaacttagcacccactattttcacttagcggactgctacagcggctgcaattcgattttgtggactgctgtagtgtgagcctattttatatgaccactaacccataacaagtaacgagtttattaattgttttgtctcccaaaacattgtattcttgtgagtcgtaacatctaacgagttggaacacaacatcaactcttcaagtgctactaaatctctacttatcctcataggttatacatgtattaatctatcactaatttgtttctcagttgatttgttaatttttataaagtcactattcattatatatacattcaaatatgtgcgatgattaaatgccgctattgaaacttagcgtctgctatccgcgatccgctacatacgcaccaatccggtaccgacccgctatacgctatctattaccttcggtacactttttcgatggcagcaatcagcaagatgcaacctgtcacagttaatgcgctgttgttggcccgagtagcctacaagagacaagcccgggggcaagtggcagctgtgcccgagctcctgccccgagctcggccaatactaacctgttgtcatatgaatatctccatggcaggccccaagaccatgtcctatcccacggccattgaaatagacccgagctgattaatagcgacatggatcatcccaccagataacatgtcgttaggtgcaccgagccgcaaccggtagtgggaacctggttcccacttcaccgacacacatcaatatgggaaatagaaaatgcatcatcgcatatagcattagagaggaaattaagagaaccattcgcgttgatttgcgccatgtgaacgatcccatatatgcattttttgccaccttatacttgccttcacaaatgaaatttttggaggcaaaattggttcctctttctaaaaaaaagctcttggtctttagaaggtttcttagcttttagtttttttattgtttggcaaaactgtttgaaaggtgtaccaaggcaaaggcagacagatctatacgactatacgtgcaaaactgaaatctagtagtaggtggtactaaacatttgctgacataaatttgttttagaaactgtcatatagccatttcaatggaaactttcaccacatgcttacttgttgtgttaggtaaacagcatatatagtcctacatgtggcaacggcgcaaccccatgtggcccacatgccgcggcaccaaattcagaagaaaatatccgcacgcagcatcctacccaaaagtctccactctccacaccacctaagctcctacgccgcggccgccggcgactcaacttcgctcagctcgcctctgctctggtcaacagccatacccgcctccccttaccacccaccccaaacaaaccactatgcaaatagtaatccaaacaccatcacttgtcagatttatcatatcgcacaagctttcagtcgactgtgccatggattcttttaggcaggcaaggcaatgcgtcgagcacctggtgtgcatacagcttatctatgaaaacaggagatgatggaggtgggggtgtatgtacttacagtttgttgatgtggcagagggtcccgttgttgtacttgcagtcgcacttgatgaacgggttgagatttgggtagtcgtcccagttggacaggtcggaggcgacgccgctgcagagctcgccgctgatgttccactccggcgacgccgtcttgccccatctccccaggatcgtgttcaacgccgccgctgcaatcacgcgcggggttagcgaactcaatattaaccaaagaagctaactagtaagacgcttgaacagttgaagtaacaattactgcgtgatgatgatcacgtactcaccttcgactggatcagttcgcggctgagcctgagcagctgcgataatccgccatgagcacagcacaagcacaagcagcggccacgcgagatgggtgaagacaccggccatgctaggccgcatcgctatcgatctgtctccacgcgtttgtctcttttctggtctcgctctctttgctggactggagactggactggcggcgaggcaacattgttgggattgttaaatagatttgaagtcgttggagcagtagttgtggccaataatttttaattttgcaaaccaagcgacgccaaactatatacgtgtgtgccaaaccgtatattgacgtttatttcatgaaaaaaagacaaataaaatgtcaaggctaaggagaggttgaaatatttgtcgtattggataacactaatgtcaaattttatctatgaataacttctcaaatatttgcgttagaaacatgaagactatgcatatgcgcctgtttgcacagctccaactacaactccaccttttctcgagctagagctcagccaaacagttttagaggggagctaggtgaaccaaataaactagagaggtggagctgagtttagacagctccacaacttcactacagaaccaactactggagttaaatttaaaagttggagttctaccaaacggaccttatatgtgacaccctggttcaattaagatttaacatgtgtggtccattagagctatgagtgttaagagcaaagttttaaatctccggctaagcctcttagctgctgaccttctcaacagctaagcacagctatagctggagatagctgcagctaagccatttagctgtttttgcaaataaataaataaataaaagacatgatcttggcataacttcataaccattaccaattgatacataaccaattcaaatgagtacattacaggttcatatgagtacattacatcacaggctaagtggttaacagaatactgaaacatcagtttcacaaaagtacagcattctagaataaagacaacagtacaacacaaaggtcatcaagaattctggatagtggatactaaattactaatatgaggcaatattgcaatcttcatttcttctagtcatcaatcatcggtctcagagacatagggagagggagagggtgacttatcagaatcagaagtctgcattggaataccatcatcacaatcttctgagtcggatgatggagcttcaggatgcactggggcattgcgcatcaaagactgtaggcttctgactttcctcttcttagcgtgcacaggccttttccttttagctggtgctggtgcttgtggtgttgtgtgctgctgtgactcttttgcacattgttgatccatttcacttgatgaaggcacaacaccagtaatgaattcattgtcaccatctgccacaacatcatccacttccttctctataggatctctacccttgttctctctcttatttcttaacttggagttaaatttaacaaacaccagatctcgcatcctttcatgaagtagcctgttgcgcttctttgtatgaacctataagccaagtagtgaacacaaagctgcaggtcagatctaaattccataaataagcattataattcaaaatagacagcatgcacataaagctacaggtcacaaatttctttttacctgttcaaaaactgaccagttcctctcacaagctgaggagctgcaggtcaaactcaaaatccttgcagccaacttcctaagatttggtgtgcttgtgccatggttcagccaccattttgctgcataaacattacacaaattacaacaaaaatgatattcagcaataaaattaagttcacatgttgagatctgaacctggattgaaatttttgttctttcactgccttacggcaatttcgtgtccaaaactcccatgctgatcttgatacaagttgagttcttcaattattttgtcttggatatcttcatcatcagccaacttgtcaatacaggaaatcacacctgctctaaatgatccatcactctcgatctcttgcttatttgggaagtagtagtaggggttcaaatagtacccagccaggtgtagtggagtcttgagcttgttgtcccatcttttatcaatgatattccaaacttctatgaagcggctcttatcattatcgaatctctgagaaatttctttcttcgcctcaagcattaaaccatggaagaatcccattgatggtacatcgctgtccattcttctcaacacgttagccaatggctcaaagtaattaactgcaatgtcaacatttttccaaaaggtttcagatttgatcactttgctggctttcttccccttggcctgcttcaagtaacccaattgctccatctcatctgatttaaatagtcttactaactcttttttgttgtctaacaagctttttagattcaaataagctgtggcaaatcgtgtaaccccagagcgaaccaagtctctgttaagaaactttctcatcaaatccaacaccctagtatgagcatacaagaaaacagtcacttgtcttgcattagcaatggtttcctcaactggtccaagcttcccaatatcctcgagcatgagatccaagcaatgagcagcacatccattccaaaatattgatggtctttttgctgtcaatagacttgctgcagttgtgttgacgctagcattatcagtcaccacttggacaacatgttgttcccctatctcttctatgtacctgtccacaagttcaaagatatatttgtcatctttcctgtcacctgagcattccactgaatctaagaagagtaccccatgagcactatgcacaactaaattcatcactcccctacccttcctatctgtccatgcatctgtcatgatagaacaacctgtgagctcccatgattccttgtgctccttgaatccatccatcaccttttccttccttttctgtaagaacgatccactcatctcatagggactaggccctttcagacttctaccaaattgtccaatggcctctaacatatgagcaaagctaggaagggttactgtgttgtgtggaatactagcttcatagaaccactgacatatgtactcacaagttctattcctcctctcttctcttttctgagttgtcaatgctgtttgaaccttattgcttagcttaattactctttgtgtcatactggcagattcttctatagaaggaggcttgtagtacttgtcaatagtatgaccacctgctacagatctagagctactagatcctgttgtctcctttggcttcaccacaagaacattattgccatgatctgaaccttcactgccactttcacaatctgaattttctatgtcaacttcagctctggccacttccttttctttgtttttctgttccttttcactagtcttcttggtaagcaaatcaaacatctcttgctgcactggacttggaactttctgacacttagtagtattgaaacctttaattccagcaagatggtacttaattcttgtaattccagcagtgcagaccttgtcacaatacttgcaccgtaggtgatgtttcttggttatgtctgggcagaaacagtgagcccatgcaggatcatctgagttgataccagcttgttttggtccagcttctactgagacagaggcagcactggacggattacctatacaaaaagcaaacttagcccacattaatgctagcgtcaaagctgcctaagcatcaaaataatgcaaactgatatagcacgtattatcattaccacctaaacaggcaaaacaagcaaacgagagatctcagggagtaagaaaatgtcgcgtcccaaatcgactctaaaatctatcctcgaaattgtgcaaaagaataattaaaattcaatgtgaaagccttcaacaattaaaatgtgcaaagataaaagtcaaatgaggcttggaggatttttgtatatttcctaaaagcctaaaatgcttaaataaattttagtggaattttcagagcacaaataataattgaaaagaaatgaacaaagttaaaaaggtttataaaaagaaaatcctaaaagaagtcttttccccctcccccttccttcttgggccggctcggcccattccctccctctctctctctctttcccctcggcccatcggctccccgcgcgcgcgcgcgccgctgacaggcgggcccgcccgccact

SEQ ID NO: 56930 - DNA, 34455 bp, Oryza sativa
ggcttaggacgagctgggacccagggtcgggttgccagttcggtctgaatcatcataggccttgggttaaggcaggttcgtgtgggttcacggccttgattaataatattggatagttctaggatcgtgtttacaaaatagccttgagcaactaaatgtctttaaatgctgtttactgcaaccctaaccctttatgtcataattcccttgtactcccttgcatttattctgcatttgtgggtgtgtcttgttgagtacggtggttgtactcagtcttgcttaattttcccaagcccagatgaggagttccttgaagatgaaggctttggtgtctagctcgtgcctgccgtcaagcgcctgtggtcgtcgccctagtcttccgctgtttttcgttgtctttgtgtgctgggccgttgttgctcgtgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagcctcccttgaccctaggacgagccgtagatcccaagccttagcaatattttcaaaaataaaaatcctttgttatttgtgaaaaccgctattctctctctgtcttgctgcttcatttatcgtcaaaatctgatcttttaaaatgttgcttttcttttgtttttgtttgtagatggccggcagcgttacccgtcgtggtttggacatgactggcttcgtcttggagttgcggggcatgtgcgtggttttgggatatccacatggagtggattaccaggccaggccgctcccggagcaggagggtgaggatgcagagcctcacgctggttgggaggtcactgcagtgatcctctccggctctcccgagcggacttcgctggcagtcaccgcgggtggggactccttccccgccgcttgccagaacgccgctctcctcgccatcggcactcttcaccagcgctacccggacgagttgcagcactcgccctaccgctaccaccctcgtcgcggaggagcccgcgacttcgccaccttccgagacgccagctcggaggatgacgctaccgtcgtgcatctggcacgcatggtggaggcgtacgacgcggctcgtatcgacttccaccagatggtgcgtcgtggcatggtggagaacaacatgaagatcctggagctgcgtcaggagaatctgcagctcaagaaggacctcgacgcgttggagacgcagcttcatcagctcaagatcgcccagggagagatcagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagtggtagacgagcagttagtaggcttgcgcgtgtgtttttcctcgtttgtcttttttgagttgtgtggggcatggttacgccggtgtgtggtgtaactatgtcggagcctgtcttattttgtttgcctaagcaacttgaaccttaatgaaccaatttaatagcagtgataaatttaagaataatggtagtcgtgggtggttagttttaatcgtcagctctccttctctgtttgctggttctgtgtggggtttccagatggtgacgaccaggagaaatgttaacaccggtgaaggcaaccaacccgagggcagcaaccccaacccccaaggcaatccacctccaccaccaccaccagacaccaacgccattctcacccaaatcctcgcccaacaagccaacatgatgaatgctttcctccaccacctccaaaatccgccacaacagaatgctccaccaccacctccccaacactctaaactcgccgagttcctccgcatccgcccacctaccttctccagctccaacaaccccgtggatgcgttggattggttgcatgccgtggggaagaagttagacacggtgcagtgcagtgatgaggagaaagtcatcttcgccgcccaccagctgcaggggcccgcatctctatggtgggaccatttccaggccacgcagccagaagggcaacctattacttggactcgcttcaccgccgctttccggaaaacccatgtgcccgccggagtcgtggctcttaagaaaagggaattccgggagttgaagcaaggcaaccgctccgtgatggagtatttgcatgagttcaacaatctagcccgttatgccccggaggatgtgcgggaagatgaggagaagcaagagaagttcttggcaggaatggaccccgagctgtccgttcgtctagtctctggggactatccggatttccaacgtctggtggacaagagcatccgcttggaggccaagcacaaggaactggagtcgcacaagcgccgcttggcgaatttccgcaatcagcagggtgctaaccagagggtccgctacaccaatccctacccagggggatcctcctcgcagcagcagcaacagcagcaacctcgctcagcgccccgacctcaattcgtggtgcgcgtcccacagcagcaacagcagcagaatcagcaagggactcgtgcaccccgtcctcctacgccagctgtgcagcccgttcaaggccgcagggacgctcaaggtccgcagcgtctgtgcttcaactgcttcgagcccggacactttgcggataaatgcccaaagccaaggcgtcagcaaggccaagcgcctccccgctccaacaacggtggcaaggacgtcatccgtggtcgtgtgaatcacgtgacggccgaggacgtgctgacaactccagacgtcatcgttggtacgttcctcgtccaatccatccctgctactattttgttcgactctggagcttcccactcgtttatatctgtgccattcgtggggagaaatcagttgggggtagaaaggcttagaaaccctctgctcatcaccacccctggaggggttatgacagcaaagtattatagccctgccgttcctatagaaattcaggggattccttttccctcggatctgattctgctagacacaaagaacttggatgtgatccttgggatgaattggttggctcaattccaaggagtagtggattgcgcgaggcgcactgtcactctgtaccgagggccagaacaaccggttgttttctttgcacctccaaccgctgtcagaagttcagaacttcatcagatagaactgtcagaaatccccatagtcagagagttcggagatgtgtttccggaagaactacctggtatgccgcccaagcgagagattgagttccggatagatcttgctccaggaaccactcctctgtacaagcgaccctaccgtatggcagcaaatgaactggccgaagtaaagaaacagttggaagagttgaaagaaaaggggtacatacgtccgagtacttccccatggggtgctcctgtgatttttgtagagaagaaagacaagacgaagaggatgtgcgtcgactacagagctctcaatgaagtcaccatcaaaatcaagtaccctcttccccggatcgatgatctgttcgatcagcttaaaggtgccaccgtattctccaagattgatcttcgttccggatatcaccaattacgtattcgtgaagaagatattccgaagaccgcattcactacgcgatatggactgtatgaattcacggtgatgtcgttcggcttaaccaatgctcctgccttcttcatgaacttgatgaacaaagtgttcatggaatacttggataagttcgttgtggttttcattgatgacattctgatatactcacaatcagaggaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgaccgccgtcaccgattggaagcaacccaagacagtcactcagattcgcagtttcttgggtttggcaggatactatcggagattcatcgagaacttctccaaaatcgctcgacccatgacacagttgttgaagaaagaagagaagtttgtgtggagcccgcaatgcgagaaggcgttccaaactctcaaggaaaagctggtttcctcgccagtgttaatcttgccggatactcgcaaggagttcatggtgtattgtgatgcttcgcgccaaggattggggtgcgtgctcatgcaggacggtcatgtggtagcctatgcctcacgtcagctacgacctcatgaaggcaactaccctacgcatgacttggagttagcagcggtggttcatgctctaaaaatctggcggcactatctcattgggaaccgctgtgaaatatatactgatcataagagtttgaaatacatcttcacccagtcggatctgaatcttcggcaaaggagatggttagaactcatcaaggattatgatgtgggaattcactatcaccctggtaaggccaatgtggttgccgacgctctaagtcgaaagagccactgcaacactctcaatgtccgaggcattccacccgagcttaatcaacagatggaagccctgaacctaagcatagttggtcgcggattcttggctgcgttagaagccaagcccaccttgctcgatcaaatccgcgaggctcagaagaatgatccggacatgcatggactcctcaagaatatgaaacagggtaaagccgctggtttcacagaggatgaacacggaaccttatggaacggaaagcgggtatgcgttccagatagcagagaacttaaacagctgatacttcaggaagctcacgaaagtccttattccattcacccgggcagtaccaagatgtacttagacttgaaggagaaatactggtgggtcagcatgaagcgggaaattgcagagtttgtggccctatgtgatgtgtgccagcgtgtcaaggcagaacaccaacgaccggccggacttctccaacctctccaagtgccggaatggaaatgggatgaaattgggatggatttcatcaccggccttccaaaaacccaaggtgggtatgattctatatgggtaatagtggatcgattaaccaaggtagctcgatttattcctgtgaagaccacctatggagggaacaaactagcggagctctacttcgctaggatcgtgagtctccatggcattcccaagaaaatcgtatctgataggggaagccaattcacctctcacttttggaagaagctccaagaagagctgggtactcgattgaattttagcaccgcctatcacccgcagacagatggacagaccgagcgtctaaatcagatcctagaagatatgctccgcgcatgtgtactagatttcgggaagacttgggataagagtctcccctatgccgagttctcctacaataacagctaccaagccagcatacaaatggcaccctatgaagcgttgtacgggcgcaaatgccggacaccgctattgtgggaccaagttggagaaagccaagtgttcgggactgatatcctgagagaagctgaagctaaagtcagaatcattcgggataatctaaaggtggcacagtctcggcagaaaagttatgcagataaccgtcgccgtgatctggaattcgcagtggatgactttgtgtaccttcgggtcacgccattgcgaggtgtgcacaggtttcagacaaaagggaagctcgcacctcggtatgtgggtcccttccgtatcatcgctcgacgcggagaagttgcttaccagctggagttgcccgcctccttgggtaacgtgcatgatgtgttccatgtgtcgcaactcaagaaatgtcttcgagtgccatccgagcaggccgactcagagcaaattgaagttcgcgaagacctgacgtatgtggagaagccagtgaaaatcctggacaccatggagcgcaggaccaggaaccgggtaatccgtttttgcaaggtccagtggagcaaccacgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaatctatcctcgaaattgtgcaaaagaataattaaaattcaatgtgaaagccttcaacaattaaaatgtgcaaagataaaagtcaaatgaggcttggaggatttttgtatatttcctaaaagcctaaaatgcttaaataaattttagtggaattttcagagcacaaataataattgaaaagaaatgaacaaagttaaaaaggtttataaaaagaaaatcctaaaagaagtcttttccccctcccccttccttcttgggccggctcggcccattccctccctctctctctctctttcccctcggcccatcggctccccgcgcgcgcgcgcgccgctgacaggcgggcccgcccgccactctcgctgacgggtggggcccacctgtcatcgccctcctcccgccgcgcccgccgccgcgtccgtgccctagcgccgccgccgccgcgaatcccgccgctcccgtccgccccgcgtgcaatcaagagggggaaattattccccgcgtttccctctcccgattccccctcttttccctctctctctccctcggattcgttcgaatcgtgcccgcattcatcgccggcgcaatcaatggcggccgagatcttcgcggccggtttccttcctccccggccgcgctctccccctcccgttgctatatattcgttgcccgagctccgctcttccgtttccgccgctcgccgctcgctctcgccgtcggaatcgtgctagcgccgtgctcctctctctccgccgtcgccgtcgaccttcggttcgccgccgccgtcgctccggtcttcctcccggctcggcgccacctccctcggcatcgccgcatcgccgtcgaccccgtccgccgctccgtttcgctcgccgaccgccggagcaccgtcgccctcgtcttcccgaaccgcgccgccgtcttcctccgctccggccgccgttctcgtcgtcgtcgttgtcccggggtgagccaaggaccgcccttcgtttcccccttccctcctctctctcgggcgccactccgccgcgccgttggtcgccggcggcgaccatcggggcgcgggtgcgcgtcctcctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataatccgaatttttaattgaaaattaaatgaagaaattcgtaaatatccatttaaagagcatataaacttcaaatggccatatcttggccatttgaactcggaattggaccgttcaagtctctaatttctccttaagatgtaaagaacccatttttgtgctttgtttctgctgttatgtggagttatctagtgttaaagcctttttcttttccgttggtcgtgtagccgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgtcattgttactattattaccttgttcaccctagatcaaacaaaaccccaactagtggacactctactcatgacaccactagtttaattttaggtagatgcttcgcaatttaattaggcaacattaggtggttttataactatagactttgggaaattctcatatcctttggacaccatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaaaagcacagggttggtgccctgctgcgaggggctcagttccgtctacctgtcccgggggttccggccgtaggcgggattgggtcggtactcttgtctaaggctaggatgggttggaaactatgtcacgtctttcgtctgtataccgtggtggtatgtggcacgtggttacacgtgaggaagatgtgtcttgtgggtaaagatgtacacctctgatcagagtaaatctattcgaatagccgagccctcggatatgggcaagccgagcaatgtacccaagtcagtgttctaattcttaaaatttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataatattggatagttctaggatcgtgtttacaaaatagccttgagcaactaaatgtctttaaatgctgtttactgcaaccctaaccctttatgtcataattcccttgtactcccttgcatttattctgcatttgtgggtgtgtcttgttgagtacggtggttgtactcagtcttgcttaattttcccaagcccagatgaggagttccttgaagatgaaggctttggtgtctagctcgtgcctgccgtcaagcgcctgtggtcgtcgccctagtcttccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacagaaaataattcacatatagtaagatctacatcataaggcaagtatctgaaattagaggtaacaaatatggacaacttgttcacatattgtaagatctgcaacatacaagcaaaaaagagaggaggatgtgagaattgaccggattgttgtgccatgccgtcacctttggtgctgctgcttcagtgcttcggagacgttgcactgacggacctcctcgtcggacttgcgccgctgctcagctgccttcaaagccgccgccgctggttggacgcccgctcgaagcagcagccggcgctggtcgcctccacgagccgcctgcgttggtcgatccgcttgaagccaccgccgccgccggacgcctctgcgccgctgccgccggccgcctccacttttcttgcagctggagagtgagcgcttcgaagttggaatggatagtgtgctgctgggagcttacgagctagggtttgcagcactttacccacctctcgactctggtctagttgggccggtttcctcttgggccagaccggccgcgttttacaatttagctacgctaaattacggccagtttagcagctattgccggctaaatggcgctattagcgtcccgctattcttagcgctaaaaactgcatctcttagctccgtccgttcccagcagctatctccggctatagcggcagctatagccggagatttaaaactttggttaagaggctgatcctagatatttgactatatgcctgtgtgactacgtaggtaggttggaccaacgaggaattgggtcctttgaccgggagggggggtggtaagagtaacatcatggtccaactaggatttagcatgtttggctcataagagaggtatatgtatatttaataccacattgctagtttagtaagggcggaaccaacttataagggcgtatccctccaaccataccaccctcgggttaacccttgtagccatcattcctgggctaggtaagagtagtgatagatgctccagccattcaatactacatgcatgtctgagacgatgtatcataaaactaaggataagggtttagtggtaaaattatcacaaaactacatatttaatgccaagcatcacaataatacatattttatattaaagttatcacaaaaaaatacagatttaacattgaagttatcacaaagatgcagattctagagtttaactagctcgtgcaaatattatgttggagctataaacgttgtagttttaggataaattagcattaacctatagttttatgataaattttctacttactaatctttttttatactctatcgaaaatttgtagttttgtgagaaatttcgaactaaatctctagtttcgtggtacaagacgttagatatgtagttttgtggtagtttggtcgatgtatctgatagtttgtgaaatttactgtgaaaatagctagattgtgtgattccctgaaatcacttaggtgtcatgctaccaaacaaagggcatgttatgctttttttttaaaaaaaaataaggatgtagcaaatggaaaataatcataatacacaaggtggtagtaattggaggaaaaaactagtacaaaagttaataagtaggaaaaaaacccagtaaaaatctggtagttttagaataatcataagatctaaaacactctggctcgcgcgtccaatgagtaaaaaaaatatcggacattgctctcatccgtccgttccgcatccttatccactcttccctcctctctctctctctctgactcttccaccgcattgttgtgatcaacccccctctctctcaatactccaccaagaatgtatcaggccacggccatgggttgtagttcatcaaggctagggagctagagaaagacaatggacggacgtagttgagggacaaaatcgacaatgacaaggtgacaaagcctctgggggagcaacggctatccgttgctgtggagtagaagggtcctgcaacgtcttggcatggatctgcagctgagattaaaggagccggtggtcatcgaataggagaaagaagccatatctaaactggtaaagtttgtgattttttgatgtttcagctaacgtatcttgatgttttatggttgggtcaaaatccgcactagctacttttatgttgtttcatgtttttgtcttgagaaaatcccttgtatacccatgaaaacttacctaatctcttctataccctccaattttactcgatctcctatgtacccccaaattttcactttggtcccctccatacccctcccgttaggtttccgtttgatctgtagcgtgacctgtgtgttacattgtcagtattttcaaaaaataccaaaatgcccctgccagccaaccctaggtaaacagatccaatctccttctcttctccccccatcctctgcacgccgccagtctccaatcgcgcggtggccgccgtcctcccgtcgcgcggtggggcgccgccggctcccacccccccccccccggtcgtgcgcgccgccggccgctgtcatcccgtcgcgaggtggggcgtcgccagccgccaccctcccgtcgcgcggtggggcgctgccggccaacgccctcctgccaccctcccgttgcacggtggggcgccgccggccgccgccctcccatcgcgcggtggggcgccgccggctcacgccctcccgtcgcgcgcgccgtcggccgctgccctcctgtcgcgaggtagggcgtcgctggtccccgccctcccgtcgcgcggtggcgcgccgccggccaccgccttccagtcgcgcagctgccgcccatagccctctgtcgcaggcaccgccggccaccttcctcctgtcgtgcggccaaagtccgataccctctcgtcgctgcgccgccctactggtaggagtagcagcaattttcatttcttcttcttgcagttttcattgttgtttgctgttgtgatgccttacaaagtgtttgacatatttgatctgtcatttgcaacatttgtgtatggagtggaaagttggtttggttcctgcactattaggtatggaaatgaaattgtggtatgtgcatcatatgagctgttctgtatggatgatgaaaatgaaattgatatgaagtgctctgtatggatgatgaaaataaaattgtatgaaatttatatgaagtgctctgtatggatgatgaaaataaaattgatatgaagtgctctgtatggttactactattttgattgatgatctatgatgctcttgatgctcttattgatccagattattttgtttcacagattttctcctttgtccacattcctgttgagtgtaccaattttttttacagagcaaactgatgtcactttgattttccaaccctattatttttttttcaaaacaaattgttcgatggattgcatttttttttccaataccacaataaaagttttaaactcattattagtctcataaaatacacatgctgtgcggtcaacatattccaattcttttccaatctacctgcagttgctcctccatctaaagggcattatagacatttgcaatcacacataactataaaatgaagaaaacctaacgggaggggtatggaagggatcaaagcgagaatttaggggtacagaggggttcgagtaaaattaaaaggtatagaagagattgggcaaattttcatgggtacacaagggattaactcttttgtcttcggttcttaaacatccgttaatgttttagcaattaaagcttgatgtttcatcagtcaaaatgaaatgttttaatctttgattcgacttagtcccaccattttaatattttaaaacatttttgtcttagtgctaaaacatttttcttttagaggtgaaccaatgtttgagtttttagaaaaatcagacattttaggacaaactagaagagtggaattcttatacatttttggaatggagggtgttagataattggacacgtatgtttgactctctaggggcttttgaaatgccttgcggactatgttacctgttgtgtatatatataatcagttgcaagtagagaacgtacagctgcactaaattattaaattggcatatccgtacggcgtgcatgattgttatatttaccatatttccacccttcaagattttatactggtataggccctatttggcatatccagcagaccagcacctctattgaattaaaaatgttgtgcggctgctaatggcaggattctcccgtgtatacagtaaattatgagttaacccggtcaaattatatagccgacctaattaatactagtggtctgtcgaagttgctattggtagctgtacttgagataaaatatattttctttatgcgtgttggaagcaactaattaatgttgtataaatcaccttacggcatgttaagcatgctacgctttggattccatcaaaactgaccacaagtccctggttttagaatttactactccatgacatgaacttggaaaaagaaaattggcttaccatccatgcatgcatggagtggcaaaatttatcgacaatgcgttttgattgaaagaaatggaacacattatatggcacaacataatttgaaaaacgtacaaacattagaaatcttgaaatagttttggacacccaaaacacatatagcacgtacgaaaaaacatggaattaattacccggcgaagaccaagccaccatcagagtgcatgcgccaccttccaaagttccatctcaatgtatgatcgaaacacaacaattaagctaatcagagggggtgaatggttggtatgctaaaaaaccaaaacttttagcggaaataaaagttaccctcaaattcgacagatcgcggtccgaccgaagtagatgtgccggtctgaccgcctagttaccgtcggtctgaccgagattgtatctctggtctgaccaccgagatcagctcctgtcacctgtcgtcaacgctggtctgaccgcccttacgccgccggtctgaccgccggtgtgccaccaattagaccgccgaaacccagtgaaacacaaatcaaagaactcttaaagtggatgacgactttattgattctctctgtgtttacaaagtgcaccaacagcactccttacaaaaatctcgactaaactcaaacccctaactcaactatcaactcaattgctctctaaaatgatacagggaagcctcacgctccctctctatttatacatgaggtaggcagcctaaagccacgaaccaaactcatactagaagtcctaatcctcataggaaaccttctcgtacaagaaacaaactttacataaccactcataccaaatttggactccttccaaattcgactccacatcccatacgcacacaatacctccatcgtatgtcatatggaatcttcaccaaccacgtgcagtgaactctagccttagtatcccgcatgatatctgaccaccacgaacatcgtctcatccccaagccgactcccggtcaatcaccgcaaatactctcccggcatctcgagtcacctacacatagaacaaacaaagaaaccatattccgagaccaacgtatccccaacttgactcattagtagcaaacaacagtattacatacacatagtatccatctagaagctataaacataaacaatcatggatatccaaacaaacaacccgaaaccgaaaccgacacagcgtcggccggtcagactgcgggctgcaccggtctgaccgcgcgatacacgccggtctgatcggcaacacctgcccggtctgaccggaccacacccagcagtacctgtagatcacctatgaaatccaatcatctccaaaaccacttcgtaaataaattccaaatatcaaaaccaataatcttcaatgtcaattgttcatcacagaataataatcaaaaacacctttaattttacactcaactgaagccgccaaagaaataccttcgagaaattgacgaagcaagaagatgattcctatgagccggtaattatgagatgcatggggaaaatacaagataaatttggcctcaggtatgttcccccatctgttatggcggtcttgaagtacccaacctggaaaaattgctacagcctacggctgagatggctttggtatgaatggagggcgccaaaactgaaacaccctatgatgaactcaataaggaattgttcgcgatattgactagagtttttatcggtaataggcaaaaacaaacttcttggaatccaactagattggcggccatagcttcaaaagcctagcaccgaacctctagtgcaactccaagaggaaaaaccacatggtacaggatgccctgcaacaagaagatggatcaatgacatttggcacaacctcattgtcgccctttcttacagattacatgaaattctgggaggtcctagcacttgaatacttggaactgacaaaaggagtggaggattcgattattggagatggacgggaaatagggaatatggcacaaagtatgcctatcatttctaattcgaaggaatgataacatcgttatcggcaaagttgtcttgggatgcatgggccccatcgaaatgcaagatcttcagttggcttgagatacaaaatcgggtaggatagcagacatattgcaaatcaaggggtggccaaacaactatttctgccagttatgcttccgaaacattgaaaccatctaccacttattgttcgaatacccaatcttgaagcaaatctagtttagcatgctttaatggttatgacaagggcacatcatccctaggtggagcatcagtaaagatctgttggactggtggacacagggaataagcaatccagaggcagtaaaacacaaaaggctcaaatcagttttcttgctagttatatacttgggggaaatttggaaaaaaagaaattcgagaatcttcagagaaaataagcaacaactaaagtatttggttggcttctcttaatggacagattaaacccaaagtatatgttggaccgtaaacattgtacccccagactgtgacttgaaatgtgtattatgtactactcaatctttggaaaatctgattcacatcttttttcggtgtcccttctcgatgatctattggaataccttgggtattgtttgggacacattctttgcaaaaagggtaatacacgaacgttcgtgtccggcgaatcagtcggaagggacatgcgaaacaagagaacacgtcattttcttctgttttcattttttcccttcatttacgtgattctcttctgtaatctgttgcatcttgtacgttattcttccgttataagtacttctgtttctttccttcacttcagtttatttctcagatttcttttttcgttatatatagattttttatatcttcttaacggaaattttctatacaaacaatttccggggaaacttttctatatatagtaggactttatatatgtaaactttatatatatggactttgaatatataaactttatatatatatagattatatatatatatatatatatatatatatatatatatatatatatatatatatatattatatgtagactttatatagagactttgtatatgaaaactttatatacaaattatatctataattaaaaagtttagttactagaaattaaaaataaaaataccaagatatttttcaaaaaaaaaagtataatccaatatgatcaaacctcccaacagaaaacgataaaaaaggaaaagtttatcttttaccatcgcatgaaaggaaaacaagaaactggaaaacaattttttttgcgtggctccgtttttctttttatcgttttctattcactaggttcgacgctagcgcgcgttcgggcattagacccaccccttctttgaccctggacggcatcatgatggaagccggagatagataccatgtccattgctttatggaaaaaaatcttgtttggggcctggaatattttgaagcaaacgaatgattttatatttgataataagtacccctctttgtcttcttggagacaactttttaagagtgacatccttcttttgttgtttaggttgaatgagagagataaagatgtagtcatgagccagattagattgttgtaattttccttttttagacttgtactgtttttctttaacaaagtattatataacaacggggcctcccctactgtgctttcttaaaaagaaagcgataacccatcaaataattaattgaattaagaacgagttgggttgttggagctcgacgcaaagcacattgcaatattaagcacattgcaatattgttgccatgaggagtaaggtgaatttgcgtgcaagtatatttacggtaaaaaatgtacagtttttttctttcaacttttgatatgtactcaaaacgtactccttctattaatataacgttaaacaacctgtttggccgttttaaaaaaaaatgttaccatctcaagcgctgcgggcggagcagcaaggagcattcgggtcccctgaagatgatactaccattaactatgttaacctcggtatcgatttagtgcacgtctcgctctagacttagctataccatttatgtgacatccatcacatcgatttaaaatgagataatgacctatgctaggatatagtatatgatagtactataattaaaaatccggaggagtcgcgtatgagtttgtttaacaatgtgggtggttcaacgaaaccctccatgtttaagaacccatcaacgttgatcccagccatcataacctttattactacaatctttggtacaacttgctgtacgcgctgggcagaattttttttactgttaattgtcatcactactgatccctccgtcccaaaatataagcttttttagtcaacaatttttgactttgactattaataataaaaaaagaaaagaaaaaaatcatgtaaaattgatgttactagacttatcattaataaaactatcataatatataactctttttatttaaaacattatatttttatcgatattgttgatcaaagtagcatatcgaagactgtatcgatatctaaaaatacttatattttggggcggagggagtactttaattgaactaagttgccggcaagttggaacatggccggacgatcttgtgctcaccaataaccaataagatgagagcaatcgagcatctgctatatacacatgcatgggggtgattgttgagaataaagattaattgatagtactagctggtactccctccctcataaaacaaatttatttttagtcttcattatctgtctaaaataagtttatatatatatatcctttcacctatcttcggtctgcaaatcgattagttttaagtgaaacaactcagtttatatgaaacgacgagggagtattagaaggcgtaatttgtttttttcttaatcttattttacacagccaaacataaagtaaaagttattttggaatgaaggaagtagccagtaacatgtgatgtgcttgttgcgtgcatcagcagcagctgcgcaggacgacttgaccaagaagtgatgttacaagtcgctcaaggaacgtaaggctcatccattcatccattcatccgttgacaaacttgactatcatgttcaaaggatggtatcatgttaaaaataatatcgtcttgctcaagaatgaaaaagactcctttcaacaataattatggaggaccagtttgaaaggctcaacggataaatgaaggatgggtgatggattatttattaattttgtgaaatttgtgggtacagacaaatggattaactattataaacttgcaaatttgttgtaaaaaatttgttccaagtaatttaagaaataaattagtctaggtgctgcactagtgtgattttaggctgatgcgcatgtaccggtgacaaaatggttgtactatgtttttttctaatgtaagttaagttagaaataaattgtgctcaaaactgatttctttattaatttctgtgtaagttttgcttgaggttcagtggtcgatgactaggattagaattatactccggggacttcgattgggttttatagttgagactagctttatttatcgatgtggagatcatggatatcccatatctacacggcgatgatatttgggctgaatataggataccaaatatacatagaatatcttatttgtatctcgggtttgtttcttaacttgtacatcaaggaaacaccttgagacttagtcggttacgactgtattttatctgtatctgcatattccgttagggatatagattatcttttgtaacacggactccttcccatatataaggggggtccgggtgcctctaggggcagatgttgattttccctaaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagtttcgacagttggcgcgccaggtaggggtagcgtcaagcttttcgccgatcagtgcaatgggtttcgtctccggcatcgacgacctcgtcttcccgcccgggcagacgtttcggttcggcagcctcgacttcgtcaccaacaacttcggcaagatttctctcctcgactcggaatcagaccagtcgggagagaaccggatttcggtcccgtttggattcccgaacgcggctgaaagctacttcaagaccatctcaaccgagtcggcttcaaaccactcggccgagatcgcatcttctccaacgacaccagatcaagatgatggggcttacccaccagtcctgatgaagctccccgacgatttagcggccgtctccaccacgacagcgtcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcacgtcctactgacatcgtggagtacgacgaatttagttctcgctacaacgacttcgacgacttcgacggaagcctagatgacaactacacccctctctactttggcgttttcatggccaataatgagacggaggagcaacgccaagcccgggagaccgaagaacgtcgccgactggaggaggagcatcaagcacaagaacaagaacggctacggcgtgagcagcaggaccgtgagcggaccgcgaaggaggctgaggatcgacgtcagcgagctttggaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcaatccgaccacgtcgtcaacatcttgaaccagacgaagactatgattgcggcttcggtcccagttaactccgaaagcgtccacacgccgactggcagccgagtcccccacttccgatctcatgactaccgtcatccaagcctcagcatcaccggcgcaggatccaatcgcaggagcaggggccacgacgagcggtctgttcactcacctcccgatcaccatagggagcgccgagtggaacggcctcgctcaccacctcgtcgccgccccgtcgatcttcgcgacacaatcatacagcgccgagcagctcgaggctatcatcactcgccggaccgccacgacgacgaccttgacggagtagcagccttcaccgacgacctgcgtcgagtggactggccagccggcttcaagccgactggaatagagaagtacgatggtaccactaacccagaatcgtggcttaccgtctacggtctcgcaatccgcgcagcaggaggagacagcaaggccatggcgaactatttaccagtggctttagcggattccgcccgatcttggctccatggattgccccgtggtacaatcggatcttgggccgagttacgcgaccacttcatcgccaactttcaaggcaccttcgagcgtcccggcacacaatacgacctctacaacgtcattcagaagtccggagaatcccttcgagattacatccggcgattttctgaacagcgtaacaagatctccgacatcaccgacgacgtcatcatcgccgcattcaccaaagggattcgccacgaagaattggttggaaaattcgggcgtaagcctcccaggacagtcaagctcatgtttgaaaaagccaacgagtacgccaaagctgaagacgccgtcaccgcataaaagcagtcgggtcccagttggaagccaaaaaaggatacgccggcttcgggaggaggtggaagtaacaatcataaggaccgcaagcgtaagcctgcggaacttgtcgcaaccgccagccactcttctcgacagcgttcgcgcgtcaacacgttcgacaagatcatgaactcccaatgcccgcaccatcctaattccaaccatgtggccaaagattgtttcgtctacaagcaattcgcggatcaatacaccaagactacgcggaagaaccccgacgaagaacaaagcacgtcgaggaagaaggacgacggcgataccccggcaggatttcaagaccaccgcaaggagctcaaccatatcttcggcggccccttggcttatgagtctaaacggaagcaaaagttgaccgaacgggagatcaatgctgtccagcccgacatgccccaatatcttcgatggtcagagattgcaatcaagtttgaccgctcggatcatcctgaccgagtggtccacccggggcggtaccccctggtactagacccagtggtccgtaatgtcaagcttcgcagaaccctcattgacggtggcagtgcactcaacatccttttcgccaagaccttggatgatatgcagattcctcgctccgagctgaaaccaagcaatgcgccttttcacggagtaattccaggattatccgcaactccactcggccagatcaccctcccggtcacttttggtactcgggaaaactttcgcacagagaatatcagctttgaagtcgccgatttcgagacagcataccatgccatactcggacgcccggcgttagccaagttcatggccgtcccgcactacacttacatgatgatgaagatgcctggtccccgaggagtcctatccctacggagcgacatcaagcaagccgttacatgcgacaaggagagttgcgacatggcccaaacccgcgagatggcgtcagcccgagaggatatccgactggctgcagccacggcgagcgaaggagaagtgcctgctaccaagacttcaaaaagcggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaactatctgatatgcccggtattcctagagaggtgattgagcactccttacatgtcaaagaagatgccaaacctatcaaacaacgactccgccgatttgcacaagacaggaaagacgcgatcaaggaggaattaaccaagctgttagcagcaggcttcatcaaagaagtccttcatcccgactggctggcaaacccggttctagttcggaagaaaacagggcaatggcgcatgtgtgttgattatactgacctcaacaaatcctgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccctttggagcttattgctatgtcaccatgccgttcggactaaaaaatgcaggagcaacttatcaacgtatgatccagaggtgcttctcaacgcagatcggccgcaacgttgaagcctatgtggatgatgtagtcgtcaagaccaagcaaaaggatgatttgatctcggatctagaagaaacctttgcgagcatccgcgctttcaggatgaaattaaaccctgaaaagtgcaccttcggagtaccgtcagggaagctgcttggttttatggtgtctcataggggcatccaagccaacccggagaaagttactgctatcctcaacatgaaaccgccaagtacccagaaagatgttcagaagttgactgggtgcatggcggcgctcagccgatttgtttcaagacttggcgagcgggggatgcccttctttaagctactgaagaaaacagatgatttccagtggggacccgaagcacagaaggccttcgaagatttcaagaaactcctcaccgagccacccgtcttagcttcaccacatccgcaggagccgttgttgctgtatgtgtcagccacctcccaggttgtgagcacagtcttggtcgtcgagcgtgaggaagaaggccatgtccagaaagtccagcgaccgatttatttcgtcagcgaggtcctatccgactccaaaacgaggtaccctcaggttcagaagctgttatatggtattctaattactaccaggaagctgtctcactattttcaaggtcactcggtaacggtggtcacatcatttccactcggtgatatactgcacaaccgcgaagcaaacggacggattgctaagtgggctttggagttgatgtctttggacatatcattcaagcctcgaatttcaatcaagtcccaagcgttagctgattttgtcgccgaatggaccgagtgccaggaggatacccacgcggagaagatggagcactggaccatgcattttgacgggtcaaaacgactttcgggcactggagcaggagtggttttaatttccccagctggagaaagattaagctatgtgctttggatacatttttcagcgtctcacaatgttgccgagtatgaggctcttcttcatggactgcggattgcaatttccctaggaataaagcgtctaatagtccgaggcgattcacagctggttgtcaaccaggttatgaaagagtggtcctgcctcgacgacaatatgatggcatatcgacaagaggtacgcaaattggaagacaagttcgatggactcgagctcagtcacgttcttcgacacaataatgaagccgccgacagacttgccaactttggatccaagcgcgaggtggctccctctgatgttttcgtcgaacacctttatacgccgacagtacctcataaagatactactcaagttgcgggcactcatgacgtagctatgattgaagccgactggcgagagcccctcatacgattcttgacttctcaagaactcccccaagacaaagatgaggccgagcggatttcaaggcgaagcaaactttatgttatgcatgaagctgagttgtacaagagaagcccttcaggaattctgcagcgctgcgtatctttagaggaagggagacaattgctgaaagacatacattctgggatatgcggaaaccatgctgctgcacgcaccattgtcggcaaagcttaccggcagggttttttctggcctactgcagtgtccgacgccgacaaaatcgtgcgcacatgtgaaggttgccaatttttcgccagacaaattcatctaccagctcaagagttgcagaccatcccgctgtcttggccgtttgcggtttgggggctcgacatggttggcccgtttaaaaaggcagccggcggttacacgcatctctttgtggccattgataaattttccaagtggattgaagctaaaccggttgtcacaatcacagcagataacgctcgagacttcttcatcaacattgtgcatagatttggagtgcccaatcggatcatcactgataatggcagacaattcactggcggagtttttaaagacttttgtgaagactttggaattaagatttgctatgcctcagtggcgcatcccatgagcaatggacaggttgagcgagccaatggcatgatacttcaagggattaaagcgcgtgtttttgaccggctaaaaccctatgccggcaaatgggtgcaacagctgccatcggtactttggtctttacgtactacacccagtcgggccacaggccagtcactttttttccttgtctatggggcagaagcaatgttgccgagtgaagttgaattcgagtctttgcgttttcgaaattttcgtgaagaacgctacgaagaggaccgagtggatgacttacaccgattggaagaagtccgcgaagcggctttgattcagtcagctagatacttacaagggttgcggcgttatcataatcgcaatgttcgatcccgtgcctttttagtcggcgacctggttttgcggaaaattcaaactacacgagatcggcacaagttatctcctctatgggaagggccatttatcatctctgaagtcacccggccaggttcctatcgactcaagcgcgaagacagtactatcgtcgacaactcttggaacattgaacatcttcgtcgtttctacgcttaagcttatcattgtacttccctatcttgactgtcaacatcaagttttcttcttgaagttgtcagtcgggggctatcatcataataatggagtgtgattttttatcagtttaatttgcttacttggtctatcattgccttgtttggttttttctacttagtctgcgaggactgaaagtttttaatagcttctttgggttttaggctcaacaaagcttgataaaaacttttaagaaatcaaagacttggctagatttatcaagcacagcataaatacaccagtattgtacaaattatgcctccatttgctacattcatgctcagtcagaatcagtcctttcatcatcagagttattgttgctcggctgaaggtcgttgttgcggaattgatctacaacatcacttgcaatcttgtcagccgcattttgagcattactaataagatcaagagcagcttcttcgcttgtcccgtctgcaaagccatcaatggcgtcaatttcaatcctcgggtacaaggatttggtcatcgccaatgccatgctagctcccatacttccagctttcttgatattcttgaagtatacatccggtgcaactctcagcttgtcaaagatttcggttgcgtcaagtgcactcggaccattgttattaaggaacatagcttggacgagtggtgcagcaacattggcgacttcatctcttgctccttcaagccttttgatcttaccaaccaggacgtcaaactgagcttgagatttgattttacggtctacaaaacacatttataataagaatctgctgcattaaaaagaggaaagttcagattgtcagctggcagtaccttcaacctctttcaaggccgagtccctttgcgcagccagttctactttgtctcttttcagagcttcaatttgtttctccatttgagccattctggtggcttgcgctgtttgaaatccaaatggttgaggacacagttatgatggcctgaatcaatgggacagatctagagattaccttttgatgaaccactcagctcgtagtttgaatcctggagttgagcgattcggttccttaactctttctctgttttcttggcatgctctttggcctcgtgtagctggcccctaacggcttcaagagttcctaaatgaggaaccagcttttctaaggttgcggtcttggcctcattgcgaagatggattctctgcgcggtggttcatggattagttttgctaacgggaaaacaaagtcatcaaaggcagtcacctagaagacttacattcacaatgcgagtagcttctccaagtactttcttcagctggcacacttcctcatcttctttttggcgatttatgacgatgccggaaacttgagagttctcgtcccaccatttgagtaagataggaggacgagagtcatcagctgcctttatgcggagaatttcttcttcgtcgccgcctaatggacctgatgtattcccaagacattagacgaacaagctggagttattcagaacggcatcactcgagaagatgagttacctgaggatgtgcctagctgagcgtgaggtgatccctgctctttatccggagacccaatcaccgagtcattaccagcttttggtccttgagaagttgtcgcctgcgcttcagcttcaggaatctcttgatttagacccacatccgactggtttccagtcgggggttcttgggttgttgcggtttcagttgcttccgactggtttccagtcggcggctggtcactcggatcggccttgtcatccgaagcatgggcgctagtcggctggctttcggcagtcggctggttttcggcagtcggctcaacgtctttggataaatttggctctgtcacagccggatcaggatcttttccagttggatctatgtcggatggtttcctgcaaagtgtcctttcgacattcagcgtaatttctatgagagaagcatgtcaaagggagatggtaccgagaggtttatacctggaagatgttctaatctttggcatttgacggccagccagttttttcttgggcatggtacgctttgggagtttattaggcgagcccttgtccccagatttatcgtcgtcgccttcatcgttgtcgagcaccagttttctcttgcgagaacctgtctgtccagttggattggaggtttgaggttgcggatctggtctgatttttggccctccacctccctgaacggtgtgctgacgaggcgaccggcgctgagtgattgggggatcagatttcatcaacgcatattcctaaatgagatgcctccaaggttaattaattcaacatgaagacaagataatgttttggtcatagattgaagatttcagatgcatacctgcggaggcggattgaatgcattatatggcacaactggcagctgatgtgagtagctgacgacaatagcatttgagaaaattttatacatcctctccttcatgattttaaagtccagagagtctggttcttcacgattgggatcatgcttgccgtcgaactcgaatgctgtacgggatctttctttaattggtgccaatcggcatttgatgaaatgccgagtaatctgctctccttgcaagccttgttctttgagttttagcatgcggtccattaattccaaggcttgagcagcttcatctccgatcggaagagagttccaagtatcttggtacaccggaggaagacaagagtactcgggaagagcaggctcaggattctgaacataaaaccagttcgcatgccaccctttgtttgaggtcttgaagggcatagagaaatacttctggcttagagttcccctcaactgaaatcctgcccctccgactacacatggcttattcttgttcggttggggcttgagaaaaaagattcggcggaacagagcgaagtggggtttaattcccaagaaggcttcacaaacatggatgaaattggcgatatggactatggaatttgggtttaggtgatgcaagctgattccatagaagtttaatattccgcggaaaaattttgaggtcggaagagcgaagccgccatagaagaaatgagagaagaccacaatctcgtgtgtatcgggggtcggaaaaatctcaccgcacgctggccgccacccgatgatctccttggctgggagaacgccgtgcgccaccatctccttcaggttctcttccgttacgtcggacggcgcccattggccttcaaagctttctttctcctccgccatcgattttttccgaatgcgctgatttggttcgagggatggctagggagaggtgagggattgaggcggtggatcacgggaaggattctgatgcactttttgaaggtggatttgagcggaatggtgaaccctagtttgccggcgcagttctttactgtagcaggaagtggggaaaatggcgagagttccggcggggaagacgaagtgacgcttggatctcggaaatttcttgttaagggtatcggaagtgctaatgggcttaggcctgaacagtacctcagcccaatacttttaacagcgtggcccattgtgttccttagggacttaggcattttttgctttggcaatttatgcgcacaatagtgttgcccaatgctgataaaatcctttttatgcggtcatataattctttagaattattgcaatgcaaattaaaaggtgcccgacagaaaggtgttatactgctttttgttagctttattaggctacaaaagctgtctgggttaatttggaatgacttgtttttatcatagtcacttccttggtatgttatatacctattttcattatggtaaatagtcatagcctaggctattagacttattcattaccataatttttataatacttggtgggtaatctttagaattttatatttggatgtctatcaagtgtgttcattcgtgaaccttttagagtgttaaccactcggatttcttttattatggctaaaaagcagtcggctagaatgcctctttaggcgccgcgtatgcttttgccatctgatgcacgattgtgctattattttgttctcaactatatgtttagtttgttaactaatcacatagttgggggctacacctaattaggtgcatctattcgatgcactatattctttatcttttcgccctttacagtcttcgtcttcgctactcggcaggccttggcatgataagttttgaagcactcggattattatctttgagaaggctatgatggttgactgcaaaggtctcgggggctactgtggagatcatggatatcccatatctacacggcgatgatatttgggctgaatataggataccaaatatacatagaatatcttatttgtatctcgggtttgtttcttaacttgtacatcaaggaaacaccttgagacttagtcggttacgactgtattttatctgtatctgcatattccgttagggatatagattatcttttgtaacacggactccttcccatatataaggggggtccgggtgcctctaggggcagatgttgattttccctaaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagtttcgacaatcgattccttgttaaagtgttattttagagttgaacctctctattgtgagaaatcttggtgcggcttacttaaatgattggactgataacatcgacagtcaagcgttggttcctttcctgaaggtgttgagatgaagaacagacctctagagcaagactataagctaactatgtggaggaaagagagaaactattaactctcataatcatataatagctaactttacatttaagccaagataaatgcattaactacataagtgaaagaaagatagaagaaaaaaaaacaacctggcttatagctaattattatacatgttattagaattcaatagttagctctactactagacttgctcttaacgtgattggcggcgcctctatgatgaattctggaccttgggaaagcaatttatcacatggtaagtactccctccatccaaaagtcttaaacatattttattttctagttttttttcaaatgagatgggcatgtttgtagtctccatgcatcccagacttaaatgataagactgtcttttcaatttgcattggtaaattaaattattgaccagaacccaagcagtcatcttaatatgtatgtatgtatgtatgtatgtatgtatgtatgtatgtatgtatgtatgtatgtatgtatatagcttttggtctttgttatacacatatgagttaatttttctttggtcttggtgataatgccatagacttttggatggaggggtttatgagtttgttattgtccctaatttcaacatgttatctttgttacccatattgatttaatttttttcattattttccaattcttgaaatgtaatggatgtgtgcatctctagtttcttctgagtgtagagttaccacttcaattatctaaaaataataattaggtgatggttcaaaattggaattcaaattttctacttctagttaattaggactcagatatttcaaatacatgaaatgcacaattaattaagatgaatgcaaatgaaaccatttctataaaataaaaatccaaattggactgttacatatctatatatcctttatagttgggaccaaacgctcaacctacattgagacacatcaccctgtagaccttaaccattggatcatttttgaaatgcatatgtagctctttacttatttctattcatgactttaatatgttagcttttcatgcatgtgtcaattcatttgaataaccatggtccacaaaggttaatctattcatttaatatattcattacgaatgtatcatattgttgttacaggttgaatttgaattggttaaatacattattgtgattaggatggcaccaacagcatttaacgatgttctcataatattaaagcgtctaggcatcaaaagattttgtcctaaccatccatttaaaaatacaaagaagtaaaactaccataagaaattcatattctaaatattataaatagtgttttcattctttttatagctcaggtcatcaaaaattaaacattgttttatttctaggtactaaacatcaattttttttgttcattatttttaacgcatacatattttcaaagtcattagagtatgcacagccatcccgcaacaatgcgtggggaatcatctagtaagcatgtataacagtgctataggatttagtggggaatgtaatggcacaagcactattctcttttttagggtacaacgacacaaaactagatatcggcaaagtacttggactcggtttttctaggacgccgccactacaataaagtggcgtaagtaagattaacaaattacggcctcatgtttatgccgagttgaatgagagagaataggagaagccaattcgtagctagcttaagcataggcatgtaactgttataagaataaattattggcttagctatataaatgatatgacaaaagatatatatatatatatatatatatatatatatatatatatatatatatatatatatatagccagcatttggctctactattaacatctataagtaagccaagtatctttattaatttttgtatgagcgaggcatgcaattaatactatggatttatgtgataacgtgactatataactcatagagtaagtttaatagtagagctaaccccatataaggatattattagagctgattagctataaagttatcttcatcttttttttcctcctctctatttctcaatcttacttatatatttgatgcatttatcttcgagcacattaaagctaacttgtgcattagagctaatactttttatttttgtttgtttctctctccatcacatatatatgcttaaagcatgtttatagtcaaacattatacttgcttttaggaagaatagggcatttctttattggtctggatcctagcttgaagatggtaatacgaacacactctgtagagtaaaagtaaaagttactcagtccgccccaattcagtataagcatttttaggattttaaattaatatggggcattgattccaatgaaaaaaaatctatacattttcagataattaggtgcttaagagggaatctatgcattttaaaaattcaaaataacaattgattggtgactaaaagagaatcttttaccactactttataaaccatttttatcaacaccactttattcctaaagatggtctaaaagaaaagtcgcttacgaaaattcaccgggatccctggtcacaagctgctataaaaattgatctttatagatgatcgtaggaggacccttgtaaaaatataattatttcttgcttgacaacctgaccacccatgaaaaagccaacacattataaattgccaattcacccccctcccccacatctgttccctctctctctccccatacctcgatctcctcccccatctctctctaggagaagagcggcagtggcgatgttccatgcaaatgagggccatgacagtagcgaagggaaggggatgtgacaacaacaaaggggagcaacggtgatagtggaggagacaaatctggtatgacagtgcttgggagtgccagatccagtggtggtattgctttggaacactagatcctgacccatgtcaggtcgcctctctctcatgtaacaacagttatctccaacattacggcagaccactggatttggtggactaccatctcccagccaacattatcatactctccaggtcgttgctggatttcctgcacctttctaccaccgtccccaagtgacggagagaagtgggatcaccggaatccagtggttgcaggatcaagagctgcggtgaggtccatcagctcctagatctagcggtgcggtggagaagggggagacctgaagttggcctcagttgcgcagaatccggcagcgacagtgcatgtgagcagcggttgtggttcgacgaaggtgacgaaggccatgacgtgggctgcaaacgacaactagcaggggagcggtgcgaacgtcctgctgcttcatgttgtgacgacagtgactcctactactatggatgattgtattgtgttgttcatgtt

SEQ ID NO: 56931 - DNA, 2423 bp, Oryza sativa
gggtagcacccccgtcactgagcaaaggttactgatgtgagaaaatatctcaatcgggcatccggccgtcacggatgacacacatctcaatcgggccaacaataaagcccgtcacggattactctcatctctaacgggcctaaactatagcccgtcacagatgactcttatctcaattgggcctaaactatagcccgtcacggatgactctcatctcaatcgggtctaaattatagcccgttacggatgagtataatcaaaaaaaattgttttttggttagcctcaggcctttgctaggcacgcccgtgggccggtcttttctacacctggaacgcccgtgggccggtcttttctacacctggaaattctttccgggttggtcacccatcccgaaattgctccaccctaagcacgcttaacctcatagttctttggaatcgactttcggagaagtagttgtacattcattcacatacacaaccatcaatatatttaacacaaccacattcacataacatctattttgatcacatatttcacatccattcacatatttcaccagcaaaaccgagttaattggatcaaatatatatttagcaagtattaacatgatgaggaggcaaatcagacttctaggtaaaaataaattttgaattgaattttatgatactaaattaactcatatgaaaaaactgtcaaaaacaaagttgtagaactcattgagatctaccaattttattttggtcatttctccatccgggtttgattgaactatataaaatttggattttaaaatataagaaattcaaatattttttcgggtactaaatgatttcaaatagaaaaattgtcaacaacaaagttgtataactcatcaagatctataacttttattttgatcatttttctatatgacattttttgaacagtttgaatttgaatttgaaaatatgacaacttcaaacaatattttcaaataccaaatgatttcaaatggaaaagtcatcaacaacacagttgtataacttatcaagatttacaacttttattttggtcatttctctatgtaacatttattgaacagtttgaatttgaatttgaaaatatgacaacttcaaacaacaatttcaaatactaaatgatttcaattgaaaatgtcatcaacaacaaagttgtataactcatcaagatctataacttttattttggttatttcttcatccgataaagtgataataacattgttcacaaaattcacatatctctcatctggttttataaactataacgtagatatgaccatcatctgtgacgggcgccaacttgaggccagattgagatgtggaatgttatctcaatcgggtctaaactacagcccgtcactgatatgtgtcatccgtgacgggcctaagttatctcaatagggccgaaaaaaggcccgattaagatgactttcatgtgacggccgctaatttcaagtatgttagaggccgtcacagatggaaggttctgtactgatgctaattgtccacctcattgcctcatgtgtcaaccatttattccatgaagttttgtttcttatgacactattgggtcgccccttattacagtttaaacttattacagctttgttcctgaaatatctataaatatccaaataccactaacatcagcatgcaactatatatgtaagtaagaacgagcagtattcaatattgtcacatcaacccaaaatcgaccatctgcacaattcaactttgcattcaccttcccgctttgattataggtggtgattgctgcagaggttcgatctcgttctgcctgccgaactcatgggtggtagaccctgagtagctgctggtgacatagcttctattaccgtccatcatttgccactcagtgatgtagcttggctttgtgaccaccttaggtacctcaacttctccggtgagcattgccacgaccttcgacattggtggtcgctgatgtggtgagccctgcgtgcagtgcagcgcaacacggatgactctaaaagcttcatccttgttgaatcccttgagatttgggtcaaggattctgagagcttgctccttttcatactggtcccaggcctatagatgaccataggtttagtacacaagagataatacaaagaaattaactttttttatcgcttagggggttcatggagggcaaacacaaaaaaggatagatgggcaagtgttggcttgatctaggatgaaatgagactagattagttcatattgattgcttgcttgctaattgatgcatgctatacccttttgtaggtatgtctagctagttgattcaattgatctatccctaatacatggaatatatccataaggggtaactcgacaataaggaaattaactattcttatctctaattttaaactatt

SEQ ID NO: 56932 - DNA, 6434 bp, Oryza sativa
aaatcaagtatattcatatgtgctggcaatttgcagaagtgaaactcaccaaagattgcttgatccaggcttccattttcaaggtactcataaaccaacaatggtgtgttgctgtcaatgcaacatccatgcagtttcacaagattccggtgttgcacagcagaaattgttgcaacctccgtaacaaattggcttttgccttgatgagatgattcagaaagttgtttcacagctataactcttccatcgggtagcttaccctgttgaatgaagaaccgtctaaagttacatgtatattttgaacgtggagaagaaagttgcacttaataccaaatcagacaattgagggaaatagacaaccttatacactggcccgtatccgccttccccgataatgttttgagaattaaaattgtctgtggctagcttgagttcagagttactgaagacatcaggtcgtccgaccaggttgtacagttctgtatttttcattccagcagatggtaaagaacaaataatttgaaaattatgttgtctgaataactgtactaaaaaggataccttctttctgctttgccattgttcttcgcttctttatccacataaatattccaaataagcctgctaatcctaaaactgaagcgccagtcaatattccagcaatttcacctgctttgcttcccttttttggtacaccatttcgcacagttggagtaaaatctgaaaataaatgtttttacttactagagccaatgtagcctacattgaagttaatataacaggtttgcttacttggagtgacgcttaatgctgagatcatcggtccgtagtaaccttgggtaggtatgccagaagtgcccttgccagcccagaagagatggatctcgaggaagttttttaacacggttgccgtgtaagtcctgttaattgcggtaaaagattttccaccagctgtcttccttatatcgaaattcttttctttcagagcaccctatgcaaatgttagtaatattttcagatatagaataaaagacttggtaaaccaattgctatacaatgcactcaatctgtacctggacatatatgtcaaaaattctccttcctaagcttagccaagtttgcgtgtctggaaaagcaaactctgcgaattgaagcataacagtgtaatttccattctcaagtccaagcccataatatctcagtgaagatggtgacatccttgcagtctcgaacaattttgagtcgactgcagtctgaaaatgctcagagctatatattatgtccattctatccgtggcttggtaaaagtatccaacattgctgacaccccatcttatttgatcagtaacataatatgatgcatccccaaggtttgtagcatctgcttcatatatggtattatctgagcccctagtagatatatcactgccgcagtcaaccgcaaacgaataatctggaattaagatgtgcaaaattatagccagtattcaaaatcatagcatctgtgcaaaactataaccattatccgaaatcctttcattctgttaactactacagataacaggagtggcaaatatacatttgggagatccacggaaacaaggagtgtcttgttggaggcagtttagtccggaaggtatactgtgcataatttgaattgaaaagtaaaagccatgaaaaagattttattacagttaataaatggcgaaagtataagtaaattttataagtacctgtttttggtgctaccaagaacaatgttgtttgccaccaaattccttgttcaaataaaacattagaatatctatttttgaacttggaaacaaaaatttgaaacttttacactcacaattgcaaattattctgggtagcccaagaaggagaggttccggtgagatgattgtaggaaaaatctctggaaacagcccagtattattacaattgaactgaatatatcattctattatgaaaatattttgtgctataatgatatgtcgatacttattgacgtacatcacttttaaagaagagcttataacatcaggcaaagttcctatgaggctattgttcccaagaaacctgaattgtgcagaatacaaaatgatgaaacatggacataatcttatcaggtgtttctatgaatttaattcatttaaataaagaatttttttacaggaattgaagcattcctagattcaggatggactgaggaacttggcctgtaatattgttaaaactcaagtccctgtgccacaggaaagaaacattacttgaacaaatacttatcaattccaggaaatgaccaaaagcattatagcaggcaccatggccaataatgaaaacatacagcatggttaacgctgcaaacttcgaaaaatctactgtttcaaggttttccgatatcctgcagttccttaatactctgtaaaaatgaaatcaaatataggtgacttgtaactttgacaatattgtaagctctaatgctctatagaaaaaggcatcacatacaagttggtcaaagatgtcagattactgataaatcccagtgaagaactcccatttacaatatcaccaatccgtctgctcaattgtatttcacaaatcagttatcaagcttgaccttctaactttctaagccatcaaatgtccaaagatgtcaaaaaacaatgtacttacaagtttgttagtttggtcagattggacaaacttgcaggaattggcccttcaaaagaatttccttggaaagccctacaagttcatactttcagaaaataaagtagggacttgcaaggtccaaattagtataagagaatgcaagctctatgtatcaacatgccatgtagacaaatttaatggtatgcagatatctgcatttctattcagtgacaactgaaaggtgaaaaatgctattgcccgagttcaaatggaaaggacatatacagaaaatttatgcttgacaatttccccgtctctaaaataagacactgtataacgctttaccaatttaatatagtaaatcttacagatcttccaattcagtcaagctccccaagtaatccggtaatttccctgtgaattcattatctgacgctttcctgcaaacagaccaaaatatttgacatttagcatatgaaaacacaatgaaaataacagttgaggatctgttattgactttacaagtacttcaggttcttaagcttggagatcgtcgaaggaaacgggccgctgaatccagaactatcaatgtacctgttattgaaacatgcagtaattatcaagttgaacactagatctctccattccaaatttagttcttagaaattggaagttataagtgaggcatttacaactgctcaagtttggtcaagttgcccagttcttcaggaagttcaccagtaaagttgtccaggctaatgcccctgaatcaagaagaaatatttcaggagtgatattaattatttgggttcaactgctaacagaagaggggcatagttttccaaataagccatctgagccactgttcaccagtacaatatttacttgaaaatactgacatgccaaacatatgacttatgagttttttttatagcttattgtcaataagttatgcgattaacaatttccctataattatattagtttacctagtccataatatatatatatatatagctctgattgatctcaaataaaagatctcttacagtgagaggagattggtgaggttcccaagttccttcggaagttgtccagacagtggattgaaacccaagccccttcaaatgatgaaagataattaaaacataacacccaccaatggatggtgtattaatccatagcttgacatgtaactcctacaaatatttcatggaagcaaattttccaatgaatgatgggatggcaccagtcaaataattctgattcaggttcctgaaacaacaccgggaacatcaagtccattagcaaacacaaaatcttgcaactaccatttgctgttttttgccttgcaatcaaaagttaattattcaaaggattttttacggtacaccaactctttccaaaccatgtattttgcatcgacggttcatattactcttacctcataggtggtaagtggacctttatgtgttctaatgtcgattattatgatagaaggaaatgaaatatgttttcaaatttgaatgtatacaatcagttctgtaagaaaacaaataaaatgctacaactgaaattctgaacttcaaatatatttggcatctaattatatttcctgtctgtttcacaagatatcaatcaatgattcagagtctaataagagtatcagttttcattcttctgttttgttttagtataaaactttgtgttatgattactttggatcctagatatatttggtatatttatttgaactttgaattcaggagcttcagttgagttagtgaaagattccacgtttttgtagctagacaacatcactgattacattagaaggataatacttttgcctgatttattaatggcaggacagaacattttctcattagggcaaagccatcaatatcagtatagtgatgagtattttgttagagctcttacctctaaagatgttagatggagccccctaaaaagaattcttatattcatggggttaaaactatgtattctacaaaacattgacatacagcttaacaaacttcattatcaatattaacattacaagtcatagatccatacaggtcttgtagaaaggtgagattctgtagctctgcaggtattcgaccaacaacgtttaactttcttactctcctgcaaaacacacaagtaatattgataagtaaaaggaataactccaatttttccacttttgaaaatagaagtccaattttggaccttgattttgcccctatataaacaaccatttgattttgccccaagaacatgcaaaacaaggtcagttgaccccggccggacaatggattactcttttttatctccaaaaaaatggattactcccgttgtgattcagcatgcactaactttgggatggactggtgtggttcatcttttcctcggagacattcatattgaattataaatgagaaaatcgttggccagtaattgtgaagaccaaattcctgattggatggggaaccaaatgcctctgcgtccctctaatggaatggtgtttgctttagcttgtatgcaagagttggtaaaaggcctttacataagatctataataaattatatgaaaaggtagacacatgaattactgctaaatataaatatattctagtaacctgattgcaaaaacagtaatgtaaattaacatggtaaagtcaagcacgtcaagctatggctctcaatctagtactatcctcaggtgtaaatagatctgaaaacgaaaggaagaacttttatatcaatggtattaaggaggtgagtctctaaatagaggataagattaatacactcaatagcatataaataattctcaaatgacacaatgtaattctcaatagcaagtggcatgtctaaagagagggatcaaaattttctgacaagtcaacagtacacgaaaatattgataaccatggttaagcatgactaagtggccatcttagatgacaattgcacccaacctagaggcaggatccgaagcatctagttcctggagatacaacgtcattctcagtaattcgggtcaacatagggtctagaaggagcagtaattctcagtaaataaaggtctagaaggagcagcatacagtaacacatagggatttgtgtgctggccacacaaagacaagaaagcaaataacgaatcagcagcaggaacgcatgcatgcatgcataaaaattgcttcgtgcttcacagtcatattgaatggccagccgattaatgctatcagctcactacgatcttttcctctcacaaaaacatgtgggctctagattttcttatttccaattagtttccagaaaatatgaaattcacaagttggaacttttattaattctctgttagataattctaacaatatacactttcacagacagattagtctggaatgactccaccattatagaaactcatagatgggttagggacagcctgtgatgaccctttcagacctttttcctagtagtgtgccggtttaagtctcaataggtcatttaatatactagccaaatacccgtgcgttgcaacggattatcaaaaatagaaaaaaaaaaagcagttctcatggttgaaaaaggaatatttatctctacttggttcaaacaagattcttcatattaaaaagtaaaacataggccagctattcttgtagaggttggttagtacaatgacctcatgcagtgtaccttatgacctcatctgtcaatggtgatggtggtgtagtgtaccccatggtcccatatgtcaatgg

SEQ ID NO: 56933 - DNA, 2237 bp, Oryza sativa
gatcaggctttggctggtactaaaccagacaagccagtgttccctttttttttccaattaaccggtttgcctggttgagttatttacgctatcgtaaaatctacgcaggggcaagtagcagatgcacatttgttgaacttgatgacacctagaaatcaagcaaccaacaatacttgcaggttcagcacgacatgggctatttcaggcatattgcatcgaacaccttgtatgtgcagctgatcaaaccaagacaagaaggcaagcttacagtttgataatatggcagatggtgttgtcgttggaagagcagtcacacttgatggcagggtcttttgggtagttatcccagtcggaattgtcagaggctacaccgctgcagggctcaccactgatgttccattccgatggtgccgtcaggccccatctccccattattgtgtttagtgctgacactgggccaataaactggtattagtatttatataatatgaatgcataactatgcaatctagtaaatcactttaagctgcatttggatcaatgatatgggcgtggggtcgcagaattggaaccaaaatcctggcagaaaggtatttgggatctcatggaaattgaattattgattccaacaaaattccaaacagtcagatgagagcttatgggattttttgccagaaaataggaaaatgattattttcccatacagcgtttactactacttaaaagctcataggtgccagttttagagggcttataggtccggtaccggcaccaattagaaccagtctaatttagaaccaagtttgtggcactataggcctataggggtgcacctgtttttttatttttgcaggtgctaaaaaaattaaaaaaaatgatatttttattaggcacctatacaataactctctcatcccacaagtcacatgattttttcaacccataatcacatacatgtctcatggaagattcaaactcaagaccactcacttcacacaaagtcacattaccatctcacctacaaccacttcttgtcttggaaataaatgctattcctttgagaccactatcatccaaatttataatccatatctaacaccatagataagctcaaatgaaaagtttgtcagttacaaaaatgtagatctcatccatatctacaatttttatataggttttgtctccacccgatatcgtttagaaattttaaatatccactcatgcaactagatttgagaccttgtaacacattttcggacatccaaacatccttcaataaaaaagtcataaactacaaagttgtagatctcgtcgagctctacaaatttgatataaagcttatcttcatacgactttatatgaaaaagttagataaaacacacacatatatgagttgtgtcatcataggtgcagttttaattgtaagcaggcacctatgggctcataggtaccggtttttattaagaaccagtacatatgtgatgcccatatgttccggatcataataaaaaccagtacctatgataccgtagttataggtgccggtttatgataagaacgggcacctatgtgttgtctaggtaacggtttgttatgagaaccggcacctatgactttggaggactattgatgccggtttttgttacaaactggtaccaataagtgtttgtaggtaccggctcttaattttacacaaaaaaaaaaaggaaaaagctttataggtgtcagttttaagtaaaccagcacctataaggttggtctctatggggtgttttgtagtaatggttaaaccaaactgaaaatcctatggttaaggaatttaatgaggctttcacgaatttatcattggcttccatatcatgatggtgagttaaaggggcgcacttgcgggtgtatacatgtgttgtgcgtcaggagtggtgatgtatgtctgcatgtgattgcaaaaaaacctatagttcatgcaacacaaacaaattctcacaccatttacatgaatcatttgctctttctctttaccgcactattaatgggcctactatctactcttctttttttcacttgtaccaacactactttaactgggccatccctgtgtttgaggtgatgtgttttacaacaggccacgcacatatgcttgttttgctatacatctttaaactttaatatctcttttttgaataaataaattcctaaatacttaaaaatatatatgacataatatcggggctgcagga

SEQ ID NO: 56934 - DNA, 19270 bp, Oryza sativa
tccaaactcgtactgttggaaaattgtgcgcgtgaaaatattgtaaccaaaatctgaaaagaaatgaggtacaatattgggagtgttgtattgtagtaatagaagacttgactaattaagtcggatcctatcaatccctcttagggattgacttgactaattaaatcggatcttactagtctctcccttagaaaaaaaataaacgactcgtacgagacggtgcgaaattctattgatagtgtagaaaaagtctctcccttagggcttctatcaacgcttcgttgatagtgagcatgcgtgcgagtgaatgaccgagcatcccaggcggccctaagttgggcacaagctggatgtaggaagacttgactaattaagtcggaccctatcaatctctcttaggaattgatatgactaattaagttggatcctactagtctttctcttaaagacatatacaaaaggtagagtctgatatgagctcttagttaatacatactcacttatacaatattctcctagaatagttgagacaacaaaatctcttcacctttaatgcacacaaatatttttttattactctttttttcgttttattcttcccaagaaacaaaatattacgacttgactatgactgttgttatgcgtagcaaccatatcccccctccccctcacgttacttaatttactttgcatgaaaacagaagaaatacgttaatgagtagcgttgtatgtgcccttagagcatctccaacagtctcttcaaatctaactctccaaatgtctatttgaccaactctctgtctaatttagcaagtcaaacttgtgtttactccaacagcctcctcattcaccctctctattgcaagtatatgacagtgggacccacacgtcagtctctataaccctcttttcccctagccccctccgacctcatctgcagctgccatctaccgcggtaccgccgccgctcgggctctgctcccctctgccgccgccgctctggctccgccgccaaccgctgccaccatccgctggcgccggcgccactaccgctctggctccgtcgccatcctccgccgccatcgccactcgggctccgtccccatccatcgccgccatccgtcgccgctattcgggctccatcgccgccgccgctcgacggcgagggacgacgaagattacagcgacggcgagaggggagaagccaacggcggcgaatccgtgcgcaacgaaggcccctcttcgcctgcaactcgagaggcgataatatccgcgcgacggcgactacacagacgacagcggtggtggctcatgacgacaacctcaacaacggcgaccttgacgatgacccggggcgtgaaggcggaggccgcgcggccccgaatccatgccgccggccaaatccgcgcgaggtcgtgcggctggccaaatccggcaggggtggataccgcgcagaggtagagtcctccagacgacggcggccgcggctagcgccgacgcagacgacgacggcggtggttggcgacgatgaccttggcaagcacagttgatgggcgacggcgagcgtacaggaggccggggcggcgtcggacagagaagactagaagaggggagatggagaaagagatagaaagtgggacccacagtggggcccaccgtttggccaggggaggaggctggctacatttggccatccaaatagcttagcagttcaaatagcaagctgttggagtgagttttttcactgtttgagctaaaatttagcttggagagccatctagcaactctgttgagttgctcatctcatacggccacaagctgcacgcaggaagacttgaacgagcatctcatacggccataggctgcatgcagcttaatgcttgacttgactaatgaagtccgatcctttcagtctctctctcaaggctttataccaatctctctcttggcttcttcgttggtggtttgggtgggattgggcatggtatatttccgcgtcgacctcgcgacggtgctcttatcgttccgaccaccgctgcagcgcgcgtcccaggttgttctctcgcaagtccaaaaccgaattgttctgatttgtttctctataatgttacactgttttaagcttatttcctttttcactgtcgaattataaattcgatctcgagtttcaggatgaagaacgagcatgccggtaaactaaatttgctgccagcacttcaccgggcctgcttgccatgcggtgagacatcctaaatttcacccctagtaagcatgtgcacgtaattagaacgcgaatcaaaagcacaatacgatacagacgaaggatctgcccaaaactggatatatatttatggtcaaagtaaaccaacaacgatgaaaacagaattaagctagtattgcagtataaggagccctcgattgctgaatgtacaaaatctcttgagcatctaaaaatctggatctccagtgcaacaagaatgtctgagaagcagtacactgtcagtagctaaacactgcaccttagtctcttccacatgacaggagatgaaacatcttcccaaccaaaaggtaccttcggccttcctcaaatgcagcctggatacaagttgaagaactggttaggccaacggcaaaagcatcaagctcacacttccaagattaagggcccctatgaatcacagaaatgagaaaacggagaaataggaaaaacataggattctgacaggaatgtaagtgtaaaacagaggattgcaaaacatagaaatgactgtttgattgggccgtaggaaaaacacaagagtttgagataaagactcgaaggattctttccattcatgttaaatttcctccaaaacttgcatggaaagagacattccataggaattttataggatttcataggattcattccttctatacaaagggctatatatgttaaatttcctccaaaacttgcatggaaagagacattccataggaattttataggatttcataggattcattccttccatacaaagggctatatatgttaaatttcctccaaaacttgcatggaaagagacattccataggaattttataggatttcataggattcattccttccattcaaagggctatataggaaaaattcctattaggaatgaagtcatctaaaattcttatgaatttcctttgaatcaaagaggacctaactcacttctatgtgtgtataatagtgtaaaatatatcacaaataattgcaaatgaacacttgactacttgagcaacttgaataagagtgctgtaaaaaacatactgagcctgttaagatacaatgttaatgctttgctgctgaaggacatcttactatatcacaaataattgcaaatgaacacttgactacttgagcaacttgaataagagtgctgtaaaaaacatactgagcctggtaagatacaatgttaatgctttgctgctgaaggacatcttacctcagagtttcacaacttcttgctttaaatcttgatgttgaagtagtcagaatcaaaatggtgcagccttacatatccatcttcaccaccactcgagaagctgttaacaccgtattatacatgaagaactgaagctcaaagcaaaacactttctgaacaacataaattaaccatgacatgtgagaaaatatgcttgaagaatataaactagctatcacataaagcagctctcataaattttctttttcaccaatagaaatcagaatagcgtatatgaccaaatctgattggcaacaatcactgagccaccatgagataaaataaaaatatacagcaatcatcagaaggccagcttagtgcccccagcaagacatcaccaaatgagaccaagtataaaccttcatcaatctaacttgcaatttaaaaaatatatattttgacatactttacaattttcagataaagaaatagtggctcccaatggaaaatgcattgcaaatggtcatgaagccattaccttatgcacatacactcaatcaatacatgaaaccttgcatcaacataataattatataaatatggaggtgatagatacactcaatcaatacatgaaaccttgcatcaacataataattatataaatatggaggtgatagataactatgtttcttcctaggatgcctcgtggatgttgaggacagaaaaggtagctctcataagtcttatttttcaacagctccaatcagaatagcgtataaaaccaatgtgattggttgaaatcacagagctttgaaaccaacaggcacatacgacgcttcaaacagctatactaagaatgcaactcaatttcacactaacaggttatcaaattaaatattggacatggcatagctctcatattcttatttgtcatcaaacagtcagcatagcgtatattgccaatgaaaacggctgcaatcactgagctatgtatgacaagaaaagtacttcaacaagacaaatagaaacaaaaaaaacataaggattcaatggagaacaaaaatgtcaaacagataggaagaccaatgaaccaatttaagggacaaatctagagaggcggtgggttaaaataacaggtgaatgatgaatagttgtacaacaatataaaagtcaaaaaaacttttgagtaaaaagaagagaaatacccatgtaaacacagccagtagaaccacaagaatgtgctaaaaatccatgtggcaggttaaaatacaaaatagacacctgctctcataatgtttatgacatcttaatatgattcagaatagcgcatattgccatggattaacatggcttaatcattgagcagaaaacacacaaagtaatatgaaacaaaaagctaatcgagaacataagtgcggtggtagaacataaatatagcattcatataatattacacatgtattaagaatattacctccgtccatcaggattaaatgccagtgcgttaattggtccaaaatggccttttacaccaccaatttcctcttgcaaaatctgaaagtaaaatataagtgtcttattgctaaacgaaaaaataacattgcaaaagaaaactacactatcattgttctcactaaaacataagatagaaaccatgtgcaaagaactgaccttgtgaaagaatttcgcttcaaattttcccgctcgacgatctgtcatagtcacattcatcgcatcttgaccacctccgataaccacctaacacaacaaagatttcttgtgacttatatagctggaataatgataacaagaactgactactcattacagcaacattacaggtggatagttcagatgtagccaatagtacatttttccaatggtagtaaaaatacacatccttgatagccaacagcactcaaataaatatggaattgtgctaaatccagggtcaaaagatgtgctggacaggtatataggtgccttgaacttcccattgtatattaattgttatttatgcatgtaaaagtactaattgcagataataaacatgtgaatgaatcatttgttgctctcgtcttggtgaaactaatcacacaaagaaaatgatttgaaactgagaacaaaaaatgtggcagcaggagaagagaagaaaccagaatcttcggaaaaaagcacaagtcatatccaacttcaacttataaggaggaccacagcaaagcaaaatacagagacagagagtaaaggtcatttcaatccctactacatattgagatcatatgcatgtagcatgagataacaccaagtaatttaaagcatgaccatgtattttgattaaaaaaatctatagaagaacttacgaaaatgtagataaaaattaggtattacataggcacatacatggtctagaagaggagaaatgtcaacagcattaacaggtcgctcggtgacatatgtcttgatcagggtcagagttcttgtatcccatagctagccagatagcaatgtgcatgtcaggaaataatcatatttgtagcacaaagtgcaaacaattggaagacatgattatgctagccacatcaacaaaatatcaccttagcagacttatccaaggagcctgttaggaaatgtgaccaatctgcagattttgaaagtgaagtaattgttttctggtgtccttgttctttgtctgactcattcagacatgttccagtctgcacatgccaaaccaaacagaatttaaaaatgcattcaatgatagagttgacggaaaaacatgttcctacccatacaattaaatagttggcatgtttaataaaaggtaaaatgacaacccagcgtacattatgtatgaatgtagcatgttttcaattagtgcacaaacacaaactaccattttgtcgttggcaccatattgccagagtcagtttaaataaaacaagaaacctgaaaggtatttatcgctggttcaatagtcactaacatatgtcatgttaattcataatgttgccatcaataacaaactgacaatcacacatacgtaacaatgatttttcaaccatatcgatgagcatttttaactattaaacaacttttcacttgtcagtccagatacatgtcaaatgatcctacaagagcgctacaggtccacataccacagttataagcaaattatcgcattcctgaaaagcaccagaagcctagtactagcgatgagtttgtagcaccaacgatggttagtagaactatgtgcaaatgttgtaaatgcaagctaacctcagtgtcccaaatgcggatggtggcatcctcaccggcggtgatgatggtcctgttcaacggcccccatacagccctgttaatcctccccttgatgccagaaatcacgagaagagactcctccgactcttcatccacaaccacacacttcagaacccacgttgttggggggaattgttagggaggaatatgagtttgaggggtggggattaagtcaattgtttggttggaggacatgggagtttttaggagggattgggaaggggagtttaagagtgaactcccaccttttcaatacctggataggggcacgtaattggaagggaatttcctcctaagtatcacgagatgtttctcatcatctcatctctactactccctccatttcatattataagtcgctttcacttttttttccctagtcaaacttaagtttatagaataatttagcaatatcttcaacataaaacaaacatattatcaaaatatattaaatgttagtttgaatgaaactaatatcatgctatagatgttaaatttttctataaacttaatcaaacttaaagaagttcgactagaaaaaagttatagtgacttatattataatgtgaaacggagggagttactaaaatgaaactcccatgaccaatccctccaactcccaatccaaatagaagccaccagaagctttcgaaacataaatagaaggttagagaagaggcatcttacggtcatcggggtcgtcggcgatgcgcttgacctgggcggtgggcacgttgcccatgaagttgtcggtggtgatgacggcgaggccgtcgccgatggcgaactcgacggagcgggcgggggcgtcgaagcggaaggtgaagagctccgccccggtctggacgtcccagagcttggcggtctggtcggcgctgccggtgatgaggcgggtggagtcgcgggagacgtcgcaggaccagacggcgccgttgtggccgctgtaggtgccgaggcggtcgccgttgtcggcgaaccagacgttgggggtgtggtccttggcgcacgagaagaggaggtccccgtcgcggttgtaccggaggaacgtcagcggccgctcgtgccccttcatcaggatcggcctcatcttctcttcgccgccgccgccgccgccgccggggaggatgggtggttagggttagggaggtgggggttctggaactctggaaaaccctagctcgcgggtgggttgggctgcctggtagtgcgtgtctgtccgaacgggagggagggcttattaatagccgagttgttgggccgtcctggcccaatagcttactcaatattttggattttcgagtttgtttacttgaaaatcatcttaccaacatttagtaaaaaaaaatttggacatgttaccaaattttgttagtattggatatgtttagtttgaacctttctaaaatttggtagtgctatatattgtgaaacggatgaagtatatgttacctactaaaatttgatacggttaaaagtgaacatcctctttaattattttcttcggtgtccaatacgcacgatggtaggctagctatttggtggacgtccgtcaaatggaagattagtctaattagctcaaaaccgtatgagaaacgctacatgcgtgttgtatataaagcatatgagaaacgcgcagggatttttcagctagctccacaagatgtgggctagccgatctgtgtttgaagtctcacttcttttcattatgtgatattagatcattccctaatattcgcttttttatatataaagcatataaatgttaactatgatatgctacatatgcagattgacttagctagtagtagttctttattggtgagaggccgttttgttttgcatgtttagtttttagttgatcggttgatcattattaggctcttgagtagaaaagtactcgcgtgctgttgtaaggtaagttcgcatgagtattttatgtaggttaataatactcttgtttcggacaaggctatggttaaaatttaaaacctttaactacaaataatatctaaaatattttatcttacatatatgaaaccatatgactagtcttataaaatactttaacaaaaacatgtattcattgatattattatatactcccttcatccaaaagttcaaagacctatttcttctgtcaccaagactaagaagtaattaactcatctatcatgtgacaaaacctataaaagcaagtttaatagtacagctaactattggctctaaattacatagtcaatttaatagtcaattcatacaatatgtacctatgtctggtcccacctgtcatgcacacatgcatcttagagtccgtgctgtagctggctacaaatctgtaacccgctgcttttctctctcatcttttatctccttaaaatatgtttatagctgacttatagtttgctattgtacctactctaaactatacacatgcacgcatgcatgcaatcaataagtattaagatggtttcttgattctggttaacaatttaatttagcacatagatactatagataaggtttagacttttggaaaaaccaaaaaaattaaataggtcataaacttttggaattttttagaactataaacttttggatagagggagtatatattgtactgaaaaatggtgatcaaagttgctcttagagttttttttttttcaaaattatattactatcaacccagagaaaataatttgtaaacttccgcgtacacacaagtattcaaacttaaatgtatggcataaatgactcatgctaatactataaaatttcaacttttggacacaactgtctcctacttacccctcccaacatgtacttaccagaactagtgcatcctccatctctgttgaggcagagtagatgaggctattgtacttaccataactttcagctggaccggctggatgcattcagagtaaagtcatatagggtgtgtttggttgcctgcatcaggcttggcctatatccggagatgcaacttccgcttgtttggttagtaagtacgagtaccgaacatctcgattagtaagtactgcacagccttgctgcttgactccagaagcatagcaagacgcttggaggatttggtgcgtggaatagatagatatgtctaaaccattgcttacactttgcagagacacatattgagtttgttatccttgccaagtttatatatagaagccgtgaaaaggtaaaattcttcggttgcatttacgtttcccctatatttacccacttgcactactgttctatacctcacctcagttaccaagtgagacttgtcgcagtctcgcacataaactcgtccacgcatttgatcttccacatctcatcatccatgccccaatcggaatgcggtctgagccatatgcttctcaatatacctagcatgttggcttttaagtgtcagcgatatatatacttacgataccgagatacgtacaaccactactaacaaaaccattttttgtgaaggcaattttagatttttgcttgatggaatttagagccgccacaaagcaaagaccagtgaagattaagatctatcgaccgccaacaaaaattcgtcttaaaccacccgccaacaaagatccatttttactggcggttgccttacaccgaccgccagtgaaaattcattttcgctggcggctgtgttaaatcgaccgccagcgaaaattaaaccatgcagttgccctagccgccagcaaaaaggaaactcgaaaagcaaaaacatataaaataaaacactgctccgtccacctccgtcaacactccatccacaaatctacataaatttacatcaacaatttacagccaaaaatttccattcacccaagcattcaagcatcacaaatatcaccacattaagagggagagggggtggtggcggcgggggaaggggaggagggatgagcgggagagagagagagagagacagagagagagacctgtggagatgtcgcctcgcgcctccccgtcctgagcgccgccgcccgcgcccgagcccgcgccggtgcccacgcccgagcaccgctgccctctcctccatcgctcgcgcccaagcgccgccgccctttcctccgtcgcctgcacccaagcaccgccgcccaagcccgagctcgccgcccggcgccgactttggaccgtcctgagctcgccgccgtcgtctcctccgtcgcccgcgcccgagagccgccgcccacacccgagctcgcgctccgccgcctgcgccccgtgcccgagggataccgccctgtggatctggagggaggaggagatgttggatctggagggactagggaagaggagagagttgttggataaggatgggtaggtggataattaaagagcggtgggggcgcggtgaatttttaatggcgtgattctttcaaggcggcgctcttcattaggttaagaagaccgccagtaaaaataggattatttttgtaagcggacttcttgacctacaaccagcgaaaatggatttttattggcggtccaaaaccctctatccctcattataatttcgcaagcggatttttcatttaatcgccagcgaaaaaataggataccgtcatgaaaaatcgtttttttagtagtgaaccaaacttatatgctatagaaaataacattaaaatcaccataaagtacaggagtgtagtaaatagtagatgggcaaataatgtacattattagataaatagtggtctcatttgtccactttattatagctaattgctatgggggtgctaatcagcgcatgcgcgctggatgggcaagtctcccacattgtctccattgtatattttcccgggcgtctctctgtccacacagagaatgagcagagcggagcgagtgacgatgacggcagtgcccctcttcggcgctagcgagaccgtttggtaaccagggtactctttctgtaccaccgcttaacaccgtgacaccaccccgcctcgccagcactgacatgcatcaacgggtctacgcaaccccactgagccagcctcctcccgactcccgtcccatttgcctcgcttttcccccacaatcagcaccaacgtatcaccgctaccgaccccatggctccggctgcacctccattgtttgcccttgtccactatctaccaccggtccaccgcctcccaggccactcctgtaagcccgatctccacttccaagtgccaccctcccctaaccccacccctgaaaccctgacctgacacttgttgtcatgctatcgaaaagctgttcacgagatggctaggtcatgcaattaagctttccgcggttggcctgcttgaattgtaaagataaaaattccatttgttaaatatatatgctgcatatttttttaatataatgtattgctagtttgcgccatgaatagatttttgtgatgaagttacagctgatgccccttcccccgctcgagcattttctttttcttttttgcgattttcttttttcgactttggcgactccgtccctcggcacgttttccttttttttttgttttttcgtttttcttaatcttcggcacacataataaatcttgaaagttttcaaatcttgacttaaaagttttcaaatttcgagttgaaagtttcaagtctaagttaaaagtttttcgaatttgagatgacaagtttaaagttttcaaaatttgacttaaaaatttaaattttgagttgaagttttcaaagtttgagttgaatgttttcaaaattttacttaaaagtttaaatcttgagttaaattttttttagttttaatttgaaagttcaaatttagagtttagagttttaaaatttgggtatgatttttaatttttttaatagaaagttttaatttttatttgaaagtttcaggtttaatttttttttaatccgttagtaaaaataacgaccttcgaggaaaaaaaagaaaaaactaccttgattactactcccgagaaagaaaagggcttatcgtagatgggctgaaaaacgacgtgcgtgtgacctcccttgccaacgtgaattaggggctattcagattatagccaaaataaaccttaccaatattaaaattttggtaagttagtgatattattaaaattttggtagaatttcttatgtatttaccaaagtttggcataaaactaaatatatacacatttttgataactttatttaaaaaaggtatggtttgaaaatggaaaaatggcatcaatctgaacagttccttatgaattctgcgggagacaagcctatgctttcaccatgcagaaatctaccagcaatctttgcaaaactaaaaggagacaagatgcatcctaatgaacaatctgttgggccattctgacaatccttgagctttggcaaatatagtaccgaagtatatttttgcaactgtaacccttaacccaacatatatgtattacaacctcatcattaacgtactatatgtaccaaaatactctcagatgttcaactagaatactactagtaggaatagaatcatagggttgaaaattgtagacctaggatcatcatcagactaaacaagatgggcatttgatcgacccgtctggtagtcatcacgagctatctcataattctgcttgagctcctcgtagtgcttcagtgaagcctctgagaactttgtcaggcgatccagaaccgtagttagctttgactgcaacccttccactgcttccacgcttccactcacctcctgctcgttattctccagcatcccacattcctgcgactcgtttctagactgcgattcggtcgtcgttttgtcctgatgatcggccgggtggtcaaacgaaccgcgcaggagctgcatcacctctttgatggacttgcagagctcatctgtggggagtgactgtgactccatcatggcaagccagtctctgcagaggacaaagatcggaggggagagcgcgtggcggggagggaaagagaccttgcgcttgcgcctccgtctgtcctgggctggctgcaggacacacttctggagccacgcgttgagggactcgacgtaggacttgtgagcagtgacccagatcctgaagctggacgagaagcagtccaactcgttccagagatgcgctgcggccctgcggtggtgctcaccttgctgcaccatggtcgaactcttgacatggtatgccagtgatattgtgatgaattgtttgtggtggcattctaacattgctttccacattctgattaacctgcacgaggtatgtgtggtcagttcaaggtttaatatgcaagaaatgagttgaactttaaaatcaacataatccaagttgttttttcactacagcttaagttagaaatgtgagacttcaaattgtccaacaaaacatggttcttgaaagatagtgaatcgttatattctaattttcaatgttctagcaccaaacttaaattgtgagtaatgttgacagttcaaatgctcctaccaaacgcacgaaaaaggaaatatcaaacttcaacaaatgcactgtatccaacaattgtgataaagtatgcaagatcaagttacggcactgctaaatcagctcgacaagtttgatatttaagtacaagtaggtgatgtttaagtacaagtttatacccttggatcagctcgacaagttgtggctgcagttcttcatcccttatcttctctattctttttgatattgcatcaacagcctggatcgcaacagacaccctggaatgaagatccttcacaacagctctggtcttatcaatcagttgagcatttagacctcgtgcaaattggcgccggagaaggttacatttctcatcataagtctttctaacatgttcactagcctacagaaacaaaataatgcagtatcagtgatccattatgccaatgacagtcctacagagagggcaaaatttcatattaataactttcagcctgcatactgtctttgctaattattgtacaagagttcaattctgctgacaaattagaaactaaattgtattatcaatacaaataactatacaaaatatgctttgtattgtcaggtcttctggcaagagatatcttttaaataaaaatttgagaactgcaactaaaatagaccaaatttcacttgaggtatacaataaagcaaatatcttttgtagacaagtgacactaatgatgaattcccaatcaacagccaggagtagagacttgcacgcaatactaaagaaatctcactgcacaagtgcacatgtactgaaaatgtaccttgatttcatcatgtagttttctctcccaagcatgtaacctatccaaggtagacgagtggcttccagataccatggcgaattgctcaacaaaatcactgttactatcacccacatcatcagtaatcattgctgctgtaagtggactcttagatgatgaggacaaagatgatacagaacgcttccaagtgacaacttttgagatattctgtgcagtttctacagaaaacctcaaaattagtacttcaaacaaatgttatggtaaaaatatgagaagaggtcagtaaagcatcctacttaccctggttgagaatattctcacgattgcagcagactcgaagtgcggacacaaatcgggcagtaggtggcttgcctggagaacctggtatttgaggaataaaacaaagatatggagttccatcaaacaatgtcgggcatggtgcaggggaaaaaacagacaagacaatgactcagcatatgattatcacctggaatcttagcacatatatcaagtctgatcttctttgtctcaagcattctggaaacctcattcccagcttctgcggcacgtacaaaccgagtttcaatgtctttcatgcttgacacaaaatcttttgctctatgagtgatgaactctgaagggtcttctgcttctgtgcacaattctttttccatgtcatcttcctccacctttgctccaacttgcccagaagtagtagcttcagttgtaacctcaaccgatccacttggcttactcatcccacctttctttgcttgggcttcttgcttaggtgctgcattatcaccaggaagctctgggtgcattcgatcagacctgtttgttgtttcttctctcagcgagactgcttcagattcccttgaatctctcaggcccttcaatctactaaaatttaatgtcactccattctcattatttgaggtggcactaccagaagtataattggaatcgaagaagtcccacgaggtacataattcagggggcaatggtggtggtggtggcacaaaggtagataccggggattcttgccccacaaagtcagcagcagatggtcaatagtgaacgtcaaaggttttgttcctgctgctttcatgtaatggatctttgttgagggaggagtcagctgactacctcgatgtactggggagccagtgctctctactgctcgagaaggtgatggagaagccatagaagaatgtgatggtgacttatctgcttctgaaatggacagtgatgattctggtgagatctcagactctgcataccgccgcaatgcagtacccacactacggagggactgagtatatgataggtgtgatgccgacagtgcatctcttgaatcaatagctcgcctgatatggcgcattcgctccttgcatagaactagggcatcctcaccagtggctttggatggcgaagaacccattgtgttcaacgaaccaacaaatactattctacaatgtttttgagaccaacagattcatcaaaagaccagctacaaccacaagctaccactgagtagaattcctccctgaaactggcagtagtcttcagtccttggatctaatcgaaacaacaaagaagaaaggtcatgcttccagctagtagaaataactaacaatagaaagaacattaagtaaagcataatcttaaaataaactagtgaaatccaaattacaccaataaaacaattttgaacagaggcacaaaattcgtcacatatccttctaacttgagctatagatgcccaactcaacagaaagtctttaaaaagttcactccatcaggcaattagccggcacatctgcaggcctcacaagaattactccacgggcaacattcatctctatctttgttgaaaactcagcctcctcagacctccaaagttccaactcttcaagcatcatccatggcggccgccggtgcagggaacatgcaccggcaagaaccaatgtcatgggctaaggtaaagagcaaaagaactaaaggaacaacctttgctcccctacccttgctaacctaaaaatgctcaagaaatcattacccaatggccaaatgcaccaagtccattcaagcgaacgcctttgactgagcaatttagggattaaggcaaacaccagagcagcaagagtaaaatggtgagaaaagcaacaagcaaagtcacctttctccgattcctagctctgaccaagtaacaacaacatcatagattcatagattcataaattcaccacctcaaaagcaacacccacaatgccataatctttctcgatgcagataccaaatcctgatgaaatgacccagcaggctcaggttctttagattaaaaaaaaaacaataagtgtgccctaccaccacgacatgggcaaaaggggagaaaagaaaaacataaagagagggctaaaataaaatagttccccacatatagtattctcttccttcttgctagttgctaccaaaatcccagtccaatgtggtcctcacaaatcgcaaatcaccaacaaaatcaacaaaaataatgcagcacaggaagccaagcaacaatcacaagcacactgcaccctaaacccaaccgaaaccccccaggacagcaccaaagaaccctcctttgcctcatctctgagactctctgaccatcacaaaccaagaacctaccacaatctattaaaacatcaagacaagagacctcaccggagcctgaacaggcggcggcggcggaggaggaggaggaggcggcggctggactaaacgggagcagcggcaatgcggtgcgggcgaccgctgtcgatcgatccgggtcacatgcgcacaccagccgcctcctgtcgatttgtttggttctcggagagtggagtactagtcctggtagactactcctaccactagcacactagcagtagtaggagtactagagagataagtaaccgttaatggcggtggagagagagagagtgcggtgcagtggtgtggactgtggagtgaggtgggtggagactggagagttggagacaagggaatgagagcgaggggagataaatggaggtgggggcaggaatctaccctgatggcccatcagatggaggtgatgccgtgatgggcagatctttttaccccctccacagctccactgcattggttgggattacaaatctttttttcagaaagaaaaaaagtgttgtttttactataggtaaatatctgggaaaatatatagtgcaaaaacaaaccagaaaattaccgtatggttaaaaattaatgttttaaatttgtccattttactagaaaaattacttccaaatttaatttaataggaataaaatttttactcaacgtaatatggataaatctcaaatatctatttataaatattttctaggtttgcactatatatattttttccaaatatcttgtgtgcactttggttaggattgaagtgagagcggccatgtaaaactaaaaatagcgatgaaaacggtcggagtcggtatcatatcttcgaaaacgattcttgatctatagaggattaactatatttatcaatttaagtgtttagtgttgataacaatacaatgtttaaagaaattaaaaaaatgaatcactagtacaaaaaaagaacatacaggtggtcaccataggtgctagaaatgctaaaatcggcacttctagtgcttttcccgtccaaaacacgcatccaaggaacaccatcagctagaacagacacctttatggagagataggagccagttctaaataaaaaccgatacctatagtattagtgttagttttattagaagaaacgacacatataatatattacatgtcctggttttttaataagcaacacctatatttatattgtaggtgtcggttagaaaactggactaagctgaatctttccacctctctctctcccttatcttttcctcattctctctgccttttgccctctcccactctatccatctctcagctctctctctcgccccctctctctctccaccacaccaccaggcggaggcagcggtggcctggcggtgggagggtaggcggcagcgccctcccctccaccagatctggcggaagcagaggtggcagcggccccgtggcacgccctcccctccgctccatccgattggaggggaggcggtgacggcctagtgactgcggcggtgccctcctctttgccagatctggtgggaggggaaacggtggtggtg

SEQ ID NO: 56935 - DNA, 18465 bp, Oryza sativa
  unsure (1)..(18465): unsure at all n locations
tgcaacacctatgaggcgcgtcatgggtggggccttgactgcggtgggcgatgagagaggtgtgcggcgggtagaaactcaacggcggcgggctgtggctagtggggagaagggtggtggtcggtaagagaggctcgcagtggccccttcctcttgccttcaccgttgcaaacttgcaatcgcgtgccgccatccagctgtctcgatctacacgtaaatccgaaggtgagaaggacaacgccatggtgtgccgtcccgatttcacacacatctcggaccccgtcgccgccccttgccccttgttcccgttgtcccgtcccgatgggaattgcagtgggcaggtaggatgccatcaccgcccacttctagaggcgatgtctcgttggatccctggtggcaaagcccgccagccagttattcctctcaccacccaccactagcctccatcctcttcaccgcctgccgctccgccgtcctcctcgccacccgccgccgtcctcctcactacccaccgctggtcttctcctcaccactcgccacctcgtgagatgggaacagcggaggaaaagagagataggtggagaggctctaacatgtggggcccatgctgactcagcgattgactcggatcaagttgccacgtcggacaaaaccacccactatactgtcatgggacgtacgttgcaccagttttggcagttgagggacccgttgcatctcgtatttcgattctaggacaaaaatcgaactcgctggaacctataaaatgaacctattcccctcaccatcagggctcagcttccagcacgattcaaggaagattgggcagaattgttcgccgacttcgagctttctgattgcgaggaagacagccaggaggagtaagaaggaaaggcacaagtttgagtcaaattcctgcaaaacttagcgaggaagaaggaaaaggcacaagttgagtcaaattcctgccaaattctcacaaaattcctcagttccaaaggaggcatgagttaacatcgctgctgcggaatccaactcaaattgaaaccaaaaccaaagccagtgtgagagaactaaatccaattgatcaactgcaactgtaatggttcacagtgaattggttacagatggtactagtcaccaatcaagcattctagctgaaacactagtttactccagtaatttggcagcatgatgaccaacgtaggagctagtagaaactcctttgtagatactgttatgggtaaagcataccaactgataacacatacgcctacttgccagtatgaatgaaatgcagctaactaggcagtacattttcaagtcactcatttcctaaccaggttgataatattcggaatacatattacacaaacacagagatattttgagaactagagtacaaaagaaacttgatgttacaggggagtggaacacttcatactcaatcagaatcagaatcttgagcggttgaagatctgaccctcctgttcattgacatataggtttcatcatcttcatcatcctcatccttcttcttttcgtcaattatacctatattgttgtatgttatcatatttgttactatttcaatttttgaagtaattgtgaagacgtaatagatatacctttcatcttgagtatattttccaatgctcttgttgaaaaatcatctttgctgccgaggtcttgaaacccaattaaccgatcagcagcaatgcccttcctaaataacaaaatgtcagttggacagcaaaaacagaaagtgtctgactcttgggttggtcctcaaaaaagttaagcaccaaacagttgagcacatgtgataaaaatccatgggtagaaatgatgaaagtttatgcacttacttgaacagtatcacacagggcaatgttttgattcccagtttcgtgacaaagaacggagcattctggattagttatttacaagattagacagcatctttgttataaaatacaattaactgaatgctaatagagatcgcattctaacttcagcatcaagcttgatgaatttagttcccaaatagattggtgcaagggccttcaaatgcttatccatgatcctaggaaacatttagataggtgtccatgaattatcatcagggtcaatcataaaacattttgtattgttttttaaagaacaacttatgtcctacttgcaacggtaaaattcacggtggtagaaatggcagatgactttttcactgccagtgacctctcctaggaagtccccttcagttatctccctatattcaccatgaccttgcctttttagcacttcacgcttctcgacctctttctgttatgcacaggcaaatgaataacttaaagtgaagagttcacaagcttcatgagggcaatatgcagatactaccttgagagcagcaattctctccgcatgcaacttctcaagctctgggtcctatagtgtagttccacagcatgatagataaaaaggtattcagtgcttcaaactaaagaaaaaaaaacaagagaaatataaaagatactatagttcaactcacatccaataattcgtcaagatcaacttcatcatggcttgcacttgctgcttgggctttctctttagctacaatttcctaacatgattactatgtcagtatgcagaaacaaaatcacaagggggcagagagaatagtattaccctgttctgtaagcaaatttgtttaaaaagatgcaagaggttcacagcatcggaacatgagggtaaaaatactttcacccccactataacaaggaaatgagtgaaaatgacacaaagaataagagaagataagaacttgcccaatcacattacaaggagtaaagaatcaagtataaataaaaaaaaaacaagtgatgtgcatgaaggacagttacatctttttgttctatactttcgatgtaaacttcaacagtttgttgctgtcaatatacagaaagctcattttgatataaaaaaagaataccgataaactttacacaacatgcattcatgtaagagcaaaatgcatcagaagttaacccattaccaaaatacataagaacgcgcagatggagcatgatccactgcagctttgattattgtaaacttgcaagctataccccaagctaaccacatttacaggctaaatgggagaagcccttgtttttgtgtactctgaggtgtcataaagcattacctcctaaccagcatggaataaactggtctctatagagtctagaccctgcaccatcactctatttcctgtcctagaatacaggactggagctaatccatcctcctaatgaactatgatcccaatcccaatgttcccaaccaaagattggatcatgctactaggcaagatttttcgcatgaaccaacatcactcccatagccaaaggctcaaacctaatgcgcctgccctttcccaagacgaaaaatcacactgctgtagtgctgtattaccaggatcatcctccacattgctatatggttctaccttcaacaatccatgcccgcagcacagctgagccgaggtgaatcagctgccagttccaacgataggtgtaccggactacaactcacttccaatttaaaattgagatttaatcgcctggttctgagatgcagggatctaggagcacaccagctccaccaccaccagccaacctgccagatcagtttttacaccccccccccaccccccaaccccttcttaaaaaaaagaaaaattacaacaaggacataaaatgaaaatgatagaagataataacttgccaatctcattacaagttgtgaaaaatcaagtacagataaaaggataaaagaaacaagttatgtgcatgaaggacagttatatctttttctctacactatgatgcaaaccccacacttttttgctgtaaaactacagaaagacgattttgatattaaaaggactgcctacaaaatttacatgacatgcattcagaaggcaacagaaggtaaaccattttcaatatataaaagaacggccagatggatcatgatcccctccaaatttgattattctaaattgaaataatatcttcaactgagccacgtttattggctaaatttgagaagaagcaacctttgataaatgataaagaattatcatcaccaattcagaacggaacacagtagtctctagaccctactacatcactctactagttgtcctggaatacatgactggagataatccatccccccttatgaactaaacctcctcatgatcccaatcaaagaccacctttcacaacccatgcccgctgcgcagccgagccaagtgctccgcggccgaatcaaccgccagagtactagactataactcacttccaatcaagaacagtgatctgatctgatccccgcgagataaagtggcacgcgagacctaggtgaacgagcgtcgggagaagaagggggggagtgagtgagtcaccttctggtagtcgcgggcggcggcggccatgacgttgccgaaggccaggttggagagcgtcgacttcaccgcgtcgggatccatggctgttcctccccctcttgcgatgctgctgctgctgctactccctcctccgcgagcaccgccgccgccgcttctgctcggccgagatctcctcccctccgatccgattcaggtggcggcgccgcgcagagcagctcgcaccggagcaccagtggccgagagaggtgacgtcggcgctagcggcgggcggacgagcggcgccgcacggttttcttttttctttccttttttttttaggcgagcctcgcacgattgtgctgtgccgtcgcccggggaactgtacgtgcgtatggtgtatagctgggcaaatgggccgtgccaagcagggcccagcccaagcacggcacgacaccgcctgggtggtgcaggccaagcctgtgtttaagcccatataagacgcgcaacccaagtcttacgcacaggagaaatttggtaccacacgggaaatctacgtagtcttagaccattatgctcccactgagctcggtggcgtgagcttgtcaccccagctgcagggggcaggagttggcagggtttgggggattgacggtatagaagatatctctctcctaacccacgatagaagccatggcactgcatggggcgggtgtggtatatataaggtatctctctccgaatccacaaagagatagatgccatgggtgtggtatatataaggtatttctctccgaacccataaaaagatagaagccatggcactatattgccaactccttttcttttcttttcttttcttttctaaattctaaatgggactagctagctatattttataggaaaaagggcactatattgctaactccttttcttttctaaataggacacggggcgggtgtggtatatataaggtatctctctccgaacccacaaagagatagaagccatggcactatattgccaactccttttcttttcttttcttttcttttctaaattctaaatgggactagctagctatattttataggaaaaagggcactatattgctaactccttttcttttctaaataggacacgggtcttttcttttcttttctaaattctaaatgggactagctagctatattttataggaaaaagggcactatattgctaactccttttcttttctaaatgggacacgggtgttggcagggttcgggggattgagggtatataaggtatctctctccgaacccacgaagagtagccatgacactatattgccaactccttttcttttctaaattctaaatgggactagctagctatattttataggaaaaagggcactatatttgggactagctagctatattttataggaaaaagggcactatattgctaactccttttcttttctaaatgggactagctatattttataggaaaaagggcactatattgctaactccttttcttttctaaatgggactagctatattttatagggaaaagtatgaattaccccctccctcgaactatcgcgatcatccgaattacccccctgaaccacaaaaccggacattcttcacccccaactatgcaaaccggacaaattacccccctcgacccaatccgcgggacattcttcacccccaactatgtaaaccggacgaattaccctcctcgacccaatccacggtggttttggtctatgaggcagtccagtcagcattctatctataaaaaaatgtgggacccaatccatggtggttttggtctatgtggtgtacacgttgcagtctctcactcttcctctcttctctctctcactctgtctcactcttcgtctctctctctctctcacggattggcggcggtgggtgatgcggaggcgagggaggagcgtggaggcagggcgaggtgatgcgaagcgagggtgcggcggtgaggtgaggcgagcgcggtggcggaggaggcgaggcggcacggcacgctcttcctcccgtccttgggcccggttcgctgcaccggcggcagcgcatcgccggtggacgaggagagcgtgcgacggacggggagcgaggctgccagcctgttctcctcttctcgccatcctcgatcccctgatgccgctggccagccacgccgcaccgttgttccctccctgagctccgatgtttcctgagctcgtgtgcctaccaccgtcacccaagccacctgcggcattacccctctcaccgagctacgatgccgccgcgctgagcttgccgccgcttgtctcctccttccaggcatcaccgagctcgtgtttggatctggggtggtggagcgggattggcgagtggaaggggctggtggagcgggattcccggtcaccatccacgcctacgtcctcgggtggaaccgcatctgccagtctccgtcgctgatcctggcacggggaggtgggacggggtgcggcgcgacggctcagaggaggagcacgcgcgtggcggcggtgtcccaccgcgtgtccctgcgcgccaccgccgtggaagagcccgccgcccactgcgcatccccgcgcgcccacgacgaggaggaggagcccgccgcccacgcgcgtccccgcgcgcccggttagctccgctcagtcgccggccgcgtcgtctcgggcccctccgccacccacaactggctccttccccgcgcgctgccatcctcacctcgccattcacatcaacaagtcgctggagtcggagtcctccaccgagctagctccgccgatacgctcctcctccgcatccgcctccgtgccgacgtcctgagcaccgatgactgcgctgtcctcgccgaccgcccttccccgcgcttgtcctcgccgtgtgcgctgcgcgagagagaaaagagtgtgagagaaagagaatagagagagaggaagaagagtatgacatgcgggtcccacaattttttaattaaaaaacgctgactggattgccaggtgtacgccacgtagaccaaaaccaccgcggattgggtcgagggggtaattcgtccggtttacatagttgagggtaaagaatgtccggttttgtggttcacgggggtaattcggatgaccgcgatagttcggggggggggtaattcgtactttttcctattttacaactaaaaactagcttatacatttattgtcaaattttataactaaagaaactggtaacttgcccatgctaatgctacagcgacatttagtaatgcaaattaataaatgctcaccacaggtattattgcaccatgaagtgtgctaaatagaactatccatgttttattcaggtcacttgcaacaaaagttgagtaaatatactacagatacatttcaagcccatctatcatgcaatagaagtattttcagaaagtagaccacatacaaggctactgagtttaagggtaaactaagggtgatacatacatctaaaaatattactccctttatcctaaaatataacaacttctaacctcaaagtttatcaaaaattataacaacttcttcaccatattctcttctcaaccgatcataactctccaccatttaattttctcacctacctctacttctcaaccgatcacaacactctcatttaattatacaaacttttttaatacccgtattcaatcctaaaaatccttatattccgggacggagggagtagcatatttgaccattgactaagctcttcatcggaaaacatgtaagtggccttgtttaacaagttctcgagcacctgaagccccagtgaacttcatttgatttgcagtgaaatctgatatccaatagtcataaaaataaaggggtatccagatagtgttttcttcacgacatgctgagtcggtaacaaaaaaaaaattgttaattagtccacgcatcacgttgagattggcgcaagaaaaaaagaaggcaagatttcaatcgaattaatgacttatagaatactatgtcagcttattcaatagcttccaacatctctgacctaaaggaaagttatccacaacctagtaaatattctgctaataatatatcttttgataatgaaacctataaaggcttataaacagaggaattacaatcgtgcagcaaaagtaccttaaggggattgatagccacttcaataaatcaattaaagaaacatcataaaccacaaataaccatcaatcactggtggagaaatgatctttgctgggttgacccaagaccacaatagtcccagttccaaaaagaaccgggactgaaaatgatctttagtcccggttgaaaaccctaccgccattctatgatctttagtcccggttggtgttaccaacaccaaccgggactaatatcatttttagtcccggttcatcccctgtcagatgtatgtgagggggccgagaatctttagtcccggttggtgttggtaaaatctttagtccaaaaagaaccggaactaaaattgaacgcgtagtatataatccctttcacttatcctctcctccacaatcgcaactcacacagatcgaatctctccccctctcctctcctacatatcagatctatcctctcttcctcatcccctctcctccacctcctccccttcctcctctcctccctctcctccccttcctcctcttcccccacctccctttcccatccggcagggctgtaggcagcggccgtggcgagcggcggcaacggctttgtttttgttttttgttttttttataatttatgattcactgagatgtataaatttgtgattcattgtatggatctgtgatgcatttgatttgtgtgtacaagtaactttaagatttgtgatgtggatttggtgatgtgaatttgggatgttactttgatttggggatttgggtttcgatttggggatttctatgccacttgattcgggagaaaataaaaaggaaaaaaaatgaccttctattactgccactattatctctttactcccggttggtaacagcaaccgggactaaagatccctctctttagtcccggttggtgttaacaaccgtgactaaagatccatctctagtcccggttattttaaccagtactaaagatgttcatctttagtcccgaattgctactcccggttggaaaaccgggaggtttccaaccgggagtaaaaatgggttctccaccggtgaatgtttagtagaccaattatgtatttgtcacatgggtaaagcagaaaatgtcaggagtactgcaaaaaatgctattatgcatatctaagggtagtagatcagtttttaacttgacagcaaccaaaagccatgcagaaatctacaaatccatgtgtgtctcagtcatggagtgcgccccatttccttggtgactaaaccattataacgggatcaaagtacgacgtcagattcctttatactgcaaactcggtatctacatttgcatacatctgagcaatcaaaattttaaattatcaaatagaataaaacttgaacctattgtgtgccatcatatatctacaatttatccatcatattccatgaaacagtccatttatcttcaaattcctagaataattcaatctgatccaatttagaaagataaaggcactggtggagaaaccatctttcgtcagtcggccgaattccacaatagtcccggatacaataaaaaccggggctaaagatgatctttagtcccggttaaaaagggtaacgggcatatttgatctttagtcccggttggtaacacaccaaccgggactaaagatcatctttagtcccggttcaaatgctgtcagggtctgttaggcccctcgggatttttagtcccggttggcaccaaccggaactaaagatcgtaactttagtcccggttggtattaccaaccgggactatagatctcgtggatctttagccccggttggtaacaccaaccaggactaaagtcccacccctatatatgtcttcttcctcctccagctgcccgagcaagcttcaaaatttcttcaaaaaagaggggaggtcatgccaaaatttctagtgaatttattttggtgattacatacaaatcggaggtgcctaaaaggtttgcaacttcatcctccaatgttttttttgtcatattacatttgtagctatgttttgcacacttttttgtctccaaaatttagttgtaagttgatgagggagaaaatttgtgtggggaataaagaatatatagaaatttagttgatttgctaaagaaggttttataaaatagttgagaaggaaaactatagtgaaagttaatcttgaataatagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgattgtcattattgtaagaataattatttttgtacgattttttttcgactcatgtagatggatcggcaatggatgtacactgaccggtggtccaaagagtttattgacgacgtgcactattttttgagagtggccgaagctaacaggcaaaggggttttatttgttgtccatgcaataagtgtaagaatcagaaggagtattctgcatccaggactattcatttctacttgtttgagtcggggtttatgccaagctataactgtggacatcccacggagagcaaggtgttgaaatggaagaatatgaagtggaagacgacaatattctggactttgctcagtgtcacaccccgaagttttcctcccaagccaaaattgtaattcttataaatgaccctaagaaaatgnctaggtggaaaaaccaggnagaaaaccncnntaagnaaagtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatccttttttcttttttctttttctttttcctccctttttcctcctttttttcgaatgggccgccggcccattctctcctttccttccccctcctccttgctgggccggccgcaggccaaggcccagccaggccgcctcgccgcctcctctctcggggtcgccgacaggtggggcccacctgtcaggtccttcccccacctcccgccgatctcgctcgcgccgccgcgcccgcaaccgccgccgcgccctcgtctccgcctcatccaggccacgtcgaccacacccgcgcgtgcgccgcgtctcccgcgcccactcctctccctctcccgctcgcgcccgcgcccgagatggccgggattcgattttcgaatcccgcctctctctcctcccccactccccacgtcggccggcgattcccgcctctcccggccacgtccgattccctctccccctatttaagcatcgccgtcgtctcctctcactttttccccatttcgccgcactctctcgagcctcccatcgctcccgcgccgtgcaaccccttgccgccgccttttccgctactccggccaccgctagccgccattagggtcgccgccaggccgcgccgtcgccgccgtcgggttcgcgtggccgagatccaccccgtccacccctcctccgtcgaggttcgtcgccggagccctcgttcccccgcactcgggtgagcaccacctccaccgccgccttcggccatggtttccggtcgccgtggtccatctacctctctctaatccctctcttctccttccttagggcaccccgaagctcgtccgcccgccgacgtcgtcctcccgtggcttgccgtcgccgttcgccatcatcttcctccgcgccggccaccctcggtgaggcacccctcccctcttttccccttcctctccttctagtgccgtgccgccgcttcgcgcagccgccttcgcgtcgccttttgcgccgtcgccttcgccgccggttgccgtcgccggcaacgcgttcgcgcgccgttgccgtcgccgcggccggtcggtctgccttgagccaagccgagccgggtgccgccgcccctttcctcccaagccgctgaccagtgggcccgcgtgccggcgcttttcctccctctcctgagtcgctgaccggtgggccccgcatgtcggcgccgcgccccctccgtgctgacgtcagccctggaatatattgcgcaataaatgatttaaggtttttcttttatagtaataaacacagtgaatcttctaaaattcataactaattcatccgagctccgtttaagcccattcaagtctcagtaaatcaagaaaagtgtgtagaatccataaaaaatggttttgttccctgtttcagtagtcttatagcctgtttgcaatgtttgctttgtatgtcgctagattccgatccctccgacgctccggtgtactttgagatagtcgccgaggttcctccagcagcagagcaaggcaagtcatgcttgtcacttgaacatgttgatcctatattgcaaatgctctattgttttctttcaaatattgcattgttttataatattactatgagatggttacctattgttacagccatgcttgttggataccatgctcctttgttagcttgggttataacatgattagagtttggactaggaattgcttagctatgcttagttcaactagttcacaatgggaaaaatcatattaatgtttagactgttggttctaatggtaatgttggtttagtaccaccgctctggtgtgggttaattaaaatgaatcacatggtgggctgtgggtgcatggttttgctggtcgcacccatggcagttaaggaccggtgcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaatttggatagtttaggtggatggttgggcctgtcgcaacgtgggttagcgttggacagcggatgattaaaattaattaattattacaactgtttaaatctttcaatttctgtttataaatgctcgctttatgcaaatgaactacttcagctcttctttgttaattccctgcatcatacccctattccggtatgacttgctgagtacagtgggtagtactcagtcttgctctacttttcccaaccccagagttcgagttcgggtcagatgaaggtttctctgaggagtaggcttcgtccgtgccgtcgaggatgcctgtggagtggtgttcccgctgcagtttagtcaaagtttagtcaaggcttagcccctgttgtttttcttttcttccgctgcatttatgtaagactttatgatgtttgtaagacgtggatctgtatgtcaacattgtcgtttgtgtaccccggctggtcctggacggggattttaatgcacattctgcttggaattctattcgggaatttctgggcgtgacactcagtacgttggatttgaaggaaatcaaacgggcgaggaggaaagggatgctgatggtaacgacgttgcggatgatattggtcagatgttgcaggacgccaaggaggactgcgaaagtgaaaagggggcccataaattggacaagatgttagaggaccacagaatttcgttgtacccaggttgcgagcaggggcacaaaaagttggataccactctggagttcttgcaatggaaggcaaaaaatggggttagtgacaaggcatttggcgatttattgaaactcgtcaagaacattcttccagagggaaacaaattgcccgagacaacgtacgaggctaagaagatagtctgcccgctaggactggaagttcagaagattcacgcatgtccgaatgattgtatcctatatcgcggtgaggagtatgagaacctagaagcatgccctgtttacaaagcactacgatacaagattagacgagacgatccaggagaagttgacgggcagctaacaaagaagagaattcctgctaaggtgatgtggtatttccctataataccacgactaaggcgtttgttcaggaacaaggggaatgctagaatgatgcgatggcacgttgaagagcgtcaacaggacgggatgctgagacaccccgctgatggttcgcagtggcgaaacatcgacagaaaatttaaagaatttggaaaggacgcacgaaacatacggtttggtttgagtacggatggcatgaatccttttggagagatgagcagcggccataggacttggcccgttacgatgtgtatctacaacctcccccctggctatgtatgaagaggaagtacataatgatgccgattattattcaaggccccaagcaacctggtaacgacatcgatgtgtacctaagaccactggtcgaagatcttaagctgttgtggaagaaggaaggtgtccccgtgtgggacgaggacaaacaggaggagtttaacatacgagcgctgctgttcgtaaccatcaacgattggcctgcacttagcaacctatctgaacagtccaacaaggggtacaaggcttgcactcactgtatggatgaaacagaaagtacgtatcttaagcactataggaaggttgtatacatgggtcatcatcgattccttgcagcaaaccacccggtacggaagaaaggcaagcacttcgaacataaggctgaccaccgtatgaagcctaaacatcgcagcgggaaaacagtgtttgctatggttaaagatcttaaagtagtgttcggaaaggggcctggaagccagcctatagagagcgaagatggtcacgcggcgatgtggaaaaagaactctatattttgggagttaccctattgggaattcttggacgtacgccacgcaattgacgtgatgcacctcactaagaacctttgcgtaaaccttcttggcttcctaggtgtatacggaaagtcgaaagatacactggaagcacgtaataatctgaagcatatggaacaacgcagcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccaaacaatgtctgggcaacaatgacaaagctatgtgcattcatgaacgcaattttgcagaaggtcatcgatccggatagattagaagcccttcagaatgatgtggtgcaatgtcttgtcagttttgagttgatatttctaccttcatttttcaatataatgacgcatctgctttgttaccttgtgaaagagatcagtattctcgggcctgtgtacctatacaacatatttcctttcgagaggtacatgggcgttctgaagaagtatgttcataaccgtgctcatccagaggcaagcatcgccaagggttatggaacagaggaggtcatcgaattttgcgtagaatttatcgaagatcttcgcccaatcggggtacctgaatcacgccatgaagggagactacggggaaagggaactctcggaaggaaagcaataatgacggtagacaacaatttattccgtaaagcccatttcacggttctgcacaatcttcatttgtagctccttatatcgaggagcacttggctctagttcgcgccaggaacatcggtaagtccgatgcatggattacacggcatcacattgatactttccccgcgtggatacgacaacatctcatgggtaacgagtagatcaaccaacaacttgccttcctggcgagaggaccgtcttagtcgatcgcgacattccagggatatgagatcaatgggtacacattctacacgagagctcaagacatgaagagcacgaaccaaaacaacgctgttcgtgtcgatgccatgggacacgttggaacaactggcacgtattacggtgccatcgaggacatatgggaacttgactatggtcctctcaaggttcctctgttccggtgccaatgggttaggttgactggtggaggcgtaatgattgatgacagtgggatgacaacggttgaccttaacaaggttggatacttggacgaaccttttgtccttgccgatgatgtaacgcaagtctttttcgtgaaggacatgtctagcaaaggaaagaagggtagagggcctgacgagcctaagaatcacgtggttctcccaggcaaaagaaaaatcgtcgaagttgaggacaagactgacgaggattacgatcagttggatgggcaaccccctttcacggtgacgattgaccttagcatcctcctatcaaatgaagacaccccttactcacgtagcgatcacaaggagggaacaatattaaggagaaagtacgtgcggtcaactgtcaccgtcgatgtattgccgtaattattttgtacacgatgtaaactattttggatgtattgattatccatataaatcaattgatgtatggaatatgttaattacgcacgattattagaggttttaacaagtttaaatcatgtatatgctagttatacgcgatacttacaatttttaattgttttaaatcacgcaggtggcaatttcatatgttaattagagtttttaacatttaatttactataattcatatgctaattataattgactaaagaatttttaaaagtttcaaatcatgcatgtggcatttacatatgttaattagagtttttcacaatttaatttactatcattcatatgctagttatatatgactattcgattttttaaaatttttaaatcatgcatgtggcatttacatatgttaattagagtttttaacaattaatttaatataattcctatgctaagtatatatgatgtttacaatttttattaattttaaatcatgccgtatgtatatacatatgttaattagagtttttaccaatttaataatatcattcatatgctaagtatatatgattattagaatttttattaattttaaatcatatatttgcttattacgttttatccacttaatttattacagacaacaataatttttcgaagtaattatcattaatctttgtactttaaataattttaaataattgtaatgcattatcttctattttagaaacacatatgtaatggaaaataatattcagtgcgcttatcagtagttccggttcttaaccctaaccgggtttaaaaagaatttggaaatagcgggaaaagatctttagtcccggttgatgagaacaatcgagagtaaagatatctttactctcggttgccgccagccaccgagtttcagacgccgacgccgacctcatcacgacacgatgccgcgccacgagacgccacgacgccgccacggcacggcaccggcgccgcgccgccacg

SEQ ID NO: 56936 - DNA, 10252 bp, Oryza sativa
tcccgctcctgccacaccgagaacgtgaacgagcgaacgaacgtgaacgtgaaatgcaattataggcaggtgaatgaacgtgaacgaacaaacgtaggtgaatgaaacgtgaccttaacgagaacgcgtacgtgaacgatatcgtgaacgaaacatgaacgtcaaatgcaatatatgttacttcgcgtttatgctaatacatctttttgtatcttgcagaaaagacgttgttggagtcgtccctcaagccggagtggtagagctagccctcgaaggaattcgcgcaggcaagtaacgtaattatatatatatatatatatgattgttatatttgtaatgcaattaagattattagatttgtaattagacttaattagcatataagattgtgtagtgttctaatatacgacagttatacttagaatacatgactatttgagttttagtataagattattggagttttaatataagattattatatttgtaattagacttagtatataattattgactagctagggtcctataatatacgtcacctagacttagcatatatcatcactatttgagttttagtataagattattagatttgtaattagacttagcatgtaagattgtgtagggttctaatatacgacagttacacttagcatacatgactattttagtcttagcatataagattatttgagttttaatataagattattatatttgtaattagacttagtatataattattgactagctagggtcctataatatacgtcacctagacttagcatatatcattactatttgagttttagtataagattattagatttgtaattagacttagcttctaagattgtgtagggttctaatatacgacaattacacttagcatacatgactgttcatttagtcttagtatataagattatttgagttttaatataagatttttaaaacataaatgtctcatgacttagcagatgtttcctgtatgaatagatggctgatcgcgatgaggaacagatattatacgatacaatcgcggagggaagcagccagtactggaacgaagaagaggggaacgaggatccaaaccagtatttgaacgaggaagggaacgtggagagggatgcggaggggaactaggaggggcacgtggaaagggatgtggaggggaaccaggaggaggaggtgtcaggcccagaaattctcgaaccagaatttctaagctgaatgtgcattaaatccctgtccaggaccagccagggtacacaaacgacaattgttgacatacagatccacgtcttacaaaaatagaaaagataacaaatgcagcggaaaagataaaagcgagctaaaccgggaagcttgacttcagtagcgagcggttccattccacaggcaatccttgacggcagcgacgaaaccaactttgacaaaacagctccaactaggaaaatcttcagctctggtgtgggggaaaagagagcaagactgagtactacccactgtactcagcaagtcataccggaagaggaggtatgatgcaggatacaaccaaaggaggctagaggttcttttgcataaagctagcatttaaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacggtgaatctggttaatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcgatcccctcttgcgccgcggtgaatccggcagctggacaaccggacaccccggccgacccaactccatcacgcccaccctcgccaccggtgcctaggaaagggtcgaggtatacttcagatcaagcagttacccactcccgcttgtggtaagcacggtaagtctcccagggtttcccgtgaaccggtccttaattgccatgggtgcgaccagcaaaaccatgcacccacagcccaccattcaatgtattttaattaactaacaccgttgcggtggcaccaatccaaagctatgctcatagtcaaagtctatgtaataatgtgatccccatatgtgtgctagttgaactaagcatggctaagcatttcctaaaccaacatctagtcattttgatacccaagttgtcaatggcatatggtaaacaataaatggctgagtaataggacccatcccacatgatattgtaaaagaatgcaacatttaatagaaatgcgggatattggtaaattgggtacaatatgatcaaacgtattgcatgacttgccttgctctcgcactgatgagatcacagcaacgtcttcgagaaactgcggatcgacgaaacggccgaaacctacgcgacaaacaaagcacacaagcaaaacatgctataagactacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcagcggaaggggggggcggcgccgacaggcggggcccacgggtcagcggttcaagagaggggagagagaagcgccggcaagcgggcccactgggcagcggctcaaagggggtcggtccaccgtggaccgggaccacgcgggtggtccaccgccggtccacgggaccgacggtccagatcggccgggagaccgatcggacggcacggcggcgactaggcacgactcggctcggcttcaaaaccggccggccggccatggcgaggcgacgacggcgcacgaccgccggcggtgcggggagacggcggcggacggcgcgaaaggcggcggcggacggccggagcggcggcacagccaaaggcggcggcgcacgcgtgaaggggagaaaagggagggggagggaggcatcggccgggctcagctcggcctcaaggccgaccggggcgaggcggcggcgaggcacgaccaccgacggcggggaccggcggcgcgggaagcggcggcgacggccgaaaggtggcggcgcatggctgaagcgcggcgatgcacgtgcggagggcggcggcatgcacgggagagagagtaaagaaagaaggagagagaggtagtcctcaccggcgatgtgggggaatcggggtccggcggcggcggacggaaagcgagcggcggccgaggtagctctcgcggcggcgaatctagcggcggtgattgcgcggcgaggcgatggctctagcgacggcagcgtgcggccggaggcggcggcaagcggtggcgctagcggcgagcggcgcgggctcgttaggagacacgggaggggacggcaaatgggggaaacgagagagggagctcgggagagtgatttaatggtgcgggaggaggcggacgtggccgggaaagcctccgatttcgccggcgacgtggggtggagagagagagagaggggtgggattcgaaagcgaatcccgcccatttgtgggcgcgcgcgcgagcgggaaaggcggaggaggtgggcggcgtgggcgcggggtgcgggcgcgatgaggggcgcgacgtggagcggagaaggcggggcggcagcggcggttgccggtgtgggcgcacggctggaggttggggacgacccgacaggtggggcccacctgtcggcgtcccgaagggatggggagggggcgcgggccggcccaagaaggagatgggcgcacgcggcggcggggtggactgggccgacggcccaagaagaggaaaaaaaggaggaaaaaggaaaaagaaaaaaaaaagaagaaaggatttttcctgggattaaaatattgcgcttgctcatttttaattggttaaaattatttccaaggctctgaaaattccactaaaaatcctgttaacgcattggagcatggggaactcaagaaaaattccaccacgctatttccgattattaattgcatttattaactagggattcagctctaggttaattaagataatttcttcggacaatttatttaaccaattttttaaagcaagcaaaaggggaaacttccgggcgtgacaaacctaccccccttaaacggaatctcgaccccgagattcggaagagctggcgaagaggtatgggtgggtggccttcaactcatcttctctttcccaagtggcctcttcctctgagtggtggctccactgaaccttgcagaatctgattactttgtttctggtccttctctcgctggtttcagggatacgggtcggcttctccacatacgtcagatcttcctgaatttcgatgtgatccggacttgcctgttcctcgggaactctcaaacatttcttcaactgagagacgtggaacacgttatggatgccaagcatgttggagggaagctcaagctggtaagcaacttcacctctacgttccaagatcctgtatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagattgcgcgattctcaatctttccctaacaactctgactttctcttctgcctcatttaaaacttctgtcccaaacaactggcgttcccctgtctgatcccagaagagcggagtacgacacctccgtccatacagtgcttcaaacggtgccatctgcagactagcctggtaactgttgttgtaagagaactcggcatacggcaagcttttgtcccatgctccaccaaagtcaagcgcacatgctctcaacatatcctctagtatttgattgactcgctcagtctggccatctgtttgtggatggtaagcagtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgaaccggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccaaaacttctctttgaggtcttggtacatcttagtactaccgggatgaatggaatactgagtttgatgagcctcggttagtatcaggtcttttaattccttgttttcgggtacacacaatctttctcccgtccagattgttccttgttcatcctcaacaaaacctcgggcttttccaactctcatgttccttttgagctccgctatttcaggatcacttgcttgagctatgcgaacctgctccaccagtgtgggctgtgcctctagggcagccacgaatccgtgctcaactataccaaggttcaaatgttccaaatcacgttgaacctcacagcatagttcctctacccatgcgacgttgcagtgactcttcctgctcaaggcgtctgcaaccacattagccttgccgggatgatagtgtattcccatatcataatctttgattagctccaaccatcttcgttgtcggagattcagatcaggttgggtgaagatgtactttagacttttgtgatctgtatatacctcacaacggatactgatgagatagtgccgccaaatctttaaagcatgaacgactgcggccaattccagatcgtgcgtcgggtagttgccttcatgaggacgcaactgccgtgaagcataagaaaccactttgccatcctgcatcaacacacatcctagcccctggcgagatgcatcacaatagacctagaaatctttcgtctgatcaggcaggattaagactggtgcagacaccaaccgtcgtttgagttcttcaaaactcctattgcattcagcggaccagataaacttttcttccttcttcaatagctgtgccattggcttagcaattttagagaagttctcaatgaaccggcggtaatagcccgcaagtcctaagaaactccgaacttgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttgaaatatcctcttcgcggatcctcaactggtgatagcctgatcgcaggtctatcttagagaacacagtagctcctttcaactgatcaaacagatcatcaatccttggcaaaggatacttgttcttgatggtgacctcattgagtgcgcggtagtcaacgcacatcctcttggttttgtctttcttctccacaaagataaccggagcaccccaaggcgatgtgctcgggcggatgtatcccttctgtaactgttcatcaacttgcttcttgacttccgccaactcgttggctcccattctgtaaggtctcttgtggatcggtgcagttccaggtaccaagtcaatccggaactcgatatccctttttggtggcattgttgtcagatcatccggaaaaacctctggatactctctgactatgggaatatcctccaacttcttagtggttttctccactgctacctcttgttcttcaccagcagcctggtttaaactaatccctggcttccgcggcactggagactggaaggttacctcctctccttttgcattggtcaacttgatggtgcggctggcgcaatcaatcactcctctgtgccttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccagtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagtttgggtttttctcccaacctcttgggctgttctggcagagctggctgaactgattgggctggaatctttaatgaacttggagtagggttgaggctgtgctgctcactgttgttgtgactgccactatggtggttcttgttgaagctacccgggtggtagggacggtactgccggataatcatggtggaaggtccaccgtgatgtcccatcgtgaaacgaggcttctgactcttcccctgggaagtcctgaactgagctgccttcctcttacggtttattttgttacagtgctcctcctgacggatagccttatccaccagcttctcaaagtcctcataatctctagagatcaactggttaatcaattcatcatcaagaccagacagaaacttctcctgcctctcggcatcggtacgcacgtcctcaggagcgtagcgcgcgaggtggttgaactcatgcaaatactctataactgttctggttccttgttgcagggaacggaactctctcttcttttgtgccacaattccctcgggaacctgtgctttattgaaactatgacaaaactctgtccaagtaacttctgcccaagctggacgggtcaccatgtagttgtcccaccaaacagaagcgggaccttgcagctggtgtgtagcaaaagcaaccttctcttgctcgttgcattgcaaaagattcagcttcttctcaatggcatgaagccagtcgtgggcctcgattgggttggtggtgcttgagaaggtgggcggcttgacacgaagagattctaacagtttggactgaggaggtggaggaccaaactgcaggttctgctgctgctgctgtgcttgctgctgcacctgctgcagcacctgatggtactgttgctgcatctgttgcatcatcattgccatcatctgagtctgattgtccaacacctgagcgatcgttgggttctcgggcggtggggacggactgctattaggtgcattgctggcacgtggtccatcgatcggctcttcgctgccactggcgttgttggagtcacgggaaccattccttgtcttcaccatctgagggggataggtagaaatatgagaaaaggaagaaaaacaggaggctcagaaactaatcttgtttatgaatttaagtgcaattatcttaatcttgattaaaacactgaaaaagaggcacgcaactcctaattgaggcagtcataccactgacacatgatatcgaccgccgactaaccctcaagcaacaaacctaaacacgaaaactagcaagcaaacagactaagaagacgataaagctaagggcggcgactctgaagctcggggcggcgcttgcaaacgagggataggactgacatctaaagtagacaagggataggaaccaattcatgctcaaatccaaattaaaccaagcaacagaagactcaaataaataaccgagcatgatgatttttatgcatagaacatttttcatgaactcaaatgaggatactgatgcaactggctaatcaataaattaatgcataaaataaatgcatagtcataccgatacgcataaacttaccccaccgaacatagacacaacctaatgcatatcacccgacaattcccgaccgactgccgaataaattccgaataaatttttactaactccctagactgtccctagtcgagaaatccaattaaataagcgaccaagatttttcccacaaatcaaaagaacaaaccccaaaattttcccgaaacaaaatccaagtgcaaaagggcatatgcatatgaaaaggggttcagagggctcttaggttttccagttggcttgtcctacggtcaaggtcggctctgataccaacttgtcaggcccagaaattctcgaaccagaatttctaagctgaatgtgcattaaatccctgtccaggaccagccagggtacacaaacgacaattgttgacatacagatccacgtcttacaaaaatagaaaagataacaaatgcagcggaaaagataaaagcgagctaaaccgggaagcttgacttcagtagcgagcggttccattccacaggcaatccttgacggcagcgacgaaaccaactttgacaaaacagctccaactaggaaaatcttcagctctggtgtgggggaaaagagagcaagactgagtactacccactgtactcagcaagtcataccggaagaggaggtatgatgcaggatacaaccaaaggaggctagaggttcttttgcataaagctagcatttaaaagcagtagttgaaagcagtaaaacagctgtagtaattaatcaatattaaccaatcactgtccaacgctacaccacgttgcaacaggcccaa

SEQ ID NO: 56937 - DNA, 2539 bp, Oryza sativa
tattgcgctgctcatttttaattggttaaaattatttccaaggctctgaaaattccactaaaaatcctgttaatgcattggagcatggggaactcaagaaaaattccaccacgctatttccgattattaattgcttttattaactagggattcagctctaggttaattaagataatttcttcggacaatttatttaaccaattttttaaagcaagcaaaaggggaaacttccgggcgtgacaggaggctagtggaagtcaaccctccgttggacagaagagggcacgcggcaacgaggtgccgcgaagaagcttgagggtcagcacatcataacggaagtggaagaagatgggcgacctagtgccccggcagaagccgccaagaactatgtacgtcacagcggttgggttgtgcggaataacgtgcctgtcagtacggtgtactggcgaagaacaagggcacgcggagatcatgagagctttgtcacagattcagagaaagagatgctgtggaccacaatgctcgagacattcacccttcccgctggtacagaggacaaagtgaaaaggtggactctgaagaaaatggcagaacaattttagagcttcaagggagatctgtaccagaaatatatcctgaagggccagacaccgaacttcgacacattccgaaagctaagggatcactgggacgagttcgttgcatataagacaggtgaacaagggcaggcgatgatggaaagaaacaaagaaaatgccgccaagaagaagtaccatcaccacttggggtcaggcggctatagcgtcgcgatgccgaagtgggaggagatggaggctagcttgcttgagaggggtatcgaaccggccaccgctaattggctggaacgatcgaagttttggtactatgctcacggtggaacgcttaacccagctgatggctcactggtcttcggcgatcagatacgagaggttgcgtgtcgactaacagacgcagtggaagcctcttctcagggcacgttccgaccggacagagagagggacgagctgtcactcgccctgcagactccagagcatccaggacgaacacgagggaaatgggtgattccttggaagattgggttcaaggaggacatccacacgtacaggagtcggatgaggcgcaagagagataccgaggcgaagattgcagatctagagttcagggtatcgagctacgagcgcagcatgcaagaggaggtggcaaggaaggttgatgaacgcatggccgcacatcggtcccatgatcccagccgaccattcctcctgcaatggtgagcccgtcaggaaaccgtagcagctgcgcctcaacggggcaagtaggatcacagagcatggacgccatgcaaacccaggacgaatccacctgccccgttgatgacatcactcagcggacaccatgtgagctgcatattcctttcaagaacttatcaataaaggtaagctcatagtttatatattttagatttggccataccgatagttgcagcttatatatcgttgattagtaataaataacctctcaccacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccgtctcctccggctccaccatctcctcctcaggatcctgcaccgtctcctcctcatgctccagcaccgtctccacctcaggctcctgcaccgactcctcctcaggctcctgcaccgactcctcctcgggctcctacactgactcctccgcaaactcctcttccgacaccttcaaagtcaagggccccccaagctccaccgcctacccacacaagggcaacgaagaaggtgaaagttgacgccgccaagaacaaggacccggggtacgattgcacgcaagaggagcttgacgcttacgtggcatcagaagtcaagagacaattcaagcctcgaaggccagaaaagaagattcctatagactcgagtgtcatgaacttcttcaggggtatgtctgcacctgccaaggaggccattaagctatcggactatgagcgaacgctgaagaaagcatcttctggaaagtccaaaccagtccctcagcttggagagcaaccaaaccaggagatcgagccgttggtgaccgataaagaaatgacgatagaagaatttattactgataccagtctaactacggatcaattgctaggagtcgcactaatcgaaaaggcggaagtgaaatacatgtacgaactcggtaaaccgcttgtcaagcctgagctgctgcagtccctacccacacaaatgtacaagttccatcagctgtacctggagatgagcgccaccggtagagagatg

SEQ ID NO: 56938 - DNA, 3449 bp, Oryza sativa
tacgaactataccagctggacgccctcgacgtctctatgatgagttgctggattttgtaagtatatcgttcagttagatttcttactacgtcacctttaattaattaggtccttgtatataagtagactatagaaaataatatactcccttttatcgttgtagaatggagattcaaagggcccgacggcggggggtttttgatactggattcatcgaccctcggaaagtaaacgtcgcaatgctcgaccaatatccgcaagccacagaggacaatctcgtctatttcctgaaggcgcagcattacaagacgttcatactattgccgtacaacacagagttagtttaattttactgtcttcctataccaaatttcattcccgtacgaacttgctaagtgtttcatatgtaatgcatcccacgcacattgcagattccactaggtgcttttactcttcgacctgtcggcctgcaccgtcaacgtatatgactcaatggataaaaaagagtctacgtttgacaaggttttcgaacttatagataggtactgtcataagttcctctgttaattaagaaaatcttgttatgttaattgctactacgaatcatagctttaaactccatatagggcttggtatcggttccgtcatttggtccgcggcaaatggagagaaagacttaggcggaagttcaaatttcctgtgagtatacatgctctacatttatatttctccgattcaaatacatacaagtgtatattaattagatctctcgtcgtttgtcatttatttgtagtgcgcaaagcaaaagcagggaactaacttgtgcagctattacgtgtgccagtattgccactgccttgcagaccaaatcatcaccacaagagagctcgatgtacgtataaataaattcaaaatttcattacatattgatttcttgtttaattactaatcaatttcatacattcatatagtttattcgcatgagggataacctgaccatacacaaggaatttatcgtggcggttcaagaacaactcatgggattcatcaacgaacaaatccttgatcccaagggtgaattctactacgacggaaacacaattcataggtccttagcttctgagctagctactacgtcgaaatcgtagctagctaggacatataatggattgtaattaatacatgactatatatgtttctatatgcatgtgtacacattttctataatgtaaatatattttggtcatatatatatatatatatatatatatatgcatttgtataacatatatatatatatatatacatatatattatgcatgtacatatgtattgaaacatatataaatataatataatatatatatgcatatatatgtttaaatacatatatatgcatggtttatatatatatatatatatatatatatatatataaaccatgcagcaacagggccatgcaagaaaaaaggtcagctcgatctttagtcccggttatttcacccggaactaaagatagcgatctttagtcccggattggtagttccggattagaaaccgggactaaagggggttacgaaatgggactacaaagggtttctccaccagtgaggcttgagcatccacaagaatacaagatcatactaaataggaataagttcaccggaggtccctcaacttaacgaaagatttttgaggtcccttaaccacaaaatcagaaatgcgtacccctaaactcactcaaaccgttcacataaggtcccatggcagtatttttctcggttttgctgacgtggcatcctaatcagtaaaaaaatataaaaaattacatggggcctacatgtcagctgcacatttttttctcctcttttcttctccttctcttctcttttctctcttctctcttcgccggcggagggtggtgatggccgagcgcgggatgcgggcgaaggtgtagagccagtgggccttagaggctggcagcaagtgagcccggcagcggtcggtgagtggcgggcggagcggcggcgggctgcgagcagagcggccgactcccgctgccaccaccgtcgctctcacccgctgtcagctgccgacccccacgcgtgcggcttcacggcgacggctgtattcctcatcaccgttgcgctgcaagttgcccctgtccacgccacccgcgggtgaccacccttctccccgcgcccggccggagagggggagaggaggccgggcggagtcggggaaaatgaggccggttgagagggggaaagaggcggcgcctcaccgccgcttgctgctccgccctcgcccatgggtacgtgctatgatccggggctttctttctttctctctttctttctttctttctttctttctttttttcattttttggatctggttttctctatattttggctgcttcgcgcttcgatacgtcatgggcttcggaaattgcctaattttgttgttgcttgccatgccatggatgcaggtcccgcggcggcggagcagatgaggcgtgtcatcgcgtcgtcggaccgcgacactggccgcgcgctaacgccaaccctgcacctgctccggccacgcgccgccgcccgccctctgtggccgcgctcgcccgccgttttccaccgcctcctgccaccgacgctctgcagacacgcgccactgccactccccctctaaaacagaaagagaagaggggaaaaaaaggaaaagagaagaagattgctgactatatggttgatcccacatttttttcacttacatgtgggtctcacgtatttttttttctgattaggatgccatgtcagcaaaactaggcaataatactgccatgggaccttttgtgaacggtttaagtgagtttaggggtacacatttctggttttgtggttaagggagctcaaaaaatttcgctattaagttgagggacctccggtgaacttaggctttgttgggaggtgggtgttgggaatccatctcccctgcacgaaaaacggaatggttcattagcgcgtgattaattaagtattagctctttttttttcaaaaatagatcaatatgcttttttaaacaactttcgtatataaacttttttttaaaaaataccgtttagcagtttaaaaaacatgcgtgcggaaaacgagaggggagagttggaaaagcatactaccaaacacagccttattcctactaaataaacagggctgtgagcatataatacttgcaggattgtaggaaccttgactgcacaagacaattagcaaaacagttcagaattgaaatcacatcagggttcacctgaaatcagcttaaactcttggatttggacaaacttactcatcaggtctccggccaatcatcgccgtcacccgaggctgctgccagccattagtcgtggcagtggtctgcaggcttactgccgcttgccgaggttctaatt

SEQ ID NO: 56939 - DNA, 7711 bp, Oryza sativa
attatttatgaaagtagtaaaacatagttgtcagggttatggataccacatacctaatagtagttgactaaatctcagcaggacccaccacataccatgtcctatacggaaacaacctgcagatataggaggagttgcggataaggaaagacaaccagagttctacatggaaacgacgaggactactcggattgtatccatattggtttccctagttctacttggataagaggacacctatgggtataaatacaaggcctcctaggaggagaggggacacgatcaacacacacccaccatagaaaacacggaacaatagatcaagacataagatcaacatacaagcctacatacgccaagacaagccgacagatatcgacatcagagatatgcctggatcggccctatccggtacctacagaggccggccgtagggatctcgcgctgtctctgattttgccgggtacgaactcgaggaggaagactaccctgttgtcgactacgagtcagaccttcagaccgccatgtcgacaacagttagataggctaccccaaatattgtactggtgtgattatgatgaataagagcaacgaccggcttcggccaacaagatgtagggttattacctgacaattcaggagcccgaacctgtataaaaatcctcgtctttgtctcttttacttcagtctcgcatatatcctagtaccaacgatccccatactatacaaataccggaatcgtgacatcaaacgtcgacaatagtagtgggctatgggcttttgatcacaacagagcatcatgattcttcattatctggcagagggaataaagcaagtattagaagaacaccacctgaaggcaatagaaattaataataactatataacgtacaactgaataagcagtattggcagcaaaaatcattaaccttttccatttagcaattagtaagtaatgacagatggctgaaatacagagatcaactgcattgatctgaagcatgcagcaatcatgcaattgtagtgttaccttctgctcgctccacacacgccctgcgttaactccagccccaagtctgtttatcagttcctttgtctgctcaatctcctcctgctgcttctcccatgtggcatactgagtctccacccaaattgccttcgccaaaacgtattctgaatagtttgccttgtgtgttttggacatgccgaatacagtttccactatcttggtacacaaactgatccaggaaagccgtcatgagaaagaccattggcacttcctgcgtcttgaggtggctctccagccacacaatcgtatccaaatcgacatgattgatcagctcatcgagcagcaccaaatcaggatcctgcgtacaatcagttacagcattgtaaatgcacacagaaactaaaaaccacaattcatcaccaattggcaataataatatatcattccttactccctctccatcacaattacacataactaaattatacctctatcctgttgcatcaattgattgatacatgtaaagctcaattttcttttttatctgtaccagtgtacctaaagaagaatcttgccgagcgacatcctcatctgccaccgctggaggcgacgaggcggtcggtgtcctggggggcgaacccgagcctgggcatgagcttctggatcttgacctcgacatcctgcgaccgccgctgtagcaggtcgagctcgtcgaggagcctccccaggtccatgtcctcggtggcaccctccagcgcggcctgcaccttctccaggcgagacctcacctccatctcctcctcgaatgcggcgaggaactcctctctgatggtgagcaacgcgcagacctcgaactcctggctgagagaggcgatcctcacgtttttcttggccttgacgacattgccggtgtcggggtcctccagccccgcggcgatgcggagatgggtcgtcttgccggcgctgttgacgctgacgagcctgactttctccccacgctgcacctcccaagaaacgtccttgagtacggtcaccccctttaggacttcgagatgctctccagtcgaaaattataatcatttacatctatctaaaggtggatatattttgtatattatttgatccacatctgagttcaccaaaataaagttcaaactccatgtgaagctaacaagttttagtttgattcattttagttctgtagttagattatgctgtatgttaattattctttatacaaaattttagagattttttcttgtactgtaagtgtatcttttgaatctacaaaataaaagagaataaattttatgagtttactggaactttgttcatctaaaatggagctaggatgaacattttatgcatttctaaagtttgtataattttcagttcagcaaataatgctttagatattttcttggtatttatccagaatttaaacaaatgggtccactggtcagtgacctgctaatatgcagaaaggctcttgagatttctaggaatcaacccgcagtcctgtgactgttctctatgtgagcaaacttttataaattagtgcctagagttttgattcttctcagaagaggtccctgcgacctggacaagggtggcatcgatggccggcggccatatttgggttcgccagtggcgaacggtggccgatctcgccgtgtttccaaaatataaaatgtaactaaggttcttacgcacccgttgttagttgaatcacggctgataatgtatcacgatgtctgcgagacaagatcgaccaaacgatgatcacgaacagcgcgcacgtacaccatgcaaaatcaccgcgcgcgtgtgcattagcggatagctgaacgtagtcagcatgtacaggcagtgctcacgtgcgaaaccaagattttagtaccatatgggaaaattatgttggttgaggcccgcataaaagaggaggcgcgagcgctcctcccgccgagctcggtggtgcgggctttgtaaccccagctgcggggggcgggagtttggtaggtttcggccgtttggggatcgaggtaggcattatctctccaaccggggtgcctgtacttgggtgcctagcatacttatatgctgcttgctagggcgggtcaaacggcgtcccaaaccggagatggattctaatagctcgagtgaacgtccacctgcttattgcatgttaactaaatggctatgaaaaattttcaaaaaaattggtaagatagatcaatatgtaatatatcactccacaaacaaacatgcaagttaaaattcaacttctacagattgtaacaaaaataacaagctatgaaaaattttcaaaaaaattggcaagatagatcaatatgtaacatatcactccacaaacatgcaagttaaaattcaacttctacagattgtaataaaaataacaaacaaaactcaaattactatagtatatttatagttaaatttgatctaacttattcatattttttcaatttttttcataaccatttagatgacatgcaataaacgggtggatatccactcgagctgttaaaatagtttcccgtcccacacctgccaactctcttttttttttgttattttctgataaggcgaatccgaccgtgcgcggtggcgtggcccggagtggatcaggaacacgagggagcggcgttgatggcagcggcggtggtgggcggaccccgagaggcgctgtactcgccgcgcgcgtggagctcgtccacgggctgcggatggaggccacgagcccgttcagcgcgtgcagcggcgccggcgaggcggacgcggaggcgaccagcgcgccgacggcgcggcccatcagcaccggatcagttgaaacaacccacatctgccaacacactctcttttttttttttgttattttcgcttctgataaggccttctgataaggtgacggtggcgtggcgccggaggggataaggcggctgctgctgcaacaacgctggcgcctggtgccatgggagaagagacgcacgcatcgcccgagaccccaaacaccttcgaccagcgctcaaagcgtgcgtatctgcatgcgctgcgtatgcgatgacgtagctggatggtctctcaacttttcgccgttggtggtggtgacggcgctggtgcggggagggcggctgcggcgaaatcgaacacccaggtcgagaacgccatgccgacgaagagcgcgcttgtccttgtctgagccaccggaatcttgcacgtaggtttttcccggccgtgcgcctgtgccgattgttgacgttagtcctggcttgcttcagaagtttggctcggtcgtgtggagcggagcgagatgccaggaggacgtcatcttcttcggatcaaataaacagaaataacagatgcaatgcagtttgcgagagttgcgtggagtgcgcggtgtgcgtgtgtgttccagagtcctgaagaaccggatcgtgggatggcacgatttttgggcatagaattcgtttttctgttgagtatatttaggagagtagctccaatttccgttttgcaagtttacagttcagttcaatgaaagaaaccagaaaattgccccacaattcctctctcattttcgctactctgaaactctgcttttctctgttttgtatcccgctctgaatttattcgtttccctgtctgttgccgtgccagacgcgcatagtttgcacgcgaggtgttcgatccagtgcattgtcgctaacaagtggtatcagagcttcttaggttgggggggagggggtggatctgacactatggcgttggttccggtgacggcggatccagcgagggggagctcgggaagcgtgttcctttaccctcaactcacatcaaccaactacactagttgggtgatacgggtgcaggcaatgatggaagatcaaggcatatgggaggtgatcgagccagcggccggagcggctgtcgacccgaggaaggacaagaaggcaaaatcccatcttctccagtcactgccggaagatctcttgatgcaggtggcaaagaagcggacggcgaaggaggtttgggactgtctcaagacgaggttcgtcagggcagacagggtgcgcgacgcgcgcctgcagactatgaaaggagaattcgctagcatggtgatggaggccggggagtcgctggaccagtacgccggccggatcaccacgatgggggtccggcactctgccctcggcgcgacgttgaacgacgccgccatggtgaagaagctgttcgacaccgtcccggagaagttcgtcagcctagtcgcagggatcgagaattctacaacgtcgacgacatgccgttcgaggaggcagtgggccgcctcaaggcgtacgacgagcgggtgcgcaagaagaaagcggcggctggcggagtgaccgccgacggccaggtgctccttactcaggccgagtgggaagtgcgcttcaagaaaggcgggggagaaacctcgtcgccacaaaagaacaagccctctagtgatggggcgaattgcggccaggccgggcgcggtcgtggtaggggtcgcggacacggcggaacgcagagcagcggtggcggctccggcggtggtggctgcgacaagagccacatcaaatgtttcaactgcgaagagttctgccactactcaacgcagtgcccatatccgaagaagaagaaagctgaagcccatcttgcgcagacggacgacaccggtccagctctgctccttgcggtgacggaggcggtgcagaacgcgccggggcagggcatggactgtgggcttgtcatgcacgaggagcgtgtatggcctcgcctgatgctggcagagaagagagcaactgctggtgatctgtggtacttggataatggtgctagcaaccatatgactggggatcgacggaagttctgggagctggacgagactgttacaggggtggtcagattcggcgacgcctcatcagtgcagattatggggaagggttcaatccttttcgcatgcaagaatggtgaccagtggctgcttgatgacgtctactacatccccagcctctgctggaacatggtgagcttagggcaactcactgaaactggccaccgagttgtgatggataatgatgaccttgaggtgttcgacaaaaatccctggcgtctggtgatgaaggtgaggagaacctcgaattgtttgtaccggattgagttgcaactagcgtcccggctagtcgatccatcaaaacactccggacagaccgcggtggcgagttcctgtccggcgagttcgcgcgggtgtgcgatgaggctggcatcgagcgacatctgacggcgccgtactcaccgcagcagaacggcgttgttgaatgccgcaacagatcgatgatggcgatggcgcgctccctcctgaagggaatgtctgttcccggcaggatgtggggggaggcggtgcggcacgccgtgttcctgctcaacctgctgccaaccaagtcgatgggtgaacgcactccgttcgaggcatggacggggaagaagccacacttaggacacttgcgagtgttcgggtgtactgcgcatgccaaggtgacaactccaaatctgaagaaattggatgatcggagtgagcagttcgtgtaccttggcatcgaggaagggagcaaggctcaccggctatttgatccacgacgccgccgaatccatgtaagtcgcgacgttgtatttgatgaaaacacaccttggcagtggagtgctgctgtaggagaggagaattccatcgagtttgtggtagaggaacctgttggcgagcagcagccggtgccggcagaacagtctgccacggtaccgttgtaccgggcgccgccggcagggaggcgagccgacaaggagccagaagtggcggaatagcgaggaacttctccggcaagcccagtgacgttctcacccacgttgcccagcacgcccacacccggcttgacatcaacacactctgccgaggtggaggcgtcaccgagcacggccggcagcgacgacgacccgctgcggtacaggagtctggcgggcatcgtgctggaggcgccacgcgtagacttggtggatgaagaggatggtgaagcactgctcgcagagacggaggagccgtcatcgtaccgcgaggccgcagggagccggcgtgggtcgacgcaatgcagaaggagctggaggccatcgagaagaactcaacgtggtcgctgtgcacattgccggcgggccacaaagcaatcggactcaagtgggtgttcaagttaaagaaaaacactgccggggaagtaatcaagcacaaggcatggctggtcgcaaagggctatgtgcagaggcacggtatagactttgaagaagtgttcgtgccggtggcgaggttggacacggtgcataccatacttgctatcgcagcggaccgaggttggcaggtgcatcaccttgatgtcaagtcagcttttctcaacggggagctagaagaagaggtgtatgttgcccaatcggaggggttcattaagaagggacaagagcaccttgtgctgaaattgagcaaggcactgtattggcttgaggcaggcgccacgggcctagaacatttgcttggacaagagtctgaaggaacttgggtttgtgcggtgcaagcaagaacaagccgtatacacccgaggtagaggagcagtagctgtgattgttggg

SEQ ID NO: 56940 - DNA, 35587 bp, Oryza sativa
  unsure (1)..(35587): unsure at all n locations
agtagctgtgattgttggcgtttacgtcgatgatttaattgtgacaggggagaatcctaccagggtagaagcattcaagaagcaaatgatgggggagttcgagatgagtgatctagggcttttgagttattatctgggaattgaggttggacaaggtgtgaatggaatcacacttaaacaaactgcctatgcaaataaggttctgtcacagttcgggatgttggactgcaattcgacctcagttcctgttgatccaaagacacagcttcagaaggatgcagatggacaccctgttgaagcgtgtgatcggtgtgatcggttgtctttggtatttgctgcatacaagaccggacctatcatatgctgttggagtggcgagcagattcatggagcatcccaccatgatgcacttgaaggcagtgaagcaaattctcaggtatttgaaggggacaatcgactgtggccttgtgtataccgcaggaagtggtgagatcacaatcacggggtacactgacagcgatctagccggagatgttgatgatcgtcggagtacaggaggtatggcgttctatatcaacaacagtttggtggcatggagctcgcagaagcagaagacattagctctttcttcttgtgaagcaaaattcatggcagccactgcggctgcctgccatgcactttggctaagggcattgctgggagagctactcggtgaggagccatcttcttcggatcaaataaacagaaataacagacgcaatgcagtttgcgagagttgcgtggagtgcgcagtgtgcgtgtgtgttccagagtcctgaagaaccggatcgtgggatggcgcgatttttgggcataggattcgtttttctgttgagtatatttaggagagtagctccaatttccgttttgcaagtttacagaaaattgccccacaattcctctctcattttcgctactctgaaactctgcttttctctgttctgaatcccgctctgaatttattcgtttccctgtctgttgccgtgccggacgcgcacagtttgcatgtgtggtgttcgatccagtgcattgtcgctaacatcgatgttctcaagagtgagcttccctgagagagggatctcgttggtcatgttgtttcttgtgtcaactaacatactgatgttctacgcaaccaaccatgccatgttcgagagaaatgattatgcgtaagcttatgtactctacatgtttttaaacatatatatatatatatatatatatatatatcagaatcaatcgagcagaaaagtttgattgagagagagggaaagagagaaccagaacttgaacagaactgattaccgatacccccatcgttggcttgttcatcctgctgagccatttgttcgagtgcatgcatttggtgcgttttatttgacggaatagcgtggttcggtattgcgccataattttattatttccgctagctcctctcagatatttgtagtgaaggattttctcaaccgcaaaaccagatatgcggggtcccctaactgtacaaaaccggtcatccgaggtctttcggcggtattgaccccggttttggtctacgtggcggctgagacagcgtgggacccatgtgggccccacatgtccggatgccaactcatcacctctctcttatttccccctcttctccctttctctctctttcacttttctcatgccggcgatgggcggcgctgtggggaggaggccgccggagggaggggagaggaggtccggtggccggcgtcgcgccgacggaggaaatgccgccgtccgcatccttgttcttcctcccattatcatcatccttgtggtcatcggagggaggcgggacaacacacggcagggcgaggcggcgtcggcaggcgagcacggtggcgcaaaggaggcggcggcggtggctgctatgcgggaggggaggccggttccgacccagaagcaacatcccaagggcacagcgtgcgtcagtggaagtcataggggatcgtcacaagacgggtccactgcgtctggcgatgtgtgtggctcttggcatttgcatcgccggaggggtagtctgatccgccggagacaagcagcgccgccgcctacaagtctttgggcgcctcggtggtcgggcccgggagcaggtgcgcgaggtccggtaagttgagggaaatgggcttttatggtgtggaacaatggagacagtttgttgcctcgccgtacatctgcatcggcgtcaccaccgtcgcaaagtacagggcagtcatcgggaacgagctgcgcgtgggcgggtcgggagcggcgctgatggcggtgcgggagctagttgctcggtgtcaccgagagcggcttcaggggaacctaccagaacgaacaaccctcctcctcgcccgccgccgccgatggcggagcacgagggagcagcgctgatggcggcggcggcggtgggcggacaccgggaggcgctgtactcgccgcgcgcgtggagctcgtccatgggctacggatggcggccacgagcccgttcagcgcgtgcagcggcgtcggcgaggcggacgcggaggcgaccagcgcgccgacggcgcgcgcccatcagcaccggatcaggtgagagacaatgtatacatctatcttttctctgaatccttcatctctgttcagttcaactccatctctgaaaagactgaaacattttgttgattggtaggtatattactcatgtcaaaagtgtcgatgcgtgtgatcgataatcacagtgtttgttgtgtgtttgcatgatgattgccaatttgccatgcgtgaatgcgtgcaagcttgagcccgggcctggtaatcacatgccatggttgtcctgttcttgtctcagctcgttgctgcgtttggattatgttggaaatatgatcacaatttggcatattttaatccaaaatattaagacaataagtatgacttttgcagggagtaaactagtgatcaaagagagtaaactacagatcatgcttaatatagaataagcataagaatttgtcacaacagaatgcaatgaaaccattgcacctaacaaaaatatagaagaaaagaacatgaacacagtgaaaaacgagttataccctgagaatggccctccgctggtgtttgaggcagtattgcctctgttggtgttatctctaggtgcaccgccgttggtgtcatctgttgacatgatcaccgatcacctggaacaggagctgaagaagttgattcccaatgaataggagaagaaccgtgagtagtcgtgcggaagcactccccaaaaacctgatcgcccatctaccgatgcaggtactcaggcaaaggcgtggttccggaggccctgctcgtcacgatcactagtgcacgcaagcgatcagaaccggggagaacagaagcaacgcaggaacagatggaagatgaaccaccgaagagtaaaccaacccgaacgtggagtaaaccagatcagatcgagagtagagatcttttctcctctcatctgtctctatgacccttgtagggtgtaggagggggatgggaagagaatcaatcccgattgcttccgcttccgttaccgcagtaacaagtaatcgttgcggaattatttggattcaattctcaactgttgcaaaacttagagagagagagagagagagagtagcagccgccgctcgcctgcctcgccacgccacgctcacggctcggcgcgcgtgcgcgtgtggctgtccgagccccacctcaaccggtcaacagggaatctccaataaactcacaccacttttaatctccaatgtgctattattgtcacctaacatttattgtggccccggactctttcgcttcgcccacgccgacgccaacctccaccgtccgccacgccctcaactccgtccaagagaagaggataagagaaaagatacaggaggagggagggagtgagatgaggttgcatcttgacatgtggggcccacgtgggtcccacgctgactcagccaccatgtagaccaaaaccggggtccaaaccactgaaggacctcgggtgaccggttttgtatagttaagggaccccgtatatctggttttacggttcgaggatattttttatcccgatgacaagttgagggaccttcggtgtactttttccaaaagaggatgcgctcgtttggcttatgccgagcctggttgtgtgggcttgtcacctcagctgctggcggtaggagttctcctcctctttcccccaggagggaggatgggatttaaaatttcccttacccatagtatttttgaattttgatatagaagtatgtataatttgtgggttatttttaaattttgatatagactagaaaaaatgtatgtataatttgtgggttatttttaaattttgatatagactagaaaaaatacccatgcgttgtaacgggtgaagatattttaattttattattgttatatagtttagttaaggtgaaattcattgtgttaaatttgcttggttgtatattctgttagcaaatcataagccgcaattaggagtccgatcatcccaagttagcatgcgagtttttttaaagagatttcttgtacgattccttttgtatttccaaaagcgaacgatcttaaaaaccgagtcaatatagatttgtatttccaaaagcgatcaaacttaaaaacaaacacataaacggatgacgtactaaagtaccggtaaaaaacatcttcaaattttataatagtacagaagtatgtaaaatttgtgggttatttgacatgggttatttgaaggaaaaaaccctataattttgtgcaacttaaaccaaaacatatgcggtttcacgtgggatactccagaccgctctaacaaataaccatgcatatatctcccaccatggggacaggtttactattccggtatgcataaatctaggggaccaaaatttccgaaattttggatattttggaaccgagagaaacaaaattgaatttatttttttctaaattcagaaaaatatgtaaaaaattgggccaaatagttgctcaacggtggggtctgatattttggaaattttgaaccaaaattgcgaaccatccatggggcatgcattattttttttaaacaacccacgaaagattagtacgacgtttcttctaacagagcagaaaaacattacaatactatagccctggaaggctatagctaggaaaaaaaaaacaaccacaccattcgtctacagccagatcctgccactgaaaggcaataaaagcacgacacccataaggaaagggccttctcgacgatgcctccgagaaggaaacgacacctgaaattgccgccactggccatcctggaaaaccaggacattgttttcattcgaagaaaatccataaagaagagcagaggagatcacacagtaacactctgagagaaagctgcgcccacatacatcgtcattgctggctggaaggctgggtttttgcccatgatctttctgccctccccgagtcgaggtcatttgccggaaactgcagcccaccacccatccagcacatcgttgctagtcggctatcaaggagctcggtcaccgacgcgctccgaatccatccacgcaattggtttcgagagggagagggtaagagagaagaatggatcccctctcccctatactagcccaccaatgcggccattttgtggcgggcaaggcaccgccgcaagatggctagtgtttggatcgtggcctgccacaggcctgcaccacccacctcacgatgtcaccgtagatgccgcctcggtcggacaacccgtggtacctccggccgcctaaggccacccaccctcatcatcgtcgcctcgccttgtctccccttgccgtcactgcgggcgttaattaattgtcaatactagaaatccaaatttgccagtgacacagacatgtaattgagaaatttcagccagccggcatgcatgtaactaaaaaaccatgttctgagaaccaaagattggaggcagtagatctattgggcgggtggtcccggttcccggacctctgaatatttatgtctactacttaaaaaatttttaaagttgtttccgccgtccgtccgtgaaaaaagggcgaaaaaattagggcaaaaaattcgaatccgattatatgtgacgcggtaaaaaaatgcgacatggtaaaaaaacaaataaattgaaaacgtttccatcgtccataataacagaaaaaggcgaaaaaattaaaacaaaaaggaaaatccgattcaatttgacgcgggaaaaaatctgtaaaaaaagctcttaagaaagggcgataacaaaacaaaaaaaacccgtagagaagggtgaaaaaaagaaggatgcatacaaaatccaatcggagatagaacgcagaggaagagaaatacttacaaaattaaaggtttttctgtcgtccgtctgtgcaaaaagggcgaaaaaaatcgaattcgattatatgtgacgctgtaaaaaaatgcgacgctaaaaaaacaaataaattgaaaacatttccatcgtccgtaataacggaaaaaggcgaaaaaacattaaaacaaaaaaaggaatgtccgattcaatttgaagcggaaaaaaatctgtaaaaaaaagcccgaagaaagggcgataaaaaaacaaaataaacccgtaaagaagggcaaaaaaaaaaagaaggatcgatacaaaatccaatcagacatagaacggagaggaagaaaaaacgaactagaggaataataaaaacctcacaaatcaggattttcgtccgtcttagttgcggacctcctccctccgattatctatcaatgcaccaataaaccaatctcaaataatcacaaatctaaccaaaaaactaaagcccaatcccaatccaatcgaaatcatccaatctcaaattatcataaatctaacccaaaaactaaatcccaatcccaatccaatcgaaatcatccaggataggagacaatcaaataagagagaagaggctgaaatcacaaaataaatcacatcacagaggtgatgagtgtagagggaggggtgagcggacgcttctgctgctcctcgccacctcgccgccgtggaggtctcgagccaccactgcgctgaggagccaccgagtagctgctgcgccgggagctgccgacccgcgcccctgcaccgctgctgcgacaggagctgccaacccgcacccttgcgccaccactgaactggggagatgtcgagaaggagggaagaggaagaaggcgatgacgaggccgaggaggcgcggccgcgcggcgaggtccggtggtgggaggcagatgcgacaggccataggggtggtggtgaggaggaggtgggcggtgctggggtcgggcgggagtcgggcggcggtgtggggtggaggtactgagggaggaagaggagcgggtggttgattggtaggtcggctccaactggtttattttaataggggtcggtatccggtttttaaaataggtgttggttttttttagaacagtcacctataagactaatatagatcattaatatatttgttggttgtgaaaaaccgggacctatatatattataggtgttggttcttttttttaaaaaaaactagcatttctctagtacttaaaaaattgaaaacgtttccgtcatcacatccatcttaaaataaagaaagagcggattttttttttcgcactatccgattccgccaccacacgaaaattggatacatactcgatttggactcaaaatcggatgaaattaaccccataaatacgaaggattccacgacaatccaatcgggctggactactacttaaaaaattgaaaatgtttctgtcctccgtcttaaaataaaaaaacagtaaacaataatctccgcccagtccgattgcgccaccacacgaaaattggatacaaactcgatttggactcaaaatcggatgaatttaaccccatatatacaaaggattccacatgacattataatcggacaatccagctattgagaaacagaatgggaagaaacatagaaacatcagcgtgaagctgccaacgccgtcatcaccacctgatctgtccacgggaagctgccggcaccatcggtgcagccggatcggcgacgtctacgtcgccgttggatccgctggacctttgtgcccaaaaatggtggtgctagcagcatcaaccacctctcccggtctgtgcttctctggttcaatcctccccctatcactttcatgtccttgactttgtttgggaggaaatccgttgggcttccattcagtatatgcaggggttggtctatgcccctcacatcatgaggatgattgagacagtcacgcagctacggtttcatcatgaggtgcctcacctgtagcttcacttgcacctcatcaaggccgatcattcctcccgtgcgagcactcctgcagctggggacatctcttccacctccactcagcctcctcctactcgtgagtgcccctctcctttggctcgtcgtgagccgtgtcccttattccactttttgtggagtctctttggcctttgctctgcggaggccaaaaagaaccgcaaagcacggaatgaggtgaagaagatggttaggcgcgtcaaacacatgcatgcgcagctcaacgagcatcttcacgtgaatgttccttcctccccaccgggctttgaggctgagcccgatgagcccgaggaggagatagaggatccttttgctgggttgcctccggattttgacttctttgggtttagccatggcgatggctatccccctcctcctcctccagaggatcctcctcaggccccgttcgcttgagctcgttggatcgtcctctctttttggtgctttgatgccaaaagggagaatttttctattcattacattccatctttggtcgaaccatgtggtttttatgtgtatgagactatgtgttaatggtttgagtttttgtaatccctttatgcattagtgtaagactatcatttgtgatattgggatgtaatgactattatgccttatgttaatgtgctgcaatgttctcatttctttatatattgtgcatgtgatgagtgaaatggcttatgattgttgtcttgtgagcttcaatatcgatgcaaagatttatggagctctccacttgccttaatgcacacttctagtgggagttttcactaaacctttacaccaaaaccttctattatattcattcccaattgtaatctaatcatattgtcatcaatcacctaaaagggggagattgaaagtgcatctaagcccctaatgattttggtgattaattacaatgcgattagaaaggataacattttttattcaagcaaatgtgaaggttgttatgtcctcgatgagttgtagtgtaatgcatatcccgcaaaaatcgtcgttatgatgagatgcggcaaatgaacaaatggtatattgtactttttcatctctttgggcctataggaaaaccgcactattaagagggatgatgcattgacatatgacgagtgatgaatgtgctcaaaatcaatttttaaaagtgtttctcctctgatttgtgtgttctggaaattttaagagttattcaaaactgattttcggaatttccgaaaatacacagaaccaaaattcgcttatggaaattttcggatatgtctaaaagagattttcggaacttccgaaaatgactaagtttccaaacatggttctgtatattttcggacttgtccgaaactgattttcggaacttccgaaaatgacagtggagtcaaaaaatcgtttctgtaaattttcggagttgtccgaaaccattttttggaatttccaaaaatttttggacttgtgcgaaacctgtgaacccaaaaacacttctggaaattttcggacttatccaaaaggaagttttataaggttgttttggttttggaaatttcggatatatccgaaaaattttcggaatttccgaaaatccttcagttgatttcgttgtttcactgttctagaaattttcagttatatcttaaattatttttcggaatttccgaatattgcaattattgtgcctaatgggcagatctggagctgtggctataaataggccattcccctcacttgtgagggctactggtgacattggatattttgtgtccttggcttgttcatcttgagattcacttttgagccttgctttcttgtttctcctctcacccgtgttcgattcggatttggtgtgtgtgtgagagttgtggattcgagtttgtgtgagtgcttgttgttaacttcatgaagattcgagagcacttgtatcatctctgggagttccttgcatcatttgttactcttggaggttgatgactcctatgcggatagatgtcactctcaagccaccgatctacgtgtggttggccgggagaaatttgtgaaggtcggatctcatctccgaaagggaagagataccactagtggaagggggagtgatttgtgcaacctcttgaggaaaggattagcaaagacccggctctttatcagctactcaacatggagtagaatcccctcaaggattcgaacttcgggaataacttcatatgcttcattcttggtaatataacttcctacctctcctctagctttgtttgattatgccgctagttgctgtttgtgctagcatattcttgttgtaggcagctagatctataatttactttgatttgcccttactctgctattttcggaaattccgaaaaatcatttttggaaatttcaaaagttactgctttgcatttacttgagtttttgaattagcctattcaacccccctctaggcctaattgaccatttcaatggaaatcaagtttaagaaattatgcatctaacaaaattataatcatctcattgagagttggaaccaatttcttatgtattataatcgtttacatctctctaacggtggatatattttgtatattatttgatccagatccgagttcaccaaaataaagttcaaactcacgtgaagctaaaaagttttagattgattcattttagttctgtacaaattttataagttagattatgctgtatgttaattattctttatacaaaattttagagatattttcttgtactgtaagtgtatcttttgaatctacaaaacaaaagagtatagattttatgagtttactggaactttgttcatgtaaaatggagctaggatgaacattttatgcatttctaaagtttgtataattttcagttcagcaaataatgctttagatattttcttggtatttatcgagaatttaaacaaaggggtccactggtcagtgacttgcgaatatgcagaaaggctcttgagatttctaggaatcaacccgcagtcctgtgactgttctgcatttgagcgaacttttataaactagtgcctagagttttgtttcttctcagaagaggtccctgcgacctggacaggggtggcatcgacggccggcggccatatttgggttcgccggtggcgaactgtggccgatctcgccgtgggtccaaaatataaaatgtatctaaggttcttacgcatccgttggtagtttaatcacggctgataatgtatcacgaagtcagcgagacaagatcgaccaaacgatggtctttttttttgttattttctgataaggcgaatccgaccgtgcgcggtggcgtggcgcgagggagcggcgctgatggcggcggcggcggcggtggtgggcggacaccgagaggcgctgtacttgccgcgcgcgtggacgagctgcggatggaggccacgagcccgttcagcgcgtgctgcggcgccggcgagacggacgcggaggcgaccagcgtgccgacggcgcggcccatcagcaccggatcagttgaaacaacacacacgtcacacgatcagttcagagacaatgcatacatcgatcttttcgttgaatccttatctctgttcagttcaactccgtctctggaaagactgaaacattttgtcgattggtaggtatataactcatgtcaaaagtgtcgatgcgtgtgatcgataatcacagtgtttgttgtgtgtttgcatgatgattgccaaattgccatgcgtgaatgcgtgcaagcttggagcccggaccgggtaatcacatgccatggctgtcttgttcttgtctcagctcgttgctgcgtttggacaatgttagaaatatggtcacaattcagcatattttaatccaaaatattaagacaataagtatgacttttgcagggaaggaaagagagtaaactacagatcatgcttaatatagaataaacataagcatttgtcacaacacaatgtaatgaaaccatttcacctaacagaaatatagaagaaaagaacatgaacacaatgaaaaacgagttataccctaagaatggccctccgctggtgtttgaggcagtattgcctccgttggtgttgtctctaggcgcactgccgttggtgtcatctgttgacatgatcgtcgatcaataggaacatgagctgaagaagttgattccgatgaacaggagaagaaccgcgagcagtcgtgcggaaacactccccaaaaagctgatcgcccacctaccggtgcaggtactcaagcgaaggcgtggttccagaggccctgcttgtcccgatcacttgtgcacgccagcgatcagaaccagggagaacaaaagcaacgtaggaacaaatggtagatgaaccaccgaggagtaaatgtgtggagtaaaccaaaccgaacgtggagtaaaccagattagatcgagagcagagattttttctcctctcatctgtctctgtgacccttatagcgcgcaggagggggaggggaagagaatcaatcccgattgcttccgcttccgttaccgcagtaaaaacgtaatcaatcaaggaattgattctctcgccgttactaaagtaatcgctgcagaattatttggattcaattctcctgtcatatgtctctgtgacccttatagcgcgcaggagggggaggggaagataatcaatcccgattgcttccgcttccgttaccgcagtaaaaacgtaatcaatcgaggaattgattctcttgccgttactgaaggaattatttggattcaattctcaaccattgcaaaacttagacacagagagagagcagcggctactcgcctcgccacgcccacggcctcggctcggtgcgcgcgtgtggttgtctgacccccacctcaaccggtcaacagggaatttccaataactccgtatttaagttgagatactacacttttaatcttcaaggtggtattattgtcccctaacatttattgtgggcctttgagattttaattgaattaaattgggcctagcctatttattccaacagattacagccatcaccggaggacagcgacggcgtgctcgccatgccaaggaggtcgccgaccatggacgtggtctcggatctggtcaccgccgtggcgggcgacgactggtgggtccatgacatcttcttagctggttggtgcatccacacgccgccgccgtcgccgccgccgccgtcggcggcgccccccgcggtggccccggactctgtcgcttcgcccacgccgacgccaacctccgccgtccgcagcgtcctcaactctgtccaagagaagaggagaagagaatacagagaggagggagggaatgagatgaggtggcatcgtaacatgtggggcccacgtgggtcccacgctgactcagccgccacgtagaccaaaaccggggtccaaaccaccgaaggaccttgggtgaccggtttcgtatagttaagggaccccgcatatctggttttgcggttcgaggaagtcttttatcccaatgataagttgagggaccttcagcgtactttgtccaaaagaggatgcgctcgtttggcatctgccgagcttggttgtgtaggcttgtcacctcaactgctggcggtaggagttctcctactctctcccccaaaagggaggattggacttaaaatttcacttaccgatagtatttttgaattttgatatagaagtatgtataatttgtgggttatttttaaattttgatatagaccaggaaaaatgcctgtgcatttgcaaggggtgaagatattttaattttattactattatatggtttagttatggtgaaattcattatgttaaatttgtttggttgtatattctgttatcaaatcataagctgcaattaggagtccgatcatcccaagttagcatgcgagttttttaaagagatttcttatacgatccttttgtatttaagaaagcgaacgatcttaaaaaccgagtcaaatatagatttgtatttccaaaagtgaacaaacttagaaaacaaactcataaacggatgacgtactaaagtaccggcaaaaaacatcttcaatttttataatagtagagaagtatgtaaaatttgtgggttatttggcatgggttatttgaaggaaaataccctgtaattttgttcaacttaaaccaaaacatatgcggtttcacgtgggatgctccggaccgctctaacaaataaccatgcgtatatctcccaccatggggacatgtttactatccggtatgcataaatatatatgggaccaaaatttccggaattttggatattttggaaccgagagaaagaaaattgaatttatgattttttctaaattcaaaaaatatataaaaaattgggcgaaatagtttctcaacggtggggtctgatattttggaaattttgaaccaaaattgcgaaccatccatggggagttcattattttttttaaacaacaacccacgcaagatagtaagacgtttcttttgatagagcagaaaaacattagaaatctatagccctgaaggctatagctaggaaaaaaaacaaccgcaccattcgtctacagccatatcccgccactgaaagggtaacactatctcgacgatgcctccaagaaggaaacgacacctgcaattgccgccactgcccatccttgaaaaccagtacattgttttcatttcaagaaaatccatcaagaagagctgaggagatcacacggtaacactctgtcagaaagcggcgcccacagacgtcgtcattgctggctggaaggctgggtttttgcccatgatctttctgccctccccgagtcgaggtcgtttgccggaaacagcagctcaccacccgtccagcacatcgtcgctagtcggctatcaaggagctcggtcactgacgcgcttcgaatccatccacgcaattgggttcgagagggagagggtaagagagaagaatggatcccctatcccccatactagcccaccaatgtggccattttgtggcgggcaaggcaccgccacaagatggcaagagtgtttggatcgtggcctgccacaggcctgcaccacccacctcacgatgtcaccgtagatgtcgcctcggtcgggcaacccgtggtacccccggccgccttaggccacccgccctcatcgttgtcgcctcgccttgtctccccttgccgtcacttggggcgttaattaattgtcaatactagaaatccaaatttgctagtgacaatgacatgtaatggataaatttcacccagcgcgcatgcatgtaactaaaaaaccatgttctgagaaccaaagattggaggcagcagatctatagggtgggtggtccaggaccgggaccgggaccaggacctctgaatctttatctctactacttaaaagttaaaagttaaaggtgtttccgtcatccgtccatgaaaaaagggcgaaaaaatcgggaaaaaaatcgaatccgattatatgtgacgcgataaaaaaatgcgacgtggtaaaaaaacaaataaattgaaaacgtttccatcgtccataattatggaaaaaggcaaaaaaaattaaaacaaaaaaggaaagcccattagaaagagcgataacaaaacaaaaaacccgttgagaagggcgaaaaaaaagaaagatccatacaaaatccaatccgacatagaacgcaaaggaagagaaattcttaaaaaattaaaggtgtttccgttgtccgtccgtggaaaaaagacgaaaacaaattgaatctgattatatgtgacgcggtaaaaaaaagtaaactgaaaacgtttccatcgtccgtaacaatggaaaaaggcgaaagaaacattaaaacaaaaaataggaatgtccgattcaatttgacgcggaaaaaaattctgtaaaaaaaagcctgtaagaaagggcgataagaaaactaaataaacccgtaaagaagggcggcaaaaagaaggattgatacaaaatccaattggacatagaacaaagaggaagagaaaacgaactagaggaataataaaaacctcacaaatcaggattttcgtccgtcttgttgcggacctcctccctccgattatctatcaatgcaccaataaaccaatctcaaataatcacaaatctaaccaaaaaactaaagcccaatcccaatccaatcgaaatcatccaatctcaaattatcataaatctaacccaaaaactaaatcctaatcccaatccaatcgaaatcatccaggataggagacaatcaaataagagagaagaggctgaaatcacaaaataaatcacatcacagaggtgatgagtgtagagggaggggtgagcggacgcttctgctgctcctcgcccaacctcctcctcgccacctcgccgccgtggaggtctcgagccaccgctgcggtgaggagccaccgagcagctgctgcgccgggagctgccgacccgcgcccctgcaccgctgctgcgacgggagctgccaacccgcacccttgcgccaccactgaactggggagatgtcgagagggagggaagaggaagatggcgatgacgaggccgaggaggcgtggccgcgcggtgaggtccggtggtgggaggcagatgcgacaggccataggggtggtggtgaggaggaggtgggcggtgctggggtcgggcgggagtcgggcggcggtgtggggtggaggtaccgagggaggaagaggagcgggtggttgattggtaggtcggctccaactggtttattttaataggggtcggtatccggtttttaaaataggtgtcggtttttttagagcagtcacctataagactaatatagatgattaatatatgtgttggttgtgaaaaactgggatctatatataatataggtgttgattcttttttttttaaaaaaaactagcatttctctactacttaaaaaattgaaaacgttcccgtcatctcatccatcttaaaataaagaaagagcgaaaaaaaatcttcgcactatccgattccgccaccacacgaaaattggatacatactcgatttggactcaaaatcggatgaaattaaccccataaatgtttccgtcctccatcttaaaataaaaaaagagcaaaaaaataatcttcgcccggtctgattgcgccaccacatgaaaattcggtacaaactcgatttggactcaaaatcggatgaatttaacccccaaaatacaaaggattccacatgacaatctaatcggacaatccagcgattgagaaaaagaacgggaagaaaaataggaacaacagcgtgaagctgccagcgccgtcgtcgccaccggatctgtccacgggaagctgccggcgccatcggtgaagccggatcggcgacgtctacgtcaccgttggatacgccggacctttgtgcccaaagatggtgatgctagcggcatcaaccacctctcccagtctgtgcttcttaggttcaatccacccccccatcgcttcaatgtctttgactttgtttgggaggaattccgttgggcttcgattcagtataagaaggggttggtctatgcccctcacatcccgggcgagcacttcttcagctagggacatctcttccacctccactcagcctcctcctactcgtgagcccatctcctgtggctcgtcgtgagtcgtctcccttattccacattttgcggagtctctttggcctttgctctacggaggccaaaaagaaccacaaagcgtggaatgaggtgaagaagatggctaggcgcgtcaagcacatgcaggcgcagctcaacgagcgtcgtcacgtggatgttcctccctcccaaccgggctttgaggctgagcccgaggagatagaggatccttttattgggttgcctctagattttgacttctttgggtttggccatgactatggctatccccctcctcctgctccagaggatcctcatcaggtcccgttcgcttgagcttgttgcctcgtcctctctttttggtgctttgatgccaaagggggagaatttctctattcattacgttccatctttggtcgaaccatgttgtttttatgtgtatgagactatgtgttaatggtttgagtttttgtaatccttttatgcatttgtgtaagacaatcatttgtgatattgggatgtaatgactattatgtatgccttatgttaatgtcatgtaatgttctcacttcctttatatattgtgcatgtgatgagtgaaatggcttattattgttgtcttgtgagcttcaatgtggatgcaaagatttaggggagctctccacttgccttaactcacacttctagggggagttttcactaaacctttacaccaaacccttctattatatttattcccaattgtaatctaattgtattgtcatcaatcatcaaaaaaggggagattaaaagtgcatctaggcccctaataattttggtgattaattacaatgcgattagagaggactaatattttttatttaagtaaatgtgaaggttgttatgtcctcgatgagttgtagtctaatgcatatgccgcataaagcgtcgttgtgatgagatgcagcaaatgaaaaaatggtatattgtactttttcatctctttgggcctataggtaaactgcactattaagagggatgatgcattgacatataaggagcgatgaatgtgctcaaaatcaatttttaaaagtgtttctcctctgatttgcgtgttctggaaattttcggacttatccgaaactgatttttggaactttcgaaaatactcagaatcggaattctcttatggaaattttcgcatatgtctgaaactgattttcagaacatccgaaaatgatagtggagtcaaaaaatcatttctgtaaatttttggagttgtccgaaaccatatttcggaatttctgaaaatgtctgtgaacccaaaagcgcttctggaaatttttggacttatccgaaaggaattttttaattttcaaaattatccagaaggatatatccgaaattatttttcgtaatttccgaaaatcgcaattattgtgcataacgggcagatctggagctgcagctataaatagcccactcccctcacttgtgagggctgctagtgacattggatattttgtgcccttggcttgttcatcttgagattcacttttgagccttgctttcttgtttcccctctcaccagtgttcaattcggattttgtgtgtgtgagagttgtggattcaagtttgtgtgagtacttgttgttaactctatgaagatttgtgagcacttgcatcatctccgggagttcattgcatcatttgttactcttggaggttgaggacgcctaggcggctaggtgtcactctcgagccacctatctacgtggggttggccgggaaaagtttgtgaaggtcagatctcacctccgaaaaggaagagataccactagtggaaagaggagtgctttgtgcaacctcttgaggaaagggttagcaaagactcgggtctttgtgagctccacaacggagagtagaatccacaactctcacacacaaaccaaatgaaccacaattctcttagcgtgtgtttggtttcgggactaggtgggatgggatgaaaccattcctgattttggggttgggatgattccatttacgtgtttggtttgtaggatgggataatcccaattttttgtttggttgaaaggatgagctagagatgggatgagcgccgtttgctatcaccgtcagcgagaaagaggagagcgagcggaggtgtgacgacagcctagtgggagctcggcgggtgggtggatgagcgcgacgatggctggcggcgaggaggagcggcgcaatattgcgagcaggtggacgaacagaggaggagaacggacgggcaagcaggggtgcagttggaggagcaagccggcggcgagcaggcagaggacgcggatccgcctccaccgccctccccaccactagatccaccgtcgccgtcgctaagccccccgcagtcaccgtcgctgagcccccgccggtcgccgtcgtccaggcccccgcggtcgccgtcgctgagccccccgcggtcgccgtcgtccagtcccccgcagtcgccgtcgctgagtcaagccccccgcggtcgccgtcatcgagcctccacggtcgccgttgtcgagcctccacggtcgccgtcgccgagccccccaccgtcgccgagccaagcccccgcgaccgcggtcgtcgtcgctgtcgccgagccgagcccccgcggtcgccttcatcgagcctccacggtcgctgtcgccgagcctcccgcagtcgctgagccgagcccccgcggccgcggtcgtcgtcgccgtcgccgagccaagcccccagcggtcgccgtcgccgagtcaagccccccgccgtcgccaagtcgagcccccgcggccgcggtcgttgtcgccgtcgcggagcccactgcggccgccatcgccgagcccgctgcggtcgccgtcgacgtcgctgagcccgccgcggccacggtcaccgtcgtcgagcccgccggtgtctgccgctgctcctgagggcgagtagggcgtgcgcgcaggctggcctcgagctcgagcatgtcacaccgttcgctcgtcccaaccgggacgagttcgtccgccagaatttgccggatcggttggtcccggatctgagaggaatatttctctccagggaccaacccatcccactcacccctcaacgaaacaacctcaaaagtgggttcgtcccatcccatccgattccatccttgcaaccaaacgcacccttagatcatcaacacctaaatgcctaggcttactacctacaattctctttccatctccatcgtaaaccgattctctcattttcttttttttttatctccttctcgtccccccatttctagtttaactgtacgacactgtatttcaagaatattcgtatctctatagaaatagtttgtcctggtcagtctttttataattagggtcctccgcccgcttcatgaaccactcgcggtctgcccccacatggccagccccttcgtattttaatgctaacggattttcttcactatcaggtggaccccatctccaacatatattccttcagatggatgaaactgaacactgaacttgcaggatggagttgcgggtgcaggaattgtcgcacgggataatacaggaaactttgtcactgctgagtgtcgaagatatgaccatatcagtgatccgagcacagtggagatgagggagtgatgtccttttatagggcagttatgacggttgtgagaaggggaaatgtccgaactgccccacaacagtcattgggagagtgtttggagcgtccacgccaaaccctaggatcaatggtgatcaggggggttcggccgaactaggggattcggccgaacctgggctgggccctcctggcctggctttcggtcggtggactccctggaccttcctctgtccatttctcaaagttttgggttgattcattgatgtttcgatgaagttcacaacccctccttgtatggatatatgattctcctctcttttagtctagatttcctcccaacatcggggtttatcacctgcatacaaatatataccaacacttgtggaataggtgagattaagcacctatcactatgttggatgttttattatctgaactttaggaatatgttggaggtatggaatcagcatttaacagccgccaacagcgtcatcgaactctaagggagcatccttagctaacagtttggtcagaggtcaggcgattgtagagaagtccttgatgaatcttctataaaagccggcatgtcccaagaaactgtggatccccttgatgttcataggaggaggaagctgatctattacattgattttagtatgatcaacttcgattcctcgttcgaatactcgatggccaacaactatcccttcacggaccatgaaatgacactttttccaattgagtagcaggtccttctcttggcatcgttgtaagactttgtctaaattttgtagataatgaccgaaggtctttccataatgtcctcgatcatgtccgagaaaatagacatcatacacgtttgaaaagatgcaggagcttacacagtccgaaggacatcctacgataagcataggtaccgtacggacatgtgaacgtagtcttactttggtcctccggatggatgggaatttgatgatacccggaatacccatcaaggaaatagaaaaaagaatgatttgccagccgttccaacatttcatcaatgaagggtagcaggaaatgatcttttttcgtagccttgttaagttttctgtaatctatgcacatcctccatccggttatggttcgttgcggaatgagttcattttgagcatttgcaacgaccgtcattcctccctttttcggcacaacctggaccgggctaacccactcactgtatggtacgggataaataatcccggcatgcaggagtttcaagacctctttctttacaacttctcacatcgcgttattgagccgtcgttgaggttccctggagggggtactctcggggttaatagggatacgatgagcacaaagcgcgggattaatccctctgagatcttgaagggaatagccaagagcagcgtgatgcttttctaacacagacagaagacgttgagtctcgtcttcagagagcttggtcgttgcaaatgctcaaaatgaactcaaatgctcaaattctcacaggattggaagatcgagagtctctccgggttccgcttcttccttgatgaagtcggggatttcattttccagaagggtctcgtgagacttgtgagggggaactaccgtaacctcctccgctgattcaatctctaggagagagccggttaaggcgaaccttgcccgcgagaatgggactgagaattcattccctcccaaagttatcttgaggctatccaacttgggcatgtttatgagaagttgctcaatgggaaggccgattagaatgtcaaaatcttggatttttgaagacgtggaaattcaagactgcctccctgtcttcaaaacggacaggcacatattgtacaattccaaatccttcaatgatatttccgttcgggtgcttgaagaatttgtttgtcggggttactgccttatcgctcagataagcaaatgcaaaagactcagagatgagattaaccccgacagttggactgtaaagaataccaacgtcgttcccctccagatggcagggaatgattcggggagcagtatttatctgaattacttcggatgaaagctctgcctaccttagctattcgtcgctcattatggaagttaactcccgagcagtttcccttaggaacccaagttccataggatcaggaggcggcaaggggatgagtggtttctttttactgaagtagttcagggtgttgccataatcttcatcaaaaccgtccctgaacagaactaccgcacgatccggcacgttccgaaaaaaataccgcttccgtatttacttgagtttttgaattagcctattcatcccccctctaggcctaattgaccatttcaatggaaatcaagtttaagaaattatgcatctaacaaaattataatcatctcattcatagttggaaccaatttcttatgaattttagaagttcttcttttatttttaattataatcatttgcatctatctaaaggtggatatattatgtatattatttgatccagatccgagttcaccaaaataaagttcaaactcatgtgaagctaacaagttttagtttgattcattttagttctgtacaaattttataagttagattatgctgtatgttaattattctttatacaaaattttagagatattttcttgtacagtaagtgtatcttttgaatctacaaaacaaaagagtatagattttatgagtttactggaactttgttcatgtaaaatggagctaggatgaacattttatgcatttctaaagtttgtataattttcagttcagcaaataatgttttagatattttcttggtatttatcgagaatttaaacaaatgggtccactggtcagtgacttgcgaatatgcagaaaggctcttgagatttctaggaatcaacccgcagtcctgtgactgttctgcatttgagcgaacttttataaactagtgcctagagttttgtttcttctcagaagaggtccctgcgacctggacaggggtggcatcgacggccggcggccatatttgggttcgccggtggcgaacggtggccgatctcgccgtgtgtccaaaatataaaatgtatctaaggttcttacgcatccgttggtagtttaatcacggctgataatgtatcacgaagtcagcgagacaagatcgaccaaacgatggtcacgaacagggcgcacgtacaccatgcaaaatcaccgcgcgcgtgtgcagtggcggatagctgaacgtagtcagcatgtacaggcagtgctcacgtgcgaaaccaagattttagtaccatatgggaaaattatgttggttgaggcccgcataaaagaggaggcgcttgtgctcctcctgccgagctcggtggtgcgggctttgtaaccccagctgcggggggcgggagtttggcaggtttcggccgtttggggattgaggtaggcaatatctctccaaccggggtgcctgtacttgggtgcctggcatacatacatacgctgcttgctagggccggtcaaacggtgtcccacacctgccaactctcttttttttgctattttctgataaggcgaatccgactgtgcgcggtggcgtggccttcgaccagcgctcaaagcgtgcgtacctgcgctgcgtatgtgatgacgtagctgcatggtctcaaactttcgccgttggtggtgttgacggcgagggtggccgtggcgaaatcgaacacccaggccgagaacgccatgccgacgaagagcgcgctagccaccggaatctttgcacgtaggtttttcccggccatgcgcatgtgccaatgttctcaagattggattttttttatttttaattttttttattaaaagttttacaaaaataattttctatttcaaaatttgacaaaagtagtcgccgccaccctctaggagggcgacttttaaatatcgccctcccagagggcggcaaatgtgacgtggccgacggccgttcactctcgggcgacggccgtcatggaaatttgcaggcgacccccttgccgccctccacaagggcgattttacactgtgcggggggtcgcctgcaaatgggtggcgagggggcctggaattttgcaggcggcccccttgccgccctggaggagggcgattttgaactgggcatatgtttctgaaataaatatttttataattatcaatagatcagttatccaatcttttatattgaaaactcaatacaagattttagtttccaagattggtaaaatctaattttatcaattttttattcttacgcatacaaaaatacaccatcataattaaacattgtaatgataagatagttaagaagtgcaaacctctgttcaacctcacttggacagcggtgatatcggcactgatatcctgtgcggcatcggcctatgcaagatgaaaataaaaaattcagtaacagtcctatattatgcaagataaatgaaataattgtaataagtaatacaaattcgacgtacccccatgaagtagtctcggtcacggtgcgtgggatacgcgtccgtgacagcggcaacgtgcagctctggggcgtctggagtgaaggtcacacgcgcacgagtgcgaggaaggtaccagcggaggtagtcatggtagttctcctccgtatgtgggaagagctcgttgatcacctcctctgtagctaacacccaatcgtcaatgtactgctgtacacgtggagcccaaagtgcgcctgcttgctgtccccatcgagtcaacctgtgaagagaggtaaattatatggctcgatcaattaagtagcataaaaattttgaatcgaacaatccgaactcacgagtggtcggcagggaggacggtcggctccacattgcctaggaacacctgcctcaggccgaactgtctcatcatacgctgcggccaatgaggctcgacgaaagtgtcgaacaccatcagcaggatggttagccagtaagcctggtcgcgtgtgcacaaggacgaaagtcctagcggtgttctcgcagcaacggcctcttctgtgtacggcttctagatgacgtcgctcagctggagatggtcaaactcaaacacaaagtccgggtaacctcatctcacctggacgtgagcgtaacgacgctggaataaacatgatcggaattagacatgttatgtgatgataaaaacgaaagacaacaaataaacaattaacgcaacaaagttccacttaccccacgtcgacaccagtaagtccccatcgtgggaccgtcctctggccactgcacgctgcgaccaaccccgtagggtgcggtgtccaccactggtcgacctatggcaaacctctcggctgcccaaagctgaagcaacattgggcaaccagcaaagatcgctcccgcgtcggtcttcgtgcaggcctcgtagaggccacggtacgtggctgctagcacggcagaaccccagctccactgcggcacgtcctgtggctcagcatccgtgatggaccgtgcgtagtggaccagccggaagtccacagcgtgcccgtgcgtgctagtgaacatcacccacccgaacaaccacagcaggtaagtttcaagggcgcatcggaccgagtaatcattagcgtcagggtggagatggtccgcctacaattaataatgaaatgttagtacaaaacaatgtgttgatcgcaaaataagcatgtatgataataacaagttgtttacttacagtgaactaaagcaaccaaaccttgctaggcccgacggtagagtacgggggaagggtgttgggcactcctaggtgtggaaggcgcatcacgtgcttgaagcgtgcggtgatatcctccttccagccaacaacaccgtccacgggaccaactggggctcctgccagtggtagcctgagcaggtacgacacgtcctgcagtgtcggagccatctccctacagggaaggtggaacgtgtgcgtctcaggtctccagcggtctaccagagcggcaaggagtgaccagtctgcatcccaccgcttcgccaggtcacggtcgtgcgcccccgcctcaacaagcctacaaagtggtagaaggcctgccgcacgcaacctgcatagagtaaactataaacataagcacaagacaaagcaaagttgagttgaaatgtgcttacgtaaaattgaacatacgcgtaccaaggaacgagcctggctgtgcaccctggattgctgacaggaacgagcggtggttcctatcaatcccatggttcaacaacgccggtgtgtcgtacgtcatacctgtatccaatagattgatcagaaacataaaaataattagttcaacataacttacaaatgttcataaatgaattactaacacatattaaaccagagtaaaaacaaacaaaaggtcacaatacagaatatttctgattacaacaatgattgcagttacacgatatgagtacttaggccgaatactcatcacgataacattacgatacaacaccgaagagttcacaatacaataggaccgtcatgaatccgagtactcactagtagtacaacaatagtcggaggtactcattacaacaacatccattgaaattacatgatagaagtacttagtccgaacactcatcacaacacaatagcagtttaattccaaattcgatagcaatgttacaccatggaattgcctgctgcacgacgacgtcttggccttgcgcgcttgcttgttgttccttcaccaggtggtcgccttccatcacttgcctgtccagatggatcagcatccgcgccgcttggaacttctgcattctttgaacatttcttgtaagtatggccgcgcagatcacacttgctgcagcgtaaagtcctcccacctgcttctgactcatccatatcatttctgatgcatctagtttggtgtcaaccctttttcacccttaacttagatggatctggaatataaaaaactttgggactcagcattgtgtaagatcctgacatcccgaacccatatatctcctcactccatgtatgaaagattgcttctttcttgaaataatgtgagacgtacacattgggacatatgccacaatcaccggcagcagcaagaacgtgtgagcaaggaaggtgacgaagcttcggcttcatacaactgcaggtacatccaccatccgccttcaggacacattcctgcacggcttgcttgcgatagataccacgcctgctcctatcaacacacattatttcataccgatgcacttgtgtgcattgagcaacaactctatgtctccgtgcctttctgattttatcttccatgtactttgttaccacgttgccaaacactatgttgttatcggccattgacggaccaattttcttgtatcgatccctaaagtaggcctgcgtgccgtgaaggatgaattcaacaatagcaaccaatggaagtacccgcactcctcgcattacccagttgtacacctctgccaaattggttgtcattatgtcataccaagatccatcagtgtcgaacaatagagaccacttctccttaggctcattctcaatccactgagtgaaatttctgatggacgaccccgacctccttctcattgttggtgggtcgtcatgtaatgcaccaagaggtatgggaggctcgtcaccttcaacttgtggtcagcgagattgctcgtctgtttgcttcattgtcaactcatccaacttgtcccacaactcattaaatttcttctcttggttctgtgcatagagcctcttaaaaagatccataagatgcttgttcttgaattgcttgtagaaatttgcacccatgtgacgcatgcaccaccaactccgaacatcaggccacttagctggaagtcccttctcatcccaactgttctacaagtaatcaatagcccgcaacatacccgcatgacgatcatgtataaggcaaatgttgggcctcatacgcaccactgcaatgtgcattctctctaggaaccagtaccagctttcagtgttctcactctctacaaatgcaaaagccataggtggaacctagttgttcccatcacacccaattgctgtcaatatctgacctcggtatttacttgtcaaaaaagttccatctatgcatagaacatgtcgacaatgcacaaaagcattgatgcaagcacccaatgagaaaaaggctctttgtagcacactctttgttcgatcatcagccgatgtaaatgtatgtaggtcatagtaagtattactattcctctgggaaatggttgctaacagacgaggcaaattatcagaggatgctttaaatgtgccatacctcatctcaataatcttttgtttggctctctaggcctttgcatagcttatggtgtacttgaatttgttctcgatgtggctaataattaattttggttcaaagccaatgttaccaacaacattgttgtacatcttacttgccacaaaagctgaagtgatgtttcaatgatacttctccaccccttgtaagtagcactggtgctcggtcacaatactaactttccaataatcattccatttacccttatatgcatggacacgccacggacaatcttccttcatgcacctcacttcatacacataatttgttgacttgaccaccctaaactctctcggaaagaaaactgcccaatgcttcaccgcctccttcatctcctacttatgagcatacctagcaccctcagttacctcgttctccttatattcccagggtacatgatcaccctctgatataacaagtccagaaaaattctcatttgtccaatcagtggccattacatcaccttcctcatcggatgatgcgtcatcctccgcttgctcattatccgaatcttccctctccatttcatcaacgattatactgactctctccccctcatccgccatgccaatggcctgctcctcccttagtttgattttcctcattttgcatcgatggtccaacaacatcccatgcattgctaggaccctccacattttcggtttgcattgaaacatttgtatctttctcttgtaccgacacaaatataacgaggggccatgaccgttcaaaagccatctccacataccgtctccaagcagcagtgctgtccatcggcattagttcctaaaaataaccttctattacacgactcattacaacagatactgacattgtgtagacttcttggtctattctaaatcctctcaacaaccaactataaattgactgaaatgttctctccgcaggcctatcgatgcccttagacgtcattacaaaatttgatagatcaacaccatctggaccaaatctaagatttccttcaccgtgaactatctgaaatgtgaccatatttgacattgtgcctgatgaaaacaataacttcgttaacctcgcatttctatactacgcactaagttacattctctacaatattgttctctctcctacgtccaaaattctaaaattaggtgacgttctccagatcaaactaaactacatcttacaattaacactacggtctatgtctcaattcatactattatattctgtgctctagatctacacatatgtgctgtgtgctacagatctgctaaaatatatggaactaaaactaaaacgcaacatatattactcaaacataatatattagtacaaatgcaaaagaggtatgggagcaaacctgtgatgaagtgagcaaactggcagggctttgccgctccccttctgctaccctcccctctccatctttcttttttttggattttttagagattataatgagatttcagagaaggggagtgggttatataggggaggggcaaaaatcaccctcccccagggcgacaagggggccgcttgcgaaattccaggcccccttgccgcccatttgcaggcggccccccgcacagtataaaatcgcccttgcggagggcagcaagggggccgcttgcaaatttccttgacggccgtcaccggagagcgaacggccgtctgccacgtcacatttgccgccctctgggaatcgccctcccagagggaggcgggcgactacttttgtcaaattttgaaatagaaaattatttttgtaaaacttttaataaaaaaaattaaaaataaaaaaaattcctcaagattgagtgagcttctgtcatgtacttgggcaggctctaggcccaaccaaacagcaaggagtataaaaccaagccacactacagttctttggatcatggatgaacatatgaatgaacaggcatatgccttgtctcctttcttcccaaatgctctcctacctcaagctccaattctctgattccccaatctcttgcttcttcttcccattctagattgctgattcctgtgtctatgattctatccctccctcaagttgtatctcaaatacttgatatcttgtgttggaattggagtatttcccttctccttgctgttgattgatggaggtcaagagggatcgtaacaatatggtatcggagctgtcggttcatgggattccatgccaggagacaaggtggttgacacacggttgcagttacgacttccagatactgaatccaagcattggaggtagttgcactggaggcgcccgccaggtgtttgatgcaatgccaagctggctgggagctggtgcaggtgctgctcttcatgtccaagtgagccacatcatctacccagtgaccaataaggtattgtaccaggtttatgacatctatggagcggaggaattgcatatactggtggtcgacgcatggcgagtggaggttcttgtttggttccgggcgagaggtgatgcgaagaaggctcggggggccacccatggccgcaacatctatgatggagggtgcctactcgaggctcagcatgcgcagccttgttccaaggatggtgcagtgccgacgcccaccaagtgttcgacgccggtaccaagctgtgccatcaccaagtccgatgccgagagcactcctaccacattggaacatgtgttcccagccaccatgagtcaatctatgccctcagccgcatcagcagcagcggcgccaccggtttccctcaccgcgactaaggaggatgaggccgacatggacaaatctgagattaaaccagaggagacattccaagagttgtgtgccaagatgattgccatgctcaacaacatgctcgtgacatgcgagtcaaccgcgagcgttgatatcaccagagtggtggcagttacaagcaccaacactgaatcagttcccaacacattggaggtcagaaaggaggccaattcaattagcttggttgatactaatgagtcgtgtatggcgacacctaccaagtgtttgacgaaaggcaatgaacaaatgatcaatgatgatgacgatgacatggccaccgaggatttagttgagcacactgaagtgaattccaagttcacattacggcaaacatccttcaacaatccatggtttggccatcaagctatttctgttgtttacttgacttgctatagttgccttgaccggagctcagaatacacagctaggtcaccactagtaccacgttggagagcagtaattccatggaaccaagctgagatgaccttcggttctcggcccttaccacggcctgatccacagctaagtcaaggcagcgaagcgcgtggtggtgaagtttctatggaattggccacctctcaagccaattgcaaaggtgatcgagtggagcaccagccacaaccatggcctaacccacaattgaatgaaagtagcggagacgtggtgtatctcctacaacgatggtcactacctgatctttctcttcgcattggtgtggctattgttcaggagcaggggcagctactacggaaacaagacaagaagaatcctcggtcagcactttttgaagcaggagataaaactgatgttggagcatttctctcactcggtaggacattgagtaaggttcaatggctgtttttgtttcgaccttgggatagtttgcaaactgttgaatggttgacttatatgggaaaattgattgccaagagcaactttgttgtgaggggatgctcagtaaatctttgggaggttcacaagcaatcttatttggctgaaacacttaatctgcaatacattctattggtgggaataatttgggatccaggagaatttggtttgcaaggacttagtgttcagaggaaatcaaatgcagttcttgattcatttgtcattatggagtattggttcatgcagcagcttatgttgaccatgcatactgaaaggcactgggaatttctttttcaccagcatcacttggatggtttacatgttaggtaggacatgcagcaaccacaactatgaccactgcaaattgtcttcccagttagtgtgagggctgacctggaaccattgctgcagatcatggcttcaatgacaaagctaattaaactacgcttttggcctgctcttagaagatggggagatcaagtactaaatcaagttcatgatttgtgcaagtgctgtcaagatcaaagcctattccagctcactttctccataggttgttccttaaatctatgtcacttgggtttcaaagtaccatatgcaattcaggggattataattacagagatgaagatgacatggctttgggatcttgagactgtcaaactgctagtagccaagtatgttcatgcaagctactgcttttcatgaggcccaagttcaagaaaatgctatgtcaaagccatgggatcctgggggaattgcatcagctgggaaactgaattgcatctgctcagagggctcaatgacatcaacaaatatggataagcaaatgtgcattgttaaaatggttgtgcatctcaactttattggggttatgcttcaagttaccatgggatccagctacatctcaatgctgatttctagagcaagagattggacagtgaaggggctcagcaagtacgtaaactcatggatgtatttcagctcaagcacaagagcacagtggtatggagcttcatatttcaccaaaatctggacaaattgctacttaaactacagcaaggcaagaatatttggaaaaaactggtgatgagaatcctacctgcatcgaagatttgcatgttccatgggatcccgatagaaccgctacatcggcttgggcacaagccgattttcgaggaggggagaatgtcatgtacatgggctgggccagctctaggcccaaccaaacagcaaggagtataaaaccaagccacactgcagttctttggatcatggatgaacatatgaatgaacaagcatatgccttgtctcctttcttcccaaatgctctcctacctcaagctccaattctctgattccccaatctcttgcttcttcttcccattctagattgttgattcccgtgtctatgattctatccctccctcaagttgtatctcaaatacttgatatcttgtgttggaattggagtatttcccttctccttgctgttgattgatggaggtcaaagagggatcgcaacagcttccctgagagagtgatctcgttggtcatgttgtttcctgtgtcaagcaacatactgatgttctacacaaccaaccatgccatgttcgaggttcgagagaaatgattatgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56941 - DNA, 735 bp, Oryza sativa
tcctgcacccaattgccccactattcctctctcattttcgctactctgaaactctgcttttctctgttctgaatcccgctctgaatttattcgtttccctgtctgttgccgtgccggacgcgcacagtttgcatgtgtggtgttcgatccagtgcattgtcgctaacatcgatgttctcaagagtgagcttccctgagagagggatctcgttggtcatgttgtttcttgtgtcaactaacatactgatgttctacgcaaccaaccatgccatgttcgagagaaatgattatgcgtaagcttatgtactctacatgtttttatatatatatatatatatatatatatatatatatatatatatatatcagaatcaatcgagcagaaaagtttgattgagagagagggaaagagagaaccagaacttgaacagaactgattaccgatacccccatcgttggcttgttcatcctgctgagccatttgttcgagtgcatgcatttggtgcgttttatttgacggaatagcgtggttcggtattgcgccataattttattatttccgctagctcctctcagatatttgtagtgaaggattttctcaaccgcaaaaccagatatgcggggtcccctatctgtacaaaaccggtcatccgaggtctttcggcggtattgaccccggttttggtctacgtggcggctgagacagcgtgggacccatgtgggccccacatgtcc

SEQ ID NO: 56942 - DNA, 3528 bp, Oryza sativa
  unsure (1)..(3528): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctctatcttgttcacatctgcagttatttttgcctagtagttgtcaacaataatgccaacagccaagtactggcattccattttgagttgaaaagattgtatcgagactttgcaaccaacaagaacatgcaaaataatggagaaatgcactgaaaattgtatttagcactaagttcatgcatctcaaaattcaattggaattatgtagaaatttcttggttgaacttcacattggctgaaaattgacttagaatgataacattatttggcttacctttacttattaaatgcatacaatttattcaaaaccagttataccaacaactgattagtcagaaaagtaatggaagtcacccaccacaaaccatgccgtgttttgcactagaaattccatccgatatttgctagtaggtgccacattgcctgcttagtcagaaaatcaacatgcctgcttgcttgctagtaggtgccacaatgctgggcacattaaagttggtgatgatcaacatggccctgatcaagcacatgagtagggaaatgagtgatttgattcttaatagttttctcctatgtaaagcgttaaatatttgtacatgaggttgaattcatcttcacatcaaaaaccaagtacttagtcatataatacaggaataatgggtaggattagtgtgctgtattgtttgacaagaaatttcatagcattaatgaaagttccccatttgttaggaacttgcattgtataattgatggaaaatttacaagaacaccctaaaaatattttatgtattggttatactcctgaatttttagtgtagattcgtgtcaggtaagttcatctctacatgaggtcttccccttctgaatgaattttcctatttgctactagcgttctagaaggtgctaggtttgttgcctgccttctagaacaggggccactaccagcagttttcttctatattaagaaatagaccataaagtcataaacattatatctgtgtatgcaactgctcatagccttaatcctagttatgagaaagattaattggctgtggaaagtagtctgctggcaatttcatgtttcaaaatcaaatagattatctcaaccagaccacattctgactggaagttgaaatgagataactgttacatgggcagttatattgagaaatatttgcagaaattcttatgtaattgtttatacttatctttccatgctgcttggatttgaagtattgcttatactaatcagcattttaattgtgtaatctcatttaagtttgcttaacaaaatggttcttcaggttggcggtctggcagatgtagttgctggtcttggcaaggcacttcagactaagggacatttagtagagattgttcttcccaaatacgactgtatgcaacttgaccagattactaatcttaaggtttgtgcttgttggttagccatgatttttttttacatggttttgcatctttaatctgagcctctgaggtaagattgtattcttggtgatcctgcaggttttagatgttgtcatacaatcctattttgatggaaatctattcagcaacaacgtgtggacaggaactgttgaaggttctaagcaactctattggaccttataagaactcaaaaaaagttaataattgtttgctaactgcaattccaatatacaggtcttccagtctattttattgagccacagcatccttcaaaattcttctggagggcccaatactatggagagcatgacgattttaaacgttattcatactttagccgtgcagcactggaattactttaccaatctgggaagaaaattgatataatccactgccatgactggcaaactgcatttgttgtaagaactgaaattcatttcgcttgctttttcatcaatagctgaaaacatataaattttgctgttattcatttgctaagttctgggtgtcaactattctctaccgtgttcaagaatattgtatcttacacttagatttcaggcacctctatattgggatatatatgcaactcgaggcttcagctcagctagaatttgtttcacttgccacaacttcgaataccaaggtacagcacctgctcctgatttatcatattgcggccttgatgttgagcagttggatagaccagacaggatgcaagacaatgcacatggaagaataaatgttgccaaggtatagaatagagaaatagcagttgttttgaattctgtaccttaaaagtcatgatttttatatttttgcttcttattggtttcagggtggaattgtttattccaatattgtgacaactgtatcaccaacatatgctttagaagtgcgctcagaggtaacaccagcaactctgttttctaaacaactattacaaattcaatatcagcttcacacactttagatgttttctttcaactgtagatacatgatcaacctctcaaatagtacatatttttttttgtaacattagtatttatacttagagtaattgactacacaaaggtcgatgtatttatctgatagaccaaatcttttttcgaggcaacatttatgtaagctgttaatgtacaagtaatgtgaaaaattaatatgtttatttgacaggcacttcttcatctaaaacaagtggcatttcttagtccatgtaggattaactgtctgcatttgctgtccttgcttttcttttggcctttgccccagagtaaaaattgctagctcaaaacatatggcataagtaaacaaggtttgaagagacttcagtgaaggccttttatgtctgacattgttatgcaattttttttaattgttttaagaattttcaaggcattttacttgatatgttactaatgaattaggggtctgatataagttgcccatcatgaccttttttattggtcagggtggtcgtggtctccaagatacacttaaaatgcattccaggaaatttgtggggatacttaatggaatcgacacaggaacatggaacccttccacagacagatttcttgctgtgcaatatagtgctactgatcttcaggggaaagcagcaaacaaagcatttctcaggaagcagctagggctgtattctgaggatgcctctcaaccactggtatgaatttcagttctacgcccatcttaactaattatatggctatctattcatctattgtagcctttttaatgtaatcaagtcatttcattgttttttcttgaaaacgccagagaattgcatttcatttcatttaggggaagagaataaaggaaaaatacaaagtaggagagaccaaagcctcctacacacccaagccccggccaactagctgcctaggtttgccgaaccactaagaaacttttggagggcagacgctcccactatacaccaaagattaccctcattctctaccacctgcaagaccg

SEQ ID NO: 56943 - DNA, 8714 bp, Oryza sativa
tttgaactttatatcattttcattttttgttggtattattcgtttagattagctgtctccttttgttttgtttcttggagtacagtctctattgaaatgaattagtctcgtagtttatgttcagctttgatcctcattttgtgccttttaatgaccatggttttctgaggcaggtagcctgcattacgaggctagttcctcaaaagggtctacatcttatcaggcatgcaatatacaaaacagctgagttaggaggacagtttgtactcctgggttcaagtccagttccacatattcaggtctgtatactcatcgagtgcctcattttattttctcaactgcagctcacatttggccctatgagttcttgatttgccatggatatgtctggttccatagttttatgtatataatttattttcttctacatcttggctgatcttgttactgtgaactgatcgttgtgcatttgtatcacagagggaatttgagggtgttgcagaccaattccagaagaataacaatattaggttaattctgaaatatgatgaagctttgtctcattgtatttatgcggcatctgacatgtttatcattccatcaatgtttgagccttgtggccttactcaggtgatctatccgtacatattaaattatagatcttccatttaccaaccaaataggcctacaattgctaaatgtgcgccagtgtgcccacatagcttgcttgggttcaaattggcatttgtgagctattatcacaaggcatggatttagactaggttttactttgatctaaatatcccatacaagtcttacatggttgtgtcatccaaataattttcttttatgaaattagccacattttactaaccattttacatggttgttgacattttattctttttcatgcccaagtctgacaagtttttatcaaccagatgatagctatgagatatggttctgtgccaattgttcgacaaactggtggattgtgtgataggtgatttctccctcaaacatttcctttgcatagtatattctgatatatctgttgtgttctacttttccagtgtttttgattttgatgatgaaactatacctgtggagctgcggaatggctttacatttgctaggactgatgagcaggtgagttttacaatggaatgcactttcaaatttggatttctaatgttttatgggtagagctcacgtgggatgcctattttggtaggatctaagcagttgcttggaaagggcattcagctactacagcagaaaacctatggtttggaaacagttagtgcagaaggatatgcagattgatttcagctgggattctccagcttcacagtacgaaaacctttatcagagtgctgttgctcaggcaaggggagcggctcaaacataaaccttttcatgatgacattgtgagcttagattctcccaagcgcagagacaatcgtcagttttatcatatctgaaccaggcatatgctgaagaaatattgttcttctcacattcacagaattcacacatcgtgatccttgctgttgccattcccgaaagaactgagaaagagtagtcttacagttgatcaagatattgcattttgcagtcagtgcacggaactagttctgggtttaatggggatgagtaatcataatctatactggattgcccccctctaaattccccccaaccgttagtttttgtgggaatgcaagaagtaaatatgtgcactgtagggtgacattcgcatacatgatactgtacggtttattcagatcaacgtttgggtaatgtgactacttttgagtttgagagatttgcgtgctccgttctaaccttctagggtgtgtttagaaaatgggttaggagaggtgggattgggaaatggaaatgaataaagggataggatgaaatggggtgagaagaatgggtggctaagattgaagcttaccctttaaggggtgggaaatcatatcccaaacccattttccaaacacagccccaaggttataaattttttttttgagggaccaaggttataaattcgtcgtctgaaattgacattttgttttgcgtttttgcatgtgattatttgagtccgcgtacatttccatgtaccatggggtattccgttccataccgccaggcaaactgatttcccaggaacaaatcagataaaaattattttacacaatcaggtccattgtacttctttcatcaaccaaccagataacattgttttacacaatctgaacgaacgaagcaaatattcgggtacgcggaaagaggagaacgtcgcgcgtctcaccgcagcctgcatgaaagcaatggacctcaccgccgttgctcgccggagatccacactcacttgccggggacgaagttggtggcgtaggcccatgcgttgttgttgacggggtcggcgaggtggtcggccaggttctccagtggccccttgccggtgacgatggcctggacgaagaacccgaacatggagaacatggcgaggcggccgttcttgatctccttcaccttgagctcggcgaacgcctcggggtcgtcggcgaggccgagcgggtcgaagctgccgccggggtagagcgggtcgacgacctcgccgagcgggccgccggcgacgcggtacccctcgacggcgcccatgagcacgacctggcaaccccagatcgccaggatgctctgcgcgtggatcaggctggggttgccgaggtagtcgagccccccctcgctgaagatctgggaccccgccttgaaccacacggcctcgccgaacttcacgccgttgcgggcgaggagctccgggaagacgcagccgagcgcgcccagcatggcccaccggcagtggatcacctccagctcccggttcttggcgaacgtctccgggtcggccgacagcccggcggtgtcccagccgtagtcgccggggaactcgccggtgaggtaggacggcggctcgccggagagcgggccgaggtagagcacgcggtcggcgccgtaccacgggctccccgacgccgcggcgggcttgggcttggccgccgacttgcgcatcgtgacgcggccctcgccgaacaccttggcattggcgaccgccttgccggcgagggcggcaggggaggagagtgccatggtggacgccgccattgacgcgagcctaggactaggaggagatggccacagatgcttttggaatgtgtgtcttttgagctcgtgagctgctgtggtgaggaaagtagtgagctcgagtggggtttaaatagtggcgggaaacggggacgctgcaaggatgggcctatctcttgcgatcgtccggttggatactttggatagctcgcttcgtctatctcgccacctgtgcacgctttctgctgacgtggagatcagccaatcagcagacgacggggtggacatctcgatatgagtcgatagagtagcaattattagatcctaggccctgtttggatccggaggaatagccctccggaatctcgttatttaagagtattaaacgtaaattactgacaaaacccattccataatccctaagctattttgcgagacgaatctaacgaggtatattaatccatgatttgctacagtaatcaactgttaatcatggattaatatacatcattagattcgtctcgcaaaatagcctaggggttatggaatcggttttgtcggtaatctacgtttaataatcctaaatagcaagattccagagggttatttaatagcccggaggatccaaacaaggccttagctaggctaatgggctaatatcttgttcggacaaataacccagcttggcccatgggctataataatccataacatctctcttcgtttagctttggaattcctttaggctgcgtttggctaatgggttatgtctaatgggaaatagaaatgatatcttgttggaatgaggtggtagattatatgaagagaaattgtatcctatgtttggttagatggatggaaaaggaagtttctagactaatgaccaaaatacccctccttgcaataagtggcagaacatagacagatagaaaggggtcaaaatggcaaggggcaatatggtaatttcgcctagcactctatccacccctcaatccagcaggattgtgcatcccatttccaatgtatccaaacagcataaatctggaaaagggaaatgatatccatttcccatcctcctaatcccattagccatacgtagccttagcttttatcactcgtgtcagattatcacacgcagcttgaagaggctattaaatactctgtagctaatatagtactctcttcatcttatgagacttcttagtcaaacgttttcaagttaaatcgaatttatagagaaaatagagtaacacttttaacaaaaacaaacatagtatcaaaatctattcaatgttatatttaataaaactaatttgatattttacatgttgctaatttttctataaatttgattaaactttaaaaagtttgattaaaaaaaaagagagtcaaagtgtcttacaagatgaagtggaaggagcagtaactttgatatattgaaaagaaaataccatggttcaagcctattcattattgtcagtgttacggataagtcatatttcctatacttaggttcgtattgtgtggaagtaccatatacctaatgttatacgagagcggaaaggtatatccaaacaagttaataaagtgagcctgaaaggaaattatctttgccggaatagaaagtgttaagagtctaacctagagaagacaagcttcttcatgttctacttggagaagaaggcgcttactagtataaatacaagcctcccgtgaagggatggacatctaatcacgtctcacaagtcatagctagagcctcatatagagacaattcggaggaagtcgaagccctagtccaagtcatagctagagcctcatacagagacaattcggagaaagttgaagccctagtcattgataagatcttgctgagccgtaagattatattcaacgggtcagattagctagtctactccatccatataatccgtgtggtacttttctcagttcattacttataataagggttattacttagcttgagagctcaaatcagtataaatccttatctcttgtcttcttgatatgatcttgcatataccttgttctaacgtttttcatactctacaaatattattgacaactatcatgaaaaaaaaaaccatgcaaaatgtgcatgttaaaagagaagggaaatagctagaggagcactaaattccgcatagcaaagtttatttctgcaggtcttctttggcgatttgtcctgaataattgctgggaagtgcacctgaatgaatccctgatacaagcaagcaaagacatcgattcacgtgagagcaaataacatccataattaagctgtgtgttcggacgtccattttctcaacccatattgctcgttttccgcacgcacgattttcaaactgctaaacggtgagttttttgtaaaaagtttctatacgaaagttgcttaaaaaatcaaattaatctattttttaaaaaaattagctaatacttaattaatcacgcgctaatagatcgctctattttccgtgctactgttccaagttgggaacaacccatagggaacacagcctagtttagctaaacacaatgcaacatgtgtttgccataatgcaatcaatctttggactgaacgtctgaaccctttcgaaacagcgcacttttcttgagtgttctgtgctaatattccactccagaagcgcccaggttcttatcgatgccacaacgaaaatgcagcagaatttctggcttactacctctctgcactagagcattatcacaacaaatctgctactttgatagttgatgcctggtagtgacaagaagcacgaatcttaccacgtacagtgcgcgcatcaaccacatgaaaagcatctactcacggggatgtgtcggctgtcaactgaacacaaattgcaggggttggttccttccatctgctttctccacaagtgaacattcacatatggtgttccatactttgatccgcatctgatttatagccatgtgttgcgaatttgtgaatacctcgccatattcgcaagttggtgaacatatcaccaattgtattcgagaatatagttgattacaagccgtaacgtttattagtgactaaaaacaatttatagataaaaaatttatatatgtacgtattattagcgacttaaaggttaatgctaaaaataattcactataaagaccatcaaattcaactctaaaattaagtttaaattttagctacaacgagtaaacattggagctaatcaatgtgaagccttctagcctttgttatttttggcgtggttttgcaagtgtctgatctcataatttccaagtgatggataattttaaaattttcccgaatcttcatccatttatttatgtatttattttgttatggatctttttacgtgtcaacacatgagcttgggacttgggagcctggccaagtggtgctagatactaggaatagtgtacaatgtatacagaattataagaggtgagccacgcaagctgccactaactacgcgggttaaacggaatattccttgctagtaagatacaggagaacttgttctttttcttaacctgataatgtagaataaggtagcagcaactaggagccttcccaagtgactaggagtaggcttctctcacatgaccgatgtctcgatacacacatggcacatggaaatgaaacactgcttcttgaccaaaaatctgggattggacctctgtttatatttcagcctgctggattagaagggaaggaaaaaaaattggatggaaattgacagatagaccagccaaacgatccagaaaccaactccctcacgttgtaccagtggttcaaaatcaaaagaggcaggcagaaaggaccaacgaggcaacgatcgaatcgtgtccatggtctccacctcacgggagattctccgcatccaccgaatatccactaggcgacgcccccggcaaatgctcccaatttttttctcacatgcactttgtcacctgtcagaaacgtgacccctgttatcctgtaccataaactacagtatttgtacttagctcctggcatccaaaaattatcattttctctgcactatacccttatatacctcgtgcgtaagaatatctcaattccttttttttcccaataagtactccaattcagccgcgtataaactcagaaacacgtagagattgtttctcaccgcagcagattgtggcaacccaactgcggatcaaaaacaattgttccacacatataccactcgcctgggaaaccggcagagccacccaaaagatagatgcgccgaaagcgaccgccaccaccggtccaccgcggcacacgcgacgcgagaagcagagaaggatattcccctcgcggctcccctccggatccttcccccacacaccgcaagtccgcaacgcgagccgcaagcgcgcaggcgcgcaaccgcgcaacggccgcacgaaaagcgaaaccgaaagacacaaccccgcatcccattcccgcgggcctctcggctgcttccggaaactcgtgttttctctcacaatccctactcccacccgcgcatcttcgtaatattcgctcggcatctcccccctcgccctcccgcgctcccggtatataagccgacccccccgcggcctcccattctcctcatcagatcaaagcaagcaaacaacaacaaaaaccacttctcgtgggtagaagagagagagagcgaggcgatttcgaccaagaagatggccgggatcgtggtggtgttcgacttcgacaagacgatcatcgacgtcgacagcgacaactgggtcgtggacgggctcggcgcgacggaggagttcgagcggctgctgcccaccatgccgtggaacaccctcatggacaccatgatgggcgagctccacgcgagcggcaagtcgctcgccgacgtcgcgggcgtgctcaggtcggcgccgctcgacccgcgcgtcgtcgccgccatcaaggcctgctacggcctgggctgcgacctccggatcctcagcgacgccaaccgcttcttcatcgacaccatcctcgaccaccacggcctcacgggttacttctccgagatcaacaccaacccgagcgccgtcgacgccgccaccggccgcctccgcatcgcgccgtaccacgacttccacgccggcccgcacgggtgcggcctcgggatctgcccgcccaacatgtgcaagggccaggtgctcgaccgcatccgcgcctccgccggcgccgccggcaagagggtcatctacctcggtgacggccgcggcgactactgcccgtcgctccgcctcggccgcgacgacttcatgatgccacgcaggggcttccccgtgtgggagctcatctgcgaggacccgtcgctgctccacgcggaggtgcactcgtgggccgacggcgccgagatggaggagacgctgctgcggctggtcggcagggtgctcctcgaggagaggaacctgccgccgctcgactgcaagctcgagtcgttgccggccgtcgccgtgcaggacggcatgcccatgacgctccggatcaagaactgatcaatggcggcgacgaa

SEQ ID NO: 56944 - DNA, 20264 bp, Oryza sativa
atgtgtgtgtgaggattgcgatacgggtataattttaactattgactgatttttgcgctacgcgtgattgagcctgcgattagtagaggctcattgtatcttgtccgatcaattgaagtaaaacatttggcttggctctctctctatgagatgtaatccatttctattatcttaaaagaaaaaaagtaaaacattcagaaaaaaagtaaaacattcctgacagtgaattgactagtctgaattttggtgataattaattgtctgtcgcctaaaatgttttacccatttcgtcaaaagaacgtgctcacccaaagtcggtttggttaatttgtgattattgtatactattagtagaatcttcgtctcatatacttatatgcaaggaaagagatggttccgataacagtggaataaagtagaagcctacgaagagctataaataaaaacatgcgcataatacaattctcggtcactcagcttttgtcttttgtgtggaaaaaaagcttgtggctcggatcaactcgaacttgcagtcttaaaaaagttaagcaagctaggctttcagtttgtgaatcaaacaagctagcttgcgagccgctagtttaacttgttagtacaatagatcaccatagtttttagtgcttatcaactaatgtttagtcacttaattacattcaaaataactgtatttaataaattatttattaggtagtagtatttattatttatttatgataaaatagtaaatttgaaattatgaaggtgaaataatatgttaaaaaagcttaataggtcagcttatgagccaagccgagatagatttttagctcgttgaggataaagagccgagccgagccgagataagatggcttgttaagatgacaagctcaaacgtaccgagcaggcttattatttgcaagctggataccgtactccaacccataagttcatctcatatttttagcttaatagactagatcagtttagctgcctgcggatgcccaaccgcacagttaccgtcctaacatgtaggtccaatatttccatattcttaccgaaattttgagatgttccacagctcgatattcgtatttcgaatgtttagcaaagatgtggcgcgagaaaattcatctagcaattcggaaagcgccacacgggcggcggaaccgccatctcctgcgctttcaccgagcgagaagatacgatgatatcttcgcgtatccggtactcgtgaacctgaaagtttggacactgattgaaagagatattccccggcaggttcgccaccggattcagcttctcaccaaattttaggcacatattctaggcatatgctgggcatcgtttctgctcccctctctgttgcgctcctcgtcgatccacgagaaaggtgcagtggacgccattgaactgcagccactggctcccacagctcgccgttcacacacgtgccaccctcccattactcgattccgaccctcgacgacggcgacctcccggtgagtgggccgcgacggccagcttcagcccacgtcgtcttcgtctttgcaacggcccatcaaacgatgggcctcgtcgagagataagcccacaatggaacgggctattgttgggtttgggcccatcacgcagcccggcctctctctcgcgtcgtgacgcacaccacccatcgcctctcctctcctacgcttcctctctctctccgacctcctcggatccgcctcgatctcctcctcctcctccacgcgcgggcggcgaggaaaccctaccgcgaacgacggcgatggcgctgctcccgcggacggcgcggctggcgctgctctcggcgccgcgggcgtactcggcggccgctacgggggcgggcgcagccccggcgaggtacgcgggggcgccgccgccggcgccccagtcgaaggcggccgagttcgtgatctccaaggtggacgacctcatgaactgggcgcggagggggtcgatctggccgatgacgttcgggctggcctgctgcgccgtcgagatgatgcacgccggcgcgtcccgctacgacttcgaccgcttcggcgtcatcttccgcccatccccgcgacagtccgactgcatgatcgtcgccgggacgctcaccaacaagatggcgcccgcgctccgcaagtcagtaccaccttcctcccctcggctgctcagatttcgcgttcctgtgttccgatctgggaatttggtgttgcccagcttttagatcttggaaattatcttgccagggtgaaaaagactcaatagctaatgtgatgtcattctgtagtgtagaaaagccataatccgaaaagccttaatccccacctttaatgtcatttggaaacttgccacaaattcgacacaagcaccaatgttctgaatgcccggacaggacaaatgggatagtgcggtgaataattgaaacctccttccagcatcaatagtgcattagtctaaatattttggcatgattcaaagtatgccaatgaagattgtggatcattcaacccaccataacttaggataacttagcatacgccctatatggccttgcagatatttgagaggataaatcgacttgataaatatatagggtcaattcaatggcttggtgttaaacactggctggatttgattttagaaccataaaccactgcctgtggatcccgatttgatggcttggtgttaaagtcttgctggatttgatttgaggacctatgcattcatggaggatcagacttggaatgcttatgcgttcaagcttcagtagtgctaaatgttaacttaattaaagcattgcgtttgacttccaggatatatgtgtaacataaattgatttgatgtttacgttgtcgattactcattagtgaaaaaacatatttgctggtgaattagatattgtgggtacatagcatggttgttaaggcattgttatggcatcgccatagtggtaaaggcggttgcaggatatatgttgttgcagatcccatgccactaccatcagatctagctcaagatcgcagttgttgcagcttgctggagcctttgaatctctctggtggcggcgacggacaatgaggtgagcagaggcattgagctctaatgggccaatggcgccatggcagtggtagcagcctgagatgttgagctcatgcaaaggtggtcggcagccagatggcggctagtgcctcctctgctgatggctggtggctggtggctggtggctggtggctggtggagtatgatgcctcttagggcatacgtagaacatgtgggtatgaagctaatgttagctttggtgggttggctgcttggcttattgggccttttatcaatttcccctttgctcttgctgatttttctacaatattctccactaatcacaccttagtcacctcatatgacatcacaattcacaacacctcatgccctatgatgctgaggcggtggtgtgcaactgtgttgcctcaaaacaccttatgccttaacaacacttgtacctaggttatttaagatttgcttgtctcgataccaattttttcaaaaaataatatagtgctccacggtagaaaaaaaaacaaatatatgccctgattatttgcataagcatggatttgcttctccaagaatctataactctagaaagcaaagaaaaatctaattctgatcagcaaggtgtagtttgtattgatgtgcttctctgaaatgtccagaaaccagcaaaaggagtggcgtgttgttctgagtgtttgaaatcaaataaaattattttgttgtatgaatgccatggcctttgtggaaatcagtgcttttcttgtgtatcctctggttatctgctattaattttagggtgctacttccttcttcttttttttcaaacatgctttttaagatttcgtgaagaacttctgttgtgccttttgctatttaggaatggttttgtcaaaagaccattcaacctttcttacctgctcacaattttataatgctaatggcattggtaacttcttccacagggtttatgatcagatgcctgagcctcggtgggttatttccatgggcagctgtgccaatggtggtggatactaccattactcctactctgttgtgcgtggatgcgaccgtattgttcctgtggacatttacgtccctggatgccctccaactgctgaagctttactgtatggtgtcctccagctccaaaagaagatcaacaggcgcaaggatttccttcactggtggacaaagtgaggcaatgcttgctactgatcttggttgttttatttctttcgaccctaattttcatccgaaataagaatggcgttgtgctcggatctgcaaacttattgttgtgcctggaaggatgtatacccaggtcgtgttgatgtcagttccacatcaatggacgagaccagtgttggaacgagtttttctttacattgtaactcaacatgttaacttcgtttatgcaaagattcgccttaagcgcgatttgtgcgctgtatctttacccttcactaaacattttattgtgtccattattggagcttcctggcgcgccgtgttccctgtgctgtcataatgttcatagtcccattgcatatttcaattcaacagaactagaaatggcagtaatacaactgtccaaaaagtcacctgatttagatattgtttaggccccttgcacatgcgtttatgtttagattttctgaagacaaagtggactgatcatcaccttttagagagagtgtggaaatttcatctgcggatgttttaacacggaaaaggtgatggcttactcgaacaacgacgtttgtgtcatttcagcaggcatcctactcaacttctgtgtcgtagaattatcacttctgctgaagacaaccctgagttgaagacccatgcatcgtcaggccagtcataaagcatttgcatcctatggagtaaccttgtgctcgagcttccaccgccgcagcctcgctcatcgatcggtggagaccggagagggatcggcagagaatgcacgtgacaccaagggactcttcaggtggtcaccgaagttcttcgtgttagaacttggaagtgggaatcgtgctatggcaggggtactgtaaaagagattattattgacaactctcaaaaagagatacatcccgttttgttatcgtaggcttaatggagttcccttggcaaagcgggccctaacctctcctccaagccaagagcgccgctacaagaacacacaccccctctgccatagccgccacattgccgcaaagacgcaaattaaaccgtcctcttctgccatctcgtacgtcgcctccttcctccaatcccggattcccggtgatcaaagcgaaagaaggtaataataaccagtgatagcttcgaatctctgtaccgccggtgtttttgttatttataatctctaattataattgcgatctaataatgatccggcttcgtgcatggtggtagtagcaggattgttcgagcgagatgaatccggcggccatggcggcgctggggtcgaagctggcgacgctggggtcggcggcgcgggaggcggcgagggtggcggcgaggcaggggtgcgcgtacaacaaggcggtggtggaggggagcaggcagctgcagtcgagggcgtgcgaggcgacgaggagcgcggccaagcacgggcgcgcgttccacgaggagctcatggagcggaacaagcgctacgtcatcgacccgcccaccatccagacgtgccaggagctctccaagcagctcttctacacccgcctcgccaggtcccctccctaatccctatagagtgatagatcgatcagcattgattttgattgattttggttagctcgatcgatcttttttttcttttgcgctccattgacgtacgttgattagcttctttgatgccaactgaacttttttttggtagatgaacatattaattaattaattggtgcgattacagattgtatagttacaaccgaaacctactactaaggatttataattgaaaagtagattggttttacggttcttgacactaaaaatttgataacaaatattagagtagttttaatcttaagtctgaagacatttgattaaactttaatattgagtggttttacagaaagatacaaaaggtttgtactgttttatgataccggccctatgctttttgaaggattgtgaaaagagaatctcaattcattattatgagaattattgtcgcgccaagaccaccaccatgtttttctccctccgtcctaacactgaagtatttgctcatgaagagcttattatttttagatgtggggttcttcagtcctttttttatatatatttttagttgtagattgccaatgcatctccaatcttcaggtgcaaacgttattaattagggtatgtttagttcacgctaaaattgaaagtttggttgaaattgaaacgatgtgacggaaaagttggaagtttatgtatgtagaaaaattttgatgtgatggaaaagttggaagtttgaaaaaaaaagtttggaactaaactcggcgttagagaggttggacatgccaaaagtatagtcgaatgtacaagctagcctagggagaagatggatgtcatattcgtcttttcacatctactaaatatttgactgctaatactccctccgtattttaatgtataatgccgttgactttttaacaaacgtttgacatttcgtcttattcaaaaaaattatgtaattataatttattttattatgatttgatttatcatcaaatgttatttaagcatggcataagtattttatatttgcataaaaattttgaataagacgaatggtcaaacgttgattaaaaagtcaacggcgtcatacattaaaatacggagggagtaataaactttctgagggtcggagagagtaaatcatagatgttgaatgctattttcttaatttacatacgagtttgtattcatgccttacttgttgagaaggaactctgtattcgatcatgtttaggaaaggtagctgatggtttcaatctctctgcgcaatctttctagttcggtatggggcttgtgcaaggacttcgtttatttcttctttgaaaacatcggttttatgtgagcttactttttttgtacaataataaacttctttagatgatggaagtgttacgctgtcggccgaagatgaactcaaccacaacaaaaaaaaagttgaacataatgtatttctttggaaaagttaaatatcaccacttactaaatttgtttgttggcttattagccgcaactaaaatttaaattttgaaacgtaatttaatcgatttttgaggtatttttcatcgtattttattttcactattgatttttaaatcgttaagaacacaaatataaaaaaaattctacttacaaattatttttgtttactttgtttatgttttttcatggtttatcagccatcgtacaccgatgagatactaacaagttgatgtttcgatcttgcagcatccctggccgttacgagtcgttctggaaagaggttgatggcgcaaagctcttgtggaaaaacaggaagaatctaaatctaaaggccgaggatattggcgttgcaacattgtttggtattgagttgatagcatggtttgctggtggtgaagtcgttggtagaggatttactttcacaggctaccatgtctaacctcttacttctagcaagaacgaccacacactagtcatacatcatcagtaagatattgtgttaatttgctacttagtagaatatgtctagtctgatcttagattcctataattcaaggagatagtagtagtttttctcttcggcacgatacaagttttgttattcttgttatgccaccaaacagcatacatgtgaaacagccatgacaaactaattggtttatttattatatctatataacatatggtttatttattatactctgtttggagtttagacatgttagtgtcctggtgtgtgtgatcacttgcaattgatttgcacattaatactgctaatttaattcatgaaactgctgctggccagaatccggacctcaacgggcaatctattcaattgattgagtatttcaatggccttcactctcaaaaactccatatttcattaacactgccatcgcattgctccatccgtttaccaccttgatcaccacctcgccctcctcaatggcgccgctcaaaacgttgctcctcttcctcgtcgtccttctccccgtcgccaacgcatgccagcctccaagaacactccacgtcccggtcttccaccgcgacgcgctcttcccgccaccgcccggcgccaagcgtggcagcctcctccgccaacgcctcgccgccgacgccgcgcgctacgcgtcccttgtcgacgcgaccggccgcctccactcacccgtcttctccgggatccccttcgagagcggcgagtacttcgcgctcgtcggcgtcggcacaccgtccaccaaggcgatgctcgtcatcgacaccggcagcgacctcgtctggctccagtgcagcccctgccgccgctgctacgcccagaggggccaggtgttcgacccgcgccgctcgagcacgtaccgccgggtcccctgctcgtcaccgcagtgccgcgcgctccggttccccggctgcgacagcggcggcgccgccggaggaggctgcaggtacatggtagcctacggcgacggctcctccagcaccggcgacctcgccaccgacaagctcgcgttcgccaacgacacgtacgttaacaacgtcacgctcgggtgcggccgcgacaacgaggggctgttcgactcggcggccgggctgctcggcgtcggccgcggcaagatatccatctcgacgcaggtggcgccggcgtacggcagcgtcttcgagtactgcctcggcgaccggacgtcgcgctcaacgcgcagctcgtacctcgtgttcggccgcacgccggagccgccgtccacggcgttcaccgccctgctgtcgaacccgcggcgcccgagcctgtactacgtggacatggccgggttcagcgtcggcggcgagagggtcaccgggttctcgaacgccagcctcgcgctggacacggcgacggggcggggcggcgtcgtcgtggactccggcacggccatatcccggttcgccagggacgcgtacgcggcgctgcgcgacgccttcgacgcgcgtgcgcgcgcggccgggatgcggaggctggcgggcgagcactcggtgttcgacgcgtgctacgacctccgcgggaggccggcggcgagcgcgccgctgatcgtgctgcacttcgccggcggcgcggacatggcgctgccaccggagaactacttcctccccgtggacggcgggaggcggcgggcggcgtcgtaccgccgctgcctggggttcgaggcggcggacgacgggctcagcgtgatcggtaacgtgcagcagcaaggattccgggtcgtgtttgacgtggagaaggaacggatcggtttcgcgccaaaaggttgcacgtcttgattcaacttaatacacttcttgagttagcctgaagcacgtgtaattctactacagttatcaaatgttgtttcagctcgtacttaaatgtgtgattccgatgtattttggtacatttgtaatggtctaaaaatattttgggatcttttcccttccgtcgtgttaaatgttagactactaggcattacaacactacgtggttatggtgctattatcacggttatcacgtacaataatcttttcagtttttgaagccacgctatactgcacgtttttgaagccacgctatacttcacggtaaccgcacggtttttacggtaaccgtcaaaccatggactaacggtaacctcatcctaaatggtttggtaaacactaaaggccacacgctatagacaagggggcatcctctccaggtttagaatcctcccccataagagttcatgttattttttacccaaaaaaacttgcacaatttttttcttttagcaaattcccttgctgatttggcactttgacaattgacacgatctatcatctatggagttggagaagctgcggccacgaggagtcgaggaggcccccatgccatgcgcctccctagcggctatggccacgcctcgagcacctgatcgagcttcatttagttgatcgatctgaaaattaacgaaacaagagcacattgtctctacaacttcttttttttttaaacacggattgatgagttatcgaaatgacgaatgaatccctgatcgaagcatcttttccccgcattgtgcagatcgaatttcaagctttattagtagtaatgggcggcgcattccagcgccaggtccggcctccaccactggtggatcccgtgcgccgccttgaagtccggcgacgcgccgcggttcaccgtcaggacggcggacgggaacaggtgcagcggctcgcatccacccgccgtgccgatgcccagcagcaggtccttcaccgagttcctcgtcgccaccctccccacggcgcccgcgccgatgtcctccatcttcttccggtggtcgaagtaccccacgtactcggcgctgatcgggtcccccgggttgacgaacacgttgggcacccaccgcgccagcgccgcgaaggcgtcgtagcctccgccgccgctgccatggtgcaggagggtggccgcggcggcggtgacgaagctgttggcgatgcggacgccctgcctcacccgcctgtcgccgatcctctccaccggcgccgacgggaacggcgcgttgaagaggaacgtggggagggcgacgcccgccctggccatggacttggcggcgagcgtcgagatggcggagcccagggagtggccggccagccagacgcggtggtgatgctgatgccccgccgcggccacgacggcgtggacggtccgcatggcggcgtggaagcgggaggtgcggtcgaggccgttgcggacgagctggaggtcgagcgccaggtcccgggacgccgaggccttcttggtgatggtgccgcggaacgcgacgacgtagtgcggcgcgctggcagcggcggcggcggcggggtcgaggaggtgccacggcggctggaacgcgtagacggcgccgaagatggaggagtcggcggcgtccacgagcacctctcgtacctcgaagtggaagaacctccaccacgccggcgcgcgggcgtcgtggccgtgccggttccactgccggtcgcgctccatgacgtacacgccctggacgaggctcgccatgacggatcgctggtggtgcgggcaattcctggccggaggaaaaccatcagaactcaaaggtgatcagatcaatggttcccaatgcaggttcctgcttgttttctttcacaaaatatacgatcttttttatgcttagttgctttcagcactgcaagttagaaatctcggggtttcaaaaaaaaagttagaaatctaagcacggtactagacaatgcaaattcttcaaggaaacagagcaatctgcaaccaaaaactggaaagttttttttaaaaagtaaaaaaaaaaggaacaatggaaaagagggaatcagcaaactaccaattcacatatgtcaagtacgtaggtcctgacacctcaaagatgtccttctgtgacggcattttgcccatctttttcttgctcggttgctctgcacaacaaagggaagaaatttgcatgttagtctcagtgtcataggacagaaatttacagattaaaccgctctacttgattatatgaccaagattcccactttcctcttaacttaacagctccactctgcagtatcctgctgcatggatgtatccacattctgtacagaacctttgtgtgcagcaggaagagaacttttgtctaatcatattctctagagctcaggatcgacagtgaaccaaatagttgacaatgtgatccataaatccgtgatacatcaatcgcgtattcacaatttcacattacaagaatcagaggagaaactaaagaaaagcagcaagaacattacccggagataaaaactactctttgcatatcatctcctgctgaggatcatcctcatcttcattgcacttctgactctgaaatgaattcctcatagcaagagcgtttattagccaaccagacgacttaagtttcaagatcaagtcaagaaaggaatctaactttttttaaaaagcgatgaaaacaatagtttaaaagattgtgcgggcaacgaactgcatcagatcaaatggaagctccagttgcatgatttgggcaattttttgttggcgctgactcaggctgcagaagttaagaaagggttgtatcggaagagcaggaaaccagaagactttatcacttatttttttcaagaaaaaacttatgagcatgaagtctccggttttgtacagttggtcggagcacaagtggcttaaatttataaagaacatatcatgtgccgtgcagatttgcatagcattacttcctcttcacatcctttctggaggagcaattagagcaagtttaataatgtagccaactactaactctaaaaaatgaaacattatctatagccaacctaataatacactcatgcaataattatttgtacatataaaccgcatcattaatacctaatccatccatctcttacatagttattagagcttgtgttgcagccaactataaatctataacttttcttgtctcttgtctcttctcttttctctccttcacataagcacaacttgtacaactcatttatataaatcccattttactcactcttagaagattgcaattaatgaagacatctttttttttggattcctaattggatacaaactttggactggttctttatgatatttttgctgacaaaaacatagctgagaggtgaggtgatattgcttaaggctagtgatgacatctgaaaagtctaaacgtgtcgattggttctctgagttatgcaacttcaaaatttttgtatgacgggcccggttgacaaaaccagaactggtaagcaaaagtgcttccaagttttttttttttctaactcgtcgtggaagaatctaatgtggtcgataactagaatgaagtgtggatcttccagaattttgtgtagctacctggcaaatgatagaacaaccctgttgtttcgcttatgcttattagccaaactttgaattttaaaacttaattttaaattcgattttatggttttctttttcatggtttattttatattatttgtctttgaatcgctaaagacatgtatattaaagttttacctacaagttatttgtttcctaataaactgtctggataagagcaaaatgatatagcttgaaatgacttcggaaattactaatagagataattcaataaagttcattagcaaattgtaactcagaagactcttacatgtccttttggtcgatatgtggaatatggatggtggaaacacatcttgaatcccccttttcagacttcagagcatttcaaatggaccaaaagtaagaaaaaacaatgccttctattccaataaatattgctcattgtacactgttacagtaatcacacttcttttccctgtaatcctagaaactctgaaagtcgattgtatcaaaagtttgttttcttgccccttctgactgaacattatctctactctatcatgaagagactgctgctgttgttgcacgaggaacatccacaagcctctcaagcatttccaattgatcataaggtgctatctgcagagaatcagattcatgttcatttcatctccatttaatccatctacatgaatttcggaagtctactgtacatgaaataatctttattttgtattacattacctgagaaaaaccatcaggccaagttatagaaactgcgtagtttcccataggacggatctcttcaggttcaatgtcttctggtatatcaccatattgtactttctgctcacctgtccatcgtcctgcagacaagaactacttagtttgtgcaaaacaagggcaactgtgaaaatattggtttctgaaaatacagactacatgatttagtttctgaaattataagcactgtacacgccatttgaagtcgatgccagtgttagaataatacacattaaacggcgaaaaggtatacccaccacactttgagcagatcggtcattccttctgactgttgctggatgcaacaagaactcttcatctgaatctggtactttcactcggattgctctaattgatctatcataggaaactgctgttgaaactggcaaaatgaaaaagattaacacatcattacaggagaaaaacttggtaaaaaaagaaacatatctgttttgctgtaatacattttttgaacaaaagctggcagtatttattttttttgggaataagaaagctggcagtatttattggtatacttctttcttcgttttgtttaaattttggttagttcgaattcaccaagaaaataaattgtatgaactacttttacatattctaggttgtaatttgtgaactgctaacttaccctgttgtctgattttagcacactgctgaacaacacaaactccaagattctgaaacgtcttagcaacatccccttgtggatcagccactacttcaggaattccagtatctccagacgctgaaagctgtaaattataccaaactgtgatcattgcactcacttttatccttgtacaagataggtgggattgagcttacagttggccgtatcggcaaatcgaagaggtgaggtattccaaactgctgcacaacctgaaataattgcaatgctgacgcaattcaaaaaatattcaagagaatgtgctaaatgtgcatcaaaacttttcttgcctgagctccagaaccttgcccaaatgggtaaaatcgttttccatcagcatcgaagtagcacatgttctcaacaactgcaacgcacggaaccttcacaaagaagatgaagatgaagcagaaacaaattgatgcacgaatagtaagcacggtagattacaattaaaatgaacagtgatatgaagattacacaccttcagcttggaaaacattctaactccctttgcaacatcgatgaaagcaagcttctgaggggtggtaacaatgacagctgcagtcaatggggctacctgatgtttcagacatgttaaatttcacagtgcctacaagcatggttgatgttaccacgtgtgatttgtacaatactcaggctagaggtaccacctgacagagtgttaagtgtatatctcctgttcctggaggcatgtcaatgacaaggtagtcgagttcgcccctttatgaaaagaagaaaaaaagtcaagttttttcaacggaacccaataatattattgggaatctacgaaaggctaagctggtaaaaatgggctgctttattatgttcatcagatgccttcataaagatgtcaagtatctcttttgcataccaatcagtagtggtcagcaactgattaatcactcccgaaaccattggaccacgcattatagctcttccttgtccagcaaagccaaaagacaccatcttgacgcccaaatactcggttggaagaatacttctgctttctgggttctaaaggtaaatctgtttaccattattagtgcaaccactaattttttgttaacacaattattcaatcagcttaccatcactagcagccggttttcaggagaaaccatagttggtaagctcggaccgaagacatcagcatcaaatattccaaccctggcccccataccagctaatgtatatgcaagatttacagcaactgtagactttccaactcctccctgggaaaaaatgttttttagttacttactactaaaaaggactgatttattattatcctgaggtcttgccttgcagcttgaaactgctatgatattcgaaatcttctgcaatccttctggaagctcccctgcgtatgctggtcgtgcaggttgcgcagacattgtaacattgaccttcttgacccaaggaagtgctgcaacaacctcatttgccttctcttcaaactacaaagcaaaacaagtcttcatgcaattttgccgcaaattgtttttccaacccaggataggacagcatttttacaaacagataggagtataaaccaatcagttcacatttatacatctatctcatcagatgccaatgataagcttaaccgatactattatctcaaaaccaatatagttactgctattttgtttgagacaactgaagataaagagtgaatagttccacggagataactgaacacgtcaacacaggaactgtactcaccatgtccttgatcgggcaggcaggagtcgtcagctccagacgaaacgagacctgaaaaagcagagccaaatggagaccaaagtaagccaaatgttcgagcagtgcatccaggcttcatcagcaagtgtccttcaacttaacctcttccaaggcctcgctaatctccaggtccttgacgaacccgcacgagacgatgtccgtcccgaagtcgggatcgatgatttgggagagcgccacgagcacgtccttcttggcgtcctccaccgacgccactgccacacacaccagttcgaaaatcaaatggaaagcacacacaaacgtaaaacaaatttcgcagtttgctgagaggagttccgactgacgaaggttaccgctcgacgaagcggctcccgcgcgccgccggagccggcccacgcgccgcggcgaggggcaccagccatgcgcctgggcggccgccgcggcaggagaagccttcgccgagaaggcgcctgcaagaaccatgaaatccgtggagttagctcgccggtgagagcccctgctcgggcgcgtcagagcatgagcacggagtagaagctgaacgcgagacaaggcaaccatccaaccgccgtgtgcgctcacctcgcggggttggagtcgacggggggaggaggagagggggcgcgggcggcgcgaggaaggaggcaggcgcggcggcgcggaggttccgcattgcgggccttcgacggcgaggcgaggagatggcgggcgcgcgcgcggcgaggaagcgtggcgcggaggagcggtgggagggagtggccgtctctgggccgctggttgtgtggatttggtttgcctttgctcgcttgaagattagtggtacaggcagatggcgagagcgtggcggacacgggacaccgacgagtgggccctgttggattacattttttaagataatggaataaaaatcccagcctctgcaaatttttggattacatatgccacaagtagttcgctcgagtgtcggtacatccatagaacgggagaaggcacagcagctaggtaaattttgtcgctaagtttgtcaagaaaagtacgtattttgcacattatttttttcccgagtttatacgtggatagtaaaatgtagtggtcaaggttagtagtatcgggaaagtgaaatcatctctttcgtgcacgtcacctaaatagtcataaaaatatgaaaaaaattggcaacatagattaatatgaaatatatcactccacaaacatgcaagtttaaattcaacttctacaagttgtaacaaaaataacaaatatagttgcgaatgtgagataactattttcagtttaatttgttatttttgttgtaacttatagaagttgaatttggtcttgcatgtttgtggagtgatatatttcgtattaatctatgttgttaatttttttaaattttttgataactatttagatgacatgcaaacaacgagaggatatcctctcgagagataaaaatagtgttgtttcattttatagatggagatgggccgaaagttctaaacgcacacgaagccaccaacagctcggacaaggcacaaggtaagcacatatgtgcatgggaacaagtccgcctttgtccctcgtcttcccgtggagtttaaattctaaaccataataccagaaattttaccaccccttctccccaacttacaaaattggattaaattagatcctatgataggatggatgaccagtttcgctgacgtggcatcctaatgagaacaaataaaaaatttggggcccatatgtaagtacacatccacctctcccatctcttcctaggagctcattggtgaggagatgagcggggtggtcggcgagatgatcacgaaggcaacaatggcagtaggaggtcggcaaagaggggctccagtggtttgtggcaacacgggaaagaggagggaggcaagggagacagtgcattgtgagtttgcctgtgggaagagaagcagtggtggcggtgccgacgagcccctgggagcttgagctcgtccgcccttcagtacgcgaagggatccagtggcggcggcagccagcaagccctacgtgagctcaagctcggtcaattgcttgtgcgaagggaggcttgcccaagtcctatcacaatcagtgaaggacacccgtgaattcgacagaggatagacaaatatgcaatgacaaacatgacggcatcgcaggtggtgtgggtgggagggctcgctgcatcgaaagcaataattgtacctgcgcccacccaagatccgtctcccgtcctcgatctccaactcaatagcgttgtttgggcccttcccgacgatgcgttacaacttcaataagaaggagatggcgcctggcgacagcctacaggcgagcaccttgaggagcacatgctgctccactttgtgaacccatcacccgccaccagagacaacatcgacactgaccgcaatcttcatcaagggtatttggcgtatagcttgtcgtcgacaccgatagtattgagcaagttggcatggaggagacgagaagaagcataggaagaaggtgaggtggtcactttacttgcgagccccacaaactaagataccacatcagcgaaacctggctttgcgaattggtggtggtggtggggggagtgggggttcaggatttccaatattgaggtttagtggtactatttaaaactcgacagaaagatgaggaacgaatagtacacttattgctatgtccatgctatgtgttgcagacggtccatatacgtagcccgtgagcgtctcggccctggcccctccagcactcgccggcccattgccagacaccacaaccgcgtgacgcacctttgctacacgcgacacaacaacttgtcctcactcgcgcccgcgaacgagtgggcattggcccaagcgcgggacggagcgccgcgccggttacgcaacgcgaagcgggagccatcggttggcttccgcttccgcccccgcccccgtccccgcgcgcgcgcgcgcggccaacgccaacgcagcctgtttatccgggtaaagccaccacgaatcgaggccactgccggtcctggcgtcgaacgactcggcaagtgtacatgatccaaccggagatggtcgatcgtccaatgcagcagcgacgggcaagattgtgatggatgagtagttgaggaccaatttaaccgaccgatgcagggaaaacacatgcactgaaaatggcgcttcttccctagttacatttcctgatcaatcctgacggtgcttctgtatatgtgcacgcgatgcgttcaagaccgagacggacgagaaggcacgaccccatggcgtaccatacacttgaatacttgacgcgacgagatctcacatatatgtattatccccgccgatctatcattctactactagcttagctagcaaccttgggagttgggggccacccacagctctgcaaacttcatcaccttggagacgctcgccagcacctcatacggcgtgatatcccctatcaccaccaccttcttactctctagatctacctcaaacgacgtaacacctgcacaccacacacagaaagatacatgttcagatgcatgtaatgcagagttcattcagactaacttgaaagttgaaactgacaaatcccttccatttttcgcttgatccggcaatgagccgacagacggtggcaacaaaccatcttttttgtagagtgaagtaaagttttactaccaaaatcttgggtaccgactggggtggcgacacctaaacttctttccagaaagggtaggcaagcacaggcaggaaggcagccatgcacatgtgtacagtgcaaacatgtgctgaaacctgcatataatgcatggatgca

SEQ ID NO: 56945 - DNA, 7322 bp, Oryza sativa
  unsure (1)..(7322): unsure at all n locations
cgagtttttcttccttgcactgacaggcccgtcttcttgcagcagctacgaattcttctgaaactctgaacaactcactgccctctctgactctcccagactctgctcacatcccaaagatgcccatgtggtagcaccaggctacgttataaaattctcagatgtacgccatttcataacccggtgatttttaaaagataacaccgactcagtgattgattcgaggtcctagatagtactaaaattcgacaaatatgaatgcttcgcttgactaatactcctaagaaatgtacacacttgcatatatgcatgaagtacgttgaagagatgttgagtaaaaaagatcgaggcaggattcaactccaggatttcaggtattatcaccttttagactagcggactgtcaaattagttgtcacaaattcgagtcccctgcccctaagttattgctgtgccattgctattgttgtgtgagtcacagagtcctcaagtaattgcaacgaagaaaaacagagagaaagagaacgaacaagtgggttacttgttcagttgttcttgggggtgaagaatcatgagttcatggcactacaaataaagttcagaatgatatatcggttcaagtagttttgttcgtttggtaaatgaaaagtgcaactttatgataacgagtacttcaaaatgcatcctttttagcactagggcctatcaaaagaatctgaacaccgtcccaaaaaaaaaaaaaaaagaacagaggatcagctgtctcataccgtccatcttggatatatgcttctgaactttcttggcgcatccgtagcagtgcatggacaccctgagctccacggtctgcaccaaccaaaaaacgcaacagatggaacagagagaaaagcatcagcagacagaatgttttgcagacatgtccttaatagaacaggggagaggagttcatgttcatcacctttggctctagatggaaagcgagagtcttggctccgccgacgagatccttgagcttcacaagctcttccagctgagagctcaccagcgcctccctctcgatggcctcctcctcgtcgtcttccaccgaatgtatgcagacgcaggcgttcgtgcagagagcgagggagaagcagtcgaggaccttctcaaaacctagcttcctccccatctctcacaaagtgcaatccttttgaaaaaaaagcagccaatgtctactgcctctcgccaagattggctgggctctgctgcgcaggggataatgtgaagaatggcacagctttgcgcgagaagagacaagtagatatgcgagctgagccagtagacctaccaaagcgcttggaatgaggtcagggaagaggcatatatacaagctgtagcagtattgaagtgggctattgcccaaaagtttgaagcaacttcctagaaatattattaacttttgttcagtgcaagacatggtcaggcgccggttttacaacgagacaagctggtaagctctgcatgtgacaatgtgcttgccgattggcaggtactagaactggtgcaattatgcattgcagaacacattgcaatgtttcttttagataatgagaactcactgcaatgtgataatcattcctggtctggtaggatgtatagaagagagagtcagagaaccaaactgagggacaacacatttaggtaaatcataagatacaattatagaagtaatcatgctaaccatttggctagtaattaatatacataaatactccatatgcaagtaactgaaaacatagaaaatctgcagcaagacgtcgttgattcacaaattgccacataagtgcctttcacttgtccacatcggaataatgtatgtatttgatcgtttcattcggtggggaacacatgccaacgtaagctgatcagcatagagaatacaggcaagaaggcatcagctaccattttaccatataaaaccatatccacttgtcttgcgccgaagagaggaccaaagttataaatttggtcggagaatatgaaatgcgagcaggtcaccttcatagacgcatgccacagcggttctaatctttgtaggccacgactttgtaagccacgacgacctttagcctctaatatcaaatatagctacgcaattaggaattgatttgttgccagtcatactctaatttgctcatctagacgcgtctgatcaatgcaaaattaatcgctaaatcttacgtaatcctcccattgtcttctactaataaaaaaagaagttataaactagtcgcgcatcgtgtgttgtcacctttttactttccgaaaggcatgatggatgcatcggtgcgcatcgccatttgacaagatcccaaagggctacacgtccaattaggggagagagacgagacatgattgattagcctgtaatgctttgtgcttatgtgcgacaccgacatcttaatcggttgtactcgcaaaaggggaaaaaaaggacgtcttaatcgcgtccagctctgaaaacagtggcggaatatggtggcgggcctcgtgcgattcaactgttttttcaaggaagcgcgcagcgactggatctttcactatttaactctttttgaaaacttattttatgaatataccctaatagaatttatcccaaaaacgacttaaatctcggcagcagggttgttggtggtgctgatttccaacgtgtatgtgccaaagatcttggcgccaaaaccctggtacattctaagggcctgttcactttgatgctattttcagtcttactaaattttggtaaagttgcaaaaaaaaagtggctacatttagtttgcttccaaattttggtaactatataagaaatcccggcaactatgctaaaattttatcaatgccaaaatttgataaggttgaaaatgacatcaaagtgaacatgccctaattcttaagaaatcaacaccaccaaacaagcataggtgcatggtgtagaagtgagatatccagactgctatcctagttaattgggtttgattaatacttgttaacttcttaagagaactgatgagctctgtgccaaaggactaggatctttggtgccgagaagttagacatcggctctaaattttttggtgccaagatttgagattaattataaaataatttcgtcagaatctatctataaaacaagttttctaaaagggataaattgtgaaaaatccagcgcgcaacgatgtgcatccactactgaataccgatgcatctgatctatctgaaaggctcgtggtgggtggccattgggcaatgggcaaggaggggggggggggggggtggtgctnaggcagacatggcaggtgggcccgagcgccgaattactggctctcagtggggaggacggatcatgtcgtacctcttacccagcatggattgggttgtgccatttgctttgcctcgttgtgaattgtcctggattccaagcaagcaatgcgtgccaagttcttaggattctgcaattcgccgactccgttcggagccaccaaccaaatagagcagtaggattctgtagatgcttcggaccccatgcattatggtgattgtgaaatgcgattgcagcgcatcgatatcagagtccatgtccaaggtaaaacacagtgtgagcacccgtctcgcgctagcgaagacgacaccatggaaacggtggcactaggtgactgcactggtggagtggctctttcttctgaactgtgaggagaatacatcaagtgcaggggaaagccggaaaggccattgtccagtctccatcaggtgggcaatcagctaaaacgagttgctaactcggctagcttagtggtctgtagaagtgtagattgccctgtgccccgattttttgagcgttcgccatggtgatgactgatgagcacgactcacatcagatgtctacgtagctaccagcattagcattggtgctgcctgtgaccacctcacaactcacaagctcaggtgggctctctttgccttgtcttgaaccagacgacgacgtgaacatgttcggagggtggggcaacagtggacggatcacggatgtaggagcaagagggcctgaaaagggtgaagcaggggccaggggcttcctctctccattgcccgtttcgtccaatccagatagtaatctcagcatggtccagccggatgaacacctgggaccttgctcgagagtagttgagcgactagggtagaaaatcagctaaaggaataaaggacggcttgagagtttgggggcacaaaacttggttgaacgtctcccagtagcccaaatgagcagagaaaccatacccggacgttaaacgtatgaataagatgtgagatgcgtccccagtgccagcccctacccggacgttaacgtgccagtaagtttcctgaaaacatggcatatcatttctatttttcttgcgttgccaccacgcacgaagtgctaacgaaagtagtactaatctagcaaaggccgagaaaacaagagcttcaacagaaaactgtgaaaaggacaggggaagaagtaaagccttttgtcgagcaagagtgactgtagtcttgtaactgttgtctttgggttcgtcgagcaagagtacatactatgccatggaatctggaatgaaacattacaataattgccaggcaacacacaagcagaaaactcaaatctggatcaaactggccagcatcaggacagaaaactctctgatattctgatgcaaaaggtataaatacacaaattcttgtccttggtcttaaaagaacaaggtaggagtggcagacaaagggaaaaaaaactgtctccgtctctaatgtccaggaaactatacgctaacttcctaagcatgaaacgttttcgcaatgatatgcgattgatctatagaaatttcccaagggagacataaagcagaaatatctgagagcaaggtttattaaaaaatctgcattgaatactatctaaatatttaaaacataatcagaaatacagtacccttggcagacactgacgcaattactattctggttcaccaaatacaagctagctttctgatatgaatacatgatcgtaccctaacaatctaacatatatacgtatcagggttgaattataaaatctgcaatccaattatgtaatgtacaaaaaactttatatttaccttggagataccaatgagggcacaagttcagaaggttgggggtaatagctgccaaaatgtggtggattatgtgttgctcccggagccccagtagaactagacgatactagcagcctaattcattgaaacaatgttaaaaaagaagaaaaataaacaaatacaagttcaggcccagaaagctacatttagatgccacatttagatggaattgtgttagttataaaactgaacctattaagatacctatgaaaacatgttaaagagatgaaatccaataagtgtaatgattgtttgaatggtttggcacatgagataaatctaaactttggacaaaaagggcatcttatggtacagagcctggttcactcatgactgaagttgtgctatgttcatgcaatgccatgtaaccaaaatttaaagacatgctacaattatatgccctagagtaaactatgtaaaagtccagataacactccccaatgtaggcatgtagctgtgcagcaattggtactagcagatcataggttagacaagcacagtcgcaaatactctatgcttgtcatttgaagagacattgcaaaggaatgttcaggttaggctgtcagagaaagttgccaccaaacacattctaccaattataaatcaaagcacaagaattcgagaaaccagaatcagactggaactcagcttatctgctccactagctagcagacaacttcctgggaacccataaccaggccatattcagctggaactaaaactcactgataacttggcacaattcaaattttagcagtcctctgtgtctgcagctcatttaactaaccagccatttatcaccatttttcttaaaccctgctgggcacaccacttagcaatccaatcagaactatttgttgtcctcgttaagaaattgccaataccccaggtggttatgagcaatgcaaatttcaaaatggagtgcttggctacagcaagccacaatatttaaagaaagtggaatagttcttccaaaagttatgcaagaaaattaagtcctgcataccatgtcatttgattcatttcagaactgccaccgactagttgtcgaaccacaaatctaggcagagtcctgccaatgaaaggggtatcaggtcccctaggatgttgtccactgaactgcaaagctgtggaggaaagagaaatgagactgggaagtccatataatagagtgcctgcaacgaaaaatatagaaagaacgaactatatgccatatgagagtacagagaatctccaattatagcacatgaccagccaagaactctataggaacctgcgagtaccatgatacctagctccaatccttattattgaaataatgtcaaagagtaacccctaaagatttccataattgttgtacacaaatgtagtttgtctgttgatagataaagtcaaacaatgaaatcaaatcaaccattttttcatcctcggtgaagtgcatggctacataaagaatatctgcagtgaataacaaggatactttgcatggttgatttctttacagctttttcttcttttcatatcccactatatgttgcattttgtattactaaactgacttaccctgtgaaacaatacgaatctaaaataatgatggaggtcgagttgatgcaccctagctaacaacataaacttggaagtaatgctggggatcgagtgaaaacctttgtcactgagtgtaaggccccttgctcctgtaacaccatgaacatgaccttcatcataagtaaaagagggcccctccacctcctcttttagctcagtcttcactgcagatgacactaaagaattgactaaaccaggggacatacttgtctcaatatcttcatttgaacttgtcacatgagattgaatttgggtggtactgagaggtttcggacaaaacaccagagtagacacccttgatgtggattgaaatggtcgatgaattgacctttcctgataaactgcattataggactgtgcataagagccaattgcttgaccatttgttgaacaagaaatgctctttgtgcactaaaagaaaggtcaaacctgttcctttatcactggattttgaatattggatgtagttgtctgatgctgatccagataaatttgagccaggattatcaattt

SEQ ID NO: 56946 - DNA, 13991 bp, Oryza sativa
acatacgggttagaaactccccccctgtaacatcgtgtgcactggtgaaatctttagcattgccataataggtatgtgattctctttgaacataggcaaaattcttggtatcaccatgatcatagtaagtgtgaaatttacttggaactcttttgtagttattggcactgccatacatattgttggattctttcagaaagctaatgtggtccctggtggtagcaaagaaagtacgtggttcctttgggacatacttgtactcttctctatcatcatgatagtaagattgggataaagttctttcaagatagccatgatcataacgatgtgttctatccccaccccatgctctaaaagagcctcttggtccccttccctaaaaacaacaatacaaacatagcagcactgtcaataagaatagacacaaaaaagacatagtgacaatggcatagtacctcgtttctcaaaaaaaaagaggcatagtactcacactgtcatttggagagttatgggagttcgtctcataaagcctatcatgatgggaattcatctcataaaacctatcatgcgcccatacgttatcatctttaggataccataacttttggccaccgaaatttttcctgaattatgatcattggatgcattaggcagcaaataaacgtgtccagatcaaactgaatattgttgaaactaatttatagaaaaagaaacacatgtcaagcgctgccattgccattgcccaggaaatgcacttaccaaccagttggtgaatgatgacaataactaacaaatgaaactaaacaccaatttatctgttcaaactctttagacaaaatacattggaatatgcatgctacaggcttccagctagacagtttgaaacaatatacccttttggcattttctatgcttattagccgcaccaaattatacgatcttcactctcatagtgaataattcagtcattccagtgcacataatacatatgaaactgtcggaattttgcacacaatggggttaattgattgataaaacaatcctgggtgaatagatgaggaatctaaagcacaggttgtggctataacctctattttcagtttgtcactcagaactatactaatgtccggataaacaacggaaaaatagaacattgagtcattgaatcaaggatgaagaagctagaacctttggctcccgtgcctgccattctccgggtcacggaaacggtcatcgtgcatgtagaaggcgcctatcgttggtacggcctgggcctcgccctccttgttcaccacctccgctccttccaccgcggcttccacctccgcctcctcaccgtcgcacttaccctcgtccccaagtgccgcgaccacgccatccgcttcctcgtcgccgtacctcccctcgtcctcaagcgcttcttcgtcggcgcacttcccctcgtcctcaagtgcctctcctcccccaacaccaccaccaccaccaccaccaccaccaccacctcccgcctccaactcatcgcgttcctcggacccctcctcctcgtcgtcgtacatctccgcggcgccctgcccgtcggagtcggagtaggagtcgaggtccgaccccgccacgctccacggcgccgatgaacccgacgcgccgccgccctcctcgtcgtcgctcgccgcggcgcgtcgcctcaccgccggtaggggcgcgtcgtcgaggtcgctctcgtactcctcctcatcctccacctcctcctccgcctcctccttctcggccatgggcgccgtcgatcgagatgccgcgggggcgaacaatcgggagaggacgctagggtttaagcttagggtttgggggaatctagaaggttcgagaggcttctcgggctcgcgttgctgttccgcctccgcgcattggctcgattaaccacctttttgctttccagctgattgatcagctcctttggggggaaaagagaaggggttggaaacttggaatcattagctacgccaatgacgccaaaaaccattggatcgttcaaatgctgggaagtcgagacgccgacaagtggggccaccggtccaatttcaggtggattttcatggtcccacatgtcatcgaattatccagtatatgctcttatagtagcgtgtttttcttttttgttcttttttttctgctgcttctcatgttttggcagtcttagagcaagcttaacggagtggtatagctaactactagctccaatttatttatagccaatctaatagttcattgatacaacagttatctataagtatatactacactattaatatatggtcccatctcttatacacatataatgtattgaatccgtgctacgaatatgtagcccgttttattctctcttttctcttctctccttcacacgtgcataattattgaaatccgtgctataaatatgtagcctgttttcattctctcttttctcttctctccttcacacgtgcttaccgttattgtattacagatggtttcaatcacctgcagactacagtactatcttgacatatgactcggcgtctcagccaagcaacggaatggtcactagtgtccatctaaaaaaaattgatcacggccatgaaggcgaatttcttgactcttgagcggtactggaagcgaggatctctcggaatgcaagggttcaatcattttatcctggagtaatcataccatgaacaattcagacttgatcgtacagagcgtcttaagccgctgatcagttgtgtgacatttcatctagtaatacttggatctaggatcatttgaaatgccagagcttgtaaatttcagccgctacaagtattggacaaaaaataataataataattcagtactactaacacagaacgccttccacgaacagcggcagagacaacagaattgttcctgtcagtatgtgtgtttctcttttttaaaaatgaaataattcggtgcagtgtcatgtctatttcctttcgatagttctcatttatgtttgttgagggaggaggatgctcatacagtaatcaagaaaattgatctaaataatttattattctagcagttcaagtagtgaacaagcctttcaccctgaattgagcaatgcaaccctgaaggcctgatacatgcaaatctatgaacttctctgtaaacccagaatataaactagtctatacacgaacactggttccatcctcctcactatattccccattgcccctaatcaacaaatacctgaaattaccatgatactccacaattcagaacatgcagagatcgaccaacaatccaaagcatctagcaagtactacttaatccatgcgactgaataaactgttactagctcgtggtactttctgaatcttcctcataccctttgatagtggagcatttcgtcctgcttgccttgcctgcccattgcccaagtgtctacacctataatttctaaacagctctacgcaagaaagagctccctatacttcgtcttctcccttatttctggatatctgcagcgcgtatcgacacgccgtgatggcgtccttgaccgtcaggaagacccactcatcccctaagatgtccctgacgtatccagacagcaccagcttctctgttacctctagcctcggattcgtcagagctatctgcaatgaccaaattaagcatgtgaaaaacagatcaaattctgcggttaagtttcagacttcagagtgagtgatgagctgtgatatcccctcgaggatatcccctcgtatacctttttcttctaaattcgatgcaaatagttatgaaaatttctaaaaaaaattgacaatatagagtacaatgatacctactagtccaccaaaattcaagttcaaattcgatttacacatcgagaaacaaaaaagacaaatttagatataaacagtacgctactattcatacgctgactttgtcttttttatatcttggcgtgtgagttgagtttggacttaagattttatggagttgtatatatgtgttatatgaatgttgtcaaatttttctagaatttttcataaccgtttagatggtttttaagcaaacgagagaacatctcctcaagggattagaatagtttcccgtgatagatagctaaccgtgatccctcttcgttcgaggctcttgtgtacttctagtagcatcccaactccagagttgtcgacagaagtgacacctgcaatgttcagacatatgccaagttagttatcacttatcagtggcctgaattctaggatgagagtcgctacgctgaaatggaagagggcgaagattcagacagtcataccaccaagatcaagaaccaagtattgcagatcgtgcccgacgctcttgcacaggttatcctcatcttccacccatctcaaaatcctgcaaggcagggtaagttaaattagcatccaatcgagagagaaaaaaaatgatcagcgatgatcttcagcgtcctgcattgctgtcacctttctcgcaggtaacccgcattgacgaagtagatgggagagccgagctgcaagacgaggatgccagggatgctcttcgcttgggggtattgcttcacgtcgcggaaggtctcgctccctgctatgttcccgagcttgcaggtggcaggcctggccacgtacagcaacgccctgacaactgacaagcctacctgcaaaaatgcacagccaaggggagcacatcagcatcgtgcagagaaatgtgctacggagtagtatctaatcaaggtttaagttggcgatgctcacggatgcgctgaggcctgcgaccatggtgaagaagacgacgccgaggaaggcgaccatgcagatgcagaagtcgaacttgtcgaccttgtagaggtggcagaactccttgaccttgacgagcccgatcatggcgacgacgatgatggaggagagcgccaccagcggggtgtacttgaagaggggtgccaggaacagcagcaccagcatgatgcacaccgacatcaccacgttcgacatcggcgtcttgcacccggcgtggaagttcaccgccgactttgagaacggccctgaaacaagcagcacatcgtcagacaaaatgttgcaaaatgtatcatggttctggttttctgaacaaaggtcgcagaggccaagatttatacctgtcgtgaggtagcaggaggtgaaagaaccggcgatgttcatgataccaaacgcgatcatctccttgttgccgtcgatctgctcgttcttgaccatcgccaagcttcggccgacggctattccttcctggagaagcatcgatggccgccgatcagaaactccggtgaattagagtgtaaagtttaagtgattgatgagggagtttgagtcaagatcatgttcgtactgccagtgctaggatcccagacaagagaccagctttcactgccgtcttcatgtgcctggactggaacgttagctgcgcaatggacaggggattgatccctttattcaggttaccgacctgtcccaagttaagcagcgttttagcgcatgttgtcaggaaaacagaaaaaaaaatattgatgtttctctgaagcttgaatcgtcttggcatggacgactgacttactatcggaattccatgctcgtcacccttgacaaggaaagcgaagatgcctccgatgacgacaaccatgaatggcgcaatggccgacacccagaacaactttggcagtttctttctctgaagttttggagaaacaaaacttatatgaatataaaacggtcattctataaagaagcagtagcttagcgtatgggtacagttgtttggctagattcatcagtctcctgattcccccacttaccaggtgcttactcgacatcaagaacaagaggaagcatatgccgagaactgcactctgccatttccactgcagagttaaaaaaaaacataaacaaaaggttcagttcagaatcttattcctgcaatttttccactctgaaatcatttacccgcgattacaaagaaaaaaaaaggaacatatgctagtgtgctacacgtctggtgtttctgaaaaatcgcaatggcatgtaccattcctcacatgacattgaccaaggtcaacatggcatgtaccagtattaccaatgtactggccatataatgctggtaaaaaaaatcttcagaaagctacgggctgtacaacagaaagagagtggattaacatgcgatatatcacttaataaatatataatttaaaattcaacttctacaagttaaaaaaataaattaaactacagctagttaacatatactaacaaaacatgtagaaattaaagtttaattgtggattgatctatcatatattaatgtatcttattaaatttataaaaaaatataattatttaagtgacatgtaaggcactatttagttctccaacaaaaactttttacactatcagatcgaatgtttcgacatatgcatggagtattaaatctctactattataaaaattaaagatgtttttgctggtattttgatacgtcatccgtgtatgagtcggtttttaagttcgtttgcttttgttaatacatatccttatttgagtcggtttttaaaatcgttcacttttgataatacataagaaattatataaaaattctgttttttttaaaaaaacttgcatgctaacttgagatgatcggactcctaactgcaactcatgattttataaaaatatatatatccaagtgaactctcacagtgaatttcatcttaactaaaccatataataataataagattaaaatagaattcacccgttgcaacgcacgggtattttttctagtataaaaaaaataattatacagattgcgtgcaaaatgtgatatgaatattttaagtctaattgctccatgatttgacaatatggtgctacagtaaacatttactaacgatggattaattaggcttaataacttcatctcgcagttttcaggcgaaatatgtaatttgttttgttattaatctatatttaatattttaaatgtgtgtccgtatatccaatatgacacgccaaaaaaagatactttaaatatatgtccgtatatccgatatgacacgccaaaactttttatctcgcaaactaaacaatgcctaaatagatgaaaaggacgacccttgagatagattttaaatagtttcccgtcaaaaacaatcccgagcatttcctcggtgcacgcaaccggtccagcgcacaaactgtaggcccaacaatgattggtcttttcttaaaaagacaagatccagcgacacccaaatagtattattgtttgtttgcacgtacgcatcatcgatgcaaaccttgttttgatctgaagttgttaacgactcgacacgaatccagccgatatactaatcgagaaagtcctagctgcaatccagtcgagattccttacgctagtcgcggttatttctcggagaagtttacaggagaggttacaacaacaccctcggaattcggaaatactcaactacttcgcagtttatccctctcgaaacgtgcggctgcatgctatttatagcggttacacatccaggacagcgaggaacaatcgccgttaaaattcttaagaaaaaactccaaaaatacgtccagaaaacacgggagaagtagaagtatggagaagcaaaagaacgacccaacttttctttatttcctcctactagtgaagtgaattgttttttgtttattttttttaaaaaaataggtcttagtgaagtcattactagtactaatcacggagagatttaaattacgtgatgaaattgaactggtaattcgcattgcacctcgtgccggtaatggtaggtggagtgcaggacggagatgatgtctgtcttggtggtgaagtgcttcatccccaggaggcccttgaactgctgcagtatgatgatcatcgccgtgccgcccatgaacccggtgatcgtcgaccgcgagaggaaatccactattagccctaaccttcacaggccaagtgtaacgtaatagtaataacaggttaattaaaaacgtcaggccgggttaacgagtgatgaattagtgaagagagatgatggaagtgcgattagtttggggtttgattttaattttttttatttttacctaaagacgcctagcgcggtctggaagaggccggtgaagaaggcggcggtgtagaagagctgcaggtacagctgcgggttctcgtccgccgccacctccgtctcgatgatggacgccagcagcagcgacgccgccgccaccgtccccaccgccaggttgttggagctcccgaacaccgcgtacatcaacggcggcacgaagctcgaatctggcaaccccaaaaaaaaaaaccaattaattcatcgggtgtgcgtgcgcatacagaaacgcattagtaataaatccgagcgcgcagtacacgtacagaggccgatgattggagggaggttggcgaggcgggcgtagctgatgccctgcgggatggcgaggctggcgatggtgatgccggcgaggaggtcgaacttgaacttgtcgaggccgtagcgcgggacccagtccagcgccgggacgaagtacttgaccgcgcaccacgcgcgcctggccgggggcagcgcgccgaacccgcggaacgggtcgtcggggaagaacgtctccgcgaggtccgaccacagcttctccgcgaacgggcggcgcccggacaggttcacctccgccgccgaggcgcctcccacgccgtgcaggtggcgcgacgacgcggacgacccgcggccgggccggtggttgcggccgtcgacgtcgccggcctccgtccccatgtggatgggtggggtacgcgatcggtctctcgatccgccggggccggggccgagatctggctgctactgccacacacacacacacacacagacacacacagagacgacgatgatggagaggagcggagcggaggaagggaaccgccaaccgcgcgcgcgcgatcgagtcgagagcgttttgctctgatcgactcggtgactgctatttcattggctcctaattatggctttgcatgcagacagagagagagtgcagagcgagcagtggctacagtagtgtgagggttaattaagtattacgcgcgagcaccgaatggcggtggctgtgcgtacatgtcgcgcgttcgcgattacgtgcagcgtgtgctcagaagcggggcgcatggcgcggtttatataggcgatcaacaaggagaggctacgggccattctaaattacgttttggattggctcatttcttgatttttgttagcatattttaaactgctaaacattatattatattttgtacgaaaacttttctatatataatttattttagaaaaactaaagaaatctattttcatattttttttaattataaatattcaattactcatatcctaaggcaccgttcgatctccttggtgagagaaaaattttcaacgcacttaaaacgagaaggctcattagcatataattaattaaatattaattattataaaaattaaaatagatttatttaaatatttttaaataacttttatatagaattttttttaaaagtaccattttactgtttggaaaacatactaatagaaaacgagaaagttgtagtttgggcctaagcattcgtttgtttgcataggaattgaactttcaagaggcacggaaactggagcaagcaattaacacataattaattaattattaattattataaacttgaaaattaggttcatttgaatttttaaaggagcttttacataatatttttttaaaaaaacatggtttaacagtttggaaacgtgctaatgaaaaacacgtaggaagtaggagtttagatctgagcctaattacgtttatagttcgtttcacgtacggctaatcatccaaagtaacccataaaagggatgtaggcttatggacgcgtggtaggaaggaattaaattaatcgatcatcgggaagatgacgatgacttaattatatcgacatgtaaaagcttttacgcgttaggcgaaagaaaatgacgacggtggcgacgtggggacgtacgggcccgggccggcccggcaggggcgcgcgcggctgcgagtagttcggtggttctctcgatcgatccatatacaatgcacgtaagatgaacggtggcatgtgacacaattccgtgcggttgtacaagtttccgcgccgcttcgatcaggatcaaatgcatatcgtttttatcatgcatgcttgctgcttactcccaccttttcaaaatatttgacaccgttaactttttagtatgtgtttgatcattcgtcttatttaaaaattttaagtaattatttattcttttcatatcatttgattcattgttaaatatacttttatgtgcacatatagttttacatatttcacaaatttttttaataagacgaacggtcaaacatgtatttaaaaagtcaacggtgttaaacattttgaaacggagggagtatttagttagacagagcccaggaggccagaaatacggaagaccaaatcattctgtcgctagcgagatagagttgaactctccgatcgagctctgaagataaatccgccccgtttctttccatttcttcttcttcttttctccctttgcatgcatgcatggttgcatgtagtgagctagatgcagatgtggatatgcccggccggttgcaattatccgtcgagggttaattaattgtccatgtatatataggtgccgttgtatatgtagtgtattcgaagataagctatgggaatgatttttgtcacatgcatcaaatttatacgcatagacttctcaccaaaaaaagaaaaagtacttccaaaatataccgtctatctatctactctctcgttccctaaatgtttgacgccgttgatttttttaaacatgtttgaccatttatcttattaaaaaaacttttgtgaaataagtaaaactatatgtatacataaaagtatatttaacaatgaatcaaatgatagaaaaaaaaattaataattacttaaattttttgaataagatgaacggtcaaatatatttaaaaaagtcaacggtgtcaaatattttgggatggagggagtataaggtaagagattctctacaataatatcgttgcacgcggtgatatatggttgttaataattattgcatgggcggtattgcggatgatatatggctgttaataattatcgttgattatgtggatataggatcatatatcatgctgagagtttgtgataaaaatgggtgaatttcgttttgcccttcaatacggtctttgaagttttgctctaggtcagtttagtttctaagatttcaaatcaaccaagcaagttctcaaaattaatcatatgacttaatataatccttaacccatcaaaagtgccacataagcgtgccacgtcatcctcgcatgaatggcatggttttggaatgatcattctaatctaccctacatatgtactccctctattctaaaatataaacattttcagcataatgacaagtcaaatatttttaactttgacaattaatagtaaaaagaaaataaaaaagattaattatgcaaaattgatggtactagatttattattaaacaaactatcatattatgtaatatttttatttaaaacatcttatttttatagatattgttgattaaagtagtatatcggagaccgtgtcagagtctaaaaatacttatattttgggacggatagagcactacgttagaaagaaaatgaaaaaataaaaaggaaaaagaaacaacataaataaggctggcctattattaccctatcgggttattttctctgtttaaacctcgatagggtttgggcgccgacgaacagcgcgcggctgcgtcgttgcagcgttgcacggtgattgctccagttcagctgcactgccgcgacatggggcaacaccaacgtaccattccaataaacgttgccaatttctcctgtggtttgttttcttttctttcttttttatatggtagataaggtcagaatggtcatttcatccttactgatgcatacgaggatgacgtgacacacttacgtagtattattggtgggtccaaggaccatgttaagccaaacaattaatttcgaggatttatttgaacatttgaaaccttatggactaaaatattgcaattggttattcacccataaaaaatccacttggtaataacatgtattctttaattttattttatccaaacaacactatcaaaatttcagaattaataaatatgacgttgtatctactctcaaattagtattttattaatttaatttcgaatttcaaaattaataattaatcatatgtaagtctgtaactgacatgtctgaaatattattagaatgttaatgtttataacttataataataataataataataataataataataataataataataataataataataataataataataataataatagattattgactagtcattttaacaggttttataaatacttaaaaaataattgctggtctgaatcacaatattgtccaatggatattttacagtagagcaggtacaatagtagtctataagccaactataaatatattttaaagagataaaagaaaagagagaagagcagcgggctatagatttatagccagttgcagtacgaattccaagacataatgtgtgtatgacaagtggaactagatattaatagtatagtaagcaactattgtatgaattaactgttatattggctatagatgatttggagttcatagttgcctataatattaaacttgctcgtagtgcaactgtccaataaattggcaggcgctaaatcgaagaggaggaagttttcaacggagaaactcagaaattagtacttgcccgcgcatctgcaaaaggtggcatcaaatgtgatcacatcgatcgtccttttgactccttttggaaatgcgagcaaatagggacacaacaattttgaaacatgcttggttgagttagctagctaagcttacctcagtcaagattagctagagcattgctttaatgttgatgataagttgcccccaaccaatcatcatcaatcaagtataagaaagctttgattttgtacgctaatatctccatcgtcacaagtgagcagtcgtactagccaacttcctgttatactaacaaaaaccaccgccgccgacgagcaccagtctatgtgccgtgctgtgttgaacacgcgactacgcgagtagaaccaagtgagtcgccgtcggcagctgagagtcgtcgatcacaccgtacacctccaatcagttcttcatttatgcaatgatctgatctctgcgaccggataaaacaatgatttcgagtgatgctttccagaagcacctgtatgatcacctaacaatctgaaactctccaggaactgcacttgttcattggacggatcggaactgatcatggcctacctgccgggagggattcactgttctactacttattacagctgaatcaactgatgatgactcctatttagatccgggggaaaaaagaagtcaggccaaatgggatgttcaacagaagatcaatttactgaagataatctaatttctgcagaaataagaaatactcaagttcaggctttttggaacgcaaaattttcaaaacacaaggataagaaaataacagaattagagtgcactgatatatcaaattctatggatgaaaaaaatcaagaaaaaaaactatagtaatgactatttgaatgaagcacgaaaaacatggaaatgaggcagacatgaaattttcccaggagattaaacctcgtgttgaaaatcctctagaagttctatgactttaggcaatcctaaagaatttgagagccttccattgttccaaataccaccatataagattttgtttccca

SEQ ID NO: 56947 - DNA, 4150 bp, Oryza sativa
tttttagagttagaagttggttatatttttaaacttgctctaaggtctcctttggaacaaagtatttttttttatgttttggccttttttgtttttacttttaaaagcaaactctttcaaaacttatttctaaatccaaacctatttttcctgtgtcaccctgcctgatgtgacaaaacaacactgccgcgtcattagtctggctggtgtgaccaaataacattgtgagagctttgtttcgtcacgcaatctgactgttatggctaaaagttcatatttggaaataagttttgagagaattttttgaaaacaaaaaatttaaaaggtaaaacatatattttaaaaaacaataaaatctattgaaaaattttcctacatagtcctttgggacaaagaaatggctttcccaaaatcctttgcaattcttatgtaagtacttattttaggggcaaagcccaacgaggcttagaattgaagacccattggggtgtacaatattccaccatataatttttttaaggcaagaagattgccttatatattgatagagtaagtaagcaaagttatatacaagtcataggagttatggttgtcccagaccagtcagaacactctattctcacaaagggtacatctcacttaggtttttcgcccccgcaactgcccattggcgagcttcctcctttattctcgaggatgagggatgggtgccggccaattttctgaagatacacgagttccattctttccataattcctaggagaccaaaatgactgtcgacttgagctgttcttgcgaagtgttcggagctgcggtgattactatccaccatataattaccaatatcatgcaaggtccaagtctctctatcgactgcccgagactagggccaaccccgactcatttcatatgaactttagaggaagaccagcatgaggctagacctcatgttttctttctcatgattcagttcatttgttttttctataatgctaccttaatgttatcacaaaaagatcaggataggatactatgtgcagtggtgctatactcttgaaatcggtaaacaaggatcttttattctattttgaatgatgcatacgtaatacctaccggatatgacatgctaaaatttatgtgattttagaacttcttttagttaaacttggttaaagggaattagggtttgtcccatcaccatactaaaatttatcggttgtgtgccttaagaatgaagatgtaaaacatttttattatagaaaaataaataataccttttataaaatctgttgtgccctgatatcctatttcataagttttattatttttgtgtgattcttgtgtttttagaatcatgcgttcaagcgaccggtctctattaccatgttgtctaacagaacgtaatcacgtttgcaaattgcaacacatgagacgccaccatgcatcgtggctcgtggggaagccatgaaaattaacatgtgctgtagcagtgataactgtgataatagtgtaataaccgtacggttttgtaaatcccgagctagagctccacaacagctagctctgcaggctgcagctgccagctggtgaacagtgatatcctctaaagaaacggtaacgcacgtcctcttctggggaagtagagttcagaggcaggcttaccccgtgcgcgcaaaaccagcgcagcgccgttacgacatcatggactggtttgatttaagatctaaattagttttaccaatatttgttaattttaatagtgtttagtgtctatttggtttgaagccaaattttggcatgcctaagaaaataggccatttcagtagtgaacttaggctattttggtttcaatccaaacacaactttgcattaccaaaattagtcatgccaaaacttaccaaaatttgacattgataaaatttagtaaggtctatttagggcacaaacgaaaccaacctcatatgtccataacaatggtaacacgcatacatctccatcaaaaatcgcttctgccgagcggtggtcgaccaaaagattttaatgcagatcatgcaacaaccttttctacagtctcttttatgtggcgttcatttggttggctagctagcatcagcctgtagagtgtagacgggaacaactaacgacagaataaatgagcctgtttaacaaccatagtacacccctgatcacggaaaaatcatttttaaggatgaatattgatatacttgtcctaattaatccttagaaaataatttttaacaaaggaagtacttcctctgtactcgtaaataaaatcgtttaggacaatgtttaagtcaaaccttgggaatataaattatgaataactctcgagttgttgagtttaaaaatataaaaattatatgaatagatttgtcttgaaaaatactttcataaaaatatacatatatcacatttcaataaatatttttatataaataagaagtcaaagttgtgttttggataccgtgtcgctgtcctaaacgacttattttatgagtacggagggagtagaagtactcattaaacatgacactatctatgacagaataacttaattaagggaaattgatttcattcctcgagaggagatatcccttcgtttcgtgcatgccatctaaatagtcctaaaaaaaatttaaaaaaattggcaatagattaatatgaaatatatcactccacaaatatacaagtttaaattcaacttatacaagttgtaacaaaaataacaaatataattacgaatgtacaataactattttcagtttaatttatttattttttgcaactggtagaagttgaatttggttttgcatgtttgtggagtgatatatttcatattaattaatctatgatattatttttttaataactatttagatgaaaatccacttcccttaattaagtacgcacagaagcgtccctgtatgacagggtactaacagagtagtacgaatagagggtactggccattctggtttatttgatttggatgagaacacattacatttgatgaggtgtctctgtagtctacacacctatccgcaacacaggcaagaggacattgagaatttgtgattcggtcttcagagcaactgtgggctcagcttttagtgatttcagcaaacaagcatgacatgcatcagtgttgtcatgcggagctcatatacgatgaatcctggatatggtggaacccagtcgtgattgagagcaaccgtgcttcaccaaagtacccatgaggccatgacaagcatattttgtggcattttctgctcgacttcttttgagcagtagaaaaaataaaatgtattgcatttcagagttatgtttcatctaaacaaacatgttctcgccgttttcgttacagtgcgtctatcttggcatcttgcactatctaaaagtaagcaagtatagcatgcagcatctcctgaataatcatgatggcttcacgacctaaacctgaataatctgacctctcgtatcacctaaagccattggattggttattattgggggatgcagtttctcccgatgaagaaaagcttggcgatccagaagaaaaggattgttcacttcctccttccatgtcctctcatgccaagtagagccatatggttctgttagcaactttttgtgacaagttgacaacgacgatcgcagcaccttaagccttgcggtgatcctagagtcgccaaccacctcgatctagcgaaaagctaaacctagatgggttttgataactaaactggctagcagagccgatttctagataactacctgtctcgtaggcaaaatggaaggttttcaggacaaacctacaaagaggtgtcgcactctcgcagcggcggcggacggtttacggcgcaaaccgacaaagatggataaactaagagaaaactaaaagcaatatgaaaaaacgattcgattgattgactgtagattgtttttttacaatgaaccggccatgtcccttatataggggttggtcttgccctctacaggccctcctccacgtccaactcggggtagaaactaaaggaaacccgaaacatgccttcccgagcaaggaaacctcgaaacccgacgaaacacagtcggattcagacctgccggtcagaccggcaacacact

SEQ ID NO: 56948 - DNA, 11975 bp, Oryza sativa
accggccctcaaccggcggtctgaccgcccaacacacggcggtcagaccggcctactcggaggaaaccggcagacttccaaattttggcaatcttttctattttaatcctagatgctaaatttgggtgtaaagaggttcttgccaaatggttgcttttccatgccatgtaatcaagatgtaaacttgtcatgcaaatgcagtactgctggcaccacaactcattagatcaatagagaaatgttgacgaggctcacttacttcttcaaaaagtaataacgtaacgtaatgaaattaacaaacaaatgcatgttcaagtttgaatcatgttattctgtagcttttgtcttgtgggggtagtttgcgcttcttctgaaacatccggtgttgacaaattggagatagggcaggaaagtattgttttctcggcctatcctaagagtgagatgagctagaaaagtaaaatcccatatgttgtatggtactgatatccatgatctcgtgttcgattacaagattgggatggcttatagcctccggatatacaagtgaggttacagtcctacccctaacagtgtctagtaagttactacaatacccatgtaaagctagaaactctaaaggtgtggttgtacacttgaaggagtgtagttgaattggtccccgcagtatctttttggaaatacttctcgctaaacaacataacctttaggctttaccagccttggtcgaatggtattttcctcttatggtaagttagaataatccttttcagaccgaccggtctattagtatttatctgtcgcattatcaaaaagtatttgtcacgagtaaaaacctctctggcaaatgagtgagagtgttttggttgaattggaagtggtgtttacctcctgctgcaacatccggtaaaaatgcctacctgacatgcacatatatatggatgtaagtattatatctttcacgattcttgaggagttactgaggtgaatgattaggagttgtgaattcatttgacaaaattaaccaacaagcactcaaacatattcactggaatattactaacagcaccacttttttctttttttttgtttgtgtttgtttagatttatttttgctatcttgaactttttgtatgagttttcttctgtgtgagttctgtaataattggttgtaactctttgagtaaaggccaaaatgttatattctattatcttaaaaaaaaactaacagcactaccaacattattcaatgatctcaggcaattccccgttatgcggttccctcggctatacaacaataaaatttgtcaatttccaacacatttgggagaagataacatatgttaatgtccccctcaacgcataatggagctcagaatctccctcttttactttcaccaaagcatgttaacctcttgctagtagttaattagtagtccactaacatacacccacgcatatggtccatgcgtttcttctcctcctagctttctaaccacccctgtcgatcaatagggaggaagtctcaaacacgcgcatatatggatggatccgtcatctccttcaacaggataaccgaaccaataatgcgagcaaaagagagcctgcagtgctgcactttcttcgaatccgagtcactcgtctcgctgaaaacatcacgcacgagagctcgcgctagcccccacacgccgaagagggtcgtggaaaattttccccagcatccgttcgtggaatgtagtcactagccaccggcgaatgatacctccctcggatgaatcaaattaagctggtagtaggagtaacgaacacaccatatggcttgataccaagcctctgcatgagtgcagtctctgtggctggctgctctgctcggtcatgcatgacggcattttgactatactttgagcaggcagaaagttattagcaactgtatagttgattgatgattcgctgctttttatcccacttctgggatgacctgcagaattgccgaagcagtaggaaacggcacctgagctgaactgatttgtccttgtagtatctttctggatgactatttgcaggggtgtaggattgatgcatttttcacatttttgatctttttagaaaatttattcttcaaataggcctttaagaaaacttattatagaattaatattttacgacgccaatattattggcgccgtggtccaacatgacagcgccaataatattggcgccatccccctaaccccttggtggaaggtaagtcactaatatgaagagggatgatgttggcgcttaggaccaatttgtttttttaaatgaaatacccatagtacaaatatttacaaatagatcctcaacacaacaatattggtgtcgtccccttcacattagtgacttggctttcaccggagggcgaaggggacggcgccaacgtcattggcgctgttatgttggataactgtgtcaatgacgttggtgtcacggaactggtccatttctagaataagtttttctataaactatttatagaataagttattcaaaaggactaaggtgaaaaatccagtgtgtgggattgtgggaagcatggaccgaacgatctagaagtttattttttaaaaaaattcaggacgtgaattcggtcggtcagtctatttccagaagtcccattatattaattctgcttctgtgcggttattaaaaaagcgtgcaccagaagtctaaagcccgtaaagtgaattttgttacaccaaaactcattacgaattcttgttctgatgctaacatctaagctttggagccttgactaatgctagtatcaggctttcagcactacagtggtcaacgtatgcacaaataaggctggaaccgacattactaaaacaccatttttcacaggcacctctttttttttttggcgaaaaagaaaactatatgtgaaaatgtataggctcttcaggctcgtatgtaaaaacaaaactaaacaggtaggtctattaagagctcgtcctgtgaaaatcaagattctcgtagctagggccttatgctattttacaagcagatctctaaagaccgcgtggagtgttgtcatctcccaatcatatctgctcatcaccactctagtacatgtggctacggaaaaggcagattcatccacgacatccaagagagaggcggatctgccgccagtagcctcgggatcggtcggtttggggcttcattgaccatcgggtgcggtgatgatttttcgtgcattttctagaacttttttgttggggagctatcatttttggaattcttgtgaactttttttagcttttttcccccaaaaaacttttgtagtcggatgtcctaacgctctcacctaaaaaattaatttttatgtgtcattgtggtgcatgtgaaaatttcgattttacatacatccagttacaagcgggcaccccacctccctatgaacgcttttgaccgaatgagaaaacgtttatcgtagtgagatgagagaaattgtgactgtcaatcttttcggaaagaaaaataaatgggggatcatcagaccatgcataaacaatttgatatatgatcagacgtacatacaaaatggcaacggatcaaacaggctgatataacacgctgctgctgctcgaggtggtatagaacggcaacttgtggctggattaggtcagtcagacaagaaaacacagctgttacccacatttttatgattcgagaaaagctcggatgttcttaaaataattacagtgagaccagtctctatttaatactctactcaaattgtgacacgtaagcctaacggctaactaaaaaagcttaattttaggataggttaacgctttgaacagagtctaaacttaaacatagaatagagtgctatcataggattattttcaaccataagagatgtatggtgaaccaacctcctatatatatttcatttaaaaaaaactcctatatacacgatgatgacgaaggccaaagctccgaacgcagaatcaaatgcaaaaatgaaaaccacatcctgtaggctgtagtagccaataggaaacacaaggacgatgatcaatcaatccaaggctaagggcagttcaaattgatgttattttcatctatactatttttttaaagtaaagttataaaaaaatgttaacatttagtttattgtcaaactttgataaatacataaaaaatcttatcaaaattttaataatatttttaacttgctaaatgtttattttggctataatctgaatagccccaaatcttcgtttcgattaagtattcaaatgatgaacggaaggatctcgccacaattatgagaaaggccgaaatctacggagggatggataacacagcctgaaagcaacatgggccctcctcacttgtgtgggcctaattgaagggaatcttctactcattgcattttgtcggcctaaaatggccttctgttgaatctgccaaaccttctattttctcttctttttttcacggtggataatctgatggagaaaacatgaagaaacagctagtcatttcagcctcacttgctcctttgcagcgcaattctggccggcaattgacattgatccagacatcaacgatgtcagaaacttggagagcatagcacggccagggccagcgagcctacctacggcgcaccactgctcgttcttcctcctgtgcttctagggctttggaaccacatgcacgcggggtggttttcttttctttctttttttttttagcgaacgccggggtggtttcccgaaatgagcatccatgtgtacaacgcctacttcgacttggctgtgtttagttgctgaaattggggagaaatttagtgaaagttagtagtttggaaaaaattagaagtttatgtgagtaggaaaattttgaatgtgatgtgatgtgatggaaagttggaagtttggtgtgaactaaatagagccattgcttgggagatgcaaatccctcataaagatatgttgtcacggcttggaaacaagacttctcccatcccctcaactagatcacactgtaaatgtaaaacgctgaaaacactttgtattctttatcaaagaaaaattcagatgaggaaactctcccctctagtgatttaaaagaaaaaagggcttgtttagttcacgaaaatgtcacatcgaatgtttgacaggatgtcggaagggcttccgaacacgaatgaaaaaaaactaatttcataacttgtctagaaaccacgagacgaatcttttgagcctaattaatcagtcattagcacatgtggattactgtagcacttatggctaatcatagactaattaggctcaaaagattcgtctcacgattttctccctaattgtgcaattagtttttggctgccttagtttttttatctatatttaatgctccatgcatgtgtccaaagattcgatgtgatgtttttgagaaaaaaaatttgggaactgaaccagacctaaaattaaaatgaagagaactccaacattctaatgggcccttaaaggctagacagcgaccatttgagcccaaacatggaatcatctgaggcgttaactctactcgatagcggatcattctaaggaccgatcgaggcgtcgtcacctgtcctcatcaccgtcaatttgtcggctgccctctgccgtgccgccctctcgcagaggcagagagaccaccggttgatgtcacgccgtacaccaccatcccggtgcccgatccccctcgcgccacgcaattcagaacagccacatcattatgcttctctcgattggctaacggcgaatcaaagacgtacataccccctattgatgatacacaaataattggccatgacctgtgcatcacaatatttcgcgttctaccagtagtttcctgtagagcaatcatcagcgcgtgaaatattcatggaagagcttatcaagtacggctggatgattgatgttcgagtcaaacacgccggattatagaacgaccaaatgtcctagttatcaccttgagtgttcgccatagccattagctcgtctacacgtcccccgccctgccggacacgtcgatggcccaaccccaaacggggacttggggttgggggaaggccccccccccccccccctccccgaggacagtctcgaccggtcccatccgtgcctatccgcctcggtgatggtcagcacgcgtgcattattactaagcttatcgcatcgcgttacacggcaggcacgggcgagatgcaagcagcgcaggacgtgggcggtggagtcccggggatacgtgtagcgtcgtggcggagactctgattccgccaaatccggccgagatttggatgaacaatggcagtatatatacacggcgacgtgtacgacagccgtaggccattcccaaccctatatatagttctataaattctacatcatactagacactacttttttcaatacaaacatcactatacatatttaaatttaatgttagttcaaacatcactatacatacttaaatttaatgttagttatctcacgtaatatcttggatgcagtggcggaggaaaaaaaaagagatatgtctcatggacacatactaatcgcactatactgtacgtcacaacattgtatcaatattcagcaaggcaataatcaattgaatcagggagaggatagatatgcatagaatctgaaaaaagaagagcaaggattgattagggacgattgaatcgggagaaggccacttgcttcagcttaccttgctgctgctgcttgccttccgcctcccacatcgctcctgctgcctgctggctcgccgcctgccacgcgcgtgtccctgccgcgtagccgcgccgctgcacaccagctctcgtgcccagtcgccgcttgttgatctcatgcggggagctggatgcggatgcctcccgcagttccaagcggccgcgccgtcgtcgcctcatcgtccgccgcggcggcggagatatggggaatttctgggctagggttaagtctagtgaatcacccacatatgcccacattaacacaaaacgagcccaatgggcctacgattcagtggagagtggcccagcagcgagtgctctgtctttgcccatcgcctgacgccgcacttcgcctctgcgcctgactgccgtcagcggcctgccggagttggaggttgggggtgttggtacgagcgggcggcgcgaggtatggcctcgccataccgagtcctccgtcactgcttggatgttgtgtaaaaactatgtcttatataagacatgtttttttctcttttctcatttatttacttgtcacattattttttatactagatggcagtctatttaatattccctccgttttgaaatgtttgacgccgttgactttttagcacatgtttgaccgttcgtcttattcaaaaaatttaagtaattattaattattttcctatcatttgatttattgttaaatatatttttatgtaggcatataattttacatatttcacaaaagtttttgaataagacgaacggtcaaacatgttctaaaaagttaacagtgacaaacatttcaaaacaaagggagtattatagacaacatattagttattgggttggaaatggccttacaataaagcgaatcctcatccctgttccgtaggagtaggccggatgcgcaacaggctgttgccaatgggagcaggataaggccgagattaacctcatccgcggcccactaggcgacgtccacgtcacccgaatcctctggaaaccgcgtccccctctcccccgccgtttaaataccctcctccttaagcttcctcttccgaagccactcgccactgcaaagcgctctctctctctctctctctctcgcatcgcgcgcagccttcctcatccccgtcctgatccactccacctccctaatccacagcgcgcgccagaggaaatccggcgccggtcgaggcggccgcgccgcgccgccgtcacgcccagcccactcgattcggtcgcgtgtgcgctaggaagttcgtcatacgcctcgcggttttcacttcgtgtgtttttcttttaaatttttacctgtgcttcgtttaaagcctctcttgatcttaggtatagctttgctcgatctgattataggtatgttgtatgtttctggtctcccgtgattgcgcgtggattgtgattatgactaatttgcttgatctgaatatctgattgtggtggtggtgtgtgtgtgtgtgtgtctgatttgtctgatctgttgtggattattattgtatgatttaccgtggttttatgttgtttatatataagcgtttgccatgagtctgattaattgtattgttgcggtttttcctaggtgtcatactgtcatgctcgatttttacaaggtttagtgcaaactgatagatgatgtccatccccaaaactccgtctaccagtattggttcatgtgcgagcacacgggatagttcgagttcctgtttgatattgattcgctggcgctggttgtttggttggtttattagctagagttgtttgtgtgcaaaggtgggatcatggttgcaaaggcatattgatgaatgacgattcataagcgtggaaagcaatctctgtgcaaggggttattaggattctttgtgcgtattcactctaaaccgatagtcttgtattgctatcagcaccacgttatctatttcctaaccaatgttttctgcatatggactctgcattttgcttcctctccttgtaccacacccagtaccctatgtttgtgcctctcccatggtccatctctcctgttaaaaaaataaaaataaaaataatagaatagaaaaattctagaccaaatacagggaagaaaataaattttgtcaggcaagagagcgacgaggcgatggggaacttattacttttctggacaaatccttcaatttgcctcatctatatcaatggaattgggaaagcagtggactacttaccatgtattggctactaatttccaccactccttgccagagaattgggaaagtgaattctcttatgcaggttctgtcagagtattgtaccagtcattgagatgactgtattcagtagagaagttttgtagataggttaaatttcaggtacaaaccaatgaagtaaaaaagtcttagtatgatggatgtgagaggctcaagaagttccctgattggagaagcaaaggaataagttttttatatggatgtgctatggattttaattaaaagaatggagaagtttcttttgttgaagatgaagctgttggcagctggaggtaggctcccttatgatctaacgtcctaagtaacgacgtatctgattggtgtaagctaataaccaaagccttatcatgaaaccgtcacgcttgtttttttcttttttctttttcttcttgtttcctggcatttgatgctgttacgtgttcctcttgccagagaatgggggtggacaccacagtaagtttgatgcagatggacactgttcgaattgcttgggaactcttccatggaatctggatggataccttattgagtagtaaatttcttaatacagctcgctatccagatagtgctagctgtgattgtttggtgatcaatctattgggattgtgccgactggagctgttcgacattgctttggtcttttgttgatttgcctggagttcggcagtatacagcaaccctggagtgcatgcagtggtttcctcattttttaggacctgactgcattctgtagtgagaactatcctgctaaatgcataatacttgcaggtgttttctgttgtattggcaacgtgatagtttttgtggtgcaaaacattcaagatgggcgccatggacgtacaacttgagtctactgctgttcaacatggacaagctaagataaatgtggaggaacatgctctagtttctctgttgtctgatgagaagtacgcaactgaaaagaccgaagatgtggaccctgatgattatgagaaacttgaggaagggataatgcagtatgggtatgttttttttttttgttctctggttaggcgttcttgataagctccttaagtgccaacaagtttgtgcttaatgtactatgtcaggtgtgcacattatcgaagaaggtgccgcattcgagctccatgttgcaacgagatttttgattgtcggcattgccacaatgaaacaaaggtatggttttcgagttgatgtggaagtgcaatagttaaaaagtatgtactcttttatccatactttcctaggtggttttgatgtaggaatagtcagttactcacaaaggctttgattaactgctgttcatattaatgcatatgtttgaagagcactagtgagtataaaacgtttcctttaaaaaaatcaaatagtgagcataaaatggtttaaaaaaacctaacaatgttctgatcattaactcattttatagctggatatgatttagaaatcagataaatggtatggttgtgacataaaatgaagacacagaatagaactactaaactgctgccagccgtccattatgactttggattatcatccatctgtaacagttgaaatctgttgtattttccattcttacattgaaacagtaatttgatgtatttgcttatgggctgttacatgtacacgacttatttgtattgtaccagcaatttgttggcaactataatatatccttttgttcttttcctggtgaaatatctgaatcgtcactgttttggtttatactgcatacttggaccttccttgggcagttcccaagctgaactatacaagtatctattctttatcatggtattaactgttggtttaaaaatgtggaaagttgttgacatccaaactgttttgacagaattcaattaaaattgatgctgtgaagaggcatgaactcccacgccatgaagtgcagcaggttatatgctcgttgtgtggcacggaacaagaggtacagctgagctatccttgttgcttgcattgtaacattattaattatctggcatctagtgtaatcacgataactcttttatgttaccaggtacggcaagtatgtatcagttgtggtgtatgcatggggaagtacttctgtgaagtgtgcaagctctttgatgatgatgttagtaagaagaataactattttgattgccttgtctatttgtaataagtagataggaaagcataatgacacttctttctacaatgtcaggtttcaaaacagcaatatcattgcaatggttgtggaatatgcaggtttgcatctcttttttgttgtgcaatcaatatgaactggaaaatatacttacattcgactatgtttgcagaattggtggcaaggagaatttctttcactgctcaaaatgcggtaatgcctcttgtctccaacgttgcattccgaagtactataatttaacatagcgccatttaaggaataaggattcttttagtccctgaactcttaattgatgggaaaaggatactgattgatataatgagagatcttgtttatgctacttttcccgatagagatatatgcatcatgcatgggttgtatggacttctgctatgataagattgcagttttttttcccaaaattttctctgttatacactgtatattactagatgaatatcctctacctttctggaagtctactaagatcttgcatcgttaacgttgactatttaaccctgttagctgaactagttcaaaccctcacttgaattttatgacttgatttctattatttatatgcatatgaatgaattttgctagtcacttctcttgatttgtgttcacctttgttatctgtttcatgcaggatgctgttattctatagtattgaagaacagtcatgcatgtgttgaaggagcgatgcatcatgactgtccaatctgctttgaggtaggcattcactgttcttttatgaatggttatatgcagcatactg

SEQ ID NO: 56949 - DNA, 1908 bp, Oryza sativa
aattgtatttgcctcatgtcagaaatctgagtcttagctgcctgaatttcatccaaatgttgagtttgttgacacttgctaatttggttcctttgcattaccctgaaggtgcgcatattgtgcaacgattgtggggcaacatcagaggtgcagttccatttgattgcgcacaagtgccagaagtgcaagtcctacaacacccgccagatctgaagtggcgaagttttgatgtgattcattttgtatgggaagagagccctgggggatgctcattttgcaacacaaatcccgctaacgcctctgggaatctgatgagctctcggtcgttttcttgctcattggatgcctcagccgaggcaaatcactcgcatctgaaattcatctatgaagtggatgctgttccctcctgtgttcaatttattacctcaccatgtcgcagactcagagtcctgttcagcttaagtttctactagcactagccgagataataagtgcacgtctactcaagcttctgggcataaatggtggctagcttgtgtgttatggtgtgtacttgttgagtctcgggcaaacactgtaacggttagtggcatagtattacttcttgctcgtgtgcgtgtgtagtaggatggcggattgcaggacgtgggtgttatttactggtaggaactgtggtacttgcagtagccaccatttctcatgttcaatgccggtcccatatgccggtcttgttcagttcctataccttgctcggttgagaaaaatggcaaatctacctcagttcattttgttctgattatttaacagagggccaagtattgaattctttgggtttgcctctttgatggtgctagtatctgggctctagtagggataatggctttttctatcttttgacttgtagcatgtagcatataagcaactttgaaagttttaaattttaaatttgatagaattctaatctatatttttttatatggtcctttgaaataaatgattaaaaactattgaatctatgaaaattataaggatgtctcaattcatacaagttgtagaggatttttgtttaatcttatgagaagttccatatgtgtctatctcttatctaattcatacgtttttcttgcggtataatcaaatcttatatttttatcttttgacgattatctgttttgcccttgaacttttgtgagtccttttttctcttatttatttgttttcttaaatcttgcgtttcgaagaagtactcagaactgatttagatgttacttgctgtgtgaaagcgcttcctgtcgtcctcgcgcgggcaactggggacgaaccctagcccccgccgacaccacccttccctcctctcccccgccttcccgcggccgaagcgtgtcgtcggatctaggctacggcagtgcgggcgtggcgtcatcgacggcgagacgaagtgtgtgctggtgcggcatgacaaggtcggccgcgcgtggtggtggtggccggcgcggtggcctgcgcagcgggaggtgaggccagtcgaggcagagcccaatgaggtgacatcacgtggagattagccggcggggcgcattgtgcaatggtgcccgtgcgccggctgaggtttagatggcggtggagcaatggtgcattagtgttagatcggcaggcgatggacggcaggtgaaaacctaatacggccttgggcggaccagcaacgatgacgttcaagggtcattcccctcttgagggcgttgtcgtgccgtctcaccccttaagtgtggctgtcaagcgaaagcccagtctcggttctctttgcaacgttgacgaatgacatcggtggcgttccgtcgagcaattggtgcaagctcgctctagattcatatgctcttgtgtcggtgtcttagcttctggaagttgacc

SEQ ID NO: 56950 - DNA, 41589 bp, Oryza sativa
  unsure (1)..(41589): unsure at all n locations
tctgtgctagccttttcctgagtctgtgtgttgacgttgttagtgtgtgggtagtggtatattacgatcttttagagttgtaatcttataattttcttatgctctatcaataaaaccgcgctaaaaaaattggatgttacttcatcgaagtggttcggcttacccggatgttaattgccgtagccattgcccattggataccttctaggcctttcgagtacggcgcaaggccactactgattgagccaagcaggcaggttttttgcgttgtgtcctcgcgtcgatgtaaacaagccactggagctcaacaggggagcagagccaacaggcactacagcacaatggtcttgtttggatccttcgggctattaaatagccatctggaatcttactatttaaaagtattaaacgtagattaccgacaaaatcgattccataacccctaggctattttgcgagacgaatttaataatgtatactaatccatgattagcaattgattactgtagcatcactgtagcaaattatagattaatatacctcgttagattcgtctcgcaaaatagattagaggttatagaatgagttttgtcagtaatctacgtttagtactcctaaatagtaggattctaaatagccttccgtactcctaaatagtaggattctagatagccttccggatccaaacataccgatgaatgggatgccgataattgcactgcgactgtagttagtgcctctgacgcctcaccaggaggccggccctgagcttttgccaccttttccctttgggagagtctgatccctgcttatgatgcacagaacacctccaagctctccttttcactgctcgaagggcacagtgacccatcatcaaacatcggcatgatgggcaagcgcaccgacggaagattcagaaagtaaaatgacgaaccaaccagaaaagaaagaaaaatgctgagaaacaaggagaagatgcagtgagaattcagcagggagaactgtttgctgtgaaattatggggggtttgctcgtcttacaggcaaaatggggaatccccacacaatccatgaaaatcatttagccgttgcacttctgtttgcacaaaccggctaaattaaaaacttctccattcagaaaaactagaacgggaagcatgttttccttcctttccctaccaaaacctgaatctccatccaaaagaggtagtagtcgctttcctgcaccaccactcaccagcactactactactacttctagtcatctactgccgattttcaccaagccaagagggcagaagaaccggcagaatccagcatcatgagctcctccacctcctcgatctcctcatcgatgtagtccctcctgcactcgttgctgcagaatgccttctctcccctgcattgcaacaagccagcacaaaggtttagcaactgagagtgagatataaacatgcaagtatctcatggaaatgcaggctacagacgagttcaggaatactcacagatacatgtagatatccctgtcctgctgcagcctcttcctgcagtagcagcatgagcgggaaacagcacacgccagcgtcgacggcagctcgccgatgggctcgatggtgaagattgacttcttggaactccttgggacacccttgcacacctccagtgtctcgtctcccagaatgtgcgtcgtcctcgggttcgggccgtgctcgatcacacaggtgtactcttcagacagagcaaagtctgcaatctcgtccagagtgacgctacctgaaccgttcttctgcattgcagcatcactcgccgccttcggcaacccgagctcaagaaatggcctgatggaatcaagaaacgagctcgtgacacccaagcacgaggagctctcgtcggcggtgagggcgtcgacgaggccgaggccgactctgggagggttagttctgaacttctgatcagcctcgacacccagtagcccagaggatttgagatttgtgcttccagtgctcgatgacaggttcttgaaatccaatggagaggttgggctccaggcagaatcagggtccactgcgttcaatcctttgctgctcagcctcacaaagaggccggggaccctgaagaacccagtgggggcagtgctcttctgtgcaaggccctgatcattggattcctccatggcttgctctttgatgagcggtggctgtcgtcttgttcacaagcaccaaagatgagagtaacctgtccctgaaaatagccaaaatttttgttctgttgcatatcaggtcggtcaatgatgatggaagcgaacaaaagtgaaaagaaattccagcttttgtgcttttttataactcatcaagtcaaaggtgcaaagaagagaaaagatgatgatgatctatgactatgagcatcataagtacataaacaatagtaaaaaaaagttagtacttgaaaaaaaggtggtttggtttactgatggcatctgtgcggcaggtccaaaaagcaagaaaaaaaatcactggttacaacaacgggcatctatctcatcttctcatctcattaatcaagattgcaaactaaaaacaagatcgtgtataacactcacttgatcaacatgatcgtgaccagaaaaactagaacaagcaaacaagcattcaaaacaagaaatcaacacgaacttctccccaccatcccctccctattccataacagcccagatcaatctcaatcgctttaaagaggacttcatatatggagagatgcggcggcaatacaacgctgtgcattacggcgaccatgaaagggaatttacatcaccaccgccagcgccaccgacccaagaatcccaaccgatacaaagacaaccgcatgcagtcccaaatcaccacctgatgaacccatctaatctcacgccggaaacgaagacgaacccaaccggaagaccaacaaactagtacatacatcccatcgatcccagtgcgccaacatccatgaacaggcaacgcaacagtccaagaaacgagcactagaagcttcaagaaaccaaaccgaggctgtggtggtggagtgctttgttacctggcgaccgggggtcacggcgaggctggttctcggcgtcgaggcggtggtggtggctcctctcctctctcgcgagacggggttaagaagggcgaggagagagaggcaggggggaggaggaggaggcggcttgcacagcaatctgcttcttgctccgctccagagtcctgaccctccgctggctgggttgctgctctgctttccgtgaggtttcttgtgtgcgtgggtgtgtttattgggaagaagacaagtgtccccgcgcggggcggcatgcagcgcaaaggcaacgggcggggggtgcggtggcttctccagggctcaacaccccacccctcctccgctttaccactaccatctctctgtgtctgtctctgactctcctagtttttttttaatatattttttcgtctttgaattttcttttcccttgcttttctttttgtttcttggaagacactctctaaattaaaaaaaaaaagacagtctctctctactctttggtagtgtgactgtgtgagacatttttgttcctttttttttccttcttctttgggtctacacttgtgctactctattgtttggttggagggatttaagtgggacttatgtttttgtgtttagcctctctctcccaaacacctacttatgtggtgtttggttggaggactaaagtagggctaaactttagtccctctcacaaaaacataagcccctattatagggacttatacttttgtgagagggactaaatttagtccctagttctcaaacacccccttactaacccggtttgtcagttgtcacttgggttgtttcatgagaagatatagtaaaacaaaacaatacagaacaaataattttgtacttatgcgttgcttttcaagctctcttgcgtgtcatgagtcatgaacgtaagtatcacgtcatacaaaaatgaccaaaaaaaaaagttcccgcacttcttgcagtgtttgttccatgagccatgactcgctaattgcagtgatttacctgtgacagatactgctttgcttaaaataactactcctactccagtataatactcatacaatgtgcttgacggagtaccaaacattgtactactctttatctgaaaagcaattgtgcttgcacgtgtggacgacgggaggtggcaaacgggcagcgttacaatttcttttttccgtcctattttgaccgccacggtgaaaacgttgaaaccaatacgtattttttgtcgccttgtgtggcgagggacagctaggcccgacgcgtgtacgacgttggcgtgtatctcgaggagcatcgtacgtctgtggagtagggacccgttgctttccctttttttttttacttttcccatcttttaccgctaataaaagcgattggcacatgctaattacgctggtctgtgtctgacgcgagacagaattcgtacccccagtaccccacacaagttaaaactcgtagaacatggcatcttctcgtcctcttgtgaactctacggtataattaaggaattaaatttgaaaatatattgttcatttatttttaaaaaaaaatattcgggatacaaaatcttttacataaatataccatcagtctcgcacaatcattacacgaaaatggtgtggaaatgacatcacgatcggtatcgtgcagtgaaagtgcgagaccgcacagtcggtgcgagaccgcacggtctcgctcaagcaaccagcgataacgctccagcaaacaacgctatcgcccaagcaaagagcgatagcgtgccttgccgatttaattagcagttaattatcctgattatcactaattattattagttaattgttaattaagtaattaatcactaatcaaatgaatcctattgacaatgtcgctaattgtttctgcgagaccgaacggtctcgctctcgtcgagcgataccgcccgagacgtcatccccgcgtcattttcactcaacgaaagtgcgataagtttttgcatcccgaatatttctgagaaaaaaattaaatgaacagtaaattttcaaatttaattctataattaagcatgcgtgacatgcatgcttaacggttgaaacatgctgtgtcatctgttcttcgtggcatttgcacgttgccttttgttctttcaattgatcaatttacggaaaatacaagtcgtcatttgatttcgttggcgatagtatttcaagcaggcaactaaggcaagagacttgtctatcctgaccgtaagggcaacaacaatatatatggtaaaagtagtctataaagataggacccacatatataaacttaaactattgtaaccttcacagtatatatggatagcaaatagtattagtaggagagaagagatagagacaaatgatatattttattctctatgggcagctcatatgcttatgggtagcttttgttatttctttcctatggactagttccacaatgttggtaggtggctgaatcaaatattatacttgtattgcttatggaccacttttagagtacattgtggatgcccctatgacatgggtggaattcacctgtgtttgcacaaaattgtgttaggttgaaatgcttctaacaaaagccactctgaaggtgcattcttaggtctgttttagaacagatgattagtcacatgtaaaatgaaaatgaaagtataattagtatatgattaattgagtattagctatttcatatgtaaaaaaattataagactgtgttctttcctgggtgatctaggtgattgtgagtgagttttatttcgttttccacgcgcacgcttcccgaactactgaacggtgcgttttttgtaaaaaaattataggaaagttgttttaaaaaatcatattactccattttttaagtttaaaatacttaattgtcaattaatcatgtgctaatggctcacctcgttttacgtatcttaccaatctcctctatctcctctcctcaaacacagcctaagaagttttagttgaatgagatttctatatagtttgcatatgaaacacgccatttaaccgtttaaaaaatacgctaaaaatcgagctagtaaccaagcccatacatagtttagaggcgccctaaagccctaaccaggttaataatttttctttcgttttgagcttacaaccgggcaaatgcagtagtacgcacgtactgtcctatggtttcttgagattcagactagatgccaagtagcatggtgattagcgtccgtgcattaggtcatggggggcaggtgtcgattcccaacctgtcgttatcgcgtcggtaaccgtgtatcagcggcagtaaaatcgcctttaccttcgtgctaaaccctctcgtgcggtacgatgattaaggcaaggccggtttagattaacccgatccatgtcggcagccacgaaaaattccctctcgctcggagccctcgccctgtaccctctctccccaccctccactttaattactcgttttttacagtggcctttttaacttttccttggattgattacattttacacaggctgcagcagtgactgcattggcgctgtcactgcgtctctctgtgtgtgtgcgcgcgcgcgcagtatattttatttagcctgatgacatatctatctctctgcatctacctgcagcaacgcgttgtttgtgatgcaaagttttcaagcccacagttgtctgcacgtaaatggcatcgatgcaacgttgcagttgcaaagttttcaagttttggtttcactttcagatgctgccatgagcggattggctggccggcctttctctgtgttctcagcgaggaggttgaagactgatctgatctgtgtcctcgtgttttgtttgcacttagcacgatggcgttgtaggggtactcctacgtcgaagtgattgggcagcgctgatcgagaagtcttggtggtttgactagtagcgtcttgggctcgcacacaacgcgatgctgctctctggttgctggaggaggacatggctgtgtggtgtgtagtgcagccatggcaaaaaacaacaactttaatcaaagcaataacagaagtgcagtactttctctgtttcacaatataagtcattataacatttttcacatttatattgatatctatctagattcatcaacatcaatataaatatgaaaaatactaaaatgacttacattgtgaaacggagggagtagtaggagtataggtataaaaacagctttgcagattgccgaaacaaattgccaagctgctgcaggaatgattggaaccgcataaatataaatagttcagctcgatctgcaagtgtgcaagaaaactgcccttggtttacgggtgatgtctacaagtaactgaagaaacaagtggacgatatgtactcctaccattacatggcttaacttgtgagtgcttccaaaaatccaaagctagatagctacacgcttgcttttgcatatcaagaagctgtgctgatgcatgcttggtcgcttggagcaggggaaaacacgccacatcgtcatcgcatggaaaagttcagtaattcagtggctgaagaatcacaggtggctctctttgtcatgcggtttcaggtcgtttttctgaggatcattttggctacgaagaaccaggttcgtagcccatcagtagtactgaagtaccaataatctaccattacagtaactattaatacttcccgaaagacgaattaacataactttaggtataagcaacgggtcaaagacgaattaacatcacttatgaatttctgatgctctgaattaacatcattgcctcccggtgaaaccgcttattttcgtcttaaagtgaaaagcgaagagtaatatggtaggaggggttaagcactaatgcaactactgcacttgcatgccttggtctccaagaagaagcatctgaaactcgcatatgcagatatgctagctgctctgccttggtctccaagaagaagcatatgcaacttaatgccagcacactactgcatgatttattttcctgaacacctttccattttgttttcatgtggtccgtaagtggaaccgcacgaaaaaataggggaccggtaccgggatatcacctgcacgggaaaacacattatcccgtgcgggcggcttaagccaaccgcacgcgaaaatcagctcgcgcattttataaccgtgcacgcactcagtccgcccctacctccctccccactcctctcctcccacctccctcttctcctctcctcccactcctgccgggctgtcgctcggccggcggcgcacggtgccttcctccctctccctcgaccgcggcgacaccgcgcaggcggcggtggtggcggcggcgggcgaccacaacaccccctcccctccctacccttccagatccggcggaggggaggcatgggggcggtggatccggcggcgcgccccccctccccttgcagatcggagcggcggcggcggttgggaggtgtctttagcggccggcgtggaggtggagccgtcggcaggaggtgcgatggcgtcggtggctgccggcaggaggtgcgatggcgtcagtggccgccggcaggaggggtcaacggcggcgggcctcggctaggcagcgacggcggtagattagggttagttttttttctttttttttgattttttgtttctccgtgcgagcgacttaagcccctgcacgcgaaaatcggttttcgcgtgtgggtgcgccacccgcacgtgaaaatcgtgattttcccagatgactgggtgcgtgtgggcccgcacgcacgtgaaaatcgtgattttctcagatgactgggtgcgtgcgggctgtccacctgcacgcaaaaattggctcgcccgcacggaacaatcggtgctgtagtagtggcaccagggccagctcactcacacgtctacaggtcgcttgctttctctgtggtctgtgccactgcggcgcagcctgcgcttacatacgttgcaactcacgacagattcattttccatttgaacaagacagactctcgtcaagcggacggcccatgggttctcgtgacgagggaggcccagatgaagttagaagagcccaatcaagcccatttggagtacaaaagaaaagctagtagtagaaaagtctagtatacagtagcactactagtacaacagcatgtagaggcccggagataagtaggcgtatgtgctactctaaactaagactagtttaccacggtcagcctcctcagtcctcacgtcacgcctggcccaccttcacgtgcacttagaatatatttaaatcatgaaaaataatggttcacttataatttatcctgttgtatagacgatgtgtgcacaccgacggatctaccgctgtgactctctgtgtccatacatccaaatgcacgccgaacaactcggccctggtcattgcgcgatgtgcaacatgtagtgcaacgtaactgcaagatagaggatgttttctagttcatatatagcgcacgctctctctgtgtgtgtgtgtgtgattgagaacgtacgaatgttttagttcatgtacatttctctttcggtgatcgagaacgtacgtctttgtatagttgcccattttcatatgcatatatggtgcgcacgctggcacgtgtgtaggactcttccatcaatcaatggttagttgaacaacagtatataggactacactctacggaactttagtgttgtcatgagtcatgcatgactgatgactccgacccgttcttttctccagcaagagttgaatgaagattaagattttcatggcatgttttttaaactgctaaacggtgtgtttcatgcgtaaactttctatatgaaagttgctctaaaatattatattaatctatttttcaagtttataataattaaaactcaatcaatcagacgttaataccaccttgttttgcgtaaaaaaaaacttaatcttcattttcatgagaaaagaacaccactaaaatgcataatcaatcatcgagatgtatggtgcgtttcatgcgtaaactttctatacgaaagttgctctaaaatatcatattaatctatttttcaagtttataataattaaaactcaatcaatcagacgttaataccaccttattttgtataaaaaaaacttaatctttattttcatgagaaaagaacaccactaaaatgcataatcaatcatcgagatgtacgcaggaattggccaccgaaatgtacttgtatatgcataaccacgagtactccttttatactagtataaagtactccttccattcttaaatataagggatttttattggatatgacacatcatattacaatgaatttggacataaagcttatacatattcgttgtactaggatatgtcacatccaaccaaaatgtcttatatttaggaacggagggaatatgtccgttttgaaagtaccgttagaggtgaaaatggttttgaaaattcctgatcgacctacgttcgttttcttttttacttttactgctcgaccatgtgaaaatagttaaccctgaaaactaagatgaaaatggtaaaaataatatgaaaataaaaacataaattatttcacgttatactggctgtttttgaatcttaccatattcttaagaaaattaacgtatttctaaatgcatctataactatcctctatttctttatttgacctatagtgtagatacccatcaactcctcaatcaaatctttaacaaaagtgcatggttaaaaggaatcaaatccttaactaaagtgcatgattacgaagaagaccgtttgtttgtaatttatgtagtgtaaccttgaattagtctcatcatattatatagttatataaagttgtgcggttttataattagaattttgccttatttattactccatccattctaaaatataagtatttttagaatagtgctaagtcaaactttttaaattttgactactaatagaaaacaattaaaacaattaatcatgtaaatttaatgttactatatttatctttaaacgaattatcataatatctaactctttatatttaaaatattttacttttatagatactgctggttaaagtagtatctcgaagaccgtatcgagctctaaaaatacttatattttgagccagtatgagtttatattaacgtattttgttcattatatagttttgttttcagtttttcaatattttttatattgaaagaagaaaaaaaaagataccgtacagtgcccccacctcatcctcactgcccacctgaccggctgacccccgccgaggcaatgggggtgacctgcccgcaaactcgacggccgatccatctcgccgagccacccctatccccggaaccaaaccctagctccccgctcatggacgacggcgcggcgcccgccgccgccgccgccgccgaattaccctcgccgtcgccctcctcctccggcacctccccctccccgcgctccaagcgccgccgcaccgaccgctacgcgcaaggcttcgagttcgccccgcgccccgcccccgcgaccgcgaccgcgaccgctccggcgccgacgcccgcgcgcggcacgcccgagtggtcggagggctccaccttcgcgctcctcgacgcctggggcgaccgcttcgtgcgcgccggccgccgcagcctccgcgcggacgagtggctggaggtctcccgcctcgccgccgccgcggcctcccgcccccccgggtactactcggagcagcagtgccgcaaccgcatcgacaccctcaggaagaagtacaggaaggagaaggagaggatgcgcctcgccgcccgccgcnccgaccgcnccgaccgcccctcgccttccaagtggatctacttcgacaagatgcagtctctcatgtgcccaccgccgctcccgttgcagccacccgtagtgacgcgccgccgagacacgcagccggtgccgcgccaatcttggggtctggacgccgcggagtacgtgctgggcgggtgtgagaacgcgggaacaagggattctgggtctggtgcggaattgggtgaagagcagccaaacgaggctggtgcagggaaaggggaagactttgagttgctcgtggagtcgattcggaagcttggggatgtctatgagagggtggagagtagcaagaggcagcacatggctgaggttgagtggttgcggagggatctccaaagggatcttgaggtgaggaggagggagattttggagaaggcgcaagcagagattgcgcgtctcactgaggaagatggggaggagggtgacctcaaggagggtgagggtgatgataacaagaggtttggggatgatggtggtggcgaagagtagagcaatgtcgccgtgaatgcttattcttagcctagggtctgtaagttcgggaaatcaggttggtttactcatacaggattatcactcatcttgaatacccatccaagatagtttgtgatcttgaatttagtgacaggcctgtttcattctagcatcacacttagatttgttgtgtttgatattttgcatgctttatgtggttatgttgaactagcatccaagctcttatagttgtatatgtcattagaatatcatgttaagaggaaaacttttctggtacagaatatctcttcaagaaggatgttcacttagtaaaatacactgctttgaaatttttgtggtagaaaatagggcaaataccctttgcaactaaaccataagcttcgtactggtattgttatggaaaagattgaggcaatgttttagcagtgaatttgaaatgttgctgaggctgagcaacgttttgcacagtagcaatttgactctgttacccaatcattaaacgggaagttgtgcaggcacataggatttatgtagtgtcagcactcttttggactgctctatttgatagctacttcagaaatgcagttgttaacatactctgtataccattcctggattaattttttgttgctcttgctgctcataaatccttatactgtaaactctgttggaaactatattaatttaagtttccagtcttccttggaagttgttgctttgtgagcgcattgcgggcacatatccatgaatgtatctttatcagtccctcttgacatcctgcttttatctaacattgttatgctgtcccttggttgcttttcaattgttattttttgaattctgatacctgcaagcatcgtacacatacttataaacctatgttttaatttcgtttgtggatgtggcttgacatgccagttgtgtccttgattttaatctccgggtcacaattgttctgctggcagtatgttaggaaaaacatcatgttaatattctttcagcaggtccttagggtgtttttgttgtatgcctcgacttgccttttcaattgtttgatactaccccttgaatttggtcttatttggatggttgctaaaatttgccatgccgatgtcctgttagagtttggtggcattccatacatctattgccatattggtggtaaaaagataactttgggaacatgatttgttggcttgttatctagtatctaagtttttcactggaatgcatgcttgcttaagcaagtcttgtaatataagcaccccatgtcttggacgttgagaataaactgtttaattttggtatttcagggctaaaacatggattttgtgttagtagttggatccacaaggattgctgtggtagtcgaacttacatctgtaactttagatattatatgattttcagatcccttgattttagattgatttgatcagcttacacgactacacccagtgcagattgtggtgtaggtctcctttgtatttcttgtaatcaaaatagtggttctcatttaattgttgtatctgtctctttgggattgatacaattagtccattactatgacaaatcagtatgtattgggttcattaagttttggacctataatcataggcaatttgtacttcttgcaaatgcacattgtacagctgcatttgtaaatctcgtgtcaacccagggttatgtttggcgcttcctgcggttgtaccattgacagggtatgttagtatttattgataggtatatctatctaggaatctcgccatattgctgacggtatcgtatacaaaagatggcaggagaaaaacaccaaacacatcactgaacgaactaaccaaatatccctatcaattacaggaacagaaacatcaaaaacattaattacaactaaaaatctcagcgttgcaactacgggctagattctctcttccatcaggcgtagaattctttcatcaggagcagtagaattgcttgccacagctagatgatactccggcccgtcggcggcggtacatcgcaataagccatgcccacaaggcgatcgccccggcattgaacacggcgatgacgcaggtgagggccatgacgacgcggttgtcgccggcggcaaccaacacgacgctttggacgacgccgagagcgaggccgacgccgacgaacccgacgctctggatggccctgtcgacgtgcgccggcgtgtgcggccgcaggtacaggctgacgtaggacctgacgcaggagaccgtggacaggtagacggcgaacgacaccagcagcggcagccgccacgggacgctgccgaagaaggaggaggcggcgccggcggcgccgtacgactccgcgaggtaggcgccgacgatgaagcacggcacgacgacggcgcacgcccacacctgggcacgggacacgcccgaccgcgcctccccgaccgtcaacggcgccgccgccgccatggtcgagacgatcaagctcacggaatgctcaacgtaatgtttgagttatgcagtttactacaagtctacgacgctcgccgcgtcctccaccgagtgtttttgtatttatggcaaataactgtaagtccgaatcggacaatgggtcctagattccaagttgccgaccgcgataagaatacgattacgaattgacgcgagttggcggcagccatggacggatacggcacgctctgtgctggggctacagcaagattctgggtttagacccatggaatcgggaaaaaggtcaattttagcatttaggtctctcaactataggttgagtctcattcagttattagtatcattttcaaagtacgcaacgtaggctactgcaagatcgagaagagtgcctagaatcaccatgtgaaaatacaattcttctgcaggagcacattagtacgctctcaagaaaaaaaaattgttgagagagtaagtgttctctaaataatgttctgccaaggcaatatggcttatcctaccaactaaagaacaggtgatcgccatctcttatcacttcaatgtcctctacctcggcacctcccacggtgagaatccctctcgctgccttcccaaacttcttttctgcaaaggggtatccattcacaacgatgataaatctgttgcttgatctgaacatctgacgatgttaatctttatgcagagcacaatttacatacctgaaagtttcatcagatcttgcatagaatctggcagtatgacgagcttcccagatgagccgttcagtgctgtgccagtcccatttaagaggtgttcatgaatagatacccgtttgggttctttgcatggcaacattttgtgagctgactctttggattcatctacatcaaacatggttgcacttcctaataccgtggagtagccattgcgaagatgatccctaacaaaggctgtttcctttgccttcaccttcagagattcaaggtactgaaaaacgttgtgagaaattgtgaactgagaaaaaaatatctatattgcattcttgaataaaatcaaataccagaacaaaattggagaatacaacgaccccatctgcagtgttaggccggatggtcgagaccatatggctgtggcttatacggacgagctgcgtgagctttctgctccggatggtgaacggctgtgggatgttgaacatcaccccaatttcccctgccattccccgtggccctattctcatcacttgctgaaatgtcacaattttgatcagaaccttttcaggtcagtatgcaaatgccggaaaaagttcagtatactgagaagagtaaggccgtgtttcgttctttggccaaattttttttaaatatacggatacacttgaagtattaaacgtagactaataataaaataaattacagattccgtctgtaaactgcaagatgaatttattaagtctaattaatctgttattatcaaatgtttactgtagcatcatattgtcaaatcatggcgcaattagactcaaaagattcgtctcgcaatttacatgtaaactgtgcaattggtttttttcgcccacatttaatgctccatgcatgtgtccaaacatttgatgtgactttttttaccaaaaaattttagaatctaaacacaccctaagcttgaaatggtataactgatatactaagtgcgtcaactgggttctcgtgtgctttaccttctctgtaccatcctcaagggttgtcaatacctcctgatacaaaataaaagattaagagaaatgcaggttgtcagagcatgaacagcgaagagaacaaacgtcacacgaggcatgttcttaccacttcaccagacacgatgatgtagcagtccgtcgaagcctcgttctccaggatgatatccgccttggggggaaatgactctgccttcatctccgcgacctgaatttaccacgttatttagtcagtcacccaccggtaaacgcagagctattccgaccaaggcgtttgtactggtgttcaattaccagcggcaggacgagcttgtcgagacgcctgaacaggtagcagtctggccgcccctctgacatgtgtggcgagcctgccgccggcttggcagtcggcagcattctgtgcagtgctctccgcctgaactagctgcaggctttccatcatctgtcctcatcccccgcagcggttgttctccgaacaccgagtcttgcccatgtcccttgcaccaatgccatgtcaccaatcncgtgtcaaaaagaaaagaaaaccatgatcaggttttgccaatatttaccatcttgaaggtgttggtggtttcgtggacgacgaggttggtgatgttgccgatgatgtaggaggtgaggcccatgttgaagagcatgaaggcgatgctgaacaacatctcgcccgtgttggcggcgtgcaggtcgccgtagccgacggtggcgagcgtggtgatggaccagtacacggcgcaggtgtagcagaaccacacgctgcggtcctcgaagccgtggaactggctgccgatccacgtcagctccttcgccttgtggtggaacgccatccacaggtagatgcacgaggcgaagtgcactgcgaacagcgtcacctgcattgcaatcatgagcacacaagatttcgtagcaagttatttgtatgaactctgccgaaatatagtactccgggtggaacggcgtggccttacgtagaggagcttgataagcctggtccacaagtaactgaatctaatgtccttctccaacctgcaagattcagaatttcatatcggtcattgatgaatgatgatcacatatgcatactgtagttattcatatagcattacatgccacccattggtgaatcatgctaccaactcaaagtcacgtagtgtatctgcactactactgtactacagggatggaaattgaggcggccaagctttctagaaatttatttattgtatttttctgaattatttaagacaattttttgttaagagctagggaactgacaaatttttgaataattttagcttaaaaaaactgatcaatcggaggctcggagctacagcaattataaaccaagccacttaaacgagctcttttcccccacactcgcactgaagataaagacaaagaaagaaaagtctcttggtccactcacttacaaggttgatatcatgaaagaaggtactctccgttcttccaaagacataagaatttctaggttatttagcagatattaagattaagaaaatatatattgctcgtcattaaatgagagattgataggagtgcgagagtgggagggggtattaaaatagaaaggaatttgaatgacgtgaacgatggcacaattaggctatattctttaatctattgtcccaacttcatcttccttgtttttcacgcgcacgcttcccaaaatgttaaacgctgcatttttttaaaaaaaaattctatagaaaaattgttttaaaaaatcatattaattcattttcaagttttttgctcatacttaattaatcacgcactaaaccgtcgtttcgttttgtgtccaatggtggaagagttctcaactcgaattggcgaacacaacctttagttagtatatacaaatgcttataaatgcatatattatgtacaaaatttaaatccaagaaatgtttatatttgaaaatggtgggagtactatgataataaattaccttataagtcaggccagtagtgctaaggcctcctttggatttggagggtttctttttggatttgcaaaggatccaaatccttaggattctattcctatagtgtcctttcgattgaaagaatactacaactttgaaaatcctatagatttaatttcctatgcctcatttcaaaggaaaataagcactctcttcctttctctctctactctctctctctctctcactcaaataaatttcctctagaattcctatattttatttcatgtgaattattcgaaggcactagttctggtattcctgtgttttgaaatcctataggttttacaagagcatgatattcaaatcttatattttttcctattcctatgttttgagaatcctatatttcaaaggagctaattaaatcatgctgcgtacaaaaagccatacgtacttgatcacaactctacaagtctgcaatacacactcacacaaagtactgcacactcacgtactaatcattcgtgcgtatatgaagttatgaactcacacacaatctatttgaccgagatcgtccattggatgtggagtatttaccttgcaaagagcttgctgacgcgccgtaatcgccagagccggagaagattgagcaacccatacaatgcttgtcttttgccgctcactatccggtagatcatctgtaaaggaatcgttgaggcgacatccagcgccaagcatggtcgtgccaggtgcctaaaaatgcaagtccatcgataaatattgaactctctgacggagatactccctccatttcaggttttcaggttataaaatgttttaactttggttaaaatcaaactagtttaactaagtttatagacaaatatagtaatatatataatactaaattagtttcatcaaattaataattgaatatatttttataataaatttgtcttgggttaaaaatattcctactttttcctacaaatttaatcaacttaaagcagtttaactttgattaaagtaaaaacgtcttacaacctaaaatagagagagcagcaaaaaggaaaaaaaaatggacatgcagtgacggatcagcatcacgtatacctggtggcgatcttcttgcggtcggttacgaggaggccggtggaggcgtcgcggtacgccacgaagaaggagacggcaatgtcgacggcgaagaaggcgtcgaccaccagctccgtgacggcgagcgcggccgaggccgacttctccatggccagctcgaacggcgacgcccacgccgtgtacagcaccagcacgatcaggaacttctgccaccacctggagtggaccactcaaaccagaccgatcgatgtacaagagttcagttcagttcagttcgtgatcgatgtataatggatgcaggttgttcgatcacctgtagctgcaggtgtgagggttaacgacgaatggtcctagcgaaggagagggctcgccgaatgccggccggagaagctcgcttctggaggcggccatgccgatattcgtcaccggtagtatggatgcccctgcagtgctgctttgtcttgccattctgctggctatgcctatattatatactgactctgcgtgctctctcctttgttacctcgtcaagttggtgatctagcttttgacgtgggctcaaatctgcaggatacgaccaagcgaggaaagagttcaaaccaaaagttttgaaagggtgtgtgccacagtccactaatcaggaatccactagagttaggatcagggtttataatatagaaaatccgataaatggcatttacaagcgcctaatttcaaaaagtacgagttacattaaatatgtgtttaatgtataccattatacaagtaactttatctcagaaatatcatcgtcgttaatgttccgttagcaacccctgtcaagtgctataggataaacaatacatttaatggagcgggacataaccttaacgacgatgacatttctattacaaagtcacttaggcaatgacattttataaaactcacacttatcgatagtattttttataattggttgtttgtcaatagtatattttggattttctcttacagtatcgacataaccagtcatttatcacaataaccagtcatacaaggggcattgcatttagaaaccgctcaatagttcaaacaaggttttcttaattgtactaaaattttttggacaaaatggtttgagacttactagttttcaaaataaaatgatcggttattacttctataaaaaaaaccactaggttatgacaatcaacagcaaaatcattttaaaatcattttttcagataatgaaaaacaaaatcatagactagcggttagcggttatagatcggtgcctaaactcatatggaaaaccttggataggttccaacttcgcttctcagacaatgttatccgcgttgatttgagaagcatcagtgccttcttttgtaactttaataattggactaaaattttagcaatggtggagattatggtcaataaaacatagagataatattttcttttgagcaataattgggtcaagaactataggtatgatatagctagctattagtgaaatatctagctagctcttcgttcttggtagtttccataaagggagagagaaagggtaccctaaggccctgtttgttttccaaaacaaaaattttcatgctgtcacatcaaatgttacgacacatgtatggagtattaaatgtaagaaaaaaaaaccaattacacatattgcatgtaaattgcgagacgaatcttttaagcctaattgcgtcatgatttgacaatatggtgctacagtaaacatttgctaataacggattaattaggcttagtaaattcatctcacagtttcctggcagaatctgtaatttattttgttattagactacgtttaatactttaaatgtgtgtccgtatatccgatgtgatagccaaacccaaaacttttcctaagtccttaatgtacacatatatatgctgatatgcagcacactgtagtaaatttcctggtgttgtagcgctaatcggcactgtaaaataataaataaatctggcaatcttttatagctaaaaccaaattataaacaaaataaataccgataattatgtaaacttttctttaaaaggcgaatgattaaacatgtgtcaaaaagttaatggtgttacttattaaaaactggtagtatgatattagaagaaaactcaacaccagttacgatgtataactgggtgccaattaatttttagtttcaaatttcttaaattggtaatataaaatgtattgcttctaaattttgaaattattatatcaagaaaaaactaaattaagattccaaaccgagtgcagctacgtattattaattctaaattcaaaaattcattaagacttcatgacaagtacaaccttgtatttattaatgaatgtatttaataattactaaattaagaagataaaaggcagcaaataattaagtattatagtgtattcaatactaatattgtaattaaactaaatcgttttgatcttgatgactctaaagcaagatatacacttatgcacagtatataaaataaatagttcatgcaaacacacaagttatctcaaggatttaccggcctagtctttgaaatagaatttgcgtgcgtgtgtttatagaggtaagtgcacgtgcattatgagtgcgttgtactgtataatataaaatatatatatgtagtagctcttacagttgacatcatacaaagtcatatattgatgttatattcaggtcgcgtactgatgatagtacgtgagggggcttaatcatgatagagacgaaaccaatggttaattataacttgccaaggatggtgtccctccaataaatggtctgttttcatacatatacgctctgcaacattgacgataccttcatgaacagaaactaagccaaattcagactttcgtatggcctatatgtatgtaccccccatggttggcaccaggacgtaccagctttgcacgggactgttcctgataatgtgtttactgtagtactctagcatcgtactaccaccatctcatattacttgtcgctttgagtttttaatatttaattatttatcttattaaaaataattagaattattatttattttgtttgtgacttgttttattattaaaagtattttaattatgacttatcttttcttatatttatactaatttttcaaattaaacgaatgatcaaatgttacaagcaaaaagttaaagcgacatctattatgggacataggtaatactatatactccctccaatcctatcttaagtatagtggattttcgtggtcaacgtttgactgtacgttttatttaaaaaattttaaaaaagtaagtcacacataaactactattcatgttttatcatctaataataataaaaatattagttataaaaaatttttaaattagatactccctatgtcccataatatagcaacctagtaccgaacgagacacttcatagtacaacgaatctggacatgaaatatgtcatgtttcgttgtactatgaagtatctcgttcaagtatctcgtttggtactagggtgctatattataggacggagggagtagatggttaaatattgaacacgtaaacttacaactggactcaattaaaaatgagacgggggagtatatagtacgagagctattaatgttcacttttctaatttcaggatttcagcacttactaaaagtatataggccggccgactagagaagtagactttgcggctctgcacccgtggtgaaccgaaatccacatgaggctaatccaacaaaacttttctgttagtgccatgagttcaactacagtatttgagtgaggccattagaacacgccacataaaaaactagtaagtaaacctaaaaacaaaatgccttgccgtcatgtatatatatcacgctcacgcacatacacgaagggaatcaaattttctagcaaatatgtaaaaacgaagaacaagattttgctgcatttgattaggtaggaaaaaggaacatgtacaggcggcgtagtagtgctgctacgtacctgcagggagctataggaagacgctatctgaacgcaggacagcatcgagagaggccatatgctcgcaagatgcagaagagatgctcgtcgtggtggtcgacgactcgacggccgatcgagctaaacatgcatgccacgagaacagctaggtaaatagaaaaacatgcggctatgaatctgtaaccacggaggcagttccgtatctgtaggcagtggatcttcctctcgcacggtccgtcaaggactttcactgggaaactctttccaattccttgcaggatcggataagaagcatgcctacatacatggttgcgttgtattccgtcgcgattcttttacttattaccgtcaggattaaagaccaggattggcgcccttgatttcattattataactctgtcacggcatgatgccgcgatttcattccccagatatatatcaattccatgctctgcgatcgtctcgttctttactttgcattggcgctagctcgatccgtcgctcccttccgttgattaatacacgcgcatcggcaatctggcatggcgtagatggcgcaaaccgggcggggcgcatcgcctgctgccttttgagcgctccttcgaagaaacggcaagtgcttggcatcgatcgatcgatcggttctcgcggcgaggggtgcggacgtgcggctgcctcttgcgtttggcataacacggacgaccgggtggtggttcactcatgcgtggggtacgtgctagcggagctgcgcgcgggtgtccgaggcgtttgacaccatacggccttcggttgtcccggccaagctgcgaacgcttgctgcagccgactggcgacgaccgcttggtgactggccggtgcgcagaggagcgcgtcgcagcgatgctgggtacgtaacttttgttgcaacttgcaagttggtttgtaagccatcgtgtgtgggcttcccaggatccaacatggtggagaggttcggaaccgtgaggcggcatacggcacgttgcgtacgttgcatagtgattcagcccattcaaccacccgcgtctaaatcccaatacgatatcgttcaggtccaattcacatattttcagcaggaaaaagtacatacgaggtccctcatctgtcaccgaactaccaaatcatctctcaatcgaaaaattagatatatggcatctctcaacttaaaaaaccggtcacttaagatccttagacggtattgacaacagttttatccaacgtaatggttgagttagcgtgggtcccacatgtcaggatgacccacatcaacaccctcttgatctctttctccttttctctctcttctcctctatctctcacttttctcattgtcgtctgagtaagtggaacagggtggtggaacaggcaggagaggaggtccagcggtcggtgacgagcaacgccatatctgagtaagtggaacggggtggttggatgcccgaaccacagtggattagatccagatggcacttatggtggagagggggcaacggtagagacggatcccctggagctacacaggcggctcgacaaagagctctaagagcatccgcaatggtaaagtaaggtgctacctataaaacatgtacatctcagcaatagactagattaatagtaaaccactttaatggtatgtctacttgggtatctataactctctaatccattgcctcgtttttctctatagactatctacaggttagtagatagctttgttctctctcttcatttaatctcttccaagtaagaaaatatgctaacatggatatcttgtagagagcctatagataaccattgtgggtgccctaacacataagagcttccccataaataaattgtggcctctactatgaaatccacgtcaccttccatgtgacctcgtaactttcagcagcacactccggcggcggcaaggcggagatgtgtggtagaaagtgccgacgacgctggaggcttatcaattgttaattaatggttagagtttttattatctcaattgttttagaatagtcttaacgtgtattttctaagagccaacactggacttagtttagctcaatggcacacaaatcagtactatgttgtaattttttcttttcccctttgcgggggagtacgttgggaagaactttatttgaacgaacttcacggttggcacataaacgaattactggacacataatgggtacaaaaattgcaatttagaaatttcttccgttagtaataaattatatggagcacaacacgtatcataattcgctcttatttcaacgtcttcgttgaacttcggcatgataaaattctacaacctttgggcaagattttaaagaacacatgcatgtacatgtacaaattaagaaaaataaagaagctaatattcagggaagagctgttcagttgcctccagccctccactcagcggaacaggcacatgacgaagatcgccgcgagtacgagcaagtgatcgatcccttggtcgatggccattcctgcaagaggtgcaaacaacacgcgccaattcaatcagagtgcaggcaactcacctaatgttagcccggaactggcagccgcgacgccgcgatgcgcaaatcttggtgcgcgtataaagtcacaagcactaaccgtccatggcgagcttcccggcgatggaggcaggcgaggcggcggcggcgccttggcacagcaacgggtgcagcagcgcggcggccaggaagttggcgagcacgagagcttgaggcctcatggcgtcccgctccgttggctcctgtgttgtcctgtggtcgatctcgtcaggctacgcttgcagaaaggctagcgtgactggagattcttggttgcgaacttgcagtgcagcgttccgatcggatttataaacgcagggagcaacgaacaaccggcgtcatttgacattcgtcacgtcttcgttgagtttagcttagcctttcgctgatctgacctgactttggtcgccagccacttctgactaatctgtcttcctctgtgtgtccgtctcgtcaactgccacgtgtagctctcctatccgccggattggcagcgacgtgaagatcgaacggttggaggaaaaaacgatgaatccgtcagttggggtaggccaccggccggatttgaatccatgggaaaaatttcagagaatgaatgctgtgtgccaatctcggccggcaggaaagcgggtgcaactgttcaagcgcacgccacacatgtgtgcgcctgtgatgcgttttggcgtcaggtatgccgtctaaaataattgcactggaacacacagttactgttcgcagtggtctatagctagcaatcctagcgtggatgtgctgctttctagctccatcatctctaaatcttttataagcacaagtgtggaagtacaatccactcgagcactcgacccggccggtttgttcggtcagcactgcctaattggcaattctcgtcggttttcaacaaacattttagctgacgtttgatcataccgaacatatcctaccccacaatggttccagcgggcaatccggcaagacggcaagttagcgatcacccgtagagaggagcgccagaacagaacggaacagaacccatagaccagtagtgctctgcaaaggtggaagcccacggtgtagtatttgccagcccaacccacgcaacccacacacgtgatgtggcccactgggcgctggcaatgttggggggtttcgggctacgtagattagattagatagacgacacgataaaagcaaagacgatagaattaataacgggaacaaagtcccgtcccccgagagagtttaattgcgaccccaacctagcgacgcaacagacatctgttgcaggggacggacatacgaacaatcaaacaaacctagctactcctactacccccagcggcaagtcgaagcaccggacgatggtgaccaccgcgccaggccggcccagtcgtcgacggattggagtctggaaaggaggagagggtcgtgtatttaagcttaagcaggagcaagcaaagcagaccacctcgccatcacagcattcaaagtgcaacgatggggagtggtggtggctactggcttagccccacggtttacgccgcgtactcatgcgacggagctaaataattgcccgggcgccggcccgcgcgccctctctatccggctctcacgtgcggcggctagccccacccacggtgccacaccacgtacgccacggtacgtcgcggtatttactcgccccgcccgcgcgcgtacaagacaattgcgcgtaggtacgcgacgcgcgcggacggtacggtggggaggtgtttactaccacttcctacccacgcgtgcggctctttgttagactttaatttgttgcggccattgcagcacggcttccgtcgatacctcgtgctacgtagtactagcacaccaaggtccagtaaaaacatcaagacgaaccaaactgttcgcgagatttttaatttgtttttttaagatagctttgtcaccttgtcgttgtcggtaagatgagccatactagtattgttactgtggtgctataaccatgcagcactgcagctgcatgcacaagagatcgatcatcgatgtacgtagtacgatgtgtagggcttgtggccgccatcaatccggtaataagcgaaccggttttgcttcgaggccaccccggtcaaggcagggggaagaaaacaacacgaatggccggttcgtatgttgtgaccattttctccatcggagagaggcaaaggacgggggcggtgagagatctaacggcagattgcccgtacccggtacccctcccacgccaccacacccacacccaacggctgcgttcggccacagccgcgtgggccccctcccggaacctgaatccgacggctgcgatcgcgccccggccgtggtcccgggacaggcgcacgtgctgactgtcacggcgcgggccccgccaatccatcccccgacatctcccagtgacttgtccaatcaggcgtccacggccacgctcgtctcactggaggacgggacccacggatcgtggggccgacacgtcagtggggaggggagggagggatggtcttgggccggatcggctgtggcatgagtggtggggcccacatggcacgccacacgggtattgtgctcccggtcgtagctccaatatgacgcgctcggatgagacgcacgggtgtgcccgtaacctcatcatggagccacttctaataaagctccttttgctttgttttttttccccttctcgccttgactgaatctttcgaactttacgtttgttttgtttaggcttactagatcttaatcacctcgagccaggggttttgctgtgctaatcatgaattagcagctgcgtacgttttatggtgttctgtatacggctgtttgtactgcaggaaaaattcgaaggataattctagccatgttatatatgtatgggaggaattttgaatggctatctcgccttttgcagtggaatacagaaaagaaatatggtatattgtattcttcaccaatgtcatactaggcaacattgatgcataagcatatacttgcagtggagtatatgcctatgcagacttgattggaaggggcatttctttttttgaaaaaaaaaaggggtagaagtcagcctctctatattcataagtgaatatacatagctataaaacgagcaccgttataaaggaaagttttacttacatacttagtttttcctttttaataggattgtgacgagatcagtacgcacacttcgctttctatatatcttgatcatgtttcgttgttgagtttaacttactctagctaattaagccgcataatcaattattctctactttcacaattttgatacaataattacttaaaaattaatttatactatgataaatgagaggagaaaaaataaacttaatataatataagacgaagggagtagatgctacagcactgaggagagatatttcagtagcggagatcgtaccatcttaagctttgcctgagagtttctaataaccgtaacttatttcataatatctacctcccttaaactgtttagattctctcataattttcaagaatatgtagtcataatatatagtaaagggattagaagcagaaacttgataaacccatcaaattctcaccaaagctacacaggccccgttagattccataaaaaaagtggataattttttggataaaagtggcacgtttttcaaactactaaacggcatgtttcgtgtgaaaactttttatataaaagttgttctaaaatatcagattaatccaatttcaaatttataataattaaaactcgattaatcacacgttattatcacctcgttttacataaaacacttaatttttatcttcatatcaaacaccgtctcaatggtttcttaattcttgatttctcatgtcccctgaatatgaagtaaattgaggtgcggttgccggtaagcaatacctcgagagaacttttacttaatacatagtatattgttaatatatattgtcggtataataaggacaatttagaattttgtcacaagattaaaagatgtgataacaatttaatctaaacccattgatcacttataccgactatagatattatactaatacagtgtatacgtaaaattctctaccttgaaacccagtgcagcattggactgcccccttatccactggtttaatttagtctagtatatatagagtacataaacaaaatttgcttcttttaccatccttaacacatttattaaccaattgtcgatctgacccccaatgcatggatagtttaggttgattttgtcaggcaattctcatggtcaattcattattttgaatcaaggtttatgatatgtgctccgatatagagttctcattccttttcatagacatatacatctgataagtacctctaacatgcgtacacaattcttactgtctcaggtcataccaaggaagatcttattgtcacacaattgattccattgaacactgtacgacaatatcttgtaaatggtcagtaaaacctgaaagtgcatgtaccattaatctttttctagccaaaatttatctttcttttgcgggtaggaaacctttatctttattttcacggcgcagtgtatccgcggcgtgtgacgatctcatgcctgtcagggcagggaaacgtacgtacgcgatcccctcccccctgatcaggcgatcactgcaccgtcggctccgtgacaagtaggggtggaaaaaaagtttgggctcgcgagctcagctcgggcttggctcgagctcgcttagcttggctcggcttaaataccaaacgagccaagcctaagcgtcctttctagctcgtttctgaaacgagccgagcctgagctgtctcgcgagtcgcttgatttggctcgtgagcctacgctatcattaattatatgggtgattttattttctagtgaagttattatttgtcaatatgtaatttatcatttatattttgatgaattgaatatataaagttattttaattttacatattaattatttgttattactttttttaatgattataaattatatagcttaatggaaggctcgcaagccagctcgagctagctcgagccacaaacgagccgagccaagctcatgttttagctcattgctataaccgagccgagccaagccgagactagcttgttgcgagccattgcaagccgagccgctcggctcgtttccacccctagtgacaagtgacaacgtcgtcgtgggcatattggggaagcggagcaccctgaaaaaaaggtcgcacgccgcagcctccaccgcacgcttcttcggctcccggatcggatctaccaccccacttcggaaattaaagacaaaaaacccttcgcgaagcaacgcaagcccacgcgtccggttccctccacgagtccacgcccgcccagggattccgcacgctcggaacgcgacccgagcccatccgcgcgaggccacaccacaggcgtgaaatccccgcgctgcccacgagcccgccgcagcgccgcgcgagggcagtccggtcaatccggcgcgcaaccctccccctcgcgacggcacgtgaccgcgcctcgagcagaccaccggctgtccccggccgtcggatcggatcgggatttaacctcgccgtaagccgcggataagcgcgggggattagaatacttaacctctcctctgctctcctcctcacccggcttaagcgcgcgggggggctgcgattcgcaggcgagagcacatgccatgtgaccccaccccaccactcctccctcacctacagctgttaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaattgctctccccctctactgtgtttgcgtctttcttcttcgcttctctttctctctctctccatctcctcctcatcacttcccactctcccccttctgtctctctactttctctctctaccgccgctctcgcagcaggccaggttctctctaatggtcgtgaggcagtgagctcgctcgtacatggattccttgtgggcagcgatagcggcactgtttgtggcggcggcggtggtggtgaggggggcggcggcggccgacgacgcccagctgctcgaggagttcaggcaggcggtgccgaaccaggcggcgctcaaggggtggagcggcggcgacggcgcgtgcaggttcccgggggccgggtgccggaacgggaggctcacgtcgctgtcgctcgccggcgtgccgctcaatgccgagttccgcgccgtcgcggccaccctgctgcagctcggcagcgtcgaggtgctgagcctccgcggcgccaacgtcagcggcgcgctctcggcggctggcggcgcgaggtgcgggagcaagctgcaggcgctcgatttgtccgggaatgccgcgctccggggctccgtcgccgacgtggcggccctggccagcgcctgcggcggcctcaagacgctgaatctctccggcgatgcggttggtgcggcgaaggtcggtggcggtggtggcccgggctttgccgggctggactcgcttgatttgtccaacaacaagatcaccgacgatagcgacctccggtggatggtggatgccggagtcggggcagtacggtggttggaccttgccctgaacaggatctccggtgtcccggagttcaccaactgctccgggcttcagtaccttgacctctccggcaacctcatcgtcggtgaggtgcccggcggggcactttccgactgccgcggtctgaaagtgctcaacctctccttcaaccacctcgccggcgtgttccctccggacatcgccggcctcacgtcgctcaacgccctcaacctctccaacaacaacttctccggcgagctccccggcgaggctttcgcaaagctgcagcagcttacggcgctctccctctccttcaaccacttcaacggctccatcccggacaccgtagcctcgctgccggagctccagcagctcgacctcagctccaacaccttctccggcaccatcccgtcgtccctctgccaagatcccaactccaagctccatctgctgtaccttcagaacaactacctcaccggcggcatcccagacgccgtctccaactgcaccagcctcgtctccctcgacctcagcctcaactacatcaatgggtccatcccggcatccctcggcgaccttggcaacctgcaggacctcatcctgtggcagaacgagctggagggcgagataccggcgtccctgtcgcgcattcagggcctcgagcatctcatcctcgactacaacgggctcacgggtagcatcccgccggagctagccaagtgcaccaagctgaactggatttctttggcgagcaaccggctgtccgggccaatcccttcatggcttgggaagctcagctacttggctatcttgaagctcagcaacaattccttctcggggcctataccgccagagctcggtgactgccagagcttggtgtggctggacctgaatagcaatcagctgaatggatcaatacccaaagagctggccaaacagtctgggaagatgaatgttggcctcatagttggacggccttacgtttatcttcgcaacgacgagctgagcagcgagtgccgtggcaaggggagcttgctggagtttaccagcatccgacctgatgacctcagtcggatgccgagcaagaagctgtgcaacttcacaagaatgtatgtggggagcacggagtacaccttcaacaagaatggttcgatgatatttctcgatttgtcatataatcagctggactcggcgattcctggcgagctgggggacatgttctacctcatgatcatgaatcttgggcacaacctactgtcaggtaccatcccatcgcggctagcagaggccaagaagcttgcggtgcttgacctgtcgtataaccagttggaagggccaatacccaactctttctcggcactttccttgtcggagatcaatctgtcaaataatcagctgaatggaacaattccagagcttggttcccttgccacatttccgaagagccagtatgagaataacactggtttatgtggcttcccactgccaccatgtgaccatagttccccaagatcttccaatgaccaccaatcccaccggaggcaggcatcgatggcaagcagtatcgctatgggactgttattctcactgttctgtataattgtgatcatcatagccattgggagcaagcggcggaggctgaagaatgaggaggcgagtacctctcgtgatatatatattgatagcaggtcacattctgcaactatgaattctgattggaggcaaaatctctccggtacaaatcttcttagcatcaacctggctgcattcgagaagccattgcagaatctcaccctggctgatcttgttgaggccacaaatggcttccacatcgcatgccaaattgggtctggtgggtttggtgatgtctacaaggcacagctcaaggatgggaaggttgttgcaatcaagaagctaatacatgtgagcgggcagggtgaccgggagttcactgcagaaatggagaccattggcaagatcaaacaccgtaaccttgttccacttcttggctattgcaaggctggtgaggagcggttgttggtgtatgattacatgaagtttggcagcttggaggatgtgttgcatgaccgcaaaaagatcggtaaaaagctgaattgggaggcaagacggaaaatcgctgttggagcagcaaggggtttggcattcctccaccacaattgcattcctcacatcattcaccgagacatgaagtcgagcaatgtgcttatcgatgaacaactggaagcaagggtatctgatttcggtatggcgaggctgatgagcgtggtggatacacaccttagcgtgtccactcttgctggaacgccagggtatgtaccaccggagtactaccagagcttcagatgcaccaccaagggtgatgtttatagctatggtgttgtgttgctggagctgctcaccgggaaaccgccgacggactcggcagactttggcgaggacaataaccttgtggggtgggtcaagcagcacaccaaattgaagatcacggatgtcttcgaccctgagctactcaaggaggatccatccgtcgagcttgagctgctggagcatttgaaaatcgcctgtgcgtgcttggatgaccggccgtcgaggcggccgacgatgctgaaggtgatggcaatgttcaaggagatccaagctgggtcgacggtcgactcgaagacctcgtcggcggcagcgggctcgatcgatgagggaggctatggggtccttgacatgcccctcagggaagccaaggaggagaaggattagaaacaacaaccaccgacacacaggagaaacagccggcggtgagtggccaccaacgaggccagtcggcggcgaaatgcccgtagaaacaacagtcattcagaatcagatggatgccattttgaactctccacacaagcttagcaatcgcttctgatggtgctacaagataagaattttccagctgtaggttgatcagtcgaagttgttatgtacctataggagtagatcttttcttctttcttttttcgcagctttcttcgtctccctgtttgtttttcccgtcgcgtcgcagtaagagctgtgtatgtacatatataaatgttgaattttctttggcgcaaaatcaaaatccgcctaggttgctcctcgtcattttttccccttctcttgtctcttgacaatggtttaaatgtgcatgagttcatcaaacatgcaatgaatatttattgcagatggatattattgcagggtggtcattgcaagtaaatggcatccgaatctgagaagaagcaccactggagggggtggtggaggagggtggtggtgtgggagagagaaacatgacaggttgaacagcaaatggccagtcaagaggctgacacagctcctgtttccatgtgaggtagagcatggctttgcttgcgtggggtcaggtgcagtgagccagtgacacacccacgcaagaagacgcactcacgcagcacaagcacctttctttaatttcggggggctagcttgctttgtcttcaaatcatttcataagaggggcttagcttagcctttagttggtcaaaggttcccctaagcattttttgtcctctctgattatcctaatcgcctaggtaacatggctcccaatcttataataaccaccctcactattatacttgcatggtgctgtgtccgatgcttgggcgttgtcaaactaatgatgtgtgtgtccgcaaagtgagcggcacactggcatgcatgcagattcccccagatttcaagatggttgttcaaacgtatggttgctttcaagttcaggatttgagcttgcagtgtgctccttgtcttggtttgcccattccttttactgtgagagaatttagtgcagagcagagctagtcacattgggtaaaaattcatgaacttgctgaaaggcattctggttttggtctttatatctccacaagtagcttctccaatctccacagtctagacaggtcgttttctctaggccaaatgagtttttctttttcttcagtttttttttacctttgaggcttcgaggagctcaaaaaaagtccccatggagtctgtcccctgggtgcaactatagtggaacacatacacatccaacacaaacacaaagcctggaaaagctacaggagccatggtgacattgacaaactgtgcctcagaatggagtctctgacatcaccacaagggagtgggccctctgcctgtccgcatagcgttagcgctctggcttaaattttgctcgcccagtgctatcattatccccccttggaatagttgcatctgtaccaccatgtggcttgatgggttacaacttctgagtcgttaaaagtaattggacacgctcttcgtgtagaatcaactgaaatacgattatacgaatctacggaccatttgatacttggaaatgctcccacagaggattaggatgacttctgttggtttactgtagcacaatggattttttgaattacttctttcgatcaaaactatcactatgtcaaagttgttaggaatttcaactttcaagtagctagtacatattccctccgtttcatattataagacgttctagcattgcccgcattcatatagattttaatgaatctagacacatatatatgtttaaatttattaatatatatatatatatatgaatgtggacaatgctagaaagttttataatatgaaacgaaggagatagtagttaagagactttcttttttaaaaataactatatataacacactattttagtctagaataaattactcttacaatgtgggcctacatgctactcttgaattatgttagcaatgcgggcctacattcatacacatttatcattcatacacatttaagacaatcttagaaagaccatccacgccagtaccaatataagcttttggccattgattttaatgtaacacaacataggatagaagagaacatgaggtgcaacttcagcaggcttggtggcaaataaaggaagtgaaggcaagaaaaaatcattcattcgccctataaatggtaaggaaaaaagaaaccgtggtattggtggcagcagtaacagatgcgtttgatattgttcttatgacaatgtcacaaactaaaacgatatcaaaataatgcaattctaaagaaaaaaaatacagtgttggacgtaatacaagagatcaagtgaaatttaaattggcgaagataacagaagtgtggagagtgacaatgacacgccatagcaaggaagttccatgcaatggaggtgatgagatggggaggtaaaacgcaaaactgaaaaagaaaaggcaaaacatatctagcaggaagaattttaacggaaacacgctatataagggacattaataggtgatgacgatggcgaactatatctagggatgggtaaaaattgagacaaaaatcaaaactgaaaacccgagaccaaacctgaaaaaacatagtatcgatcattggtccctaactcggtctaggtctcatgtttacaggaccaattatttgattagtttattgcatcggatacttgaattaccgatctattcaagccttatcctaatcccctcctcattcatcaatatatcccttccacttcctcatccacgatagcacttgacgcctcgtatgttatcttggcgctcctctcccctctcctcacctcagaacttcttgagtggacctctctggctagaatgtctccatggcttttgtccctcattggccaccgctgcctcaacggcaaggtgctagaaataaagtggtacatagagagggaggaaggggagaacaatctcttctcttgttagtgtttggtggtgaggtttggaggaataacaaggtaggggatgacaaggagattgtgatttgttgaacatcgaggtcacatgtttcagatcagatctgagataaaccagacttggagaacaatatgtttaccgggtgtttggtggtaacgagccaccacaaccgcaccaacacctaaggagtaacggtgacagccgttgagcctctccactccacgcaccatagctagcgaggatgtctcctcttttgtgcacttcacgtcctcgagcatcaccaaaaaagacagtgcacgatggtcgatggcaaccatctccttgggggagagccggaagcctatgttaaaggcaagtaccacatttgcgtctaagtcatctgcaagtgtgcggcttgctcacctacaatcctacaaggaagatgaatgtttggttagaccaaaactatcggttaaccaaatggccagtttaaatacttccattgacaagttcggtcttccaatttaaaggaccgaattttgaaagaccaaaaagactagattatagcactatactatgaattggatggtaatgcttgaaattggttagatgtggggaatgcacttctgacgcgaacaaattggtagcatttctacacgtaaacaacaacaaaccaatactgtgtggtcacttatttttgctgaattatttaattcctaggagccccaaaatgcgccatgttcctcggcctatttttgcactgcgtttagaactatgcttaaagatttgtcgtgcatcagcatgcatggcactttaattgtttcgaagtgtaggagtacctagcaatctagcattgttgtcggcgcgatgcgtgtatggttgtgtatcaccatttgtatttctcaatttgtgcttgtgttcaaaaggagggcatcaagtctgggccccaggatggctgtgcttggcctaatgcttccacccttatctgttgggagaggacatgtagggcatccagggacagagttatcatggcacagtgactgggtagctggacgagtgaccggctgagcgatctagcagtagtatcatcggccaggagtatgtgaaaatctagcaaaacaaaagcgcaggttgcattgctgactttctgcactgataacagcgtcccccccgggggtctctctctctctaggtgacattacatgcgactaaggctgtgtgtttagtttcctttcaaacttccaacttttcgatcacaccatatatttggaaaagaaaataaattgtatagtttatatgcaaattgcgagacaaatcttttgagcctaattacataataatttaacaatgtggtgctacagtaaatatttgctaatgatagattaattaggtttaatagattcatttcgcagtttacagacgaaatatgtaacttcaaatgtgtgtccctgtacgttaattttttttttttaccaaaacaactacacacgacctaagtggttcggttgttcgtgcattcatatttgtgaggcattttaccacgcaccatgaatgcgccctgcccatgaatgtggagcagtaaagttgcagctttcttgaatggctactgttgcccatcaccagcaaaaagttgatcccatttcaccggtacaaacgtggtcaattgacaaaatggttgtatagtgttaatatatattccgacgtattttctctatcacaaaataacttaatcatgcattttatccaaatttattataatagaatatatcatattatattcttaaattgagttattttaaacaggagagagtatgtgtgaatggttatacgttatcaatatttggcacatacgtttctctcatatttttcttgatctcttatacattgttaacaaaatacgcaccttacggccatacgacatttcgttataactaggaaggtagcctgcgcgaatgcgcgggcatgtgtcacatgctaagtttgagacactcataagagcaaaatattaaccggtgaacatctaccacgatttgtccataaattgttttcgtcgacattaatttattttataattttctaacctattagttttatattatatcatatttaagtaatatctataagaaattatttataatcttcttcatcacttgaaaagaaagtagacttattttctttagaaaacatgtcaacgaaaagtaagtgtaaagtaaaactaagctatttttcattttcaattgcatatatattatcatggtttattcaaggattaattgggtgggacatgatgctccattaaatatatgggtttatataggctaatatgattgatataatttgagagccgatccatgatccatgtatgaacatttcatgtagagtgggtcagaagttccatgcaagctaatgtgaaatcgaaatataattgcacaataatatttttgaaatgtgatgtaccatgtatacacatctggtttttcttatacaagatagatataactgttagaaataatgtttcc

SEQ ID NO: 56951 - DNA, 8274 bp, Oryza sativa
ttaggtgacactatagaatactcaagcttccccgaatgctcgaggggttcggctagccattgccaccaccctcccgggctccactaccactggacagtgagaaaggacaaaggaggaagatggaggaagagagaatatatgaaagaggacagctaggggatggaataccattcatctgacggtatagtttatgatcttgatcgtgcacgacatgctgctcccccccccccccccttcccggaaaggacgtggcggtagtgctcatgtaatcaagtctcctatctggattagtttggttgaactgtaaggaagcgggactggttggcctaggtgggactcaggtgggctgatactaagaaaagagttttcctattggtctaaacgctgatatggactaataatagtctagtagtatctcgttaggccatatgctgatgagattaggacaattgatattccctccatttcaaaatataaggcacaaccactcttaacctaaagaccaagaaataattattatcatcttgtagtttggatcatcctaataaatataatggcatgcatccaatagaattagataacatgagagtggaggattcaaaaaagtaataatttaatagagaaaaggtcatagttaattgtatgcttgcatacatgccttatgttatggaacatctaaaaaaagtagtcgtgccttatattatggaatggaggaagtacatatcttcacaataaatattcttgttgggtcatgtgctaattaggttagaccaataaagatacacacatctatgactaattattacaaagtatggagaaatcatgtacttatcatctatgaaatcccatgatacttggtactacatagtaccgtatatgttatgaacctacaaggtaacagacctggtactccatatgtatcatatgtggtatctaggtatcatacttatatttatatccaatatctaggtatcataatttgtagatatcgtgagtatcatatatgatacttgggtaccatatttgataattagacctggtacctaggtactagatttcgtaaatatcgtgggtatcatacatggtacctgagtatcatacttgatacttagacctgatacctagggtatcatatatggtacttgggtatcatacttgatatttagacttgatacctaggtatcagatttgtagataccgtggatatcatatatggtacctgggtattagacatgatacctatatatatatatatcagatatgatacttaaaacaagataattaagaaaaagataaacataaaacaagataattgaccatggctctttcctgcaggcccagctagcatgtgagcacctcttgcgtgtgtcctacgactaatggaagaagaagtcacgttcacactcggcaagacaatgcgataaaagcccaacaagttcatcatgtgggtcgtggggagcctatcgacatcttgcatatgaggcagacaacgattcgctctcattaatcgtcccgtgacgacgggatatcgttctgtagcttttcttggaaagagagaggaaggagaggtgaggaagaagataagatgaggacgtcactaacatgtgggatcccacctgttaacttagcgagtcaaaaccacagccaacttgccacgtcagcaaaaatcactttccaaaccatcgaaggagtcaatttacacgttttcaaagatttggagacgttatacctgattttgcaattaagggaggcgatttaatcagcactaagagatgaggaagagaatacagacttatttctttcctgctcttaagttactacatgggctttaatggcccacctaatacggctgtggcaaacggtgcagcccatcaactagccacgggggacgttttactgcggttagtagctcgatgatccgggcccgcatcgttccgctaaagtgctgaacactctctgctgtgaatatctccctacccagaacaaatttgctatgaatcaccccaaaacgaaacgattcaagtaatactgtacctcgtagtccgatcttaaaattcgctactccagaaatcgctttggagaaccgcaggagaaaaagaaaaaacgtcgagaaaggttgtcagagtacgaggcttcgtacgagaccagataggatagaagtagtacaacggatggcgcgccgcggcacctttttccctctgcagccgctacgcgtgcccctgcgccgagcgttgttccccgtctgattctgaccactttggtcactccgtgctgtacctgtaccctggaatgatgaactcgtgatgttgatgcaccagcatgcatgcgcgccgaggccgatcgagcagcgagcccgcccgcacgcacacacgttactccactgttcatggcgaccgctggtcgtagtactcctagctgcaccagttggcatcgatgcacgaggccacgagccacagaaacgaggccgtgcggtcgtccgtgcagtgcacacgctggccaatggccatgccatgcgtgcgcgacgtgatctcggatggattaatctatgatctcgaatagattaatctatgatgtagtagtacacttgatcgatcgagcccctctctctagtctctctacccaggacagggccagcttgcgtccatcgaggcagcggatgcacgcacgccacccgccgcaagattccaaagccatcagttcccgcgcgtgccaagccgcatcatgcgcccgtcgcacgtgcgaggccggggctttagctgtcgcctgcctggtcgtcctcgtcagttcactgctccgtatcacggagaggcccccccgccgcggccttttcgttggttgattagcgcttatcttgtcgcacgaactgatttaatatctccccaacttgtgttccgaggcgacaagagaagacgaaacaaaaaaaactcgagcatccagtggcagatcgatcgagaaaacgtacaagtcactcgcgttgccgtgaatattcaaatatgcagcgtgatggtgttggggttcatttcagttcccgtcctggctgtccggctccgctgctggtggttgctcgatttgaccgggcagattaaggttcggatcgaggtggcgttgcatgtgcggatgatgatttgttaaggtgggcaatagctcctaccagactccctgtactgtacgtgagtacgttactaatcctgctacatcccggaagctgcggaccagcttcggttcctgtcaattgcatgccccgatcgatcgcgatgcacgtacgggctcggatcgtaccccgtcgcgtttaagttaataatcgacacacgtgcaccagcattaatatgtcatcactaactccaacgacgtgctccacgtacgtacagactcctaaaccgggtactgtagctggcatccgccgttcgattttgctcgtcgtattcgtgtgccagactgccagggcacatattcatgttccaaaaactgatcgatgtgtgtacgagcgcgctcacgcgaacgtgtagccggctagccgctcgtgcgcacgcggcctgcgtgcaccggtcgttttcagttgtgcgcaagcgcacacgcacgcgcgcacggacgtgtcgcgcaccaaccgcgtcgccttttttgccctccccggctttccctccctcccgttttcgtcgtttcatgtcgacgtcgccttaatttgaggcgtatgggcgtatggctaccgctgagatcgacgtgcgcgttcgccggccgtcgctgcccacgagacgttcgtacgagaaatggaccgccacagcgcctgttctactttacccgttcccaaatttttggacgaaatgcagcggtggtgtcacggaaagccccaaaggataatgttaaacagatcgccgttaccgatcgcagcttatagtagagatctgatcccagcgcgtgtagttcatgcatcacgctgcacagctgggcgagctggcaacagactagtagtagtcctcgactcctgaccacacctaacgaagcgacctgttgtccggttgagaccggagagacgggcagagggtgtgaaggacaggtcatgtgatggtgaggaccgaagaggagcttgaggtgtgtcgcccggtggatcgaggcggtcggtagtcggtacggtacctagctgggctgagtattcgtctcatcttgggctttctggcctgtatcagtaggaccgcaggagtatactagtactagtacgtacgtacacaatatactagtaccactgtactacgtacggcacatggcatgttccccacttgccctgttcgttcatgggaatcggatgagcaactttaatacaactgcaagtcagtcttaaacaaatactgcaagtctactactgtcggccggagtagcttaatactggagtactccactatttacgccgtgtttagttctaaaataattcatcaaaatttcaacttttccatcacatcaaaactttcctacataaacaaactttcaactttttttatcacaccatttcaatttcaaccaaatttttaattttggtgtgaattagacacagtccgtgtcgaagtagtacttattacagtactgatctacagcattattgttgtagcaggcacctgcagatgcagccttcctgatgccgccctgatgacggatcgtcgtttggagaagggggattggaactgatcatcacaaagaaatacggagtagagtaactgcgatatgtagtgcagtctcctaacctcgagttcttttgagcagtctgaacaagacagataacatatgaccgtgttccagagtgcatcggtaatttgtgaaagttttcagaaaacagagaactctatacatactaaaaacacacaaagcctgttgataataagcacgtgaccatcagtgcctgttgctagattaattctatttacatgtgtatccatcagtgcttcacactacagatcaaattggcaagtcgatcgatgccactcacggcgcctagctcggcgcacacttgcacaggcaatagattcacccatcagccatatcagtccatcgcgcagcggcaagttgggcctctttcttgcctgcctcgtaccgtcgcgagagggacaactaaccacacgagcgcgcgcgcacgagcaaaagagagcacaggagataagcacgtagtagctaccagctagcgactgccatcccattgaaaggggccgagatcgatgcgtgcagcatccaaagcatatatgcatgcatccacctgattattcgtcttatcaacacacacatacgaaagataaatcaattaatcatgaacaggaacgcacgaacgtccatgatcgatcacgagctgatcaaaaatcatccatcactcagtagcccggttgcattcagtcgacactgatgatcgatgatccatgggcgcacgggtcgctcgccgcggtacgaacgtgtacgcgcgtgtggcagaagggtgtcgcgggtgagccgtgatatgaccgcgcgcgcgcacatgccccacgtcgaccgataaggggcggcgccggccacaccgcggcgcgacggagaccgctgcgtggcgatatggaggcagcggcgctttcccgctggggccgagtgcctctctcgtccaaccgcggtctcgatcgacggcgacgtacgcttgtagatggctccgtcggtccgtcccaacaatgcaccaccgtgatgaaatcaacttctttgccgttcataaagttcgtattctaccgtaccgtacaccatcgggattttacactacgccagctcaggttatcagtgatgggttcaaatcgtcacttttgatggatttgacccttgtcagatattagtggttaacgatgactcctctcaccttttacgagtggagactcttacgtggtgaccataatatgtgacgggccacaaaatttcacctgttacacaggagattgttctctaacgggcaatatattatcacccctgtcactgagctacttaatgggggcaaaaagagattcaattcacatgttagcacagtgtcactgatatatattaaccgtgagaaatggttaattcttgttcatcgttgtcatattaacacaatgtcaagaaaaactacaaacctatagctgattgattgagatcctatcgatattggctggccttgctacatcgcatcagcctgttgaccaatcggctccttgatcttatatgatctatctatttatcttgttagttgcaggatcaaactaattagcacaccgtaaacccgattgataggaccagcattggaactaattaaatagtcctcctaggccttcgtgtgtgacgaatttcacgtaacaaccaacgcaagctcgagccaccattaggtcatgactagtcagatccggcgtctcccgacctcggggatactcgtgggcgacgacggcggtggcttggggattgaagttgcagcgacagacagtgctcagggatgcaggaggtgggtgcttggggacgaaggcaaagcccacgacggcgagtgctttggactcggcggctggtgcactcgatgagggtgaggaggtgtgagagagagagattgtggcctctggtctcaagttgttggtgggggatagaaaagagagagagagagagatgagagattgtggcctctggtctcaagttgttgatgggggatagaaaagaatatggttcctctggttttgtgtgatgggacttatctttgatgggtgcatattctgtacccgtcacagatgaagagtcgcctctaacgggtctatgtttgaatctgttaaatgtcagttgtgccgagtatgtacaagaggcatgtcacagatgtcgacgtgtgatgaaccatgtctcatagccttatttacaacggaatttatttggatccgttagagataaaggtcgtttgggacgagacattttggacggtaagatatagatcatcactgatgcgctattctgttgtagtgatattcagaacagtcagtttgattatattggactgatgtggaccaacgcttcaaagtgatttctattgctccagctagcataagagtagtactacactatccctctgtctcataatataagggattttaagtttttacttgcactgtttgatcactcgttttattaaaaaaaatcgtacaaatataaaaaacgaaaagttgtgcttaaagtactttggataataaagtaagtcaaaaaaaaataaataataattataattttttttaataagacgagtgatcaaacagtgcaaacaaaaactcaaaatctcttatattatagaacggagggagtatatattagtgcacaacttgaataaattagccacttaattaagcccggcccatgcctccccctcatttccataccatcgccggttctctttctagcgggcatggaataatatattgagatagcaatatagtaggacctaattatagcgttatgatagcgaaaagttccgattgcaccgaagggaaaggaaaaggtagagatttggtgcataaatattgcctgttgtcttcatgctcccatccttagcccatgtttatttgtctcatccactccacttacaaaaaaggagggctagctaatgaaatgatacgattaaaaatgatttctcgaaaagaaggagcggctatacttaaaaaatttcttgagggccactaactaatcatacgcatcgatcattatagcgggccagaatagctttttaagtacatgcatgcatgatccacggatcaattggatatttctggtcagacgcacagtattatattttgttggatcctttcagtactggcttttctcaaactaacactgcacggaaagacaatgctactaccgaacggagaaatcgttgaagatgaatgcatcgaatatccgacgaacggcgccgggtttgccacaagcagagaaatcaattatgaaagagctagtagtactccccaatttcttttcgtcaaaaaagaaaataataaatctgcacacgtgtgtgtaagagctactcgtcgcttaacagcggatgatctttcatgacttgatagatggttgttgttaatttgttgactgtgcattgtgctagcatgattggaatgttcaagatgaacctagctaacttgataaataaatggtggccactaacagtacatgaaggtgaaatgagaacgatgcaccataatttttccccgaaaaatgttccttttcttttcacgaagatatgcaatcgtttgtgcacaatactagtactactagcactattgggctgcaggaatt

SEQ ID NO: 56952 - DNA, 4325 bp, Oryza sativa
agttgatgtgtgattcttgcctctctgttttcctttttctttcttcttctctcggtttgctggttgatttatggggggtgtttggttcgttcttcatcgtttccttgtgtactgtttccttgaccagaacctcgcttgcttgcagttgcagactcggacaaagctaaaagatcctcgtacttgttggtgttatactactacaaaggaggccactcctgccgactgtgtccaaaacagtacacaagtagctgtgactgcctgtgagggggttcaaatcccgtcatcatctctacctattactttcttcaagtacagtatgttttaagaaaaattaccacttgattaatttggtaatcagagcagccagcttgtgaaattgtgcttctcccatggtggccgggctaaactagtagagcttattttctgtagaatacctcctgatgatgtaaccagaaattatctatcaataaagatgggttaagcatgatttcgcacaggattgaccctctccaaccaaaacccaaccaaatccagggagtcatccaaaaaatatttaagagcaaagctaaccacacaagcagatactgcaacaagtggcctttttttgccggttgcaacaagtggttttcataagttttttttagataaagtggctttcggaagtaaatgtgaggcaatgaggcagtccagattcaaagcaaccctatcaagatcgaagctcaagtccagatgtcttaaattaggcagccgtacgataggagaaaaactggaggtagcagctctccagctggctggctaagagctggaactccatactccatccgtcaaaaaaaaaaaaaaaagacaacttctgggaatgaacctggacaagcatttatctagattcatcctcagaagttagttttttgtgggacggagggtgactttgcgagctgaatcagctgctaaaaaaatggctttgtgattggttttcctccactccttgaagccacactaaacaccagctgtgtaataaagggtgcgtgcctcctgtcacaccagggtccaattttgtcaaaagatttttctttaggccaggaggaggagattagtatggtactagaagcgatctctcgctaatctgtcaaggttcgataggctctttcaataaagggggactagtatgttgaccaggatacgtaatactactagattttagcaaagcatgtgaatgggggtctagttgggattagttattagcttatggatgatctgttagtagtaaagaattcagagttctcgagctgaatggttcagaaaagttggttgatcaattgctacgttacatataatcgggtgggtactccatagtataattaaaccatcaagttgaggaaccttaattggatcaaggaaaagggggttaattaagatctgaccgatcagcttcttaggcttttccgagttatcagtgagttggtgcaggtgttatatgtcagaaaattctgtcatcattggttatttatttatatctgcttctattggctcgagcacgctgtcatcggctgttctttatagctgctttaatttgttagctcaagcacgaatcttcactacgtcatattggacccgtccagttgtagggtcccttttaaattatagggttgaaaaaaatagagaaatagaaaaaacacatgattctgatagggattgaagggtaaaacagagaaatacaaaacacagaaaaaacactggaatggtcgtttgattggagcgcatgaaaaatacaggaatcggatgagagagatagactcaaaggaaatttttcaagaggttggagctcttgatatatttcctctaaaatccacatgcaatgtgccattccataggaatttcataggatttagaaagcttcaatcctttgaatcaaagggccaaataggaaaatttcctataggatttgaataatatgaaattcctgcataaatcctttgattgggcccctttgaatcgcaggaatggaaaaacggaggaataggaaaaacgcaggattctgacaggaatgcatgtgtaaaacagaggattggaaaatacaggaaaaacacaggaatgaccgtttgattggaccatataaaaaacgaaggaatcggatgagagagatatactcaaaggaatttttccaaaaggttggacctcttgctaactttcctctaaaatctctctataggattacccattccataggaattttaaaggatactataggattcaatcctttgtttcaaagggtttcatagaaaattttttcataggattaaaatccttcaaatttcctacacttttcctacaaatcaaaagggaccctaagtttcgtgcttaatggatctacatccagtacgtatacgcaggtcctcaatcatacggtccaagtcaatagaacaaaagaaaaatatcgcaccagctgccggtacgtacgcaggtatatgattggggtacatcttgcacgatcatgcatatgccccatgatagacacttgtatgtgacagagaattttagtagtattactccagcagcaggcagtactagtcagcaagcagctgcctgggcatcgatctgcagcaagccaacgaaccgtagccgcgcagacgtcgatccgtcacgcaatggcactatggcaggtatgggccgtatggcgccatggcaatggcatattggggtagcatgcagcgatacatggcaggtggtggtgactctctcgctgggacctagctagcgagtgtgcgtgtgtgcgcgcgcgcctgtggttggtgagagcgacaggtacgtgcatgcgcgcgcgacgcaaccaccggccgggccacgcgtacataaaagcagggggccagccgcgggcaactaaccgatcgaggaggcgcccggcctccgagcctcggacggcgaccgtgcggggcggccacggcgcagcgaggggacacgcggggccaccccggcctgccggccgaacgcgacggacgaatcgatcgatcgatcgatcgatcgcccgcgcgcccgcgatcgaaagctacggcggtgacggccaccggacgagccacggccacgcgcacgctcgtgctgactgcggaccgcgcgcccgggttgcaaacggcacaggaatcccttgttgcaaccgacgaaccgagctaagacaaaaacaccttgcattggaacttggaagtaatctttgtaggcacccttgacagagttttacgcagtagtcggtatacaccgtagtagtaacttttttgcgggtagtgtcttgagatctgcaatcatgtccaaatctattggaaaggggagagcaaggaggagtaataaaagacaaaagaccggtaacacctgaagtgtcttcgcacaagtagcggcatcaaaaagaagaatgtatggtgatgccatgattgcagggggcctaaagacggaatggccatcgcacgttgttggtgggtagtagtagaagctttaatctaagctaagttcacaactatgggtctatctggtagaggctcaactcctaaatttagtttcagaagataagtttgtagtggagttatgaagctgcctaaacccaacttcacctatctagctagttcgttttgtgagagagtttcacccagctctactcctatttcagatgaaactgaaactatttggataattgaaagatagaaaaaacatcatcctatattcacgaagcaattgcgggcatagaaaattttcattgggtgatttaatctgagcttgcaaataaaaaagacgtgtttctaatctcactctcttttctttctattaaaataacgatgcacacgtgcacacccataaatatgtctcttaacatatgctaaaaagagacggagactaaaaacatattcgtcaccccactaaactcctattgaaagtgcactcatgtctaggtaatatttcaagtctaatgaataagtcacgtacctgcgacacttcaccatcagtagtggtgaaaaaaaaaaactcaactagtggctgggatcgacttatatcatgcttagttcagatcagctctaacttgtagtcataacaagttgaatcaagctaggcttttagcacgtgaacggcttgttagtataaaatagggtaaattggctataaaatatcaccatatgttcatattcttagtgcatattaactagcatttagtcgtttaattacatgttaactatatttaggaaaatctttagtaattagtgtttattattatgtcaatacctactaaaattgtaaatttaaaattacaattcataaccactggaaaaccaaatacaatatcataaacgttg

SEQ ID NO: 56953 - DNA, 738 bp, Oryza sativa
gcaagttgaagggtgatctctatcttgtcgattttgatgtggatagagtgaatccggaagcttgtttaattgctaaatcctccatgggttagctacggcatcttagactagcccatgttggaatgcggaatttggcaacccttctaaagggggaacacatcctcaggctcactaatgtcacatttgagaaagatcgtttgtgtagtgcttgccaagccgggaaacaagttgggaatccacatcctatcaagaacatcatgactacaacacgccctcttgagctttttcgtatggatctattcgggcctgtggcctacataagtattggaggtaacaagtatggttttgtcattgttgatgatttttcccgcttcacttgggtgtattttctccatgacaagagtgaagcacaagatgtcttcaagcacttcgccaagcaagcccaaaatctttatgatttcactatcaagagggtgcgaagtgacaatggaggagaattcaagaacactcaagtagaggaattccttgatgaagagggaatcaagcacgagttctctgccccttatgatcctcctcaaaatggcatcgttgagaggaagaaccgaactcttattgaagccgcaagagcgatgcttgatgagtataagacttcggatatcttttgggcggaggccgtgaacaccgcatgccatgccatcaaccgcctctacctccacaagcttctaaacaaaacttcat

SEQ ID NO: 56954 - DNA, 16645 bp, Oryza sativa
tccaaagatacatcacactgtccaaagatatcatcccgtcgacaacatacttggtgacataagaaagggggtaaccactcgttctcatgtcgctaacttttgtcaacactattcgtttgtctcttctttgaaaccaaccagggttgaagatgcacttggtgattcggattgagtgatggctatgcaagaggagttgaataacttcactcgcaaccaagtatggatattggtggagagacccgaccaaaatgtcatcggcatcaagtggatcttccgcaataagcaagatgaacatggaatggtagtaaggaacaaagcccggttagttgtgcaagggttcacccaagtcgagggtctcgatttcggtgaaaccttcgcacccgttgcctgccttgagtcaattcgtatccttttagcctatgtcgctcaccatgatttcaggttatataaaatggatgttaagagcgcctttctcaatggacccatctcggagttagtcttcgtggagcaaccacccggattcgaggatcccaaatttccacaccatgtgtacaagctccacaaagcgctctacggactcaaacaagccccgagagcttggtatgaatgtctccgagattttcttttgaaaaatggttttgaaattggaaaggcggacactactctcttcactaaaaagtttaaaaaggatttattcatttgccaaatttatgtcgatgatataatatttggttctactaatgcctctttttgtaaagaatttagtggtattatgactaagaggttcgagatgtctatgatgggcgagataacgttcttcctcaggctacaagtcaagcaagcacaagatagtaccttcatctctcaaaccaagtacgtgaaggacattctcaagaagtttgggatggaggatgccaaacccatcaagactcccatgcctaccaatggtcaccttgatcttgatgaaaatggtaaatgtgtggatcaaaacgtataccgctccatgataggatccttgctttacttatgtgcatctcatcccgatatcatgcttagtgtttgcatgcgtgctcgctttcaagcggagcctaaagagtgtcatttggttgtcgtcaagaggattctaagatatttagttcacactcctaacctaggcttgtggtatccaaaggggtgtgggtttgagctcttgggctattccgattcagattacgccgggtgtaaggttgatagaaaaagcaccaccgggacttgtcaatttcttggacggtcctttgtgtcttggtcatccaaaaagcaaaattccatagccctatccaccgccgaagccgagtacattgccgtcggttcgtgttgcgcccaactcctttagatgaagcaaacacttaaggatgatggctactccttctccaaaatcccactcctatgtgacaatgagagcgcaatcaagatagccaacaatcccgtgcaacattctcgaaccaaacacatagacattcgtcatcattttttgagagatcatgaaaccagaggagacattaccctcacccatgtgcgtaccgagagccaattagccgatatctttactaagcctctagatgagaagagattttgtgagcttaggagtaagctaaatgtattggattctcggaacatcaagtgatgggtggttggctgaccaatagccaaacatgagttactaaaatgtaaattaaaaaaaaatatattttgagcccttgtgtccttgagatcacttccttcatatgaagttggccttgacaccaggaacaaggctcaaacattccctctatcctcaaaaacccatttgtcaaaaagtttgcgaaaatttttgtgtgtctttttattgcgaaatttggtttttatcttctccttatgatgtatattgaccattgttttgtattgattgattgattggctggtcatatacatcataagcctctgcatgtccatagttttccattcctcagtttgattccttccctttaccttgtttttgggcctgactgcccattttctgtcaggccagaagttctgggcctccctgtccggaacctccgggtgttggggagtatatatactcagggggagttagaaccctagtctctctcctcattcttctccctccccgactccaatccctgccgccgcctacagtaaccctaggggcgatttccattttccaccaatcaaattcgctttttctccgtgaaatcgtccacattggtggctgggagcttccctctgcgattgattcgcagtttcatctctcaaggtagcactttttgattccatctctcggttcattgtgtttttagcccgatctctaaatctgtgaacctagggagaaaaccacttggatagtcttgtttctgctaccttgtagatcaccgatctataggatttgttcacatgcactagctatttttgagatcactgttcttctttttgctggccgaaagttccggtgttcttgcacccggaacctccgggcgctatccagccagcctgccattcttgattctctcaatttttgcctaactactgcactccaatttgttgattcctgttgcagtaaacattatgtctcgtgagaaaagacagaaagcctctcaggatgtgtccggtgatgagagtcctcctattcggttccctcgaggtcgtttgggtaaagagaaagtggttgagggaggcagtggcagtggtcctcgtacttctcccaggttcacaaggcagtccagcaaccgtcctctttagattcgggatgttgacggtggtcaaggcagtgatgcttctagtgcaagaggtcgtgggagaggtagtggtcgcagttctggggctggaagggcatctcacaatttccctgtaggatctcgtgagaatcccattcggctctacaagtctcttggatttgacaccactcccatgcaccacattggtagagccaagtccaactatcttcatcagcttgccaagtgtagaagagaccatttgattgatccagagacacagcctgaggagtcacaggatcctcgcttcaggaccttcactcagttggattggtataactcagtgattatggctagagaaaatccagtggttgagatgaagtggattgattgggcctacatgaggaagaagagcctagttctatgcgacagcattctttggtactactaggaagggtactccatgtgtgaagtggttgactgagggtgttaggcacaagatttccatggcacagcttgctgagatgttgggtttggaggatgaggatctcaataggcccaatattcatagtgaagcacccctccccatgatcaaggtgttgtactccatctttcgttggtccttgcttccaaaggttggagatgccactgctttgccaaccaagcatgctcatcttctcagccacatgcgctacaatcagcctcccttcagtgtgatgaagtttatttggtatgagattgctaacaccatccttgagcctaagcagggttgcatctatgctccttacattatgaagatgatcgagactgttatcgaggtgttctacatcaaagatgggcgccacaatccttttcgccctcgtgctccatcttcctcttctccagtggtgcctagatccattccttctacctcagctggtccttcttctagtgccccacagagttcctctagttcttctcccatcaagaaggctcttcacgcaattttttgcatgtatgctaagactgccaagaaagtgaagaagatagaaaggcgtcagaaggaagatagaagagaggctgggaaagaagtgtcagatgattctacagatgaggtctatgttgatccatttgaggcctatgaggcggcccgcaacattgctggtgaaggtccatccacctacttccatgaagaatcttcccattcagatgatgatgatgatgatgatgatgatgatgatgagggtatcaccgaggcagctgctaaggatgctcccacttatgttgataagggcgactccgctgcacagtccgatacgtctcatctctccggtgataccgagattgttccctctgatggagatggagatgagtgatcctcttcttctcttcatggtttctcgctttttggtgccttgatgccaaaggaggagaaattgtgacgtgaagggggtcatttgaatctttttttgctgccctgactgctgtctggtcatttggccggaagttccggctcttgtgacccggaggttccggccaggcagatttcccctctatcactactttctatatggacatgtaatcgtattctattatggttggatgtaatgactgttagatgctttattattttttatgtcagtcagttatctcatatggttgttgcattttgttgtgatgtagtgttcttttatctttttgagtgattgccatgtcatctagtcattttatttgcatcactcatcattcaagcatttacatctgcatctcttatttgataagtgttgtgtgaagtctctcttgtgctttccttcatgttatgcatattgatttcatatcatttctttatatgcatatctttagggggagcttcacacttctcaaatcattccaaatttaaaattctattatctttttgtgtgctttaaccatattgtcatcaatcaccaaaaagggggagattgaagatgcacttaaatcccctagtgggttttggtgattaatgacaagttggttaaaggggactaacgtgtttatcaagttttatacacaggagtttagtcccaaagtatgttgtgatggctaagaatacatggagaccccctaatttgaatgatcttcatgcgagaaggaccgaaagtggttagactaggttttacactttcaaaattgagtttaggaaaaaccgtactattaagaggggtttcaagtgtggttctagggtatacaaagtgctcttagtcatatccatgagtcaaaagatttttggaatcatttttgaaaaatgattttctccccgggacagagaggcctacccggaggttctggccggaacttccgggcaccgaggtatagcgagaattttcctaagtgctgcccggaagttcctgacatttttacccggaacctcctggtaaccctctagttcaaatctgtgagtaacggctagatgacgtcacctagccgttatatatagccaagtcgaccccagctcattctttggccattccacttcagttctttcatgttctagggttttctagcctctcctaagctccctttgcttcctccactcaaatctagagcctatcttgagagattgagagaatagatgagagtgtaggagtgttttggagatggcttgaagattaggtttgattgagcactttggataccttgtgggctgtcacttgagcttattactcttggagatcttctcctagacggttaggtgtcacccgtgagcttccaaagatcttgtggatgtcccgggaaggtttgtgaaggttttcctcacctccgcaaggaaacaaggtaagtgagtaaagttcttgtgctgagctttcagaggttgtcctaggtagagcaacttgcacttgtggtcttttctagaaggaattgtgagttggatcttggtggtcactcaattgtagaaaataacctagaagtgttgagttgaaggctgtggacttcctctgggatctttgcataagtgaggcaaggggttaatcgagacctggctctttggagcacctcaatggagagtaggattcgtgtgatccgaacttcgggaaaaaatctcctttgtctctcttgttcatgttctgtgattgtgcctactagtatcttgtgaaatgtatcctgtgaatctctatgcttgttgtagcttactagaaactcattttactcggtgattttgatattctctgttgcccggaagttcctggctcaagaactccggaagttctgggctactcatcactgcctggaagttccggtgttcatcaacaggaagttccgggccctggtaaatttgaccgctgcgattgtttttgaaggagttttcagcaacgcctattcacctcccccccctctaggccatatctctgcccgttcactcccatctcctttctctaggagcccacgggtcacgggaggttcggtggctagcggcggcagccccaggccacggccagcggaggtgctcctgctccggcggctacccctgccactgcctccacaactcgcggatcctcctccacgtgcctcgtcgcgctcgagctccgcgcaccatggccacgcgccagcagctgtagcgctgtctcctcctctactaccgccgccaccggtttccccttggcgaaggcgggcctcacgggcggagaagcgtggccaccgccacgccacgggccccctccctccgtggcgttcaggtcgttgtcgtggccgctcccctcgcgccgcaactgcgcggggacctcgtcccttccgccgccgacaccaatggatgcggccgcgcatggcgggtggcccatgaggaggcgatggtgcatggaggtgatgatctcccacgccggtgccgtcggtgagttcaacattatcctcggtgcccctctcccttccctccaccactaccaccgcaacccatcgcggacagcgccaccgccaacgacgacatgaacgccgcggagaggggcccatggcgttggcagtggcctcgctcctccgcccatgaggcccagcggattgccgccattccgcgcgccgctgctccagccaccgtcgcgccactccgcccgctgccacgtcggcttcgcgtgctgctgctccgttccgcacgccgccaccccagtccacattgtagggatgaagggaggggagtgacgatgacacgttgggcccgctatttttttctgtgaagctgacatgtgggtcccatggttttgttatttttccggatcgaattgtcacgtaagcgtcacgtcagtgccacgtcagatgaaaaccgggtcaaaatagccacgtaggcgccacgtcagccaaaaccgccatctaaaccgctgagggaccttatctgcatcggttttgataattgagggacccgttatatctggttttgaggttcaaggacgaaaatcggattcgttgacgagtcaaagagactagaacgggattgcgggctgcgtgacgagcatcttgggctaaatttgttgataggcttctgatgggtccaatatgcgccgtacaaatattgggctgaaccttcaagtgcggtttagaaaaggccgaaaacgagatggtcatgaatgcgccgggtctgtatctctctctctttctcgaggttgaaaactggagtagtatttttctgtttccagttttctgcttcttcgcttaaattctgtcaagtcctctctgtcaattcaactgtgaattgttctttctgaaaaagaaaaatcgaaatacatcaaaaggaagcgccgtgaggcgcgggcaactactgtgtgtcagtgtcaagcatcctgttagggcaagtactggaagcccctacatattgcccctaaatttgccatacataattagatgatgaggtgtatgagattgagccacccctcatgcaaggggcaacctttacacaatctccaagaaaaaagtgtaagatgatgtgagtgtgagctaatattggagtttgtatattgggagcgtatcttatgcacacatgccctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattacaaccttaaaactgtcagattttttgtttttttttgttacggctaaaatataatgaatttgacgttaagattttaaccctaggtgtaatacaattgaaagtatgtgtatgatttttttctagaatttttggtgacattttttagttgatgtgcacgtgtgtacacgtgagggcctgtgtgcataggatatgttgccttgtatattagatgtgatatattatactcccttcatactcataaaggaagtcgtttaggacagcgacacggtctccaaaacacaacttttgacttcttttttctataaaaatacttattgaaaaatgatacatatatacttttatgaaagtatttttttcaagaaaaatctattcatataatttttatattttcgaactcaacaacttgagagttattcatttatattcccaagatttaacttaaacattgtcataaacaacttcctttgtgagtatggaggaagtatgtgttacctcttaattaatgagaagatgacatattctaaattaaatgtgacatctacctccactataaaacaacttgcccttacgtgccttccctctcattctctcaaatctcaaacccgacaccagcaagttgagacagtgacaaaaggtagtactagattttcgttcaagactgaaaacctctagccggttggttaatcctcgtatcacaggatgggtgaaaattaaggcggattagttttacacctcaatcgtgtttaaatctccccttcaatcacccatggcggacggattaaccaagtactatctctgttgcaatatatatgcaagtcgtttagctctctgttacaacgacttagtacatttccgtaacagagggagcatgtcaaatgtgtcgttcagtaagagatgcaaggacaggtaataatttgatgcccacgtcgtattcaacattctatcgtctccgtttccacgtgtacaaccaaacaattttaacttaccctgaaattgttaaagtttgtgtcgaatatatatacgtagtcgtttacagtttagggcttaaaattgtactggtgttaggactaaaataagagtcggactctgtcataggctttctcataaatagagaggcatgcctgttgtatctgcatggcacctacaatatagcgtatacacgcagggagatgataacgatgtggccatggactcgtagcgactaggagatatattagatcggggaggagcgcccgtaatcagtgccccgagatgtagacatcggctgaagctcgttaacaaatatcatgcctcggtgtcgtcttcatgtttggatcttctatgatgtttctttcacgttcggttttcgaatttatatcgggccggttttataacagaaatagtgctagattagtagactatatagccattaatttctctacccctttctgagctatatattttcgagagataagatggtcctctgcagtactgtatatgcagtagtactacttgctgacatgtgggccccacaaatcctcataaccaaatgtaaataagcagtattagtatatgcaatacggcagagaatctcaattgcctaatggttactgtagacgtgcatactgcatgtgcagtagtactactcgctatcacgtggaccccacagaccctcggaaaaatgtgaaccttgcagcggctgcaattgtgcagctgcatgcccataaagatacctcccatttaggggcggatgtaaccattaggtaggatgggtcgaccgacccagttacgacccatgtcgtccacaccccacatttaggtatagcaaggcgtgaacacccaacagattagtccatctcttcacaaggcacgcacgtcacaaacaacgattgaggcagttatgcgattgaactataatacgatatttgttgtgttagattgctgttatcgagtgaatatctcccttctctgttccatctatcttttaaagttgtgtccgccagtcccattgtatggctgccgagtccacagtcaatttggccacatacatagtgtgcatgctcgcccatttgtacaacatgatttctttgcaagcaaattaagtctttcttgccatcccgagggccttaccgaaattttgtcatatttctttcaataaattgtttagcatgcaatccatgctttttaagaatgcacagtacaacgacacaaaatcaacatacaaagacaattctcggagaaaaccaaagcgacaagagaaagaaagaatatactttatgtcattgagttgacattgtccttttttataatatgcccatgagtttattagttcttctataatatgcaattgggttgtatcttattttcaaaaatacccaaaatacccttatatacatataaggttaactattcatttatcctatcagaagtttcaaaaaaaaatatgaatgtttttagtctctttcatgattcttacatttctgttttttttataaatataatttatctgttatatgttatgtagaatatttttttatgttttaaagtaaatcatctttcttatgctacatattttttttgtactattgtatttttataagctattttactctcatatatcacaggaaaatgactttctaaaaaaatattaaaaaacttgaaacttacataaaaacttttatgttgtctaaggaggttaccataaaaaaaatctgtatattttttaaacttctaatgcgattaatcaattattgatcttgcatgtttttaatgatattttgggtgtttctgaaaaaaaaatagcatgttatagatcaattgataagctcaccagtatattatataaatgtgtaatgttaatgataaattattaaactgatataaactcaatggcatagatcgaatgaattccctcaacggaaaaagagcgtagaacaatgagctacaagtatgtgcgaatatagaccccaacggcctcaacacagggccctgcacggccgaagaagccaacaatgctggcagcatcctccaccggaacaacgaatggagttcctcctccttttccataaggtccataggtgcgattgagattcgtcgtgaacttaagcgatgttatgacattttgtagcatgccaaatgaaccgactgttccagacagcccctttatatgctcaaaagctccaagccgaatctgcgtcaatgaatagagatttttttaaaaagaaaaagtagctaagaaggtattgagaggtattatattttcaaattatgtattatgtagctccaggtaactctagcccacagtccacactagaaaagaattactagaagctaaaggtagtacaccacaaattaaccctaaaattataccttttcaaaaaaaaactaaaattactcaaataaatactccctcgattttaaattaattgttattttaacttttcttaagtaaaagctaaaaactatctttgactattatttttttaaaaaaaaaatccgtatagtttaacagtttgggaatttcataatgtgaaagcttttctcatagtttgtcaaaatcgatgatcaaagatacaagtttaatttgacttagaacaaaactagattgaagtaatttgaaatggagagagtattaggctacttcagtttttacaaaaagacaaaacgatgacatcacacctgtccaataatagaatgtgttgaataaaaagcatgcatgaataatcttctttcaaaagtaaaagaaaaaccttattttaggattccttcactcaccgtgaaagcagcgccaccatcaccgccccatggaccaactgtatgttgcttcccattatggtcgttgtatgagaaggcaagcgagttgatgatatctgcactgcaaattgtcaagctttctaaacggtgaggtaccacctccatgtcgcgatccatgtctccgctgcctccccacggcccgaacttggtaagtgccttaccaacacaaatcaatcaagtaaaaattggtcagcctgtaaactttgaggatgatcttttttttttagaaaaaaaacttttaatgatgacaattatgataaattaactagggtgaaaaagaaatagtacatcatcatccccttttcctctttcctcttgaattgtctcatgctcggagtttacttgcaacgcatccctaaaatgtctgctcaaatcaagagttggtcgattgggactaacatagacaccgatcgaatgaagaaaaccccctgcacgaccgaagaagccaacaatgcttccattgctctgcgaagtgtggaaagcggttccccctccctgtccaaaaggtccgtagctaccactatttgtgaccaaggtaagtgattttacgacatcggccactgcacacacatatgggccagttgttcctgaaatttctgtcagaaattctgatggcccaaattgaacctacaagaggtaaaacaaattgttatgcttgcagtattgtggagatagttaacatcatatccagcatattttaaaaaaaaataataataacttttgggatagatatgttttcttagtattaggatgtgtcacatatagtcctaaattcgtttttttttggacggagtgagtactcactggtggagaaaccatctttggtcggtcgaccaaattccacgatattcccggttgcaataaaaaccgggatggttgaaaaggttagagctactttttaatctttagtcctggttggtgttatcaaccgggactaaagattatttttagtcccggttcaaaaaaggtaggtgatgtcagacccccccccccctaatatctttagtcccggttgaaagggttatagctattttttgatgtttagtcctggttggtgttaccaaccgggactaaagatcatatttactcctggttcaaaaaaacggtaagtgatgtcagacccctctaatatctttagtacgaactgggatctttagtaacaccgggaaaaaagatcggcatacgcggagagatcgaggcgtgtgcgtgaatcggatcgagatacatatctccttctccctcccggttctatctcctcctctcctcacaccctatctcttcctctcctcccccttctcctctcctccgatccccttctcctccccatcttacgcgcgaaggatcctttccttctcctccccctcccccctcctctccgatctgcaggcggcggcgccggcctgcacggcggcggccgggcggccggcggaaggcagaaggcggcggcctgctcagcggcggccgggtggtaggcggaagatggcggcttgcacggcggcggccgggcggtaggcggaagatggcggcctgcacggcggcggccggcaaggtgcagatttgttttgtttttttttctttgagaatttgtgatccggatctgagatgtatttgatttgtgtgtgatgtgaatatgtgatgtatttgtgacgaattttgtagaagttgtgatgtcattttttttaagattttgtgatgtatttggagatgatcaatttgagaattttgaggtgataattgatttgggattttagggatggagatggggatggagtgaaatcaatatattaaaaacaataaagaaaagaaaagaataaatgagcaactgggatcagctggactctatctttagtccctaaaaaggctctatcttcaaccgggactaaaaatgaatttttactcctggttatttcacctgggaatctttagtcccagattcgtagtcccgattagaaaaccgggactaaagggggttaagaaccgggagtaaaaactacttctcccctactgactccatatatcttggaaaaaacattcccatatgagtgttgttcactcatcaaaattttaatcctgatgctcatggttacgcacatacatatgtgtttccaataggatattattcatgtcacatttgagtttgttagtctatgtatttcttgagtgctagttaatgggtgtgtacttgttggtacgtgcgtaatagtgcgtgtgaatgtgcgattgtgggtctcaatgtaattgaaagagaaatcccaattgtgaatgtcaacaaattactcataaatacttataagataagattagttaggagctcaccgtacgagcacttccaccagggccaccccacgggcctgcttggtgcttcgtcttccctttaaggtcaacgtaagaaaatgcaagtgcatcaactatatcagcaaaccagactgtgacacttagcagacgatgggacgccaccttgatgttgtgagctttccctgcatttcctccccagggcccaatctttgcaagcacagcctggccagcatagatcaaccaagaaaaagaattagaaacatagtagagacaatgtgcaattaataaacaattaaatcttgtacaagaattagcacctcctggtcatttcctccccctcttttttcttctttctttggtttcagcttataccttgcctccagtgtcgtcgccgcactatattttgaggtgcttgcgctctatacataggcgtatcgaatcgagagatgtcttagattcacagtgcatctcactggtttgtgcatatgttgtatattgacttatattgggaggggatatataaaaaaagactacatgtacgatggtttgtacttgtaggggttctagtaaaagtattaataatagcggaaacaatctaagttattttctacgactacaaggggcggatctacagtagtatgagcggtgtcaggcgacaccgacgactttcatcaaaacctatagcgaattagcatactatgacaccgataggcatgttatgacaccaacgaatcgattttctggatccgccactgatgtcgactactaggatggtggtctaaatagatatatacatgttggataagaaaatatgatatcgatatgtctagatttattctactactagtataaactattataaaaagtatagaaaaagtagataacaagtattgccagtgttctactaccaatattatcgtcaaacaaaacaatctaagccattgtcttataagttccaccactagtaaaaaacaattatggattctaatccttcgaagaatatcctctcatataccttttagtgaagtggtatatgcatgttgtacacaacacattttttacattttttagaatttcttataactacgtggatgatatttgaaatgaggggacatcaccttattaagggattaaaatagtttcccgttgagatagcagtatggtgacccgtgcagattgcacggctagcatcattatattttattctcatacaatagcatatatattttctcaatgtattattcaaatatattaaaatgacaacataattttaaattttgtactacctttacgaaactattaatgtataatattcatattgtattttatatacgtgttattttatttattaattatttttaatattcatattgtattttatatacgtgttatttattaattaattatttttaatatcaaattttagttatttgtaaattatattcctatatagactctagactcgtcttttaatattttttttaatttcgaatttttgttatctgtaaattatatttctatatagactctaggcacttcttccaatattatttatttttaattctgaatttttattatttctaattgtattcctatgtcgactctaaactcatctttcaatattctttaatttttaatttcgaatttcagttacttctaaattgtattcttatattgactttagactcttcttcccatatttttttaatttcaaattttagttatttttaaattgtatttttatacgaaatctaaactctacttttaattttattatgtttattccgaattttagttagttttaaattcttatatggactctatactctacttctaatattccttatttttaattccgaatttctattatttcttaattatatttctatatggactctatacactacttctaatatttcttatttttaattccgaatttctattatttcttaattgtatttctatatggactctatactctacttctaatatttcttatttttatttccgaatttctattgtttctcaattgtatttctatatagtctctagtctcctcttgtaatattccttattttttaattccgattttcaactatttctaaattgtatttctatatggactctgtttttctttttctccgattaatatgagaatttctaggccgtgagagcgaacgtggagtctcatttttctattcctttaataggttaatagatgtttcaatggatgaaaacaaaaatgaaatgtctatattaattctaataccaatatagactattgtaaacattatctaaatataaggcatctcacactagatttttcttagacaaatttaaagttagaaaatgcaagtttaggcatttacatttttcacaacacaccttaagcaagtaaagttacgaatcttggcgaaaatagatctggcctgcaatgactctgatcatacctggtctccagatgacaatgatcaattggtggcttataaagtaaaagtgacggtgatattttgcgaaccatatcatctagtatattcaatctgctgacaacctcggctatcgtaggccttttcagtcgctgggcctccacacactgcaacgccatttctatacatgtcttcatttgaagtcgaagactctctacttcctctgatgtatacatcggggttg

SEQ ID NO: 56955 - DNA, 11330 bp, Oryza sativa
  unsure (1)..(11330): unsure at all n locations
gtcaggtcatttccaacccaatgactagagtggtgtccatagcattaaataaaatgccatttaagatgaaagatgatatggcaagtgaataaatgaggaaagagaaggaaaccaggtcttgcatgagatatggtttctacacaacatccaagacatcatgtgagataagtagcattaaatttaagtatggaaaaatggtatttgcattgaaagagtggtgtctactacagtttcttaattatgtggagtttatggaaactatatctagtgtcttgggttgggactagcctgcattcacttgagacatcaatttgggttaccatttttttttattgtttactgcaaagttattgggttaccattttttttattgtttactgcaaagtgcaaagttatgtgtacgtccaaccaaaaactatcataccagaaagatatttgtcaaggcttccacgctgtaaatattcgaagcagagagctctttcctccacatgaacaacaacatacttgccattgtgcagtacaaccttacgtcttgtgtcatagcagtagccaactaattgaacaatatttttgtgttgggcactcataaggttaacaaattcattcataaacttctcatcatcgagtgactctatgtcatggagcttcttcacagcaatctctttcccattctctagtactccctgttaacactaatgtcttgttaatatgatgttatcaacggaaatatagaaaatatagggtggatagcccatctagtctctcaaattttaccaaaggcttcatttggtcctagcttgaggtttcatttcgtccatacatctacctttaaatcatccttgagaccttaatgtgcaacatatagctatttctagtccacattctatttagaaaatgtccctttacccataatttgcatatactagaactaataaataacattgtaaatatactccccattatttcaacacatgagtgttgagctctaattaattagtggccaacagctggccatagtatacttttgcaagtacatgattattattttttacataaattactacgcaatacctattaggagtacgcaaatcacaatgaaaaaaacatcatataattataagatgtatgtttgataggaagttgggttttttactggaatatgttgggtctttagggggtctcatcagacgatttcactgcctgaatagtactccctccgtttcataatgtaagttattttaacattttccatatttatattgatgttaatgaatctagacatatatatctatctagattcattaacaagaatatgaatgtgagaaatgttagaatgacttacattgtgaaacggaggaagtaaggcatatttttctcattttttccatatatatgtgaatgagtggtagaaaggtcatttatcaagacagatggtgattatgtttacccatgtggcttcctatgtgggctcaagtatgagtttgaactaaaataaaaacatgaaagactaaaatagattaattgaaacatcaaagaactagaagtttggctattcacccaaaatatagatattaatcatactttgtatactattccatacccaccatggccaatttgattcttcttagaaaaatcatctgtgatacgttttatcaaatcgaacgtaagatccttgggcattgcatctgtgtgttgtaactcgtccgccatgctctcatgtatctcctattggacctagcttctgtgtccttgtttacagtaaaaaaagagaacagttctattacattaaggtaagtgaatacgtaacaagacatatcattatcagataaaaatgagctcttttaagaggtgtggcaggctctaacaaaaaaatatccaacggtctaattttcaacgtacgcagttgaggtttgggccttgcagctattgaaattataagcacataatgatttaatttattccataaataaatcatggcattgcatatgtaaactaaaataaatgcatcattggatctacacatgtaaactaaacagtaaaacatgaacagatcgaatatgcgcaatatgttgaacatgtaccgaggttgccgaaagatcggttgctcagcaggaattactcgcgagccgtcgcgaaagatcagttgctcagcaggaattactcgcgagccgtcgcggacgaacagggagcagtcgcgcgaagcgcttctcaaaaaccttattgtcgccttctcaatagtctacgagctagatttatttcggttgctcagcaggaattactcgcgagccgtcgtggaagcgccgctagatttatttcggttgctcagcaggaattactcgtgagccatcgtggaagcgcttcccaaaaatcttttcgcgtaggttgcgcgcgcgtgttccccctcttctctccacctcacatacttcaagtggctaggaggacattctcccttttaatgaggtccccctctcctagaataagcaaggtggtactaaactctccattcataccattccatgaggtgggcttttgtgattttccaaaaaattaatctttaagtgggctaagacccatctattaattccaacggcggcaacaagcactctaatcgtgtagtagtgtggttgagacatcgtgaaccacaatagtaaaacatttccgttatcttaaaaaaaatcgtgaatcgcgagtaacctagtgatacatggagtctcaggttctcactgttgaccaaatgatatccaaaattccatccccaaaatcctgttttgagaatccataaacttgaatatattgattcctccaagagatggcttaaagttgtgttcgagaggaggggttgggagcctctctctccgatacgcaacatgaagcacatattagcgtatgattaattaatattagcttaaaaataaaaaatagattaatatgatttttaaaagtaactttttttatagaaaaaatgtaaaaaagacacaccatttagcagtttatatgtagcatgcacgtggaaaataaaaaagataaagttggaaaagtatattaaagaacacaacctaaacgaagtttttaaaattttaaaagtgggccacctgttaatccactcacattaatatctgttgttcctcccctcaccacccaccccccccccctcccgcgcagggtgatgagcgcgtgagaggcccaaggggatcctgactttcggattcatgtttggggcggccattgctggatctgatattttcagcaaagctcccaaaaaattagatagggatttgttttgggcctctctttgtccatgctctaaaatgtacccatattaatcccataaaaagtagggccattccgttctatttctccttgttcaagattcaaatactatcttgctacttccgcagaatggaagggaccataccaatgaaaaacctggagaatgccaggcgagtccggctcaggtgcagggaaccctgcacatagtaatatacaggccaaatcaaattgcgacacctgtccagggtggccctacttaattacgcatgcaacggaggtttaacgaggactaaacgggtgaatggttctgttacctgattttgtgggatcgtggttaaacctccgtttacattgttacttggttgattgggtggacctaccttgtatacaggtgtcgcgatttgatttggcctgtatattactatgtgcagggttccctgcacctgagccggactcatgccaggcgccgggcgcccgatgccgcgtgcatgcatagggcgctcctgacgtgagggggggcccacgcctgtgttgcccacgtgcgcctatgctgcccacgcccttacgctgcttctccacgtgtctttactatatactccgttgcaacaaatcattcatatattttggaaacactctattaaggaaatttggtttattttttgttccaccaaaaatgtttcacctagtgcactcacaatgtttcactatgtatagatctaatgttacagtgaactgaaataatctattgcaacaaaaaaaacccacatattttggaaaccccctattaagggaatttggtttattttttgttccaccaaaaaatatttcacctagtgtactaacaatgtttcactatgtacagatctaatgttgcagtgaactgaaacattctttcgctatttgctgaaatattatttttatataaggtgagacaacgtctgatttaaacgattgaagcattttcgatctacttagtgaaacaattccgatatatctagtggaacatcgtgcaataattaaaaataattcaataataagttaaaaaaaattcgtcggaatatatccatgtgtggtcttgttttgaatatttaattgcaacgaatttaatggtgcaatcggatcatgatttggataagtaatttaggagaaaatcagtttaaagtagttttgcatgtaaatcggacgctgacgtcatgctgacatcagcgcccgattttgctcctagccgatcgggcgcccgatccgtaggttcgtccgaaaaaccttgtcaaaatttttagcagtagtaaagccatcaattactgccatttcgggaccattgcataaaaatatactacaaagcatatcaatggggtgataaaataatgaacatgaacgttcgcagcagaccatcaggaatataacttatcatcttcatctggttcttaaaacagaattactagagaagaaaagcaaatgcaaaagttgtaaacctggagaagcttctatgctcgcagctccggccgtatagaaggcttggtccctgcgatggtgctctttatgtcgtagttatatagtactgagaaatacatgcacccaatttatttattattcataacactaattattgatatgctggtgtctaacacctaactcttcggatgtacgtacagctagctgatggtccaagtcgtggcgtgtctaggcagtggagacggcctatgggcatagtttagtgaagacaggataggttggcacagaagaatcatctttaaaatgaaattccaactggccaactgtatggaacaaattgaccattttaatatcaagtcaactgttgtggctataaattaatgaagaatggatgatcctctcacatcagctgcctgattacgacttgtcaggatgttaaacgcaaaacactgtagtgtcaccataaaaggaaatacataaactcaatcattaatggggagcatggaaacctggaatggttttcaacgaaattacaaacaaaattacccttgaagatgttgaactttttccgtggggtcatatatttattacaacttgtgctgattactcatgcgctgcgattaataaagcattggtttgacacattcagagacctctatgtagactagatgcatgcattgggtggctagcaattggcccgacgacgactactgccaactgggtcaactcatgagctatgccgtcttgagctatcctaaccttctgtgtcacccggaggtccctacttgttatagcacgactatgggtgcctgcataatagcctcgtatagatggtccgtaatatatgataatgtgatgaaactttaaatttaaacttttacagagttagaattataagtatgaacggacctatgattccaaagaaaatctgagattgacccctttgcttcttgatgcaaatgtgtcacatcaaatctgagatgaatcatgctagaacattttgtatacaagactgtccgtgagattcatcaagcaagaacattttgtatacaaaattttcaatgcgatatcttatagtattatgacgctctctctcgtggcccgatcttctggtgaggggataactctcgctttgatcgagtgtgacgtttgcgacgtggctaccaaccagaacaagtccaggacgtcgtgcaatcgctacaccacaaacgatgtcgtaccaactgtgacgcgcggttgatgatccctacaatgcaaacgagagaacactacaagaataagataagatgcaatctaaatattgcgaataggtgattaagcataaagaaatagttgcgattgaagtggtagatctaatcgacccggcaaatcaacacatcaactattgggggctctaaatcaatagtcgtcgactaatcgagcgagggactagagacaaggtgaatggcacttggcaaaattcaattaaacaaaacccaattgtttttgaggatgtacaaagctatttatagaggaaaataaagctagggttaagtgctaattcgtggaggtggagggagacacttccgagatgggtctagtctattacaaggcctaaggcctaaattcagtttcagcagcagcactgtcttgttttgacgattcccgtcgactcagaatgaatttggatatgagactggatgcgtttgaaaggtagcgagataagctttccacgaagtctaagatcacccaaatcggagttggcatgaaggcgctaggtctgtttgaagtcagtgctgtctccggaggccgaactgaacttggacttggaattatcattggaacatgtgaagttatgtgcgtatccgatgaagtgatgtcttcatcatagtatatttttttgtgaaagaaacatttaattatggagggaaattaagattcaccattgcagatgttttttttttattttgcttcagcattcttgtatccactcctttgaaattagaaatttgcattgatgagggtaatcattttttgtgtccttgtcatagctatttcatccctcctttctgaaatatttgaagtttaagaacagacacgttgaaacttttaaaaaacttaaccttctaatatgcagaaatatttaagtttatcatgtgaaaataaattaaatttagaagatttcagaaactttagaggctaatggcaggtcatgttagtttattaaaattaaaatcagagatgggcaatacatcataaacttcaagcttaaatactttatggtcagtatattgtagccacagtttcagtgaaaaatgcaaaagtaccatatgtactaattaccagatgcagaaatttacattttgttgtcaatttgacatctgcatgcatatgctaaatcactatgcaaagtcagagaaatttgatatctagtatttaaatccaatgagttgaataaccttgcaggagtacctttttgtaggttctcattgctctgctggctgcaaagcaaacagagggaaagccaggattcaaattaagttccaaacaaattaaacagaagtgagctgaaacttagttaggtcgttacctttgtgattaaaacattacatttgcataaacaatgaaccttaagatttaggttgcattcatttgcctctttttgagattggtccctcgattggaagacactattaagcagtagcgcttgacgttactaacttccaaagtccaaactgatttgggacaatgggacttccaaactattgcgaggaaagagtcagttgtcattcatgaagtactgatttatgtggggaaaaccccacatacatcactctcgagtctcgactcgatcccttccaaacttttgcagtaacactgattttgaaagaggaatatttttttttcaatgccaatgctggaagcagttgaaaaactgcagtattttttctgattttcttatttcatcgtcattgcactgctaatgataacgatgatagattgtgtactaatcaattaggagacttatcaagtccctattcagattagtgtcagtggtaaatttattgatcacaaaaagtattcaagatttcaagcacttatagcaatatataccaatgacgacagtgctgtcaatggagaggaagtattaatgtttatttccaacatgtaatttaggttttcccaaagcagtaggccaaacttgtacttaggctctcatattggtatgtccaggtgtgcaacatatatggtgtctcttctcctcagttacctaatgcaattaagtgttgctaacataccaattgccataaaaaccaacctagataccctaataaggaccatcagtcttcgagtcattgccatttttcaatataatcatcaatttatcattttgatgcaagcataaactgcatataagatggataccttgtttatccgaacaaaatctaatcacttaacagctccacctgcggagtacatatctatcttgcttctcccttcatctgcggatgatttttttttatcaagaggagacaagctccctacatttccatatgtcagaaacgaggcaacatagttcattgatctaccagatcggagatcataaaacgtttaaggcaaatgcgatgctagttacgttcataaataatcaaccatgtgttccgcattaaagcagggcgacacgcattaggcatttactccctccgtcccaaaataaacaactctcgtacgggatgtgacgtattctagtacaataaatttacacataagggtgtccagatttatcgtgaatttgtcgtatcctatatgagattggtttgttggtttatttgggacgagggagtacctaagaagcaaacttttaacagagattgggggtgcatagcaaacaataatcctgttttagctccagtaatgtacaaaaaccttgtgctattgatttccacaagtaattccatttatgtgtgatggagctatgcattagcttgtttgtgcactatgcggtttcagtcctgtcagcttgcccgaggatctgcacgtaggcgtccaattctcatcatttttttcgtcaattcgtccctctgtccaacgcctatcgggttcgtaatttcgcaggacgctgatgcattctgctgttccttgtacacagggaaattttgctttctgcatttcagaggcgttttgatttgttaagagaggcgagacgtacagcgagcttctcgggtgtgagaggacctaatttaattcggttttacaagttgatattgtggttcagatatgcgattcaaactccacgtcaagatgaggacctaaagtgaacttattttccatacgattctgacgagtccaatacttagaacgggccgtccttgtgctctgccaaattggactgaatctcccgataccgttaaaaagaagccgaatactcgattgccatttttttagcgacgcagccagtggccacggctactctcagttactgattgctttgctaggagccttagtgcctcacaactaattataccctgccaaaataccacaaatatttttcgcagaacaaaattataacaaatgtatcatcaccatcatgtcattttgtgacagatccaatgcattatttcttttcaccatgttcatcatcagcatacaacaatcatagattgaagcatcatccacatgtatgtgttcatcttaacaaaagagacgtttatttcgtcatcattaagagatatatagttcatcatcccgttggtatacaaagatgcttaacaagcattggaaaaaaaaagtactctcaaactaatattaaagctgggttggtgaccactccaagatctcaaaatataaccaaagctggtgcatggttatcaaatccaaactctgaaaatactttgggggtcacaccaagacccaagcgagggccaaaaaaaaagaaactacagaagaaagggaaaaataaaggtgatttccacggctcccatgataaatgtcgcaagttcagtagcagtattgttacaatgttactgattgttttgctcacatgctggggcctttagaacatttcagacagttagccctgccaaaacataaaagctatatcagcacattgtctaaagatcaacattgtaatgatatattatagttcagaaataaattatggcttcctggaaaagagaagatgtaaagcatggcctgtaaaaactgtgggttgcccatatgcaaagagttttactatacattcatagttactaaattggacatattatagctatataagacaaccagatattagtatggtctgcaactctgcatactgtttttcttttcatcaacattatgaactgagctcttggataaatttctagttttgatatatgaatcaaatgcatgtaacaggcagaagcatcttacctccataacaacatcatcgtccttagatgtttcacctgtcaaaataaagaaccttatttttgtcaccaaggaacagacaagaaacaaattgcggtaagtgttatcaagaaaatatatatgtggtcacgagattaggttgtgaacctaacacttacaacagagtttgtgttcatgaatatattaacagaattacatcaacatcttagaaatacaatttcttgataactttacagataagaaagaaacatgatcttctacatcatcttcgtagccagttcaaattaatggtacattttgagttactcagtcaaacttggatcaatgcaaagctgtactagtgacccttattagaaaaaaaagattggttggaagaatgacaaagcaaagcaacgcaaagcatgatcacttgatcagtactcaagtaggcccttttgcacatacagctactgaagttttacaagatcacgtcaacatgaaaccaatgtcatgtcattttggactgcctctaccattcgttgctcacattctgtaaatccttcatcaaatattatgtggtaattcagagggtattttgttctgcctatgagcagcttcacttgatgaatattaagttatgaccagtgaccacaacatatggtaaaagcagaatttctgctacttgctctaaacctttcaaaatggtaccatatatatagaagatataacacagaatattctctttatcaaaaagcagaaatgcaacagaagttgattgttgaaaatattttttattgtagttcatttacctccagttagttctgatgtccacaatgccaggttctccttcaggagctgcatcataagcatgctgtccttgtaaccctccacaccagcagagttaatctcagcagtagcctcatcaagtgcttgttttgccacttggctagctctgaaaaaggaaataaaatgactaactcattgattatggtatatctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56956 - DNA, 19156 bp, Oryza sativa
  unsure (1)..(19156): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctgtccatgacttcacttacgacagatactttggtgactcttagtaggcttcctgagcttttctctctcattttttcacttgatgcagcaaatggtatttcaaatatcctcaaaactgtgcagaagaatacattggagtcaggtggtaaaatctttgtgccggatggggggtttacaaagttgaggttgctccgttttacggcaccagtgctaccacctctgagcttcctagaaggggcaatgccagagcttcagaggcttgagctgaggttcagaatcattgagtttgtatacggcctggaaaacctttcaagtctccaacaggtatttctgacctttagcagccaggcacctgaagatgcgaaagagaaggtctctcagatcaaaggactggcaagcaagattcgaaaggctgattcctccaacattagtgtggtgatagatgagtacaacgaattatcaaaagaacaatagattacctagtcatgatctccacagttggagggaaccagtgtgttatcgatgtgttgtacctactccatctacagtctgtttttgttttatgattttcagatctatttacaattttttgtactgtttttttgttgagctgtggcatctttgttttgtctgctgtactcccaaaactctgctagtgaaaaaaaatatatcttctgttttcctaagaaaactaatcaatataaaggtgtttcaccaattctaataccattggcctacttaaagatgctatttatttgcctcgcaaatttcaacttaaaacaaatatctgttttcagtctctaatggggttcactgatccctgacaattaattattgcctgtagaaggattcactaatccaagttactgccaaaatttttttaaaccaaatttaatttctagtaattccagaattctaattagttcctgtcaagaaaatgaattctagttaaccatgtacttgtgtttattctagtcaacaatgcgtgtaacatgcatttgtttctacatccaaatattccgtaagaaaacaatgtatttacaaatactctaccttactggaatcaacttgtatagtgtcttgattttattttcaacgctaggagttctgcagttttttatttcattggagtgtaacattttttagtttatctattcctacacacaatctgttttacatcctcacagacgtgactaaatcaaccgtcttaactaaatatcaattttagtttttctctgcaattttaatcaggtggttgtggtcttgtggaactgccaacatcaccaattcatttcagttattttttttatgttgctcattttgcaatttcagttcatgtggtgtgtagtttcctagcttgctctgtatcaacctagtcgattaaattactcccttattattctttcgataatgacctctacatccagcatgtatcagaccataaattacccccttgtgttcctagccaccacttagagtagacaagcaaaataagagaactgaatcaatcatgtgtctgcatcgagatgaaaaacctagtaagccgtggtcctcctgatgagccatggtgctcgacctgccgatggttgggtggaggccgacgaaggaagacgtgaaaaggggatccgacctcggaggaggaggaggtgcatgcgcggagatgtagcggcgacgccggcgtggacggcacagggatgccgcgcccgcgcgtgggcaggaggtggagaaggggggcgccggcggggaggacgtgcgccgtgtccctccggtggccggagcggaggaggaaggagaggcggagcagatctgacggcccagattgatcttgcgatattgggccttcaagtgtctcctggcatgatggcagcacccttaaacgggcctccttcatgggcttttgttttggttgtctatgtgggctgtaatttctgtgggccttcacatttgtgggcctctaatggccatggccgtcatgtaatccgtgtggtgagagatgctcgctctcgccgttgccatggcctccaccgccgccgctctccccttatttttcacgaccccacctcctccagtccggtgaccggagaaggggaagaaagaaagcctagaagatccgacggcggcacagattggttggcgctctctcacgcgagtcatacatggtcgccccgctttgcaatgcgtcgagtgggcgaacaggggtgtccggatcgggctggagacgtggagatttgactacgcgcacaaggtgtttgacggaatgacgcacagcttcctagcagtcgaactaccttctgttctggaccttctggtcagtgttgttctacttcgattttactctcagttttgagttgactttatactgcaatgcattccacaagtttgaactgtgtaggtagattttggaacttcaggtttggtttggactttcatgtagaaaattacgactcaatgacagtgtaacacactctagggaatgtaaatcaaatcatagtttacaacagttaacatgatattgaagataaaaaaaatggcacaacagcgacacgcatgactgaacatttacgatatatatcttttttttaagggaaaacagcatatgtgccttttcattaaatatatatcacaatgacataatttataactatagttacatgacacaatttaaagtttatagatgcaagtggctaacagtaatacagaagcgaacgcgagtggcaagttgtgtttcttggctgttcttgtctgcaggctgctattattgtcccggacgtccaatgtatagcaaatcacaataacacaggaatctgttacagattattgacttattacacacgcaatctgcagcatacagctccgaaacaatagtattactcgcagaatcaactttgaacgaacacagcgacacacaaataaaaattacatatacacagtttgctcctgatcatatgtaattacatatatacacagcgaccaacaacaatacagaagcgaccatgagatgtaagagttattatctcaccgctctgtgagatgcattgccatttgccaacaacagtacagaagcttgttcctgctgtctgctcctgaacgagctgaagcaacgcaggctgtcctattgtcttttgacatctctctcacctcaggagtcaggagaggaggacgtcattccctgtggcaacaagtaattaagaagaagttcatcaactaaatttggagttagtttgcaggtagcaatgctagacaggttagcgtgaacagtgattaccttttcaataggagctaggcatggcactctgtttcaccttcatcttctatctcgctctgaaactctgtttctctcctcggtgccgcttcatctgctgcctgaacaacatcctccggcgaattgacttggttgaatcttgttgcaccctctgcctcctcctcaccagcttgattaacttctatttgcatgcctctgatgaaaaggtcaatagggttgcgatgcttggcgacctccttgctcactgcctctactttcctcttaatattggggctgttcatgtaccgtacgttgtagcaaagagctacctctgaaagcattttaaggtttccgatacctgaaggaacactcatctcgctcataggggatgtgtgcaaattcagtcgcagatatgtgagcttcggcatagcctcttcttcgaaggtcagccgtgggacagggcaatcaagggagaatttctctagttctttgaaccctttgctctcaatcactatagcttcttcaggaatgaactccaagcctagtatcaggcgctgtaatttgaccaagcccgcgaggatcttcacatcacctgccacttgtttacagaccgtgatctgcaagaaagtaagatgctcgagcccttcaatccattggggaacattggcgaattttccggctgttactttaaattcatcaagaaatttaggtggatcacttagagaacgcaggaactccatggaacaaccgagcccacaatgaatggttaaggacttaagttgcctccattttcctaaggatgacaatagggcttgttggtaggctttgtcattgcactggtgaaaggcccatgttattgcgaggatcttcaagtcgtgtagatcaccgagatactttactgacctttcggagaattcacttaaatcaatgagaaaatgtttcaacatttttagccgcacaatttgctctggcatgtgctttatttgtgtgcctcttaggtccagcatccgcaaagatcctggctcgcacacttctgatgggatctcacttatgtgggtgtggctgatgtccaatgcattcagggtgcgcagctctttgatttgtggtgggagcttgctgacctttgtgttactgacgctcagataactcagcacaagcattttgcatatctgcagtaggtcctcatccttcaaattctcccagccttgaagatccaacgacaccagatatccaaacttgtctagagggactgttgttctgttgactgcaccagatatgagtagtgaacgagtatgagacaaatccatttcttgcagcatttctgggagctgtggatcgggatggtggagagctagacgacgtgctatccgagtgttcttgccaccacctcttggtgctgagttgagagttgcgctggtaatgacataacccttctctgctgctctgtaagcaagaaacctcagtatgaaaggattgacctgccacaggcacaagtcatcttcatcaagattgtgtccacagttccttgctgctggggtgattatattcctgtcaaccatctcagagaaatgcaactcagacaacagcccttcgtctagccatttcatgacaagacgatccttctcaaacacatatccctgtggcaacatgcttaggtagagtaacgattgtctcaactcatcactgtaatcaaatgatagccagtgttcaaactgtttcagcagcaggcgtacttcttccaccctaggaattgctgagctgccgtgttgctgttgatgttgtttcaaccaatcagccataccagttatgaacgatggtattcctctacatttcatcaatatttcatcacataatagcttcagattttctggagggcaatcgtccatggaaccaaaagcttttatgtggagcagcttctctgaatctgagtgactcagaggcttcatcttatgcacaatcccattataatttgacaaacaccaccctgctatccgctcatcgccagccgtaaacaatattctgctaccacagttattattaggaaatgcacccttgatcaattccaaatctgattcgttgaatatattatcgatcaaagcgaagtatctggagggacaatacgaagagaaaatattaacagaattcgagctctgatgctgtactgtaagagaagtcgtaaataagtagtgctatataattatagcagctgaattaagcaagcagtaaatgttgtttacctcttatccttgaggcgttctgatatgttgcgagccaacagctccaggtcgtcccccaacatcgtgatttctgagctgtttggtgatgatggtgcctccagttgctctatgatctgcttcaggatggtttgaggaacaagcttgctcccgtgaggcctccgggagaagttagccacaatgtggcactggaaatgagtttggcaccggagtcgacggtggagctccatggcaagagtggtcttgccaatgccggcaggtccagcaatggccatgacccggaggctctcgtcggcggccatgagccatccgagcagctcgtttgccgtgccgtcgatggcaacaagatgatcatggacggtacaggcctcgacttgggctgcttgaggcggtgatggcatgagctcagagcgtagaccattgaacacaaggtagagagggtataccttccgcggaatgtcatagccgaatgaccttcggcggcggaagcgccgcgtggcttttcgcagcggcacgcaaggctgattagatagaaatttcacgatagccgtgaccgtattccgcactccgatcagaacactcatccaggtcatcaggtcataatgggcaccatcatcatgatccccaatggaaggcgacatcggcatcctcaggtatgcgacaatggcgcccagttccatctccaggaacgccaaaccgtgcctttcgtgggcgtcggtgaagcgtccactcttcagcagcttagagacactctcaaggaggggctccaactccttcaacgccgcctccttcttctccatgatggaagttcttcccatcgctccctccgacatgatccccggccgcacgcctgcaacactgtacggtaagtactcaagagatagctagctagtgcggcagaacaaaattactgcatcatgtaaacaactgtattgcagaatgcagatgcatgccgaatgcgagctaggcagatctatctctagcttgcctgagagttctgctacttttacttgctttgcctcttctctgctctcccttgttgtctgtcatttccagcttgcaaagcgaagtagtagcaattaattaacactgaactctgcatgcatctcttctcaattactccagtagttttcttcttcttatagcactttacacattattcttgccatgtgcatgtcacgttactaaggatgatgactttgcttccactttcgttcattcctccggtgctatgttccaaaagaagatcctccagtgctattatcaaattaaaaagaagatcctctcacacaagttcttttccaggaaagtaccactccggcaagttaaaaggcgcgcgattggacacaaaacctctccctttggcaacatcaaggtacattggcattgccatttatcaactcctcactacaagccatgcatacacatattcgtttcttctatctcaagcgacacattgcgtaactagtcatgcatgttgtgtgcacctgcgacatggaaaggagtgaagagcaaacactgccgtgaccaagaatggcattcattcccttgtgaaaagaaaaaaatccacatgagattgatcgattgatttggccggtgattaagcgagccagatcgacgatggacctcgtcgtcggcgcgtcgagcgaagccgtgaagtcgctgacagggaagctgggcagcctcctcgcgcaggagtacaccctgatcgccggcgtccgcgacgacatccagtacatcaacgacgagctcgccagcatgcaggccttcctcagcaagctcaagcgacgggacgtcgaccacgacgagcagcgtcaggactggatgaagcaggtgcgggaggtggcctacgacatcaaggactgcgtcgacgatgtcggccaccgcctcggccgcgagccgcgggggagcggcgcggccatctccttccaaagggcgtggtaccttctcaccaccctctacaagcgccgccgcatcgcagccgagatcggcaacctcaagctccgggcgcagcatgtcagcgagcgccgcaccaggtacggggtggagaacctccagggcaatggtggtggtggcggcagcggcagcggcctcggcgtcggagccaacgctcctagagaccgtctagctcctcttccccggctgattggcaccatggagcctgtaggaatggatgctgccattgatgagctccaggagtggttttccaaagggaaggatggcacccagcagaggtacctcgccattgtcgggttcggtggccttggcaagaccacgctcgccatggcgttgtaccgcaagcttggggacgaattcgattgccgagcattcgtgctcgcgtcgcagaagttccatctcccgacggttctgaggagccttgtcaagcagttccatgagaagcaggcagacgcttctgaggataccctccatggaattgagggttggggtgatgaaatgctgaagaagaagctgcttgaacaattaacaggcaagaggtatgattttgggattgctaatatctatctcttcaccacatttttattgtactgtcttactagtcatcactccgtgcgtttgcatactcggaaaacctccaaattattgtatataaagatatttttttttcgctgagaagaccgaaggaggccatccgaatgtattaagaagaaataaaagttacaagaaaaaacaccacaatgcaccaaggtgcatgaccacacaccaacgcactaccacctaagcacaaaccactgagagtgaacgccgctaggcatacggcaacaccacagagacgagactccgaaaacgatgccaccaagatggtcacaacatctagaatgtcaccactgcccatctaaaaagatgtggttttctcccagaaaagctcatcaagaaggggagagggtaaccctcgacagtgccccaaggaggttatgacgcccgaaggcgtagccgctgccggtctggtgaacaccggactagcctttcgcctaggaccctataaccttgacagcagatcgccatccaccacacagaaccaccacatagacaaaaaaggtagcacgtagcttccaccaccgccggcctcctcgtcagttttggtcgaaggagaacccgggattgggtggcactgcttcggtagtctgagcttcccccgttgacaagctgccgcctcaatccaacctaggaactccccgcaaagaaggggaggagatccaggaagggcgagggtgctgaccggcaacgaggaagacgacccaccgccgccagctccctttgcactaccatctaggcatgtgccgacgccggatatgctgccgctccggcaccggcgccacccttcggcgccccctttgtccggcctctgcgccccacctggctgctaagggcaccgcaacggcttcccggctgcccgggcatcgaggcctggccgagccatggggctgctcgcgccggcaccagcgagacacggctgccgcgacccacgccgccgagccgccaccgccgctcccaactgtcgagccgccacacccgggttgctgcaccagcaccacaccgggcaggctgcgccagcactgcctccacgcacctccgcacgctgccacgccccacctccgagcacctcacccgcacgctgccgagccgccaccgccgtgcacctcgcccgcacctcgccaagccgccaccgccgtccctagccgcctcgcgccgccaccacactagatccaggcgcgggatggccggatccggccttcaaggcactggatccgccgcctccccacaccgccacagcgtcaccacctccgaccgcgatgggggcttcgtcgttcaccccgtccacgtcgcgccgaggagggagaagccaagaagaaaggaaaatattgatattcctagttggaaaattttgattattcatttgtgcctggaatgagcactataaaacgttattttataactagctaattacttccaaacaatgcttgaagcaggtaccatatcttggtagatgacatatggtctgtatcagcatgggaaaacattagggattcattccccaagagtgataagggtagttgtgtagtggtgactacaaggtttaactctgtagctgaagcctgccgccgtcaacaaggtcatgtgcacaagctcaaacagctcgatccagagagctcctacaatttgtttcttcagataatatctgctaatgatctgtgtcccattagacctattaatgctcgcattatcatgaaaacgtgtgggggtctgcctttggcaattgtagtagtagcagggctgattgctagtaaaatgaaatcaaagattgacctgacattggatcagcatttggttgatgtagatgaggctttaagtgcagagttgggaagcaatctcaccaccgaaggagtaacgcaaataattaaccactgttacaaaaatctgccacctgatcttaagacatgcttgctgtacttgagcacatttcccaagggccgcagtattagcaggaagcatttgataagaagatggattgctgaaggattcattactgaagagcatgggaagactgctgaggaagttgcagaagacagcctcaatgaactcattggcaggaacttgataaagcctatcaaaaacagcagcaacggcagggtgaagagctgccaaattcatgacatggtcctccagtacattgtctccaagtctagtgatgagaatttcatcgccgttattggcggccactggcagacaccacttccaagctacaaggtacggcgattgtctgtccataaaagtgataagcaagaaacagacatggtagagaggatgaaattgtcccatgtccgatccttgacagtattggagagtttcagtgctcttcattctactatgctcaagttccagatactgcaggtattggaccttgatggctgcaaggacttgtcccacccacatcagctcaagaaaatatgcaacatgtatcagttgaagtacctgggcttgcggcggacagatattgacaagatcccgaagaatatagggaggctggagtacttggaggtactggacattagggagacaaatgtcagaaagttgcctacatcatttgcaaagcttcagcgaatgacccatctacttgctggcaacaaaagcaagcggacagcattgaaattaactgaggaaattacaaaggtcgtagctctacaaacactttccgggattgagatcagtggaagctcaactttagaagaagaccgggagcagccacgagatatgcccatcagacactctacaaccaccagagccgaggagagaggcaacactgccttgcatggtccacataaagaagctagcaaagtggaccttccaaaacagctgcgtcctcttgaagccttggagaagctcaccaaccttaagaaacttgccatttacaagcttgtaaagttccaagcgaaagacgatgagttactgctctctgctattgagcatttgagcagttgttccctcaagtttcttgcaattgatgacagtttcacaggtttccttgaaagctcactgagttcttcgcaagcagcaccagaacacctgtacaccctcgagctttctggcatgttatctaaagcgcctggatggattgaccgcctgcacaaccttgagaagcttactctgtcattgacttcacttaagacagatactttggtggttctgagtagcctgcctgagttattctctctcactttttcactccatgcagcagacaatgattcaaatgctctcaaaataatacataggaatacaatgaagtcaggaggtaagatctttgtgctggatgagggatttgaaaagctgaagctactgcattttgcggcacctgtgctaccttctctgagctttctagaaggagcaatgccggagcttcagaggcttgagctgaggttcagaatggtggactatatgtatggtctggaaaacctctcaaagctgcaacaggtatttttaacagtcagcagccaggcacctgaagatactagggcaaagacatctcatatcaaacaactggcaagcatgattcaaaaggctaagaattcccctaaccccagtgtggtgatagatgagtacaacgaactagcaaaagaataatggatgatctagacataatccgcaattgcaatgtgccattgtattatcgatatgttgtacctactccatcagttgtgcctttttcttttatgactttctgatctatttacaaattattgtactttttttttatgatctgtggcatctgtatttcgtttcatctgttgtaccctaaagtctctgcaagtataaagacttatcttcagctttccttagaaaactaatcagtccagaggtgtaactagttctaataattatctttctaactcaatgtgctattttttatctctctcacgaattgcctagtataataaaaaaaaactttgtcttttgtcactaaggaagtagactaattcacttatttctatctacttcaagaattaattagtattgtaacaactaatcttgaattcttgggtgaatgaattatgattgagaatcaagcacctatcctttcctcctatgtcaagtacaagaattgctcggtggcagcagctctgcaagattatgcttgggtggccactggccaatatcagaggggggttatccttgcaaggtactgccgattatttcaagatttgggatgtggtctcagagtatccctgtgccagggattctatgctctggttggcataggctaatggcgatttctctgtcaaatcggtgtattcgctgctctgtgctcggtgaacaaagtgtgccttgggcagaattgggtgcaaatccagggtgtcggcacgttgcaaattcttcatgttccttgccatgcgaggagcttgtcttactgccaacaacttgcagtgtcgcaggtggcatttggtgagcttctgtcaccttggttgctgtgatctggaaacctgcttgcacatctttcactgttgcgcatgcacggtgcatgtctggaatgcacagccgcctgggattcatttgcccacagcctacactgcatttgcttccctggtggctcgcagtccgcaagacgatctgcaagcaggagcagagagccttcaatgcaggtgtgatcctagtgacatggcttatctggaaggaacagaacgcccgtgtttttgaggggaaggccactatggtgtttgcgctatgtgtggtcatcatagatgagtggcggatgtggaaggtggctgctctttttacgctgggcctggggtgcatggggcactgcgtgttctgatgtgagaatttttggcattgttgttgttgcggtgttaaaatctgtgatgtggcttgtttcgttctctgattgttagggcgtgctccggcgctttggtctgtaagccatgtgtcctgtaaattctgttttctcccattcttaataaacttcggccagtttctgccagcgcggaggaaaaaaaaatcgaattcttgtctcaaggattcaaccatccctgacaacttcctaaaaagtaccatttcgaccagaatttcatttttaataattgtagagttcaagtgaactctgtgtgtaacttttatatgtttatacatctaatattccttaaaaaattaaacaaaaactctttactgcaataatcttgtatagcatcttgatttgattttcagtgctaggagttctgcactttttagttcaccggaatatgacttattgtttattccgacatccaatctgttttaaaactaaatcctgatatggcaattcctcacagatgtgaacaaatcaaccaccttaactaagcacaaaaatttagtttttccctgagattttaatccagtggtggtggaactaccaacattaccaattcatttcaattaaaaattttctgtttctcattctccattttcagttagctggtgtgcagcttcatagcttgtttctgtactaaacatattgattaaaattacccccttatgttcctatgatgtgttgaactgtcaccaccatttagccacaagcaaaacgagaaaactgaagttttgcatcagatcagatgaaaaacctggggagcccatgatggcctcttgaagtcttgatgagccctgatcctcgggctagctggtagctaagccgcggcagttgaaagatgagagaagaaagacgcatcacgccaaataactgtaattttacttccccatctggctatataactgtaatttttagtgtttttttcttaatctcttgtaataaacttccttcactatgtatttatatatttatggtacactcgttccctacattctcctaaggccttgagtaggcttctgtgtaaactgaaatcaagtagaatgaaaagtaaactggaattagttgcaggagttaatatgaggaaacttacatccaaggcagaagcaaagggtcggtttcctcctcggcattctatcaaacagttcgtgggcaacaaatatttgtagccttcagaccatctgcaactgcaagctaggccccaaccttcgatctgcagaatgcatctgcagcagagacgagcgaatcaaacattgagtgatcgatcggtcggtcgccgcacgacggcggcaacgcacagcaaatcgggatggacgtgtgtcgcctgggtgagaaaagaggttttacctggagatacatgatactcctggaagaggcaagatagcctccacattccccctcctccgggcacacggccgccggtcaccggtcgccggtgaggtagccgacgcccgacgcggacacggcggcggggaggccggaaggccaccgccggtgagagtggtattggaggttggaatcgacgtttcgtcgtagccgtccataggaaaacggacggttcagatcgtggtgtacgcagaacgacaaatcaatgctgatggttaattgagttttaattgttagtattagtactataaatttataaaaatatatttattttatatacttttaaatatatatagatatatatactccatctgtttcacgacgttttgagtttggtcaaagtcaaactaattttatagaaaaaatagtaatatttttaacccaagacaaatatattataaaaatttatttaattatatatttaatgaaactatgctggtattgtaaatattattttttttaaattaattaaacttataataatttgattttaattaaagtcaaaacatcttataacctgagggagtatataaagttttatcataataaaaagctcgcggattaattaagttttaattgttatagatttatttgataaaaaatctatatcgttttgtaaaaagtatactactactaccgtttaacagtttattactaacaaaatcaatctatatctaaataagaaaataacgggaaagcagcattctgcgtggagagagagatgcttgctcgccgttgccatggcctcctcctccgccgccgccgccgccttctccccaacctcccaccactctccaccgccgctatctccaccccgtctccgcctccgcctccggatgctaccctcgatggtgccgcgcccggcgaccccggcgcgctcgcccccgacgacgccatcgcgtccctccccaccgtggcggactccgcgggctccgcggcggcgctggcgctgttccgccgcctcgcgtcgcgcccggacctgcgccgcctcatgcggctctacgtcaccgcggccaccgccttcgtcgcgagggggagcctcccgatggcgcacgaggtcatgcgggggatggtggccgccttcggcgaggccgggaggctccccgaggccgccgacatggtcctcgagatgcgcagccacgggctcccgctctgcgtcgagacggcgaactgggtgctcagggtcgggctggagaccgggagcttcgtgtacgcgcgcaaggtgttcgacggaatgacgagggccggtgtgtgccccgatgagcgcagcttccgggcgctggtcgtggtgtgctgccgggagggaaaggtggaggaggttgatgccttgctggcggcaatgtggcgttatgggttctcgctggataacgcgacgtgcacggtggtcgtgcggtcgctctgtgagaagggacggttcaaggatgtgtctgagttcttcaggaggatgttggagacgggcacgccaccgaacgtggtgaattacactgcatggattgatgggctgtgcaagagacgctacgtgaagcaagccttccatgtgctggaggagatggttggaagagggttgaagcctaatgtgtacacgcacacaacgttgattgatggtctctgcaagattgggtggacagagcgggcgttccggcttttcttgaagctcatcaagagtagctcgtacaagccaaatgtccacacgtacactgtaatgattggagggtattgcagggagggcaaacttgctcgtgctgagatgctattggtgaggatggttgagcaggggttgaaaccaaacacaaatacatacactacgcttattggtgggcattgcaaggggggcagttttgatcgtgcatttgaactaatgaataagatgaagcaagaaggcttcctacctaatatttacacatacaatgctgttattgatggcttctgcaagaaaggaaagattcaagaggcttacaaggtgctccgaatggccactagtcaggggctcaagtttgataagataacatatactatactgataactgagcactgcaaacaaggtcacataacatatgctctagatttgttcgatcggatggtggaaaatggttgctgtcctgatatagaagcatacactagcctcatttctacatattgtcagcagagacaaatggaagaaagtcagaaattttttgacaaatgtcttatgataggactactgccaaccaaacaaacgtatacatcaatgattgcagggtactgcaaagtgggaagatcaaccttggctttgagggtctttgaaaggatggttcaaaatggatgttttgcggactctataacttatggtgctctaataagtggtctctgcaaagaatcgaggctagaggaagcaaaggctttatacgaaggcatgcttgataaacgtttggtgccatgtgaagtaactcgtgtcactttaacttttgaatattgcaggagggagaaaacaagcattgctgtatcagtcttggatagattggacaaacggcagcaggttcatacagtagatgtagtagttagaaagctcagtgccttgggagatgtggatgctgccagtctttttcttaaaaaagttttggacgaggattatgctgttgaccatgcaacttatactggcttcatcaattcttgttatgaaaataatagatatgccctagcttctgaaatgtctgaaaaattctcaaagaaaatatctagctttaaagaaaaaagatgatttagcaacagccattgcttgatcagaaagggtggtgcattgcttctactgatacagacaagaaattctacagtaggtcctcaatctgacttttttcacatgctgccatattaatcagtttttggtaaaaatgtgtcctttcttatttctttactgtgctcctgttgaagaaatctttcccagttctagttggtcaaaattttgttcttatatacttactagtcttaaaatctccagttcaaggtatagacctgactttctcaaatggagtgggggagaacttgaagatagtaatggcatcttctttgcataaaattctgtgagaactgagaagaaacaaggtcattcgttgatttgatggagaaatggtaacagctcagcacttcagtagtgttttagtttgatcctagtgtttattcttctaacacatcattgtatcatttgcctacagaagaacaagtctttcttgaatacttgggagatagtagtcactaacaaaatccatctgtgcattgtataatgaaggttatttcattaaccattatactggttctgaacaattagttcaattttgtacttaagcaacaaggatgttgtttcatagaaaagttatccattattcctaccatctgaaagtttctgctgtgtggatggttaacaatttgattttatgcttattccagctattcatgtatattgctatattgttgacaagctttctaggttttatcattacatggccaaactccagtctgttttaattcttctttttatttttctttagtaaacatgaaggcatggaatttttgcatgcaccatagactacagctgtcagctttaacttgttgccgttcatggttttctatttttacattgtatattacttacaaggaatcctcaggttatccaatttccctgcattctgtttcgacaaagaaaatgtccaggtattcgtaataggagtcacactattttgaagataaattatttttacaataatctagaaatgatatgtagaatcaggctccacaatacaatttacaaatctgattcatgcagtgctgcaggtatgttacacatcaacgttcctgcttattttcattctactttctgtagacctaaatcttatatgagcagcactaactttttcctgtcttcagtggttctggctgtgtgtggctggatatggcttttaaactaccctgtctacccacaatatcagggtgtttgggactataggtatcaggctatcatctaatgtcctgcaaaaaatggggggtgattagttatgttgtctgttaacaagcaatacagaaatttttttagatgaaagctcaaccagaaaactgaccaaagctggtgtggatgctggtaagtccaggaaattactttccagctagcaaaattggtgcttgattgtattggttgtcaaacgtgggctgcctcgacgatgctgaagatgtctgtcttattttgttatccttctcttattggttctcatgggatatttctggcctccatggatctttctgcatcttgtttgtttccatgcacattgtcgtatgaaatccactctccaccactccaggtttgtgccttatagtttcattaatttttcctctctttctttggttgcatatttgctaatggtcagcttcattagtcctgtcacgctcacagctttagcaaaaatctgtgagaaaaactgttaacttcatttctttggttgcatatttgctaatggtcagcttcattcctcctgtcacgctcacagctttaacaaaactgtttacttcttgagattttattaggtcatttattcagttcacactttcatacttgtctggattttaaaaaacgtgtcatgccagaaaagaaagggaaggccaccaagacagttccggaaaccaggttaaaaaaaaaaagct

SEQ ID NO: 56957 - DNA, 2631 bp, Oryza sativa
  unsure (1)..(2631): unsure at all n locations
gctccttcaccctttcttgggaaacaagtgaagctcatgtgatacaattgtatgatcttccagttatctgccactggatagctgaatggcttcctggatattgagagactcctcactgaagctgaacagcctgcgctgttggttcatctcatgctgatgccgccgggcaagttcagccacctgccactcctcccattgctccgctgggacaacattgccttccagcatctgcacaacctctgacatagcagggcgaagatgaggctccacatgagtgcagaggagtgctatttggatcatcttctccagctgttgcaaatcgtatgcagtgtccaggttgtggtccacaatgtctgtcaatcgtcctccttgcaccaaccttttcaccttcacatgtaccaaagagtcaatcccatcagggtcatctatgtgaaaagaatgagnacaccaactttcntaattcttcagaaaatttatgttgcattgttcatacaataagtcaagcatcattcatagttatacctaacttctactcatatcaattacataggtgagaagcttttgcttatctgatcttaatatgcttccattctctagtttaataagatattattaatggtgtgcaatctaaactttctttggtagctataaacgatagtaaggtaatgtaattatatcttacttgatcattgagcatgatctcactgtctccttccgagaattcagggaacactgcacgctctcctgtcactatttctaacaacattacaccatatccaaatatgtctgtcttcactgatggccttcctgtcttcaggtactcaggagctatatggcccattgtcccgcgaaccccggtcgtaactgtattcctctctctgtctatcatcttcgccaacccaaagtctcctaccactgcttcaaagtttccatcaagcaggacattggctgccttgacatcgcggtggataatcttggggttgcagtgctcatgaaggtattccaagccacgggcagcgccaagggcaattcgcactcttgttggccaatctaatgctggttcatttagtttgatatctgcatgcataggtgtcatcaacagtactattgcattagatatttttagggtttgtatcatcataaaaggacctatttttttggtagtaacctgcctaaagaagtagataattcaacgattcaattgcctatacttcctttttatcaagacatagaaaccacatttccttctatttcctggcactgttttaactaatatacctcaattgacattgtaaatgaagatgaatcatgaatgcatattctaggaacatgctaaagtgatattcttatgttactgttacctctcaaacgggaagcaacactaagattctccatgtaagggtagaccaagagtcgctcttttgtagtcgtgcagaatcctatcaatcttaatatgttcttgtgcacagcaatgcttatcaattcaacttctctcaggaaagctatttccccttcaggtttttccacttcaaacagtcttttaactgcaacctttctgccatgtggacctgaaagcactcctttgtacaccttaccaaaaccacccttgccaagaacattttgctcgctgaaattgttggttgcaatttggagttctcgcaatgagaaccgctttatctgtccaaactctagattgtgatcatgttgacctgaaattgttgcacatgcttatcatcttggtaaaaaaaggagtctttattaatctgtttcagtccatgtgaattgtttctttagctgaatatgtttcctacagtaaccatcacacaaatgtcatgctgctgaactaacctggaacatcaacgtatatttcaggtcggtggcgcattctttgccaccataacagaaatagtactatgataacaaggagagttactgctccaccaatgcttgcaaccaccttgagtttggagttatttgatccacctgttgataaaaagaatggaattgtttattgatccaaattaagggggcaatatagattgccatgttgatttctatattacctgtatttatattgtttccttcacaagaaatcaagtgttggccacaattcaaatggttacctatataactggaattacaattgtcagtattgtgaagcactaggcgtaaaattgtttgtagaatatatccttgcccatacctgtagtgagacacctgaagcaaccgtttgggtatttcaccgctcagattgttgtctgctagattgctgcaaatcacagtgagatgtgatacatcatataatgtaactgtaatccaagcggtgatatttggcaaggtcacaatgttatcaacacagaaagacttacatatcattcaatgatgagagattagacaaagaagttggaatattcccgattaagagatttttgctcatgtccctgtcgaagatgtcccattattacggttattatgatcaactactacactattgactcataatcttacttgtattcttagaaagacacagagtttgacttacagattttggagttttgaaagacggccaagagagtcaggtattgaaccatttaagctatttcctccaagttttagtgttgttaagcttga

SEQ ID NO: 56958 - DNA, 2663 bp, Oryza sativa
gagacacattcagtgaaaaagaattggaaatggtaatattcttcttattcaatgccccatatgcaatatggatttagagcgagtacattatctaaccaagaattttgagcaatcttgttcaattatgaacaattgtgagcaagcatatttgctacactggagaaaaatgcagatgtgctaaataactggagtagtagttgtgctttctagtaggctagtagtaagtacaagtgctctagaatctgttatgcagttgatagtcaaacatttgactgatgacaaggacaagatgtcatatccataacacaccctagcgttctcagtaaatattgtgttagtcaaaaactcaataatgcaataattccagagtctcttgcagttcacagtcaaaattctcagattgattccattgcctcttctaatgccagccacatatgaataactgatgtagaaaatatatacatcaaagtgtaaaggccttaccttcggaatcaggtgtagcaaaatattgtatataccccagtaataacagcccaaaagctattagtttcatacttccttgaaaattattatcaatttgtttaattttcaggaacagaagcactcttgaatacactgtgtttgctttcttgatggaaaatagaagcactttggatttgaggtctgcactaaatagctgcatcaccgaagaataaaataaattgtgtgagactcacaaggcttaaagagtaaactgagaatacagatattgaggaatcttcataaattcctgccaaaattgaaaggaagtgctttaacccaaacaaggcaagaatctccttaaaagaacattcagactgtttgggattctttctagagataattattttatttttgttgcaaaccatttttgatttcttgcatataaaaaacatgtgatcagtcacctgactgtatgagtcttgcagcggtcactaaacctaaccggatttctatagttacactgtaatcgattgcctgtacaaatatggggtggtccaaaagaccttaaactgtctaaaaggttgtccttaaatatgaaaagtatgttactattgaaataaaggttgtcttaaagaaataaatgtaaattctaaaccattactggagaagttagaagctcaaaaaaaaagcccaaaatgatttaggggaataaactgagcaaaaggaaaaacagagacagacaagctgtcctcttctctttgcagttacgtagcagcttctcaaagttcacaccctgttctgaatactacttgcaaagaacctcaagacgcgcaaagtaaactcttctctgaattctctcttgatttccgagaaattttagctctggagattgcagacagaaacctctgctgttctgcagggtgtttgagctaacagcaaagcttcatccatccctccaatggtgatgcctcttctccccaagtcccaacataaacctccccaactcaaagaaccattaaattgagaagaaatagaataaattcaccagatgacacaggcaggtgattgaagcaaacaggcagagaagagggtagaagagaacagattcagaagtcaaccatgcttgctgttgctgtactaccacatatattagagagtggcaagaacttaccaagaagagagggagaaggactgtgtgctgctcctagcttcctaaaaactttcttctttcgtacgagagattggaggaagaagacgacctgaggtctcagagactgagctcaggccttatagacaagtcatggagctcagctgctgactgaaatcttgtgtgagcagtatttatgtcatgagagctcatcctggaggagacaatggagacactgtcattggagccatctcattggatgttgcaagtttgcaacggacggctcagatcagatgcaacagagaagattctccactgaacactcgatctcagccgcccaaaagggaattgtaaaactgcagataccttgataactttcgaagcaccgaaagactgtatttactagttgattaaccgaaattagccgaataatagaccatctacatctcctaacattttatagagaccctcctctgtgtgtgttggcatgagattttttcttagtactttttttaacgaactggaataaaacagtgtcaatttcactctgtacagatgtcaaaaagaaactttgtgtacaagcgtgaacgaagagttctttttgttagtatttggtgtggacatagggagtgttgaacttaactgttaggaatttgtgccttaaatattgttaaggattctctgcttccttgaccccgttgacttaagaaaggtgattacccaaactaccctgttcattctttaagcaacacgtactctcagtcaggtcacactcagggtgtgtgtttagttcgtcaaaagaaatttttcgggtgtcacattagatatttgaccgaatattggaaggggtttttggacacgaataaaaaaactaatttcataactcgcttggaaaccgcgagacgaatcttttaagcctaattaaaccatcattagcacatgtgggttactgtagcacttatagctaaacatggactaattagacttaaaagattcatctcgcgattttcatacaaactgtacaattaatttttatttttatctatatttaatg

SEQ ID NO: 56959 - DNA, 23193 bp, Oryza sativa
tgactgttgacttttcttctggatttagagtttcatttgtttgtcggacattgactgtttgagggagagattgatcaagggctgaagccgtgggcatgctccttcgctaccttgactcttctcgttattatcagacacatcaggtcattcaaaagcaaagaaggctcaagctcaacccaagtcataaatttatatcctgagtctacacagcccaaacaactatctcatcttgtatgttggtaattaggagagcacgaattagaaggtgggaacaatcatcatcctattaaactaatcttttgggttgtagacttacctaacattgtaactccggttgaacctgtgatggagcaggccgatgtaatctgggtggctcataattggtaggtcgggctacacactctaataaacatgactgttttatagtagcaattattgtttggtggatgtaactatatagaaagaaatgattggtcaaggaaaaagaacggtattcttttttaaaaaataaaaaagaagcaaaagaggattccctcaccccattttggcggataagattatgttattctgtataaaaaaatctgtgttcacagaaaatctacttctcaccataggaatttacaagcatagggtggataggcatccagttcttctgttaataaattatttttttagtacatatcaatacattcgtctagagttttagttttttttccttttaccttgatgtacatactcgccttaattaaaattatataccgtggggggctccctcactgttttcagtttaaaaaatgtaggaaaatgcctttgagtctagaggaaaataaggtatcatgtatgttagtttctactaaacgtatatatgaacttgatacatggtctccgctaagatatcagatagttttagccttttagcaaaagaaatacctagaaatcctattggacttagctaaaggcctaagggtgtgttcggaagtcctagttccaaactccctctccctccacgcgtgcttttcaaactgctaaacagtacgttttttaaaaaagtttctatacgaaagttgcttcaaacaatcatattgatcttttttttaaaaaaattagctaatacttaattaatcgtgcgctaatggatcgctctgttttccgtgcgcactgtttccggttgggaacgagcacttccgaatacaccctaaagcttcctatcaacatagagccaataagggaaaaaggtttcagaggacaattaataacagatgacaaccgaacctaatagcaatgaaaggtcagctcttttataaaacaaagaaatgaaattcgataagattaacaaaagggcaaaatcttctgaatgaagctcaaaatgcgtgtcacacacctcaaagattcaagcttagcaacctaatcaccaccccaactaaaaattgaccagcaagatctttacaaaaaggattatgaaatgcagtgagtgttaacggtatctattctgttcccatttaatgatgccttgcattattataaatccatcctcatccatctcccctctccaaacaaaacaaattctcttcgcaagtgtgctttgttctgtcctaaaaatagtctggattcccgtggcttttgccttttggtctcttcccagaattcagaagaacctgccctgccctaatgttgacaagatcccatatggaaagagactgaaggacatgtacagttccatcagcggtatatgtatagctggatgaccttcaagtgttcatgcacttttgaagtcctaatcaggctttccttgccccttccccccggtaaaagcggttacaaattaccaagcaaaaccgatgaaaaccagacattactacaaacttattttttaaaagttcttttgaacttggtcgacataacgaacaattgctattaccgtacacatgcggtaagcccagttaccatggtaaccgatggtaagaaaaccctattcctaatttgactatctataaaatagaagccttatagtggagcctattatagaaaaactagaggaccaaaatgtaacttattttcgtcgaattaatagtggtattctcacaccttatcttttatgaagtccactcactcatatccgatggcagtggataagactataagcagacaactagaaaagcctccaccttacaaaatacagaaagagagattcttaacacacaaaaatttacacgaatgattgccttgccattactaaaccacatagactgctttacgaatttgatacgttaggttgtagatgggtatatgcagaatagtttcaccttttgtctttcataaatactataggggtgtgtagacataccccatccaacaccaaacgtgtgcatactataaacaagctttcaattttgtggaagtgtaggggccttgtggcatcatggtagaagctaatgctgattggtcattagtcagaacaacaccttggccccaccactaatcccctttccagtttccttaatgtgagtatcacactaggatctataggtggtcatttttcttattgagtgtactcaattacattgcagtcaaggaaaaattattgagtgtatttgcatttgattgaattaaaagacggtacaattattggtcaaacagtagtcaatcgtagactttatctttggcacctttcatggcttgcaaaattcaatttgggtccatatgcatacagatacatcaaaacaagaacgaaatctggacgaaatttcatcagaagcttccaaatctcgtagaattttttgcccttcatgcgttcagacatgggtaacaatctgacactgatatcctgttcttctgcagtccacatatccatgtttatctatcatgctaattaacttaatttctcccttataatgccttctagattctttcaatttcatatgctcctctctctatgctcctttctgaattttttttcttccctgtgattgatgctgctggagatcatcatgcacaggtcatcatgcaacatcatccagtggaacaggttagatatgctgttattcgaagtagactgcaaagaataaggtgaacttttatgctcatctttctctgtcccatctgaacatttctttctcatgagttggatactgtagaacatcatgcacaagtcatcatgcaacatcactcagtagtcagtaagcaagttgatatatactacagggtgaggtttgtttggatgctcctggaaatgatctgatgatggagatgtaacaacagatatggccaatcgggagttcctatcagggagaaactctgcatgaactgaactgacatcagaaacacacgcgcattttcaggcttgaatggggcaatgccaaggttgaaaaccagcaatcaacgtagaggtttagtatacgtaagatcaagctgtaagcaacaatgattttagccagttggagctcagtactgagactgaaccaacgtcaacatacctgcccccacagcaagacggagggcatgttcactttgatgtcattttcaactatactatttttttttggcaaagttgtcaagaaatggctacatttagtttgttgctaaatttggtcaatacactagaaatcatgccaaaattttagcaatattatcatcttaccaaaatattggtattgccaaaacttggtaaggtttattttggctacaatctcaatctgaacaggccctgaaattctgaaaaggaatcattggtgagacctatccctgtaattctacagtacaaaaattgttgcgatccagaaagcagtatatatagacagagaaactaaatcactaagtctggtgatcaagtgacagtgctactacaagctctgtaatatctattgttagtccaaactctgaaattctgaatgaagtagtacaggcaaggactgaacaagaagggaaggaggaggagcagaaaagcacgaggcactttggatgtggttctcatgcttattaaagctcagtaataagttcaatggaattgattagttctgcatgagtacgaattaaattgactaaatattcaaaatcctaaatcactggacagatactctcctaggtcagagatgacatagaatgtacatcaactcatgaaatcagcaagttataatcctcaaatcccagagcaatcaattaaccggctcctctcttggattttcgatcatgttcatgacattctttatgcatcgtgaacagtggtcagtggtctccggtcgtcgccgtcgtcgtcttcttctctgatctttctcatcggatatggccatatggatggtgaaacgtgaccatggcacgaagacgacgaaagtgtgaaacagtgaggcagccgcgagacagatcgtcaatccggcgtgacgacgatggcggggctacttgcaccaagatcatgcgcatggtgatttgatggttgatgctattattaaataaaatcgatggagaaaagcaaattaaatgccaattcaatcataattactcaattcgtttcatattataaattgtcctttttcattaaacttctttaaatttaaccaaaaaatatatcaatattttgaacacaaaataagcatattattaaaatatattaaatactaattttaatgaaactaattttggtgttatagacgttaccaattttttctataaatttaatcaaactaaaaaaagtttaacaaggaaaataattagaacaacttataacacgaaacatgcaaagtacctcacaaaattttttttaaaaaatattgaatgctactttctccattttatattataggggcaattgcttatttgaccctgttttgaaacttaactaccaatatgaccctactttttctagtttgcttatttgactctacttttttaaaatgaacactccgtttggccctgttttttaacacagttaagttttcattttttaaaaaagaaagaaatgcaattatttttcgtaatgaccaaaatacccttgaccaaaccctatccatatctacgtctctccccgtattccgtctctctctctctctgtgctggcggcggcggcgactcgtggagggagagcggcggagaccgcgaggtgcagcggcgatggctcgtggagggagagcgccggtgaccgcgaggtgcggcggcgaccgcgaggtgctgcggcagcggagctggctcacggagggaggagcggaggaaacagcggtggctgccgtggggggatccgtgccggcgccgccgtcgtcggtcgtcttcctcgtcgccgagccgccgctcctccgccgccagcggagggccgcctcgtcgccggtcgtattcctcgtcgccgagctaccgctccttcgcagccaccgccagcggagggccgcctcgtcgccgagccaccgccgctcctccgcagccctccgcatccgccgccagcggcggccctccgcgtcgcgccgtcgagccgccgctcctcccgccgccctcctcgtcgccgagccgccgctcctccgccaccagcgcctcgtcgccgagctgccgtcgctcttccgcatcgcgctgccgagccgccgcttctccgcagtgctctggagagagagagagagagtagagagagagtggatatgaatgagtggtagagaatagatggatgtattaggggcattttcatcattttaccccttagttaacggtgttaactcgtcttaacggaatagggtcagctttcctcttcgattttgaaaagcaggtcaaataagcaaactgaaaaaaatagggtcaaattggtagtttgctttcaaaacagggtcaaataagcaattggccctgttgttttgtttggtttttttttttcaaattttgttaagtttgatcaactttatagataaaatagtcatatctaaaatattaaattagtttcattaaatctaacactaaatatattttgataatatgtttgttttatattaaaaatactactatattttttataaatttaattaaacttaaaaaagttttactaataaaaaaaattaaacgacttataataattataaaacggcgggagtacccgtattccctacatctcgacgaatccctgtgcttcgtactgtgctcgcaccgacgcctgaatcctctcgatcacctcatcggccttctcgaagcacccgccggcctcgaaccagtcaccggcgatctcctccggcgaggccgcggggtcgtcacgatcggccggcgccgtgaacacatagccgaactggtggccgaggttctctcgtcggagggagaggaaccaggccacgtccgccggcggcagccgcgccatcctctccaccgccgccggagacggaggagagtcctcgctctcgccgccgccagccgcatcggcgggaggcttcctctctaccccctccgccatggcttcggcggtgatgctcaccgcactttcgcctcgccgggttgtgagttgtgtgacgccacgccacctcagcagcgggagatttgggagacggttcagttgtagagtccaagtccaggaagcttccgacgagtgcgcgtgggccgtgagatccatatcttactgggccctatttgagtcgctactaatagggccatattgggctgattctatcgtgcgggatcagtacggaaacaactttggttggcccgtatgatcctgttggtcataattaaaatatttgaaaagtcctgattagaccccccgaaccattggggtcgatcgaattaccccttgaatttaaataccagatatttttcaccctcaactattcaaaccggacaaataccaccccctcacccccttgactcaatcataagtggttttggttctatgtggcaatccaatcaacatttctttttaaaaaaattagtgaggttcacctctctcacatgagcctctcacaatcccattccccaccacctctttgggtctatttgtgggagcttctagttttgcatcttctcccagaatcaaaagctcctcaaacagtccagcttttggttcagattctgagaagttatatctatagaatcctgaaaatgaactagaagcctaaagcaggaaaatcaagctttttcagattcttagaagctagctaccaatcagctgcttctcagaatctttaagctcccccaaacataccctttgtttcctccccttgctgacccgcagcaggggctagcccgtcgagcttgctaatcgggcaagcacgccgccaccctactgctctcctgcatgcgctcactcgacggccagtggcggagctagaagtcacttgggacggcgctgcggcagagcttgagctagcgcggtggcgactgcaacggtgatggagcctggaggcggtggaactgaagctaggatggaggcagctgcaacggtggtggagctggagctcatgcgaagcggcgaaggtatgccatcatctcgagttctctcggcgatatcctctcccagctaggggtggcgctatagccatgcattgggccccactgaccctgacaatttctcatacccatagtccctaacgactgtctatccatttgtcgggtgatttctaaccaaaaatcacccgacaaatggatagacagtccctaaaaagactagacgccggtatagatggccaaatgggccgcccggcaaggcccgacccaggcacggcgggactgggctgaggtcagtcgggccggcacggcccgacctacacgccgggccgtgtcgtgctagcccacgggctgcacacacggcccaggcacagcccagtaagacttggaccgtgccgggtgttggtattttttaacgacattactagaaatataattcccagcaatgacgcagaaatactcctggtatattatggttacaaagttcatccgcaagcgcacgtatataccattgtagtatatcacccgagagtattcgaagggtatcgtatttatttaatcccgtgggaagatcatagtagagagaaccggactaataatttataagttacttgtaataatcgtagcctaagcaggggttaagataatccaagggtagagtgacacacaagcagggctactcattctcatactaaaatatctaagctaagtgaaaagaaaatagaaagagaatatattcttatacttctagtatacatagtatacatacatcctagttatctatcatactagctaataccctctatccgatgccctcctggtacttcaagaagccacccctgactatcgagttccttacgacagcccgtcatgaccatacaaccggggctaaatacggaggagtaccctccctagaaaattaacttaggactgtatacacgcgcggaggaatacccgtactgagctgtcaccattagcggcccacctctcatccgtagcatataaccctaaataatgatatcccgttatctagacaccacacctaaactatcagatactactctaatgccatcgtcatgacatagagtaattgcataagcaaacactatacccgtacccatgcatctcccagataagctagtataattagtgtacatgaacataatgtaaagctagcattcatatacttggaaagtatttcaataccatgaatgtatatagaagagtattctaataaaagtacaaagcttacaaaagagaaaagaagagctactagagccatacccgaactcttccgaaggcttccggacttcgatttctactctattcctattccactagcttgagaacactaaactaacttgagagaatacgagagagctcttgcttgaggtgtgtgagtgaagtgaggataagagctcattttataggcaggtaatgacggttagaaaggtcggtaataccctccaactgtcattggggatcaatcctagccgtccatcaaaaccctgcatccattggctccacgggaggtttggccgaacccaatggttctcccgaaccatgggtcgggctggcctggcccaaaatcggcaggtcgtctcctcttttgctctcatacgcagacttgtgaattttggcccagttcatcgtgtcaattctgagttcttggctcattcatgcataagtctgattcacgacatcgtccgattgatttattgtctgagttgatgtcgattctcctccactttatggttattctctacaaaaggtaagtgaaccaaatactagtggaatattattattctaacatggatatgcattacaagcataattagttctcctctatttcggtaatattgacggtcgaaactgatcgctaacgacagtcaacaccgggccggcccaaaggcatgacaggccatcgtgcttctccacaaaataagtctattttatattcctcttctctttgggccttgccttatatggttaattaagtctattttacatccctctactatttttttcgcgtgccgtgctaggccggcccatcatgccaagggagcggcccaagcatggcctggctgtcgggccgggccgacacgagcacgagtccagtcaggctgtgtcgtgcttgggccgggccacagccctcgagctatatggccatctatagacgccggtaagcatgttttgttacagcccgattagcaactagaaacgacacgattgaaattagcaggcaacagatagaaattagctagcgctaaagattttatgtcagcccaaaggcctaatatacatatatgtttgagatttgagcccacaaccacaaggcttgtagcgggcagcccacaagtccacaaattctacctgttgcatcgttttcgtttcctccgagcgcttcgcctagcaccgccgcacgtcttgacttctcatcttgtcgtcccctagtcgcgcacacgcacatcgctgccacatccaagattccaggaggcagaggtgtggagagacaaaggcaaggatcggcacttcggcagaccgcagatggctgacggcacgagggcaattggcaaggtcgagccgccgagggggcgagctgatggcgagttgatgggtaaccgattaaccctgtcataatttctagattattatcacaatttggaaattagggttatgagatatgaattttcgattcctttatacttaagttacatggtcatcagtcatgtgcgaggagaatattaaaacatagtaattttgttctttccagcagagtggaatataaaaaatcaataattttagtaatcttagtcgtgagtattattacgcaacccctcctgctaccgaggtagtccaagagggattgcataattctacaaaagtggagacacaagatataagggtgtggtatcctttctcattcatccattgcattctcaagtgtacaatcctcctctctactcctctatttgtagccattccctcttccaccttccatgtttagtgatgggcccaattagtgggtaaccgggccgggccttcatgggccggcggtttcctaacactcccccttgggctctcactgtgtgatgcctatgcctcattaaaactccacaaaaacccagtgggaaaaatttggagaaagagtacatagcatacgcttgcaatgtcgtacgaattgcctcgttaaaaaccttgataagaaactgctaggaaaacttatccaagggaaaaagagtacaatccacccaattctctgttcaatctttctagattgattttgggtacttgattttctatatcaagattatagaatgagtcagcgaaattctccccctgaattttgcatttatctaagtctcattattccgatttctctgacacacgtattcaagagaagatgtcaataatgagttagtggacaaatctgtaagacttccacatgacttagttcgtagctcctatgtaattcatgcacatagaaaagcttgggggttcatgtgtttagtgagtatgcttttcacgtaactcatttgcatatgtgcgacatatgctgctttagtttcataaatggtggggttgagatagtttccaaatcgcgattgatgtcgcgggtaaccatctctcaaaaccatgctgaggctctgaatagttcaacgatgtttagttcggtttagttcaattagcctagtatttgtgtgctactatgacacttgtgtttgggaattccgtcccattttggcgataattgactaaccaaagctatgcaccatgaacatttctaagtgcggttggagtgatgtactagactttcatctgtcgcatgcttttagctgcaggtgtgagcatgatttgggtttggccaaatatttcaaaattaaacttaaattcaaaacgaacgagtttgcttcttcgattcttttctggtttattctttctatgttggttcgggacctagtacttcttcatgtactattatgcaagtgtccgatccaagctcctgaaatgcattcattgattctatcttcaatgcttatcaatattcaggttgagttcttcttttcaacttctagttcactaatttcattcaactccaggttgactgccaatgacttttgttgtctaaaagagacatttgcccataaacagtctcattgctaacttctattggttgcatgagactctatgtgaatatccatggatatacgaggagatgcattttcatatgcttcatcttcttctttgcttaatacttcttgatgtgggcatgtaccagcgttagtgtgcactccaatagctggttttcttccttgatggaaggtgcggtatgcctattctgaggtttcgtaccgtttgccagatctcaactggctctccttctatttggtgggggtacatttcgtgattttgagtatgatagtccctcttgccctgttttcaccagacgtctccggttactttaggggcatgaggagccagagtttcttgtccaattctttttgttcgaggcctctagacaagacgaggggtacctttactttcttcggtatcaccctcctccggtgcatttcgttcatgcaacttagtcaaactcttcgaaatcacaaaagtatttacaaagtggtttggcagttttaattctttatgcaaactgcattcactagtgcggtgtaacatgcattagtcccgaactatcatatttcctgacatttcctatctaggggttcattctctccccctaaatgactggaaataattcttatttgtcaaggaatttaggcttcataactatctccgtaaaaggtttccgactttcggagagagcctattgcaacgcattatgatagtggaatatgcacataaactaaacagatgcaatagcactagttgcaggatggatgttcatgccgatggtctgaatttgcttttagagtccgctgttttcaggactacatgtccttttctactgcggtattacaacaatgatatagcaaatattgcaattcatagcttatagttagtccgattatgcggatatttggtatttcgtgctgccagttcaccaatcatcaaatgcaatgctagcattgtcctcgcggacttctgaagatgatttagtgagttctattggagttcacatgatcttgctggatcagtcttggcaaatacacggtgtctaagagacactggatgtttgctgcttcggaagcgcatttatccatacagtaccaaatggaagccgcatatattcttcgcaatccagttcagggatgctagaacaatatgcggtttatgcattgatctcctatcggtgcatactggcacacaaatcttcatgatttaggaaaattatacatatatgtgctatgaccatacgagttgtaatatttatgcctataattctaagaccgaaaatggctgaaaatccattgctaaaagggtgtaacttaaaacatcacactttttagagagtttaacggggttgacggacaatagatgcttctaaaaagtgcacaattgttccataggtaatatgactgtggtgcattctaggccgacaaattcagttgttgctgctagcaacggtcataatattttccagttctatagggtctggaaataccttcttctcttaaagtgttatttgtggttatgtggaccacaatttattcttttcttttatgtttgggtgctacacaaaattcaaagcattgtaactatgtgctataaaagagcaacaaaatagtaaatgccttaaatatgctattttatactagaaatatttttttattgcggggaaaaatgtgtgctctacatgggcaaaggccatttattcaatccaatattctatttcacaattgcaacaagtgatgacgaagtatattgattcaacgaggtattctggtactgcggattcaattaacttcatagcgagcttcttgctggatagctatggcaattatttattatcctaacatcaattttagggccgatccaatatagcataggagattcttcgtccatagccatgcaaataggctaggagctctccccctcaattcatgatgagtgtgctattaggattgtccttttcttttagtgttcatagttctagattgtttcaccttgacctatgttctactcccccttttcttcttctccgttgaggtaagtgcaccaggctagctgctagtgttgaattcgttatcaactgcgctagttggttttggaagataatgctcttctactgaacactatcccgaacgttacgcaattccattatcaactggtaaggcatacttcttgtatgtgcactagtgatacttgcgtgcaactttcgtcgtgttcggctagaacattaagagtttcagcggtattcaatgcaatttgatgcatcgtgttaccatactctctctgggtcatctgctcggtgaatctagttgaaaatacccattcttgcttataattcttgctctatgagaggtagggtatgtaccatactcttctaaatactaacacgcttattcttctagcctactcattcatgagagtagcttggaggcactggcgagagtttgaaatgctagatcaaactcatcgagtcaatgcctatagcgcgattggattaacggtaccatagagcttcttgctctactgtaattaaaatatgtcagagatactctagattcaacaaattttctaatccgtgatgccagtcatctttcgttattcaaaaatatgcgcaaattaaatgctggtaaaatgcacaagtgttgcaatataatggtacacaaaattcccgcaaacaattccagtatatactatgaaattctattcattttaccgcaacgatattaattaaaagtaataaaagcatcacaaataatcaataatcgtaaatgcgatagataaatttcataatcatatatatcagcaataaaagtacctgaaatacaaagttgggttcgaaattcaatgtcccgtggctcttttatgcgagaatatgattttggtgatatttgcaaatttcgaatgccactcaaacaaaaatcccaatacagagggttaattgtgtattttctgaaaaatctagggtttataaaggcaaatttcctatgcagtagaatatgcacttaatttctaaaaaatacgagggcatttgcaaaatcacgggaatctttccatttttcctttttctttccttctttttttttctttccttttctcttccttatgctttccttgttttctcctcccccgattgcgtcgcctgccatacgcggcagtcggccggcggcgagcggcggcagtgcacccgtgcggcggggcgcggccgaggcggcagcggcgcgggcgcacgttggcaccgggcatggcgaaccaagggcggcgcggcggcgggggcgcacggctatgccgcggagcggcatggcgcggcggccaggaggcgcggtgcggacgcgcctgtgcggtggcggtgcggccaggcggcgcggccgtgcggcggcgggagcgctggccggcggtcgcgatcgtgcggcggcgcgagcgcgcggcgtggcggtggactcgatggcgcgcggagcggagtactagccggccactcagtggcctcggcggcgtgcggccgtgcggcggcagacgtcggtggcgcgacagccgaccgaggcgaagggcgcgcgcggcgtgcggcccttcgtgggcgcggcggacggccaggcggctcacggcgtgacgccgtgcggggcggcatgggagcggtctgggcggcacggggccgtgcagcggcggtcgtgcgtgttgggaatagtcccacatttgaaagtttagggggagtggcaccaacttaaaaagggaggggtccctcacctcatgagctagcttttggggtgtagaaaggctttctcccggttgggccaacgtctcccggttttgggccaacagtgcgagcgcaaggcagcgaacgcggccggatgcggcgcgcggtgggcttgccggtgcgcgacgtagcgacctctgctcgggatcgaccgggcctctgcgggtggtgaggcacggcgcggcgaggccgacggccggcaggggggatggtcgtgcggcggctgcgcgttcccccctttttcctttttttcattttgttttgtttcttgtttcctcgcggtgcagagcgcagatcgacgcagctcacggcggcgcgttgcggacgcggccgtcgtggtgtgaggcgtggtggccggtgcgcggccagaatggcgctgcttgtcgcctgggtgttctccccttttcttttctgttcttctttttctctttcctccatggccggtgccaagagtagcgcaagcggcggagcgacaaccgacggcttcgcagttcgtcgcttggcagccctgcggtgtgatgctcggtgttcaacggtgtgttcgaccatggcagccaacggcgagtccacgcgatggcatgctctgttgcctgtccccgtctggcactgtgtggcagaggcgcatctcgtgcggatagaacaccccaatcggcttgtgccggtgactccaagtcggcaatggcggtgttcatcgggagtcaaagaaaaccagaacgagaacacagagaggaattcgttttcgcgattgaatcagcgggatgcaatgcaaatcttcgagttattacccttcttctttctcggtctccggtagaacatcgtgctgataacgtattacgcaacccctcctgctaccgaggtagtctaagagggattgagtaattctacaaaagtggagatacaagatatgaggttgtggcatcctttctcattcatccattgtattctcaagtgtacaatcctcctctctactcctctatttatagccattccctcttccaccttccatgtttagtgatgggcccaattagtgagtaaccgggccgggccttcatgggccaacggtttcctaacaagtatttgtgcatttaatgtctactttatttacatattactatgtccggtttttaataatttatacatatatccatgccttgcaacgagagattcaattttctattagctaatgattgctcataacattatttagggtgtgttcggcacccctttttcccaaaccatctctctcgttttccgcgcgcacgctttttaaactattaaacggtgtatttttttcaaaaagtttatatacaaaagttacttaaaataatcatactaatctatttttttaaagaaaatagcaaatacttaaataatcatgtgttaatggactgctccgttttcatgttactgttccgggttgggaaccagcgtatgcgaacacacccttagttttgttgggtctgctttctccagtttttttttggtttttttataaggggcacggtatgcgcatgaagtaggtgagaagggtggatgatcaactctgtttttatgtagtagagataagtaggcaagcaaagcataatggcgtgattcttaaacaggaaaatacacatattttagaagatctaacaatgcatcaaacactaggttagtactaaccctatacaccatttatcctagcttcgcccatgtcccagcatgccgcatggatgatggtcacgatgaaggcaccaccaccttctctgcccggaccactgccactgccatcttctccgcctaaaccaccgttgctgctaccttctcctcttggaccgccatcgtcaccaccttctctatatggaccaccaccaccaccaccgccaccctagaggaaaggggagggaattggaagaaagaaggagaggggaaagggcatcttgcactcgaggaggctgcagagctcgtttgctcctcagcctccgccggcacgcgttccctcaagagttttgaatccactccccatatatggtttataactctagatattgattccataataaggcccaattccaacatactaccttgcaaagataattctcagcagctggtaaatatttccatgaatgatattatatatgtattatatgtattgaggaacgagacaagaaatataatgcgacaattgtaccattatacatacgaataagaactataaaccatgtaagggcgtgtttagttggagggaaagaaaatttttaggtgtcacatcgtacgtttcaccagatgtcggaaggggttttcggacacaaatgaaaaaattaatttcagaactctccgggaaaccgcgagacgaatcttttgagcctaattaagctgtcattagcacatgtgggttactgtagcacttatggctaatcacggactaattagtctcaaaagattcgtctcgctatttccccataactgtgcaattagtttttctttttatttatatttaatactctatgtatgtgtccaaagattcgatgtgatgtttttgggaaaagctttttaggaactaaacgggccctaaatgttaagatcaagcaatatgcatagttaagactagggtgcgggctgtaacctcttctcggcgcaattgatgtcagctgtttgtgcgccgttgttctgggccacccaagcgtcgttgttcttggccgcccgagcgtcgttggctggttgttgaactcgggatggaccctgtgaggattgtccggctgcggcaggaaagccgagttgaggtactgcatttgtctcgcccatgcatctccttccggaaaggttaatggattgaaagtagtcttcctgagcaaggaaccaagtgcattcaagtgttgggctggtgtcggttagagtcttcaggttcacgaggatcccccagatcatccgaacggatttcgccctcttcagtcttcatgcacgtccgccacaacgccatcgatcatgttcacttcacttgaaaagttggatcttgaagactcttgatcgttgaggctgtgtatagcggagggctcacaaggatctatgctggcatatgcgatcatacagtcttgggtcctgcagggttgtcgttgttcacacgtgcagctcgagattgatcttggtgtcggtgaatcacacaacaatgagctcgggtcgtagatctagtaatcatctagaagaccttgcagctagtaagggggtgactttttggtttgtgaatcaggcaccactccttctatgggatgtgcacgggatagctcgattttcgcaggccttgagttccgctttcacatgaagtatcaccttgcagtcgatcaaagggtgctgcgatgtctcgtggatcgagcaccaggtgttgtcgttaggtggagatttcctcattggcaccggaccattgtcagatgtcatgggcttggccgcttttggaattttctgtagagctgaagttgtcggcgccctcttttctgactggatgtgaggagcggccagcgctaggttgtcttccattgtccttgcaatgttgttctcgatcctaactggctttggggaaggcgagattggagttgcagtgaaaacagggaaaatgatgcatccgacttgagtccatgcaaacattggctgggtaagatctgccaggccaagaggactgtgggcatacactactacaaaaaccctcatagagaccagctcataggtgccggttcatttaaaatcggcacctatagagctttccccactcctcgaggctgaaaaattgtagaaccggcacctttaaacactgtagaatcggcacttatactataggtaccggtttttttaaaagaactggcacatataatatgttataggcaccgtttaattaaaaaaccggcacctataatatattataagtaccggttaaataaagaaccggtacctatagctttgagccgagccgtccagccgatcgagcccatccgcgcggatccacacccggcgtccttatctactccctcgagcccatccgctctcgcatctctctctcccgcatctctctctctcgacatctctcgctctctctcgcatctctctctctctcgacatctctctctctctcgctctctccatccgcgcgagctcgcaggcgatgggtggcggcggcggcgccctcccctccgtcggatctggagggaggggaggcggtaggcggcggcgccctcccctcccgccagatctggtgggaggggaggcggcggcggcagccgccgccgccgccgcccggaggaacggaggcagcggcagccgcccggaggaacggtggcggtgtcctcccctccgccagatctggcgggaggggaggcggcggaagcggcggcggccgcccggaggagcggaggcggcggcagccgctcggagtagcggtggcggcgtcctcccctccgccagatctggcgggaggggaggtggcgttggcggcccggcggcggcggttcgttctttggtttttttttatgaatgttgttttcgatgaatgtgatgttgatgcattgtttgaatgtgatgaatgtgatgaatgtgatgtatggatctgagaaatctttgggggaaatttgggatttggggaaattttgggatcggcttgacggctcaatgcatcggctcgatgtattgagccgatttttttttgctcatgggcgcctcaaaggtgccggttctatttttgctataggtaccggttgctagtattggtgccgacctattggtgccggacggaaaaccggcatattgccagtttccaatcggcatcaataggcctttatgtactagtgatagttgtcggaaatccttgagcttgaagccatctcagcgaaaccttgagcaccaagtttctctagctggtgcgccattgtcgacggggacacccgtagaccgtatcttgagggtattagggtatatcagtacgaggatctatatgaaacgatatcaaggactccctaaatagtactctgactccgattcggggagatgatttccttatacactgttaaattccattatctctaaggtaaccttcccgtatacttaagggtatccttacccatatacttcattacacaaggatagaaggtatgccttatttgtataacccttaaaatcatctatatgcttaagtggatattccgatgttgattttgctggttgtcgaatcgacataaaaaatactagtggaacatattattttcttggtacatcattagttgcatggtcttctaggaaataatctagtgttgctcaatcaaccactaaatctgaatatattgctgctgctagttgttgtttatagattttttttggcttatatcaactttgaaatattatggtcttacttttgagaaagttcctctcttttacaataacacgagtgttatttaatattgctaagaattctgtacaacactcacgcacaaagcacaaagttgggtttcaagtttagtcaagagttttgtgaggagtactattgttgcactttgtaaacatgaatagaagtaataaagttcaatctactttgagatatcttcgatatgtgtttgctcgtgtttcggtagtcacaccgacgagtgtacgacggtccgatcggcggcggcgataggcgacttcggcgcatcagccggtcagaccggtgaatctactccgatcagaccaatctacatcgtaacgagagtaacttttaattccggtaaaagtttggttttttagtagttcgatcattcacccctcatctggttggcttaattagttctttactatactgtggcgatcccacattagtagtgtgttccacttaattgattgttgattgagtgatttaacaagtgattatttcatccattcattcgcatatagtacaacgtaccggagagttgatcgatctagcatgcccgcgagagcatgcttaggtcaccagttctcaaattagcaattctctctttaccacataggtaaagcatatcaaaccttctatcgatgcaaaataaacactcatgtgaacttggcgcatctttaaaaaaatccttagtccatatcatcgaattggttcaaacttatttatgatgtttgtattatatttgggaagtataggcacatgagaaatattcccggagagatgaaaatccatctatgacacaaagtcatggctgtgtttagatccaaactttggatccaaactttcaactttttccatcacatcaacctatcatacacacacaacttttcagtcacatcgtaccaatttcaacccaaacttccaactttggaaggaactaaacacaaccaaaaacagaaggtacagatggtcgatatgatggaggtacactcaaacaggaacaacatagaaaccaattgcgtcaacatacgacgaggtgcgtccaaagaagccaactatgctgccatcgctgtgcattggagcctcgaaacgagttccggttccttgtccaaaaggtccatatctatcagcattggtggtaaagtggattgacgtgataacactggagaatttaccaaatggaccaattgtaccatatactttcgtcacgaattcggaagggccaagctcaatctgcaagaacaagattatgaacgtggttgaaatactttttatctgagtttcaagaagaaatgaacgtagaacactgaattaatggacacctaccttatgaattctgcctccattcccgccccacggacctgcagcgtgcttgtgcccattcttgtcagcatatgtgaatgcaagtgagtcgacgacagcaccacaactaattgttatactctccagacgttggggttgcatagtgatgtcgatgtcctgagcattccctccatttccaccccacggcccaatcttggtgatcccagcctaacaatcgattgcaaaaccacatagtgaactttaaaaatatttctgaaacatatatagtgggaaaaatagtctaaactctcaaaagaacattccctcgttgtatgcatgtcatccaaatggttatgaaaaaaaaatcaacaagagattaatatatgataaatcactctacaaacttgcaagttaaaatttaactttacaacttgcaacgaaaaaacaaatttgactgcgactatacgttaactagccatagtttaatttgtttttttcattgcaatttttagaagttaaattttaactttcaaaatgtttgtaaagtgatttatcacatattaatctattttgttgatttttttaaaattttttataatcatttggattacatgcaaacaacgaggggatgtgtcctcaagtgtttagaatccacacccagatatcaatgataaaaaggaaaggaagatttgaatcaaagtatatgtgtgtgtgtatatatatatatatatatatatatatatataatataatatatatatggctgtgtctcaaatggctgaattaagtctatgttggatccctcaatttcttttctttgaccgtgccatgccgagccagcccaccgtgccgagggagcagcccaggcatggcccggctgtcgggctgagacggcataggcccaatcccaatcgggctgtgtcgtgtctgggccgggccaaattcctatgccttatgccgggcctcgggcagaaacaaacacacacacatatatagacacacacacacctacctcttgttcgatcttttcttgttcagggttgatatagacgccgattgcattgacatacagatctcctcgaccgaagaagccaataatgctggcattgttacgcattggaacctggaaaggagatccttctacttgaccgaaaggtccgtaactacgggcattagtgatcaaagtcagcgatgttacgacatcttttgcaagggtactggatggaccggttgttccagaaaacccaatcagaaa

SEQ ID NO: 56960 - DNA, 21179 bp, Oryza sativa
ccatttggcgtaaaagaatagactaaaaaccgaaagcctgatgtttcaatagtttgtcattttgtcattgactgtgtattttgatccatcaaattgagcaagagaatatattttttttgtgcttagatcctaaaattaacaagtccatcacttaccgtatgagtattcccaccaggacggccccatggaccagcagtgtgctgatgcccgctcctgtcactatatgaaaatccgaatgattcgacgtagtcagaactacatattgccacactttcaagtcgacatggtaacacgtcgatgtcgtgtgcctccccttcatttgcaccccatggcccaatcttaacaaccgcagcctcacaaatgcaaatagatgagaagccaaaagttagaacggaaataaaaaaaaaatgagagagagagacaggaggtgtactaatcaacagagtacctcatcttcgtgtgttgcatcctgattagggttcacatatatgccaaatgcgtctacataccaacctacacgtccaaagaaaccaacaatgctgcctttaatttgtataggaatctggaatggggttcctcctacttgaccgtaaggtccgtaagtacgggtatttgtgaccaaagtaagtgatgttataataacaccatatggtgagctagcgattgttccagaaattcccgttagatactctgataggctgaactgaatctgcaagcatttcaaggagaaaacatggattatagcagaagaaacggaaaactaagcaattagcgcatatgcgcgcgcttttcttggctttcttgtgagaattcggaactaatccctctattaaaaatcatcgcaaactttttaaagtcaatgagacgtggtttcaactatactccgatttaactcttgtttataaataaagtattttacataatgacatataatatatattatatatggtgttggacgtacgcatgctgaccgtggtccgacgactatatattttggtgtaactctgatacatcattaacattcataagcccaaaacatgaaacaacattcctttttacttattaacggggtaataactttgaccaagtacatttactcttaactgtatgtaatgaattgtctcttaatataacagcattccttttgacttaaggcagtaataactttggctaacatttacactcaccgtatggttgacacctttatcaggtccatcaccgccccatggacctactttgtgctgctgtccattgtagtcgtagtatgagaaggcaattgagtagatgacttcaccacaaccgatcatcaagcttcctagacggcagggtgccacctcaatatcacgataattacctccaattccaccccactgcccaatcttggcaatcctcacctgagcatatggtaatgaaaaattaatgtactactacgtcgtaagacaaatgggacagctagcaatgccaccacacactttttagtggcagtactacttaaaaattaacactaaaaagtgtggtataaattaatctatatttttcttcagaagaagttaatgtatattgcgaagcattatcattgtcatggtggaatcctggtgcaggactatccaccaaaatttaaatcatggtccacataattaaatatggttgtgtacttgtgtgcagctagccctagttgttatatataattgctttcttttttttttacctagttgttaaataaagagaacgaaaattatcgcttcactatccaaaatagaaaaaaaacatacatgggggagataatttatactccttcggtctctaaatatttgatgccattgactttttcaaacatgtttgaccgttcgtcttatttaaaaagttttgtgaatattattaaagaaacttgagtagtagtagtatatttaacaatgaatcaaatgataggaaaataattaataattacttaaattttttgaataagacgaacggtcaaacatgttttaaaaaatcaacggtgccaaatatttagggacggagggagtatatagtcgggtataacatttttgggaagtctgctatatgaggttttcagaaagcatgcctagaggtttagcaatacggtgcgaattataattctttttagttcatttgttacgacaatctgttgcatgccttttgcatttgattccgtttggagtgggggcacttttagtagatgatcatatataccttgttccaggatgacattgaactactagtttcgtctatctgtttcaattcacgaataatatcccgcatactaggtctattctttctctccacctccacgcaacgtaatgctatttcaatgcatctttttaatcgttggcaatcttcttcggttgatgcatagtttgatgttgcctccatcctatccctccatttcttgcatacctgcaaaattgtaatacaagctatagatgataacatataccgttgtttttctggacaaagtaacatacgaaatgtcttgtaaattaaattagcaaacattcgtcgcctgcccatggggtagaggctgtagtacaaatcctgctacctattatatataaaacctatcatgcgaaagtgtaacgtaataatggataatatttgatgaaataacaattggatctttatcaaaggtaaaaacttttcttacaagctcaataaattgttgggggggcatgtcatcacatttggaatatcccaaaggacctgctattatctgcaggattataacacctaagctgaaaatatcatacttatttgagatttggcgtctctgtatatactccggtggcatgtaatacctgcatggtagcataaatgccaagcagaatgcggtgtataatttcttaaacaggcactgtttgactgattacataaaaattaagaagattgagtttaaataagaaatttactaactcggtgcctttgcaattcctggtggtatgagtttgtgttccaccgaaaagccttgataaaccaaaatctgcgatctttgggtccatgttcttatcaagcagtatattggcgggtttaaggtctagatgataaattgactctttcaatcgctcatgaaggtaatataaaccttcacaagtccctttgattattttgtaccttgtgcaccaatcaagtccatgagattcttctgcacaagtagacaaaatgcatctaacttacgtttttgtaaaataggtaaaaccaaacctctgcatccaaccggatggacacagccaagcaaaccaactaactacaaggtaaattgaagaaatcatgtagttctttctgtaatcaaagtgcaacgtaccacatagatgcttgtcaaggcttccattctgcaaatattcaaagcagagaactctgtatatgatactggaaaaaacaaattctcccttgcgctcgatatgcgttttatgtacttgataacaatatccaattaaccttacaatatttggatgctgaatcttcataaggttattgaattcattcctaaattgtgtatcatcaatccctgacatatgataaagcttcttgacggcaatttctgtccctgctctttccactccctgtttgtgatatatatctaatagattagtatcatatatactcctggacaactttggctacactttcttactttgtggccacctagggtttatccaatgactaagccccctgtttagatcccaccctaaaattttacaccctgtcacatcgaacgtttgaacacctgcataaattattaaatatacgctaaaaaaacaaattgcacggattgtgactaatttacgagacgaatcttttaagcctaattgttccatgatttaataatatggtgctacattaaacatttgctaataacggattaattaggatcaataaattcgtctcgtggtttactgacggattctgtaattagttatttttattagtgcccgaataccccatgcgacacccaaaacaatatccgatgtaacacgccaaaactttacaccctggatcaaaacactcccctaaatatgcactgaaatttggtttcaggttgaaatcataatggatgtgacgtgttgtcgacatgcatgggtgaaacacagtggcgcatagtgtggaatttatccataataaacatacaatcacaaaataagttgtaccttgtaaacttctccatacccaccactcccaacttttctgctgtctgaaaatccatctgtaatttcttctaaataacgtaatggtaaatcacgtgccgtcatccgtgaatgatttcacttccccctggttgttattataacagtgttatttatcagccggccgctttcacaccctttttaaatccactagaaaatatttcaaatatacaagaagataaatgcacgatttgtgttttttctaggtaaaatgttgcaacatgcatggacctttaattgctcataagcaaaatcatcattaaaccatgtctctacgctaaaaatgttgcattcacagaaaaaaaaaatggtcactatggaatgctagatacgtgttaggtatatttcgggaacgtgcgactaattcattcttcgccaactcaactaggctgaaccgctatcaatactacaaaacatcaaataaatatcagcactataggtaccgaaagtgataaaacgacacatataatgtcttagccacccacgcgccgacccacgcgtccgtgagcccggcaaaataccaagaaccggcatctttatatcctaataggtgccactttataaaaaaacagcatcttttacctttgtcagatatagaaaccgacatcttttagttggtgtgagacacaccctagacacttttgtgggaaaaaaatagatgactgttcctttgtcagatatagaaacgggtatctttaagttggcgtgggacccaccaccatagaagcggcacttttattgggaaaaagaaatagatgacggttcttagaggaagtttaatagtatagccaactactagctccaaataatttatagtgaatgtaatagctaattcatacaatagttgtttactatactattaatatctaatcctacctatcataaacacattacgtcttggagtccgtgctgtagctggctacaaatctatagcccgctgcttttatctcttttcctttactggattgtttagcatatactaaggttaaaagaaaaagaatataataccccttaattaataatacatagttggatgtgggatggtggttaggggtagaatgaggagaaatttaaattggaagtggttaatgtgacatgtagtacttcaaaatgacaactattttagaataatttttaaatactagaaagccaagtatcgtgggacgtaggaagtatgcttatagaatgctattgtacggtacctgctcttagtcaaaaccgacgcttttcatatatactgtgtttagtttccccctattcccaactttccatcatatcatatcatataaaaacttttttacacacgtaaactttcaacttttttttctaaactttcaactttttttagaaactaaacacacccataatccgttggtgtctggctgtaaagtcaaagtggtcaaaggggaggggagatgtgggtcccgcgggtcccacttccttttctcttctttcttctagtctcctgcttctttccttcctcccttatctcttctctgcttctcgttcttttctctctctctctctctctcctctcgctctttctttctcttggccgagcggagcagcaggggcgggctggcacggcggggcggcgcggaggggagagggaagggcggcgccgggcaaggaaggggaggaaggtgggggcggcggcggcggtggaggccctcgcggccggctcgacctggtgagctctctctctctctctggaacacgaaatgtcgtctgctcagcctctattagggcatcgatctgatgagggcctccaccaccactttgccgagttgggatttatttcagattctacacgtacctagccctttgtgttagagagtatatagaatggaaccctataatatatagaatcgaaccctttgtgttagagatttaaaatagaatgccatctaatctgtttttctgatcttgagagatctgtcgatttttttatatgatatgatgaaaagttttagtgtcagcaggtatcaaagattattgtgatctaaatgcagttgtctaccttcatccaatgtttctataaaataaattatgggctgcactagctatgtagtgctagaagtgaaccatttaactttcgccggattgaagtgaaccatttactctgtaatggctttggtttagctagaagtcaaccattttactttgtaaggccttattcggattagaggatttctagaggatttttgaaggaatcctgttcaataggaatttttcctttcctatcattcggatagcaaaagtggatcacaggaaaaccaagggaaactttccaccgcccttgattccaagggagaaacgcaggaaaaaatacatggactctgacctctttttttcatttccttcacgtaagaccgaggaaatcaagccctaatcagttggagtgacatgatgggactaatattttattgcttaattagactataatctatgagattactgttgattggaaaattcctatagtttatatattcctgtattccgaacgctccacaccatcaaattcctatgtttttcaatcctacgttttgcacatacaatcctatagtattcctgtgtttttcctattcccatgtttttccaatcctttagtccgaacaagccctaaatgtctttggttaagaaaaggttggtaaccattaaccaatgctccctgtatttaaacatgttgtcatttaaacagctcctattttgtcatgtcctcactataagagtaatgattatgtcttatggttaaatctaatgctttgttgttcagcgagagtatggatctttaattttattcgcccacatatgcttattggtaacgctttgttggactcctgatagggcgcgcaatgcgtgcaaattgtctagtttaatttgtgttttatttggttggccttggccctatgcacttatgcagttaacgttttctccaatgcgaatttgccacgtatttggttggatgtcaggatgcacattgctgggattaatttaagggatgatgactgactgcatcacttcagctttgacttatgattttgtttaatttggatgttggcacaggggccgagcatcccgcattgcaataagcagacaactggactagtccaaagagttgtacatgagctttttcaatctctacaatcatcagaaagcatcgctatgtggagtgtgaagttgccgatggtaaacgttccagcctcatgttctgaatttgaacccacatcactaaatctttactcacattgatatgccatttctcaggtggagtatctggaataagtaaggtcagtgtttgtcatgggcattgggctggaaggcagagacccataggcagcccatatcaattaagttaggacagcattatttgttaagttgaagataagattagattgagttagagataagattagattgaatccttacttaggggtcaagctatgccatctatataaggatgggattgtgtctattatcatcaagtaatgaatatcaattagtctaacctctccatcccaataatgttcttctccgtagcctagatctacatcccttctccaagagccgacgccacctggctatcttcccggcagtgtttatcctgtcatggcctcgggtcatgacaacttggtatcagagccactcaccatagcttctgatgccgagtgagttctccgtgtcacggtgagtcatctattgtacccggtggatgagtatctactccaccaattgtttgatggctatggagtagaaaagaagattgaagtgcaccagatgggaacatatgtggaagcctctgttccgtttcaaactcgagcagccgctgagcatgcttggaacctcaacggccgtgccatctatgatggttgttggttggacatacagtgggagcaaccgtccaacaactccacgacaccggtgacatctctctccatgatcatcacggagtggaaggaagacatcaaggagttgagggctgtcctgcaggacttggtagcatttttgcaggaggagctggcaaaagaaaaggaagaagggcggcaatgggactaacggtgacgccggcgcttgatatgccatcaattcagtcaatccgtccagtggcctccatgtcgtcacaacttcaagatctccaagcgagcagatctgcgtcacaggccatgccaaggcggccatcgacctcttggagttggacttggcaacggcgtcatcgtcggcaaggtggagtgatggaggcgagcagagccgttgttgtgggcccacgaggacgacgaatgatggacgaactatttccgcgagctctagatgcggcagcggcggcgctgatcttggaggtggcagttggtgggttggatgggcggcacgtcttgctgggcgagaaagaaacacatcaacgccattcttttcacacagtaggttcgcgtcctcattgtttggaggcgctacggacgagagaagctgacgatagggttttttctctgcttctaatgggccgacaactattcatttgggtcgatcaagtggagtggccttccagtgccgcaactcatggcttggctgttgggttggccaggtagacctcggctgcagactaacgggcccatcttggatgtgagaccttggcccatctacaacatccaagatatcatgtgagataagtagtattaaatttaaatatagaaaagtggtgtttgttttgaaagagtagtgtctagtactagtttcttgatgatgtggagtttatgtaaactatgtctagtgtcttgggttgggactagccgtagaatttatatggagttgcattggttccaggcttgtggcacggcatggcctcgtcctttctttacgagacgtaggacgggatccacctcctgctagtagaacatattttttcgtattggctttatcttctattccaattaatctaataagtcgagatgtaaaaagcttatgttatcttagattggagtcatttgagtttagaagtccgtgttgcagctcgaggacgagctgctcaaaaggaggggtataatgtcattggcattgggccggaaggaagaggcccatatgcagcccatatcaattaagttagatataagattagattgagttagagataagattagattgaatccttacttaggggtcaagctatgtcatctatataaggatgagattgtgtctattatcatcaagcaatgaatatcaattagtctaacctctcccttccaataatgttcttctccctagactagatctacatcccttctctaggagccgacgccgccaggctatcttcctggcggtgtttatcccgtcatggcctctagtcatgacagtgttgttgagaatattttcttatgctttctctgtacagattcgaatgttagagagtatcaaactttatttcattgtatctcagggaccttcttgacttgtccaaagacaacctatagatcaaggagagtaaaactcaagggatctacatttctagagcaacagaagtaagaaaaaagtgcttaagatatgtccttgtgttttcaatttgacataggaaatttgcacctaggaatttagacttaggacatatatatgcaaatgttttcaatttagacttgggaaatttagacttaggaatttctgtcttaggatatatttgcaaatgtttaggatttagacttagaaggttttgaacttaggatttttagacttaggtatatatatttgtaaatgtgaatgatttggctatgaatatgaatgtgcctatatgcaaatgtgatgtgaatgtgaatgtggctctttgttggtgaatgcatgtgaattgtgtgatttggattatgtggttgtgaatataaagcatattggaattgtcaggtgctgctatttgtatgtgaaattgtcaggtattgctatttttaatttttttttacccaacatataggtgccagtttttcattacaaaccaacacctattatgcttgccacgtgtcccttttgggctaaaaccagcacctatatatgggatttataggtgccggtgttttaaaaaaactggcacctattaggacaaccacatggctgagttggaataggcacatttctcccctaataggtgtcggttctaacctaaaaaccggcatctattacatatatagatgccagttttgaaaccggcaccaatgaccgaagtcatcggtgccgtctccgtggtgccggttgggaaatccggcatctattagggttttccaactggcaccgattagggtttctgtagtagtgtatgtgataaattattcgctaaatgatgttgatatgaggattacggatagcatgtgctaagtttcaattacggaattcgaaaaagaaccataaatttatattatatatcattagtaacaccaagtttcacttaaaatctaaaaagtttagagtacatatttaattactcatacatttcatagctaggaataataataataataataataataataataataataataataataataataataataataataataataataataataataataataatatataaagaaggcacacgactataagttatcccatttatacacgtaccaaggacatgtttatcaacttatcattcattatcattgttgtaaccactatctatagcagtcttatctctctagttatagagagaggagaggggtttcgtctttttaggtctctgaaaagccagttcacatgcgatccaataaaggaggcagtacttctgcctgaattcctctagatcctacccgtcggtattaccgtggaattatgagaagcaactagttggtagccagcttctaagaatctgaaaatgctggttttctcagcttctggcttctaattaattttttggattgtacaactatagtttattaaaatctagaaaaatactgaactatttggggagcttctgattttgggagaagctacagctgccagaagttctaccaaacataccgtagcgaacgctaaatatttgcacctaggattaattcttgcctgaatatacaaaactaaagctgatttcaataattcgtaaatctttcttgacattaaccatgaatgtaaaccctacgcccgacatagctaaatcaataattacgcaaacaaatttgcagggaaagatctcttttattcccaccacagatagtaagtaggtggaatccggccagaatgagcggtcgggctagatggtacaggtgaccatactattcctctcctcaatcttttatagatgctggtttgtctaaaatcaactcctataaaaaagttttcattttttattaggattaaattaaaaacgggtacctataaaccactcactgtatttatttcagacagtattccataggacagcatttgagtgtctcctatggaaacttttccatgatatgtacgggccgtcacatacagccaaggcagaaatagcagaaaacggactagccaaggcgtaaccgcgtgagtcaacaaagcaagcgttatagcggatactaagtctagtggccgaataatccataacaaatactgtagatatactaagacttcacgactctcttagcacaataagataaacacactgagtcacattgaaaaatagcggatactacgtctagtggttgaataatccatcacaaatacggtagatatgccaagaccttgcgactctcttagcacaataagataaacactaagtcacatattgaaaaattagcggatactatgtctagtggtcgaataatccataacaaatactgtagatataccaagactttgtgattctctttgcacaagaagataaaagctgagtcacacattgaaaaatagcggatactacgtctagtggtcgaataatccatgacactgtagatatgctaagacttcactactctcttagcacaataagataaacgctgagccacacattgaaaaaaagcatgtgttgcatcactacgtataaaatgtggaactaattaatgatgaccagtacatattaacatcttaattgttacctaaagaaattcaagcaaataaatcatctatattaagctagcagcacatcggtacaaagttcatacgaaacagtggccttgatctcattcatatcctagccctattgtgtggccatcctgcaactggaatttggtattgcattcaattataatgacatactcctatgtagatatcttttaattaaacttggaccatcagtattttcataaatacatagtttaaaaacaaaactaatgatatacgtagatttgttttggaaagtgctattacaatatggtattggactttacaaacgttggccctgttcgagaacccaacaaagggggaataaagttttggatcttcgtggcacgtttttcaaactactaaacggtgcgtttcgtacaaaaaatttctatataaaagttgttctaaaatatcagattaatccatttttcaagtttgtaataattaaaactcaattaatcataagttattaccacctcgttttacgtaaaacacttaatcttcatatttattttcacgagatttaaacaaagccgttatatcaaatccattttgttaaacaaaagataaaatcttagaataaattgcacccacggtgtatcaaattgacaggtgggtgcaatttattgcaagaacttgaaaaataagcgttccagtgcaacaacttggtaggtaagtgcaatttagtataacaattttataagtgaccacataaatgcaacaacttgcagggtagatacgattttgatataataaataaattgttatgcggtaacttaattatttgcagtatatttatatttttatcctaataactaataactgaaagtcaatttaactgaatgtagaaattattatatttggttgatatttgagaaggtgaagaaaacaaaaaaaatcttaaaagataattgaatgtaaattgtatgtgcggtataattcttaaagattaaattcaatattataaaataatatccgtaggattactatgtgatggcatattgacatcgtgaaaaaaaattcacctagcatatgcttagtcaaattgatgcatcaaaatattataaattgttaagttcttgtactagaacgtacctacttgtcaagttgttgcactcggacgttcaattcttaagtttttgaactatatcgcacccacctgtcaagttgttgtaacatatatataatttactcaaaatcttattttcaacgttaaaattaattcagcagagggaaggagtagcaacaaacttagagcaggtagaacgcgcgagtcatgaaaattaagaaccaaaaaatttcgcatcgatcgacaaaaactgagcagcaagcaaatgtgtggaattaataacaactaagtaagaaggtaaaagctaagtacaaaagtctcaccggactaggctaaatcaaggcggagcgtgcagggtcggatagcgcgacaaacgaatgcaaagttgtatatataaatacttgcgcgcggctgcgatggggggaaaccgccaggcaaacacgcggggggccgcattgccttcccaaaacgaaaattttcatgctgtcacgtcaaatatttggacacatgtatagaatattaaatatagagaaaaaaaccaattacacagattacgtgtaaattgtgagacgaatcttttaagcctaattgcgccatgatttgacaatgtggtgctacagtaaacatttgctaataactgattaattaggcttaataaatttgcctcgcagtttcttggcagaatctgtaatttgttttgttattagactacatttaatacttcaaatgtgtgtccgtatatctgatgtgataaccaaactcaaaatttttccgcaactaattaacaaggccttagccacgcttctctggcctgacgctttaaggggacgaatgcaaaaatgagcatatttttttatgcgtcctctaaaaggccacataattttcacatacggacccctaagtgatacaaatgcaaaaatacactcttttctccatagattttttttctcccctccactctcttttccctctcaacacttcaaattttttttcaactcctcccctctctccccctgtcctctcttgattattctctcctttctctttctctcttctcctctccgagcaggagcagacgccggcggccaagagcagctgcagcgacgacgaatagcagatcctcacgacggtgtctgcgaaagggtcggatccactgcccttgggagcagctacggcgacggcaggcggtggatctggctgcgccaccctcgggagggccggatctgtcgccctacatagcggctatgatagcgggctgcaatggcgccgatgcagattagagttttggatttttcaaatttttatttttttcatcaaatttattttcatagatctttgagtgcatgaggatcacccgttcacatgaaaaaaaaaacacttttgaccgttcgtaaaaataatttatgtagtaatgaactactcaagagcgagacacagtgatacatctcctcagtgtatgtcgcactgtacgtcggtagtcgtggtgcctcacggttatatagctttatagagtaggctatggcttcttgtaaatcacaaattccactgtcacataagacaacaatcttaaaattatacatcataataatactatgaatttagacagctcaatcctacattgctatataaacgctgagatagtagtaaaatacaagtaaatttcccgttatctgttattgatttgagcctttagttgaattagttgatgtatataaatcaatatgatattagacacataatttttgagtttaaattttgacctgtgcaattaaataaactttttcagcctactttcattccacgtcggatgattgatacctgcaatataagtgtattgcccgtatcctgaaaactgagttggagcataattgatgaattggtcttttcttgtaagctcaaacttttgtgtgtgtgtagggctgtcaatgagctgagctcgagcaagctcgtctgcccaagctcgagctgagtctattgcaccttcgagcttctaggcaagcttggttcgagctcgttcaaacttgagctcggctaccaaactcggccataagtagtataatatatattttaatgataatctcttgataagtataattattttctagttaatcatactaataaaagagtagaaaatgattaaaataaatatattgtactaacacatgctaatttattgtgtaaatagatactaatatatatttatatttatctattagtttattatattaataaggtgaacatgcaatataaactatacacagtcaagctcggcctggctcggtagaagctcgagctcggctcggtaaagctcgcgagctcttgcttaggctcaggttcgactcgtttggagctcgagccgagctcaaatcgagcctaggacgagccaagcttgagctgctcgcgagcctcgagttttttttacagccctatgtgtgtggatcttggttagagtagtaccaacattagacattgttaacacccaattttagcatctatgtatgaaataggaaaacatttccgaatttagaaaggtggttttcatcacggtgccagtctgactagtgacatctgagtcgtactccgagcccaattacgtcgggtcttgggtttttttccttgggctgaggttttttttttaagttctaattgatgtctgctatgagtaagatgtggagaggaggtcctgtaggcagcaaaacaaacccctttgtaaggctatggccggtttaattgagcacacaatctatttccaatacaatataaccaattgaattactttttttcaatattgcatctactttttgtctagttctagcctagctttcgtttattttcattggtttgtgctaaaatccctccgttccgccctcgaaacgggtatttatccctattcgtctaaatcggctccgctagctggttttaacttacataactcatcttgatttagatttttctagatcgatgtggtaggcgacttcgtatgactgcaacatattaggtgtttctatcttgattggcggcgtgaccaaaaagttgccaacagagatcacatatcatgtctacgtcatgtatatgaaactactcgatccctctgctctaaagtacaagcctttctatgtgttcctcaaaatatttcgaatagagggatgtgcagatatatgttggaaaacccgtataaatgcttacatgttagaagaaaggaaaaagtaagaattacccctctgaactatcacaatcgatcaaattacccccataaactcaaataccagatatttcaccccctaaacttgtaataccagatacccatatattctgtgcgctcccagcgacaccgctgtccgtccactccaccgtcctcctcggtgcggaccaccgcttgccgcgcccttcccgcgacgccgctgcccgtcccctccaccatccgcctcggcgtggcccaccgcctccaccatcctccttgcccgcaacccgtcgcgccctccccgtgacgccgccgtccaccgctgtcctcactggccacgacgctagagagatgagagagggagagagcagaatgaaaaaggaagagagatgggtgagggggagagaagctgataggtgggtcccatcgatttttttttaaaaaatgctgattggactgccacgtgtacaccattcataacgaaaactgctttagattgagtcgggggggggggggtaattcgcccgattttacaagtttaggggggggggtaattcgatcgattgcgatagttcagggggtaattcgtactttttcctagaagaaacgatgttcaactttatatgcaaagcttagttaagttttactactgggctacaaacagtttgttggtttaccaaactactaaaaaaaccctgaaagggattggtcttataggtgtcggttcaataaaactgtagaactggcacctatgggcattttcccacctccgcacgatgaaaaaaatatagaaccgacacctttaagcagtataagtgtcagttttaaagaaaaaccagcactaatattataggtgctatttttttaaaaagagccaacacctgtacttgtattattggtgtcggttcaagaggaaaaaaccggcacaaatagtataagtataggtgccgttttttaacagaaccgacacctataaaataagtataggtgtcggttttaaaaaccaacacatatttaaaaaaaccggacacagagctaggtctttatccactcagccacgccagccacatctctctctctcccctcctctccctttgccttccaacggagggagcggcggtggccgacggaggacgggccgtggccctctcccagcttggggcccttcccccttctcacctactccagcggctggcccaggtgggggcggtcgacacggaggtcggcgcacgcgcggccaggttgcggcggcagcgacggtggtggttgtcgtggaggaggcgccagccccctctctctcccggtggccctccctcctcctctccgccgctctcccccttctcctcctctagatccattggcggcagcggcggtggtggtggaggaggctcgtgaggtggaggccagcgcacgcaccgcgaggtggcggcggtggtggaggaggctcgccagttccctccctctcccaggggcctctttcctcctctctctctcccaccctcccccttctcctccttcagatccgttggcggcggtgccgttggtggtggaggaggctcgcgaggtggaggccggcgcggcgcggaggcgggcagcagtgtaggtgccatcgtcttttttttaaaaaaatggtataggtaccggctttagaaccaacaccaataagattaaggcaaaggtgccgatcaataggtaccggctgcgaaaccagggggcttttaactatttgtgtaacatcccggcctagggcttaataagattaatagaatactcatattaacaagttacaacttcttttccggaagccaatctccaaagaactccagggttaagcgtgcttggcgtggagcaatttgggatgggtgaccgaccaggaaattcttcccgggtgcacacgagtgaggacaaagtgtgcagaaaagacatgtgttggtctgtgagggtagtctatgacctatgaaagctatcagacgtaagcgggcctggcttgggggaagacgggatgttacaaaatggtatcagagccgactctcgcggtttcacgggcgcgtgtgtcgcagtagcgcaggcatggtgcgcatggctggtgtagaccgggagtggttacacagcatggcacatgcgctggcactggacacatggacgtggccaagagaggacgttcctggcctagagttgatcgacgggggcgtcgatctctcttaagggggtgagggtgtaacatcccggcctagggcttaataagattaatagaatactcatatcaacaagttgcaacttcttttccggaagcaaatctccgaagaactccagggttaagcgtgcttagcatggagcaatttgggatgggtgaccgaccgggaaattcttccgggtgcacacgagtgaggacaaagtgtgcagaaaagacatgtgttggtctgtgagggtagtctatgacctatgaaagctatcagacgtaagcgggcctggcctggaggaaggcgggactttacaatttgccactcttaaaccagttcccaaccggtgccacttgtttatcggacgtaagcgggcctggcctgggggaaggcgggacgttacaatttgccactcttaaaccagttcccaaccggcatctctaaaggtttttctactagtgccacttgtttatcagacgtaagcgggcctggcctgggggaaggcgggactttacaatttgccactcctaaaccagttcccaaccggcatctctaaaggtttttctactagtgccacttgttttttctagacactaattatttccaatgctattttggttgtttcttgataagttggtttgtgtgtttttatagtgtctaaaatacaacacgtgatttgccttacacctcgttaactcttgccatatcgaacttattctaaatggtaggctattattaagtaacttctacctccgtcataaaattaaatgtaagcgttcttagtttgacacgtgtattaaaaaatataaaaataattaaggaaagactattattaattgagaagagaaagtaagcgaacaaattaaatagataatataattatgattagtggaatagaataacccgattaaagggcaactcggcattttacgagttatgaaagtgcattggatgatagatgagagggtgatgaagaaataacttactttcaaaacaaactacttcctctattgtaagacatatttattttatcattaagaccatggagaaattaactcatatctcatgtaacaaaacaaaaaactatcttacaatgcatataaccaattagtattaggatggttttttgagttctgattaacattaaagactacaaatatgatcatctcgttcttttgaaaagaaaaataaaatatgtttaatatttttgaatgaagggtgtagtatgctaaaaaaaaattcattttaaggacggatgtaataaatcaacacttgctaacactaggagtgctcttcgtaaagaattggtgggagaaatcaacgctagtctgtggtcaaccgagaaaagcaagtgaaagctatcctgatgtcactctccataagaaatttaatgagagcactacaggagaaatgatatttgttaggtcggctgatttccacaatagtgctggttctaataagaactgggactaaagattatttttagtcccgattagaaaaattttgatttgtaactccaattggactaaagatcagttcatcacctgtgagaggcctgtcagggggtcgaggatctttactaatctttagtctcagactaaaaatctatctttagtcccggttggagttaccgaccggagtaaatatttctctcccatctctgatcggttaagtcccagacaagactttcctcctcatcgagatatttagataaagattggatcgatctcatcccctctcctgctaacccttcagatcctcttcctcctcctcccccctcctccccttcgtcctcctcccctctcctccccctcttcccctcccatccggcggtcggcggggccgcgcgcgggcgtggtgagcggtggcaggcggggccacgcgcggaggcggccgtggtagacggtagcaccctttcattttttttataatttgtgattcactgagatgtataatttctttttttttagaatttgtgattcattgcatggatctgagatgtatttgatttgtgtaatttttttagaatttgtgatgtatttgatttgtgtatataactaacttaggatttgtgatgtgaatgattttggatgttactttgatttgggggatttggtgtttgatttgaggatatgcatggcattcgatttgagagaaaatacagggattaactctgtcaattagtaaagaaacaatgaaaaaaagaaacgggaaccaaccgggactgtccctaccctctctttagtcccggttggtgttaccaattaggactaaagattcaactttactcccggttatgactaaagatggacatctttagtcccagattcgtagtcccggttagaaaaccggtactatagggggttcccaaccgggagtaaaaacggtttccctagtagtggaggttgatgggagtattttcttatctaccctataattcaccaactcacttttacacctacattactcattcatcaaatccaactgcccat

SEQ ID NO: 56961 - DNA, 4978 bp, Oryza sativa
  unsure (1)..(4978): unsure at all n locations
tatgtggcaataatgtagctagattatctaaatcaaatggggtagatataccttgtaaacttctccatacccaccactgccaagtttgtgcttttctgagaaattgcctgtaattttttctaatagagcaaatgaaatatcccttggcccttccgacttgtcttccatgctattggcctcagacctacttgacctcttcgctcccacgtccctttcaactaatacaatttttttatgagtacattatacagtatatggttaaaaaaaatgcatggtgcataaacttcatgagcaaaaaatgatgaaaagctaatgaaagaatattttggtcacaaaattttaagagtaaacagccactgagtgtacggaagagttatcccctaccacactagtttgttctttccctagtatgaacggaaactacagtactgattgccttgtaacgttttattaacggaaactattataagcaaaggtatgagattgaccctactattactaataagaatctaaatatatatccaacacgatgcttgtatgatcttaaaatcctagattaattgtatcatcttcgtcttcatgtaattgtttgagatcaataaatctcattttacccaaaacattgatcttatgtattcttataaaatctatcttataatcttatatgttggttcgtctcaagacgttaattgaactaccctaagccgtatgtgaacacaaaacatatgattgtaaaaatacaggaaaaacaaaggaatgaccgtttgattaaaccgcaggaaaaacgcaggaattagatgagagagatagactcaaaggaaagttgtcaagaggttgaagctcttgctaaattttctccaaaatctctataagattgtccattccatagaaatctcaaaggattggatatgattcaatcctttgttttaaagggctccatagaaaatttttctataggattgaaatcttccaaaattcctatgtttttccttcaaatgcaaaggggcccttgaatcattgtaataggtgggtaattcttgctttgtgcgntgtggttaagcaaagagtgggtcctagtcatgtccgctttatttttaacccacggctgatatccacctttttttctttcatctccattacgttttgccacagtcggactcaacagaaagttttgctacaccccaaaagttagcttaagagacaatggatttccccacgatcaaactcatcagcgcacgatcaatatgtcagcccaactagaaagacttaatgcatcccaaaagctaacccattagcgcatgaccgatatgttggtccaatcgggagaaagccttgctgcatcccatcagtgttaaataattattaagtaattattcaaaaacttttgtgaaatatgtaaaactatatgtatatatgtaaaagtatatttaacaatggtagaaaaagaattaataattacttcaattttttaaataagacaaacggtaaaaaaaagttaacgacgtcaaatatttagggacggagagagtacgagaaaattcgaaagtaaggaaacgacataagtgttttaagcagaaagaatatactctgtttcttcctagtacgtatatatctctccgtacgtaatctctagaaagaagaaagaaatctaaatactgaagtagtactatatcagtctatcagtatctagaaacgcattatataaaagaaaaattccagtatgcaacgaaaaaaagcttggtataagaacagatctatgtcaactaatcgatcggaaagtatataatgcgtgtccaattaacctttcttccacaaatggttaatttgaggggaataagtacctaattaggaacggttggatatccttggtctggccggcatgcaactgcaacggctgacggaggagaaagatcgagctatgtcgtcccggccttggttgctcgaatcctataatactatacaagtgatcctatgtagggtgtaattaatatcctaactatatcttgtatatagaagatgcaaggcgggggtgggtgcgcacgcgcgaggagaaggatcgaattaaggtgacttatcaatcctcggttagaaatttgacctgtcgtggtcaagtagacaatgcaagtaccaataattaagcagttgcataattgcatcaacatttcactctcaattataatagataattaatttcttgaccatgatcaagttatttgtcatgttttagcaaataaaaggtaggtgtgagtctttaactgccttttggtcggacgataactgtaattttatcccgcacgttttggatgtggatgagtaatacatcttcctttccccgaaaaaaaaaactacatgcatgcatatgcaggtgcatgtacgtgcgattagccggggtcaaagtccatgcaagaaaccggtgtgggtgctaatctttaattttgtccacgttatctactaaaacatttagaggtagtgtatacaatacgttatctctatatagtaattaactctaatacacagccacagtgttaatttattcgtccatctactcttcctctctctctccttaattttatcttgaagtttatataaaaattgtaggtagaaaaagatgttgtaagtgggttataggagttgccacctcacattttttctaagttaaaagaaagagaaaaggagagcgaaagaaaacgggttacaaatatgtagtcaacagtaacgctctataaggctttgtggagagagttagctgtaggactaattactactcccaccgtcttataaaatagaggattttggaggaagtcgaactcctatgctttcaagtaaaagcttgacgtgacgcctttggtccaaaatagttctagatgtgtcgcatccctctaaaatcttttatattttgggacagaggaagtattgatgtagtatgaatatgtagctaactattatatagatatgctacatagattaaagatgatatggcaatagatagagtaaagcatggtctctctcctctattctactcttatccgtatcatcaagttcttattgtaatttctctaattaatacttcttccatcataaaatataagcattttttgagtttttcactgggatcgagtaagaagagggatgaaattaaatggaaaggactatgattagtcgagattataggaagtaaatagaggaattgaatgagagatggttgtatatagcagaaataattaagaaagcagctggagaagtgggtatatttataataaaatttgaacgttaaagttgcaaaatttcaagacgaagggttcgagtaaataacaatatgaacatcaacaagttgccaaacctaacgatatgatagtattaatttatccagctaacaatttatgatcctagcttgttgcttcgtaagaacaagagaattgctaggaatcaattggaatactcccaaatcattagctcgcttatgtacctggctagtgcaactaggcctgatatctcctttgctgtgagcaagttgagccggtttacctctaacccgggagatgatcactggcgtgcgcttgagcgagtaatgcgctatctgaaaggtactatggaattggggcttcactatactgggtatcctgcagtactggaggaatatagtgattctaactggatctctgatgtggatgagatcaaagccactagtggatatgtcttcacactaggtggtggtgttgtttcatggaggtcttgcaaacagaccattttgacgaggtcaaccatggaagcagagctgacggcactggatactgctactgttgaggcagaatggctgcgtaatctattaatggatctgcctattgttgaaaaactggtgccggctattcttatgaactgcgataatcagacggtaattgtcaaagtgaacagttctaaggataatatgaaatcgtctagacatgtgaaaagacgattgaagtctgtcaggaaattgagaaactccggagttataacattggattacatctaaacagctagaaacctggcaaatcccttcacgaagagactatcacgaaatgtgatagacaatgcatcgaaggagatgggtttgagacccatatgagttatactatggtggtaacccagtctatgtgatcggagatcccgtgaattagaacctgggaagaacaagccattagttaactacagaagagtaccattctataccttctctaagtgaagatgcatgtactcttgtgagctgtaaggcagattggctatgccttaatgagttctgttggctttaattagcgaagatgctcctgcagagcattcttgaaagaagtcacctttgtgagcttgactattggtcacagtctatgaagatgttgggtgaatcttctaggaagcttactaaagaccaaggagtatggcttatacgctccacccgaggggtaatctacagacggtctagtaccagataaggctctgagtgaaacttgcttgcacaagacttacaattcaaggcgtagtccattgttcaagttgtgagtatgtgtagattggagttctaggtggatgttcaaccttaattggtctccatcgaaccgctagtatataaacagtacattggaaaaggcaaatctcagtgggattttgagctttggtgggggattgttggaattaatagatggggcttagcccattcgaagattaattctttagaaaatcacaaaagcctacctcatgggatggcatgcatggggagtttagtaccaccttgcatattctaggagaatgggacctccttaaaagggaggatgccctcctagccacttgaagcatatgtggtggagagaagagggggaacacaggcgcgcgctcgctcgcctggcctggcctgggcagggcagggcaggcggcgcgcgtacacgatgtacgcgtcgaatggtctgcaaaattggctcatcacccttgcgcagatgcagcctccttt

SEQ ID NO: 56962 - DNA, 1024 bp, Oryza sativa
atcaatctggggttcgccttctactctgtgctgcgccgtcgctcgtagattactccatcccgctcgccggcgtgcaccggcgatcgggagagcaggtctccggaacctctgccttcgacgtcctgcaccgggagaaggcggcaataaggtttttgggagacgagggagagagagagaggtggcgttgtgcctgtttgccctctctcagatcggcgccaccgccaaccactcactcgctatcgccaagatcgaaactgatcggctgcacactcgctctcccttgcaaagatcgatgccgccgcacctcatcttggcgatcaccctattttctcgctcaatatgcgccaatcacctctcggacaaatccaccacaacccctccctcccagccttagctactccaagatagccgccaccgctccttcccacaaccaatttgataaagaaatcaatgcaattgtctttttttttttggtttaatctaccacaggtaatgctccacttccaaaattacctgacaactacaacttactgtttttgaagatagctgctgcgttgaaagagtctggtcttggatcttcttggttttgacttgaccaaaagcaatggatagtcaggtctatattactgtttcatgttgcacgcactagttgtttcttttaagactttctatcaattgtacttgagtatccgttttaaaattctatcaattttaaacaaacatttttttctgctgaatttctgcaggcacatattcctttagaagaaaaatcttcgcatgctttgctttgttgagttgataaactgggtcaaaacgggagacctaatgtgcaagccttgactcttcttgacagatgacagattttgtaactatctgaatttgtcgtatgaaaactacagatttcattctcacaggcataattgcagactatcaatactttgaaagggtagctttgtccagaggttcgtagtaggtataacatttttttctcgagtacggtaggtcgatagcatttatctactca

SEQ ID NO: 56963 - DNA, 17393 bp, Oryza sativa
taaatagattaagaatcatccatcatctacagagaaaacagtagaatcattacaaggatatcgtctgtcgttctgcaaaaaaatatttagataaggcgagaatattaattaacaagccaactaaaagacaaattataagtgatggtcacagaacgcaattaacattctagttttgaaatggttaaatcaacaattatattacaataatccatgtaatttagggtgtatactaattaacaaggaactttaacagggagtaatgcccactggagaagagattgcggtgaagaagctatatgttatacctggtcttgatgatgtgcagtttaaaaaggagtttaataaccttatgaaagtccaccatcagaatgtcgtaaggctagttggctactgctatgaaacaaagaagaaacatattgaacgcaacggagaatttgtattttctaacgttgaagaaagagctctctgctttgaacatgtgcagcttggaagccttgacaaacatatttctggtacgattttgctcaatctgcttaaaagtggtttcgaccatgctgtctcagacaattgagttatcttcagtgactttgtgcagatgaatcatgtgggcttgactgggacacacgctacaagataattaaggggatttgcgagggtttaaattaccttcacaatgggtccagcaatcctatttatcatctggatttgaaaccatctaacatattgttagataaaagcatgataccaaaaattgcagatttgggcctgtcaagattctttgcgacaacaaaaacccatatcacaagccaaattaaagggacactgtaagttgcaacctcatgattcatatttgttgacgtctcaatagaattatgtggacctttcacccggaaatgctacctagcgattgatcgctaggggtagctaacagcgatcagattagatttcctcccctccacctggtttccttttttagcaccgcattactttcctattctagtaaatttatgcaactaaagtttatacaccttaagtttacacacctaaagtttagagattcaaagtttataaattaaaagtttatatatccgatttaaatttaaatttgaattcaaatatttatatatatatagtatttctatacatctaaaatttatacacctaaagtttatagacccaaagtttataaatcaaaagtttatatacccgattcaaatttgaatttgaaatatatctgattcaaatttgaatttgaattcaaatatccgattcaaatttgaatttgaattcaaatattctttttatatatagtatttctatacatctaaagtttatacacctaatgtttatagacctaaagtttatagacctaaagtttatatatctgattcaaatttgaagttgaattatatctgattcaaatttgaatttgaattcaaatatttttcatatatagtatttctatacatctaaagtttatacaccaaaggtttatagacctaaagtttataagtcaaatattaaatttaaatatttatggtgtagtaggaagagaaaaaggggaggaggaaggggggagaggagggagcgttggagtataggggagggcccccagcgattacccgtccattagttgtcccccctttcacctcacccataagacaatatctatttatactaagcggtgtggatctagaaaattaaataagacatattggaacctcaaaaaaagggaaaataaaacattggtatcataacatgttattttactggtgccatagcatgttaatcatacttaaatcacagtgttaataattctatgtataataactttagctattgagtttcctaaaattaagtcatcgctggatcatcctttctccaatagatttccacgtgcttatactaccacctaagcgactgataataaaatatgttattctaatagtagttgatctcttcagtaatggcttagatcacgtctaccggtggtaatactagctagtagtagaaaacacacacacacacactatcagtagaaacaaccgtttaagtattcggttcattttgttttgtgtgttttttttataacgatatataatttgtgtttatatactatgcagcggatacatgccaccagaatacattgaaagacgccaaatcaccaagaagtttgatgtattcagtttaggtgttataatcatagatataattgctggaccttcgggctactctaaatgtgctgaaatgacttcccaacagtttattgaacttgtaagaaaagttccattttatcttatatcgtgaacaatagttattttagtataattaatttgtactgtatgcacgcatgcttacataccttctctactgtattgttcaattttgaaggtacaaggaaactggaagaaaagactgcatgcagcaacatcgaggtatgcatcgcaggaagcagatagcctacaagtgaagacatgccttgaaatagcattaagatgtattgataaagaccgagcaaaaagacctactataagcgatattgttgataaaatgaatgagatcgataccctaaaaatgtcacttctaagcaaggtatattatctccaaacttgtttggtttcgtactacaccaaaataatgccaaaatttgataatgctaagttttaattatttttttgactgaaaagttctaataattttgatacagtaatggtagaattggttattattgtgtttagtaatttgttaccaaaatattataatgtgatttaggtgtatatggtattaaaaaccaaaccaatgtttattcatagtacgatacccctccatcccaaagtaaactcttagtttttcctgaggagattcaggatagaggaaaaagactataatacccctcattaaatgtgatatttggggagttacatggcagctggggataattaagactaagtgaaaattaaatgagaggtggttggtgagggatgtactctctccggttctataataattgacgtttttgacaagattgaggtgaaacttgtataactttaaccatcaataagttttaaaatatttagtttaaagaaactagaacaacatatatagatttgcctttcaaagcactataacagaattaaacatgtatttatttattatatatattataatagaaaaataaggtcaaaaatatattttgtaaaccgtgtcattgtccaaaacatcaattaaaataaaactagagggagtagtgatctattgagacaaatttcagatgctaaaagtggccttttattttgggacgaactagaaaattttgaattgtttaattaatgcattatatatggtaccataaccacattttatagtcctacaacattagtaatatctctatggatcttcgttgcagagacctgagcctagggagtttcttgggttcgaccctctagagctacgcttcccattcgagactaacaaggcgatatcctgcgtactgcagctaacaaacaagtcagatgacatcgtcgagttctatgcaaacacaaacaagaagaagtaccaaatacacagggaccaaggagttatggcaccatggtctaggtgctatgtcatcgtaacgctgcaaccacaggggagcgcaccaccgaacatgcagtgcgacgatatgttctttgtacggagcactagggtgagggagacagacatcggctcacttgacattaatgtcactgagcagcacttggaaaaacagatgggtgaggttaagtcattgccgattgtctttgttccaattcctcagcctccaacaagtattgcggattaaacggcatggtttgaggcatcatggagtaacatcatcaatttgtgtcggcatttgatatgcttacaaatatttaagttgttcgatgagttacttttttggaatttcaaattcactactcgatgtgatgttcaaaatctcgtaaatttgtgagaacatatgtatcatgtttatctatgtaaaatcaaagtgttttttattcttattctgtgataaataaattggtatatatgattattggttctgatatttggagattactgttgtttgctaacaataagtcaagttggagataacttgtgctcaaaatatggtttctttgtttgattcatgtgtaggtgacttgatgcctcgggagagtattgccggtgatggatcgagagtcgacttggacataagacgacgtccggacggtcagatatcatgcgggatacttaggctagagttcaatgcgcgtggttggtgaagatttcatatggcatacaatggagatattgtgtacgtatgggatgcagagtcgaatttggaaggaatccaaatttggtacaattggagtttgtgaagtttatttcttgtatgggaaggtttcttatgaggattaagacttcttgtatgagtttggttcgtaggtatagactgtctacctcatatataaatagagagggagcatgaggcttcttggtatcgcttttgaaagcattgagtttagagtaagagagttagtgtttcgagtttagtcgagattttcatgaagagtgctgttgttgcaccttgttaacacggagagaagtaataaagttgtcatctacatatagagttcttcgatttgtgtttgctcgggttcggcggtctaaccggcgagacaccagcgatcagaccggcggtatcgcagcggtcagaccggcggattcaaggcagtcagaccggcaatggcaacagggagcagaggcgacttcagggcggtcgaatcgagcgttctacatcggtcagaccgacggcttccaggcggtcagaccagcacgactacttcggtcagaccgcgatctgtcaaatttgagggtaacttttaatttcgctaaaagttttggtttttcggtacaccaaccattcacccccctcgggttggcttagttcttgctattcgatcctataagtggtatcagagccttgttttcttctttggattttaaccgatctagagttttagccatggctaacaagttgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctcacaccgaaacagaacgacagcagcggaaaaaggcgatcctagcggggcttcagctccactccacaggcaaaactcaactggggtctgagccttggtcttctaactttgtcttcagctcagaagcactactcttctgaaaagggggaataaaagcaaggctgagtacagccaccgtactcagcaagccacaccaacgatgcagacatgcaaggggatacaaggaggggtttgtggctatttgcataaaggcagttgtaaaacactttattgagcaaaacagtaaaacggttgagtaattaaagtaacattaaatctccactgatcaacgctacaccacgttgaacaggcccaaccaacccacctgaactacagtgtattgggtcgatttattaagatgggactaatcacggtgaatctggtcgaccgcccataaccgcgggcacggctattcgaatagttctactctgatcagaggtgtacaactgtacccacaagacacagccccacgacacgtttccgtgcgccgacatgccaccacgacataccggaaagaggccgtgacaggacccttcgcataaccccctctaactaagcacaccacacctcaggtttcacccccactcctcgcaaggcagcgagcagtcccctctcgtgcctaggtgaatccagaagccgcatagaccgtcgcagggcccatccgaactccatcacgcccacccttgcctggatgcgtcagctagaggaaagctacactacaagcccagccgttgcccacgctggcttgtggtaagtacgataagtttttccagggcatcccgcgaactggtccttaactgccatgggtgcgaccagcaaaaccatgcacccacagcccaccattcagttgcattttagttggataattacgaccatgaagcatggccagatgtctcgagcacgcagctcattctgatactaaaaaggtctaatactataattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaataccctgaccccatgtaattagcaaaacatgcatatttatttgtaaacggtaaaacatttataaattgggatcaacatgctcaaggggagtgtgtgacttgccttgcttcttcaaacaatcttccgaactcttatccttgcgaacgcgatcttccgaaacgacgggaactacacgctggcacgcaaaatgaggaaaaactctaataaaaaccaaggtaacagtacatataaactaaacaaacatgtagagctcaattttagatgaattttgcaagttgaacggctcaattcggagttcgaatgaattagatatgaattttagaagttttgagccatttatatgaatttctagaattattcacgaattattgcgcaattattatttatttttacaaaggaaaaggacctcgctgacgtcagcaaggggcggccggcgccgacacgcgggccccacacgtcagcgagtcaaagggggagggcgcacggtggacatggtccacacgtggcctcgggtgcgcgtccaccacgtggacggcccagatcggcctgagccgattgggcggccgaggggagcggcagccaggggcacaggcgcggcacgaagccggcccggccgagccaaggcgcggcggcggcagggaccaaagcgacggcggcacacgggctgggcggccaccggcggcggcggcacggcgcgcgcaagcacgggaagcggccggccaaggggagaaagagggaagagggggtggagtgctcacctagggcggcgacgaggggcggggaaaggagggggagctcggcgtcggcgctcctcgggacgaaggcggaacggcgacccggcggcgttccgcgaacgggaaccggcggacggcggccggaaggacctggggaggatgggggagaggttaagagggggagagagggctcccagcggcatgaatcgctggtcggaggtgagaacgggcggcggatgcgcaccggcgcaaggggaaccgtgttccggcgggatcctggccgtgaaaagcggcggccgaggtgctcctcggcgctgcgaagcgagcggcggcgacagcgcgacttggggtggctaggagcggcgccaagcggcggctggagtcggcggcggcggtggaaggaggtggtgcgcgtggcgacggtgcttcggaggcggggaggggaaatggagcggacgccggggtgcggcacgacgcggcgaagccgcttgtggcggtcgcgcggaacgacggtggtgggagcggctgtggcgaccggctggagggtcgtcggcgagcggcggcgggaggtgcgacggtggcggggtggttttcgtgcacgggagggctcgggagagaggggaaaagggagagggaggtgcggggaatgtttttataggggaggggaggccggattgagcccgagagaggtagaaaccggccggcgacgtgggaggagagagagatgcgggaggcggcgacgtggccggattttgcggggagagtggggggaaacggcgcggacgtgggcgacgaccgcgtccacgcacgcgcgggagagggagtcgcgcgggagaggcggcgacgtgggaggatttggcggccatggcggcggttggggatggagctggaggtaggagatgacatgtggggcccacctgtcggagagagggggaggggaaaataggctagggaggaaatgtagacttgaggaagagagagagccgagcgggccgaggaagggaagcccagcctaggaaggaggaggggaggaatttgggccaagcccgaaaggaaggaaggggaagattattttcttttctttttattctaattggttaaatgaactttgtgctatttaaaattatttcttgagctccgaaaattcacgggaaatttcagagagtattttagggaacaaagaatattgcaaaatattcccggccaatgatttttaagggaaaattttaattctcccattaattcactcgaataaattgcttaaatttttatttaatttctaggaaatgcattattaaatgatttttaatcccgaacgaaaatcggggcgttacacaagtttactactaagccccatgttttcgatggttcggattttgcttattggtgtaataagatgcaatcttacattatggctgaggatcttgatatttggagaaaagtttctaatccttatgtgattcctgatcaaattaatactgctgctttaaaaactgaatttgaaaataattgcaaagctcgcaatattcttttgagtgggatttttcgttcagattttgatcgtgtttcacatcctcaaaccgccaatgagataaactttcaagaaacttcaaatattaaagaacttcatcgagatcttttcaaaaaggaatacataaaattttagatgaaacctgaagaagctttggatgacaatcattctaggttcaacaagattttgagtgatcttagatctgtagattctgcttatgatattaactactcacaatctaagatttctcgacactttttgattggtcttgacatgtatatttgggagatgaaagttacatctattcatgagtctattgatatgtccactctgactttggattcgctttacacaaaactcaaaactcatgagataaacattctttctcataaagttgattctaaatctagtgctttgatttcttcctcatcttctttggatgttggtgcttcttcatcaaattctactactcttactttgattaatgccatgtccgatgagcaacttgaacggttcgaggaggagaacttggttttagctgctaacaagatttctcgagctatgaacaatgtcaggaacaggaaaagaggaggtccaacttgttgcttcgagtatggagcacttgatcacatacgttcgcattgtcctaagcttgggagaggcaagaaggttaccaaggaagatgaaatcaacaagaaggagaagaagaagagtctcaagcagaggttaatccgagaactcatagaagcttttgatactgatgagtcggagaatgaagaagagagcaaaggtaagcaagttgttgatctagcttttatttctcgtaatgcaaattcagatgtggatgaatctgatagtgatagtgaagaaaagcttagttatcatcaattagaacatgctgctttcaaatttgctaaaatacttaaaacatgttctaatatgcttgatgagaaggatcatactattgagattctaaatgctgaaattgatagattaaaatcttcgattcctaatgatgatgattgcaaatattgtgaagttttattttctgaaattaatgttttgcgagatgtcaattctgttagtcataagaaattggaatctgagattgaaaagtctaaaaaattggagtcttcttttgctcttggatttgctttgcatgctcgtgttgttgatgaattggttttcacaaagggctttttgacaaaatacaaagttgctttttgtgcaagtactttgttaaatttttatgtccaaaaagggctaaacaaaataaagatgttttggtttctcaaaattgttctaagtgctttttgaatgagatgaaattgaaagatgctttaggacgtgctgagcatatggaaaacattgtgaaatctgatgaagtgctttcttgtcccaaatgtcgtaaaagcaaaggtgacatggtagattgtgaaaattgtgctaatttggaaaaagaagtttcttgtttgaaaagttctttgcaaatattttcttatagtaataaacaacttaacatgattttggatcaatctaaagtgactagttccaataggggtgttggttttgatgttcatgaccatttcaccaaaaatcaacctattgttttgagtgtgactgaacatggtgaaattttgacaaaaccaagtgctaagaaaacagtttttaagtctgctggaattttgccctctctttctgcaaatttaaaagaaacaaaaacaaatctttcaaaaccatctacttcacaaacttgtcgtgagaagtatacatgttctttttttttggaaaagatggacatttggttgtttttgtttttgacttgcttttgcgaaacgacgatggcaaaaattgggttttcatgcgaggagcacggccagaccgacactgaccagtcggtcagaccggctgccaggtctagttagaccatagggacactggcggtcagatcagcctcggggtgattttgcgtgtaattcaaatcggaattttgaaagcgacaaggtaagttttcagataagtctggtcctgattttgttagtgcttttgtacctactggttctactggtcgtgtgactcagtgttggattccaaagtttcttattcctaaccccaacacggaggccttgatatcttctcgttcataggtattttgatggcatactccccatgagcattcaatgttgagatgacaattgcttttcaaggtaacatcaacttacttttgaattgacataattttgttccactttcctcattattagcttttcatatgctagtgtttgaggtagtagttttggttaatttgagtgaatgtatgttaattcatgagaactttggtggtatcgttggcaattggatgtctttttcaaaatctttgatttcttcttgatttttcttcagggagaattgaggttaatttcagggagagttagtgctttttcatttatctttttggcatggtttgagggggagtttttgtacctcatggttttatcaagcaaaattagcaataagaaaaattgagaaaagagagctttattttatatatatggtatattcttgtgcatgctagcaatatattatgaagctttacttgtctctagtatagcttgtatgtattctagtctttttatgaggcttagatattgcttttaagggaaatgatgcatgacacttaaattctatacttgaattaagagaatttgcgaaattgatgctagcatatggtttgatttataaatgcttatatatgctttattgaattgttatttctcaaatagctttgtaattgctcattgttcaatagaataaaaatatctatgagagaaaaaaatgaataccgaatccttggaaacagtcttgacgacaaggacgtattcgatgtgagcaaaaataatgggtgccgaatccttggaaacagtcttgatgacaaggacgtaccaggaataattgagggaaaaaatgagcaaaaaggctcaagtaaaagttaaaaattctcttggttgttttgtgctaaagttaatttgagaaagtgtgataattgcaataggtatatatgtataatgtttattttttcaacctatgtgcttgtaaagatgttgcattataaatcatatgaaatcatgaaatttgattgttgatttgaacttaattgtaaaatatttggttcatgattatactttaatgcatgcttgctatattatagatgggttcatcttctttttataacacaacttgacgtgatgtgccatatgtatgctaagctcatgaacataaatgaacataattcgtatgcttgataaaatcattgtcaaaacggaggagaagagaagagattgtgcatgttttcgatcaaggggacatttctttcttttcaaaagtaagagaagtcttcttttggattttgagcaccatgtgtgcttttgcacgaagtgtgtttttttaccacttttgtttttatttttccaaacaccaaaatatttttggatggatttgccaatgtgttcatcaagggggagattgtaaaatcaaagtgtttttcattcttattctgtgatgaacaaattggcatatgtgattattggttttgatatttggatattactgttatttgctaacaatgagtcaagttggagatagcttgagctcggaatatggtttttttgtttgattcatgtgtaggtgacttgatgcctcgtgagagtattgccgatgatggaccgggagttgacttggagataaggcgacgtctggacggtcagatatcatgcgggatacttaggctagagttcaatgcacgtagttggtgaagatttcatatggcatacgatggagatattgtgtacgtatgggatacggagtcgaatttggaaggagtccaaatttggtacaattggagtatgtgaagtttgtttcttgtacgggaaggtttactagttggattaggacttcttgtatgaatttggttcgtggttttaggctgcctacctcatgtataaatagagagggagtgtgagacttcttggtatcgcttttaagagcattgagtctagagtaaagttagggtttcgagtttagtcgagattttcgtgaggagtgctgttgttgcactttgtaaacacagagataagtaataaagttgtcatctacatctagagttcttcgatttgtgtttgctcaggttcggtggtctaatagtcgagacaccagcggtcataccggcggcatcgcggcggtcagaccgcgacggattcaaggcggtcagaccggtgacggcaacagggagcaggggcgacttcaaggcggtggactgagcattctacttcggtcagaccggcacgactgcttcggtcagaccgtgatctgtcgaatttgagggtaacttttaattccgttaaaagttttggtttttgggtacactaaccattcaatcccctctggttggcttagttcgtgctattcgatcctacaatctcaatgtgttgatcatgattggacagctctattctacaccccccttagaataactattctacactccctcctatcctacccaaccacctcagcccaccccagccagctggatgcggcaacggtttccattgactgtgagcagtccgggagacggcgcggggactagctgagttctttcccccactttcccaactcacatctctcgttttccacgcatacgcttttcaaactattaaacagtgcgttttttaaaaaaaaattctatacaaaagttgcttttaaaaatcaaattaatctatttttttaaaaaaattgctaatacttaattaatcacgcgctaatggaccgctccgttttccacgtggagttgggttcccaacccgaagcagcgaacacaaccttagagcaagtttaatagtatagtcaactagtagctccaattcatctatagctaatctaatagctcgtccatacaatagttacatactacactattaatattcggtcctacctgtcatacacacactgcgtcttggagtccgtgctagagaagctgaccggatggatgggctgctgggctgaagagtacgtgtgggctgtgctaaccagatccaaaccattgagagtggactgcactgaccaggatcttgatcattaggataggatccaacggctattgtttatttgatgatgtagatgaaccggaaattgctaatatctacactaaagtggggatgatttgtataggtatataggatgttggaattttggttctgcatatacatcaagtggaaccaaaaacatatctagaccctacccagtgagacaaacaagagaagcaaagcagaacacataaaacaaaaaagaaactatggttctgtttgttttattgcataaaccagctctaccaaaatttctgcattgctaattttcaggggtgttgaaatatgtttggtctgaaacttcaacatattttcgtatatttttaacggaaacttttgaatctacgaatataagtatgcttggtttgttatcttagcaaaagttagtaatgacaaaaatttacagggttgaaagtgaagacaaaccaaacaggcattatgtatgtatgatggtgcacctaccaattccagtatgtcaacagagtagttcctagcaaccggtgctcagcatttcatttgggtagtgaatgttcaatatattcaaacgaacagcagctaaaatatactccctccatatatgtatgacactgttgacttttcgatcaacgtttgaccattcgttttattcaaatattttgtgcaaatatgaaaatatttatatcatgcttaaagaaatttgatgatgaatcaagtcacaataaaataaatgataattacataaattttttttaataaaacgaatggtcaaacgttaaaaaaaagtcaacggcttcatacattaaaatgaaggtagtattatatatgtagtttcttaatgaacaatacaacagtcagcaggagtacgcgacaatcttatgataaacaaagcaatatcaagaagtagaaaggggaggcatatgcacacaaactaatgcctcaacagcatttggccaatctcaggttagaatttgcgaatgtagatcccaaatgtttcgaggcactgctctgcacggccaaagaaaccaacgatgttgctactatactccaacggatcaactttaaacggagtccctcctccttgtccaaaaggtccataggtaccaccatttgtgaagaacttaagcgatgtaataacattcggcattgaattaaacggacctactgttccagaaacttcccttagaaagtcgtgagagccaagccgaatctacaaggaaaggagaaccgttagcaaactatttatgtataaaaagaaataattaattggcaccctatattactggacaggtattttaagattcagttattacttaccatttggctactttcactactagcacttccccaaggacctgaagtgtgattgtccccattaacttcactataggaaaattcgagggaatcaacaacaacagaactataaattgttatgctttctagacggtgaggaactgtctccatgacatattcgattcctccatttccaccccaaggaccaatcttgttgaacccagcctcatgagaacaaaccacaaaaaaaaattagaaatgaagaagaaaattaatcgagaacagacatacaaaaataacaaattaacttcttgcagtaagttagtaccatctccatctcctctcctcttcctccaattgtttgcacatcagtggtcaattcctcttcatcaagtactgtgggttgtttcggatgaaggtagacgccgattgcatcaatataccagcccgcacgcccaaagaagccaacaatactgtcagtactctttgttggtgcacagaattcagttcctcctccttgtccgaaaggcccgtatatatgtgttttgaggtattgaggaggaagtatatgaggggtagtttctttcagagttttgacgtggatggctcacagttttggaagggattacatcaatgtaagaattacttgcagaggttggtgaccaagaaagtgcatgatggtagtaaggttgatttctggggtgatacatggtgtggtgaggttcctttcaaagtggcctttaataagctgtttgagataagtttacatcagaaagctactatcaaggagatttggaataatggggattggaatacggtactcagcaaaccattgctctatataaataatcccccccagttgctgaagaagatgaagcggatcctgctgatgaggagttcttccaggagcaagccggctacgatgagttttagggtttcggcctagttcccaagtcgcgcctgtgatgtttggtccaagacctggcttccgcttcccttttgtaatgcagttgtgagctcgggatctgtccgcagcccaacatgactgtacctctactctataataaagagacctctgttgctgtgataatctgtcttcctgtgataccagcactgtttcctgggactggtatcgattaacaggttaatttggagcgtcacggggtagttccggtcggtactagttcggggcgtgacaatatataactctagatattgactcccttataaggcccaattccaatatattacagtgcaaagataattctcagcagccagtactcaatgtttccatttattaaatttcttttgagaaacgagacaggaaataataatgcaacaattataccattatacatacgaataagaatactctaaatcatgcaacaacatgtgtgtgaagatcaagcaatatgcataatcaatatgtgcgaacgtagaccccaagtgcctcgacatatgaccttgcgtgaccaaagaagccaacaatttttccgttgctctgcattggaacgtcaaatggagtccctcctccttgaccaaaaggtccatagctacgaacatttgtaacaaatgtaacagatgttacaacacatcgtgatgcacgaaatggacctattgttccaaaaactcgcaccaagaactcagaagagccgaacttaacctgaaaaggagcaaatgaagagatcatcgatcaagaagctagtacgtattttccacaagatagggaataattgatgagcaacatataaagattagcaaaatgggaaaaggttggatcactgactgtatggctcatcccaccaggaccaccccatgggcctatatcgtatttttgcccgttggatttactgtacgaaaatgcaagtgaatcaatgacaacagcactgcagatcgtcacgctttctaaatggtgaggtgccactgccacattgatgtccttaacaattccttcgcttccgccccatggcccaatctttgcaagccgatcctggattacaatccagtaaaccaaaaattaggaaaatattacacaatatatataactgaaaaaattaatactatctccgtttcaggttataagactttcttgctaaaaagtcttataacctgaaacagaggaagtagaacataagtagacatggatgggattttacgttctcgtccactcctgcatccacgttgacgcctatcgcatgcatgtatctacctgcatacccaaaaaatccaacaatgctactgttgcctttcactggggtactgaaaggaacccctcctcctgttccataaggtccatatgtatccttgctggtgacaaatgtaattgacgttataacatcagaacgtgaatcgacgtaggggccaattgttccataaacatccaacagagattctgaaggatc

SEQ ID NO: 56964 - DNA, 1623 bp, Oryza sativa
attttagatagagcaggagtaccttttggtttgcattccctaaattatccgttctaaagcgtcgtctactgacagcaaggtttagttggttggtgttcacatagacaccaattgcatgcatgtatctacttgcacgagcaaagaagccaacaatgctgcaatttgtttgcagtgtggtgcagaaaggatcccctctttctgttccaaaatggccatatctgtcctcattagtgaccagtgtaagtgatgttataacattagaacgtgaattggcaaatcgaccaattgttccagacacctccaatagaaactctgagggaccgagctgaatctgtaaaagttaggaacatgattttttgggtgtcaagaactgcaggacagagcccataagagtgaaaaaaaaatactgtagttgtaagatgcatttactcactgtataaggactagggccaggatttccaccccaaggaccaatagtgatactttgaccattaggtccaatatatgagaatgcaagcgaatcgatgatttcaccgctacaaattgtcacactatacagacggtggggtggcacctcgatgtcataagcgctccctcctttcccaccccaagggccaaacttacgaagaactccaacctcctgatgagtgaacacaaccaattaagcaaatttagaaagaatgaataaataattacacatgtaaattaaagccccgtgattagtaaattattacattatcatattctcctctagcacctctttcttgttccatcgtctccctttcattgtgtctacttgcattgctggaatcctgagaaaatggcatcaactcctcataaatattggtaatcctgctcaaaatatatgtatcgtcacgtgtatcggttcattttaaaaattttcagcccatgcaatgcctgttttcaaacaacttaggcccattttgggttggtacctttctgttgatagtgtcaaacttgaggaaattttaacattaacatatttgatgtagtagaattggtactagatggaacccaaatattgatatatagatagtgtaggcaaaaattggcattgaaccaaacatctacatgttactattaaagttgccaaattaaaattttgatagggcaagaattggctttaagatccacaacagtccatataacatagatttcaattactaagcatcaatatatatagatgtggtaatgtagcaaaatggcattttgtgcacaacaagttagtgttctaggcgaaaagagatccattgtgcaagagctcttttagagtgctccatgttacctttgcggtggtaagataatattaataaatcctggtcattgatttttcatatttgcttcgtttattgacaaatacatttccaccacctaattaataaaccaagaataaaaggaaagctagtgccgataagtactctttatgcatgcaaggaacgaattatcgtttatatatatggtacaaaaacaaataaactaccattaaaatctcaaattttgatttattacaagcacttaatcgcgcatatatactttctagtatcaaattcaaattattcagttttgagcattcaggctgtacatacatatatataaagatca

SEQ ID NO: 56965 - DNA, 11086 bp, Oryza sativa
cagctcagaaggtaaaagcgatggtgacgttctctgaaacatagcatctaattcattcagtctgctgacaacttccgctatcgtaggccttttgtgtcgatcggcttccacacattgtaacgccatttctaaacatgtcttcacttgtcgttgaagactacctatttcctcagatgtatacgtcggcgttgtctgctgaaatcttctactccagttttcatggacctaaggaaattgaaacataatataagaaagataattaatggtatgggcgcacaaaactaattgaggaccttcatcatataggctagatagaaaatttcttacgagctcgatgaactcttgggaaggcatttcaagcagttttgaccgtgccttaggtccttccattatctctattattatcacacctagactgaatacgtcaaacatctccgtgatatgttttttctcaatgtattccgggggcatgtaacctctgcatgatcgatatcataattaagttagcatttttctcatttacataaagtgtgaatagctaacaagattcaacaattaattagaaaataagtatatgctccctcctttctataatatgagggattttagatggatttggcacatcctagtaaaataaatcttgtccagatttattttactaggatatgtcaaatccacacctaaaatactttatattatggaacggatagagtatgcgattaagttgtcatgtttgatcaacttacggagttcctataaccacttttgttgtatgatgggatagtgttttctcaaatagccttgacagcccgaaatctgcaattttcggcacattgttcttgtccaacaatatgttgccaggttttaagtcgagatggaaaatatgaccttgcggtccattgtgaagatagtttacaccctcgcatgtccccttaattatgttgtaacgtgtgcaccaatcaaatccactggattcgtctgtaccataaacaataatttattttcttgagacatcaatttggttaccctttttcttgttaactgcaaagtaatatagttaaaaacacaaaaacttagttttcaaaaaaaaacacaaaaactatcataccagaaagataattgtcaaggcttccacgctgcaaatattcgaagcagagaactctttcctccatataagccaaaaccaacttgccattgtgtgggacaagcttacgtcttgtttcacagcagtagccaactaatcgaacaatatttttgtgtcggacactcatgaggttagtaaattcattcataaatttcacatcatcaagtgatattatgtcgagcttcttcacagcaatctcttccccattttctagtactccctgataaaattaatatctcattttgatacgggtcgatcaattaaactgtagaaaatataaatgttaagcataccttgtaaactgttccaaacccaccatgaccaatttggtgcttcgttgaaaaattatctgtaattcttgttaacaaatcaatcgtaagatcattgggcatcgtatcagctgtgtgctgtaacttgtccgccatgctatatgtatctcaaattgggcctagcttaccttccgtgtccttctttacagttaaaaaggggcaggtctataacgtcaaggtaagtgaatacgtaaggagacatatcattatcagatcaaaattaattgttttaagatatgttacaaatagcctttggactaggtagagttactagataagatgagtgatgctccgatactctctaccagtagtattatactaccagtataaatgatttgaattgtccgttattaagggtaaattagtaaattactaatataatgataggggtaactttgtcatttatttttttttgtctagatcaatatgtgatcatccattccgctaacatcgcttatattccatcgaaaaagcgaaaaaatggagaaaaaaagtttactcactgctaaatagcgattatacctgtacacacctttttttttgacaattttgcccctcaagtttctactaccgctaactgggatggtagtataaatagatctaaacccttcgatcaaatgagatcagtggttcagattgttttttactatcagtagagagcattgtagtgaacatcagattgttttttactatcagtagagagcattgtagtgaacatcaagaagagaatgatatatttgatattttagaggttttatatggtgctctctactggtagtatgaatgatctgagccgtcaatttgtaaggacattaagtactccttccgtcccaaaatataacaacttttagcccttaaaatttgtcctaaaatataataatttctccaccaatattctcttcccaaccaatcacaactctctaccattcacttttcccatttacctccactactcaacaaattacaaccctccaccatttatttctacctactttcttaataaccgtgtccaactttaaaaatgcttatattctaagacggagggagtactttttttactaactccgtgcttaattttgagattcatttactcccgtctgcatttacaccctagcagcggcgcaccaccccctcccccccacccccgagcggcggggcggctaggagcagcgggccggtggatgacgatgtcggcgctaggcacgggccttctccctctccctctcctctccggtggatgacgatggcggcgccgccgagcttgccatatccgccctcggacggcagcgccgctgagcttgccagatccgttctcgctatcttcgtctctcccaggctgctaacgccgccccgtcgagctcgggtagtggactcgccggcgacgaccgccgcccccttgcatggggtgtgtgggggcatcgcatgggggcttgtcctctccggcgatgctctcctctatttggcggcgtcgggcggtggaagtgaggagggcagcgtcggcgtcacgtgtcgcagagtgtgggcccacctgcgcaaaactgacgaggaacttgtagccaaagatggctacgcgaacctgaggaggccgaacggtttgagtacgtggacacgaatattcggttcgtgggagtgaggctgaacgccatatcggcgcactgtaaacgcccttactactgggatgactacgcagcatgcggaacgcgcgccaaccaatcaggcaacggtctgcgcatctatcggtaggaacttcatcgatctcttcccgacggcagccctagccgagcgtgacgcagtctcgccaagtcatggatcacagcctccgcctcccttctatgcgtgccaccgtacccaccggccggcgagacacatcggaagacttagccgccctcaactccatgccgtcgtctgctcgccgttcgtgtccaggacactctgctcgatcggccaaactctcagcacaactaaaagtacaacgcatgtttacaaatttatatatccggccttctgcacactcacttctctatatatactattatacccaaaaacgtttctactatcattaaatcaatttgatcccttagattaaaaaaaagatgaaaggccgtaggttaattatactatcagtagatcgaaaacacggtacgtagaaagcctcttgatattatatatggacggaatcatcctctcaatttcgagttcccctatactttcctctgttctcaagtccatatcctgtgctcagagttctccatggtcgctgaagtcattctaccaacgcaagacaccaacatcagctggtatgtatagggcacgagttcaacaatacgacccaagctctgtaagcaggagcgcaagaggctcctaatcacatctttatcctccgatcgtcccaactcgatcccaattggatggttccacccacaaccacgccaccccctccttaatttgctgccaatcttgttaggccatgtttataagctagcttatgagcaaaaatatctaagcctaaacaaacgagcaatttttctatttggcttttttaaagcaaaaaaacccactcttatatactgttaagccaaaaatttagattggagagcttttttttttcttatttaaaatgagggtacgactctacaattaaacttaattcttcaaagccacttgcttacaaaacatataagccaaaaatttggcttaaaagcctaatcccaaataaagatgccctaagtaccaatcagttatcacgttaagttagctaattaatactccagcattttttttattataagacatttttaattttttactagtcaaaacattgtagcatttctaacataaaacaaacttagatttgataaaattattttgatgttgttgatgttgcgattttttctacaaacatagtattttttacgaaataaaataaaataaaaattaaaacgacttataatataaaacataaaacagaacaagtattatgttattagttatccgatccgactttatgctcccaggtaaacaaatgattagctagacaaaacaatccgtacctcctcaatccaacatctccaaacactagtaattgttaccagcagaagtggagggaccataaatatataccgaatgaaaattttcaccagtattaattgtagccacgacgattaattacattttgagaccatattaaaatagcaataagtcactcagatgataaaatagcgtgacccaggggcggatacaggagtagggcagctagggctacagccctactcctgatcctaaatatgcattgaaatttcattttaaaacttcaaaaattagaagataaagacaaaattatataaattcaactaattgagttctatgtttaaaaaaaattctgactccgccattggcgtgaccaaaacatcccaagatcatcaggaatataattgatcatcatctcatctggttcagtaactagagatcgaacaataaagcaaatgcacttacctggagaaattcaagtactcgcagctctcgccagctcagtatggcgcggggcttggtcatgggatggtgctttatacactgacatattcatacgaggccgatcgatgtggatcagcttgataacgaaattccaaacgttagtataacaaaaaggtcaggcgcggctgagctatattatgtaattaatctacttgattaatgagaaattaaactttggctatatcagatcacacgttattggtcgccgagcttccaaaaagcatccaatatctttattagtatcgaacaacgttaattattgatcagctgggtgtctatattatatactagtatataggagagagatgatggttgactacaagtcatctatacaactcgctcggatgatacttttatattgatttatagccagtagcagatccagaaatttagttcgttggtatcacaacgtgtctatcggtgtcatagcatgttaattatatttagaatatagtgttataatatatggataggtggtttaagtatagcttttgccaaaagtcatcggtgtcacctgacaccgatggtattactgtagatccgtccctgtttatagctagtcattagctctactattaaacttgctctgatggtataagtctactctggtcgtacaagtcagagcttatttttggctgtatatatatatatatatatagacacacacaaatatagaggtcagatttttatttattattaaaaaaagtcagagcttatgtaaagtagtggagatgatatatattttggcatggaggaatcgtcatcttcaaaatgaaattacaaatggccaactgtatggaaccaattgaccatattaatatgaactcaaccattgtactagctagctattaatgaatgatcacagcagctgattgattacttattacgatgttcaacccaaaatagaaacatcataggtaaggcatgcactcaaatcattaaggctttttaatctccaaaagagagagattgaaggattaagtgaacaaggcctaatgtgaagcatgctggacctggaacggttcaatggaataacaaacaaaattaaccctcaggcgatgtcttctttttacagaggtcatatatttacgagaacttttgttgattactcatgtggaaaaatcattgacattacatatttgcaaacctctctataatatacacaatttgttcaaaaatattataattctagataatttttttgccagagattaatcttgaggagaggaaaaaaactttgatgtccttgttaaatgaggaatggttgggaataatgtgaaaaaaaataaatgggaggtaatggttgatgggacaaattaataatactctaaataaataatggtataagtatttatattttcatacaaattttaaatattagacatgattatattttggaaagaaggcgatagacaggatgctcgacgacttactgccagctgggtcaactcatgagagtcgcctgctgcgttctgaagcctacaaatcataatcttgtttgcagggcagcaacttgcttaccttgtatgcggccctgagtatggagtatactccctccgtttctccgtttctaaattttgataccgttgactttttagcacatatttaactatttatcttattaaaaaaaatcaagtaattattaattcttttcctatcatttgattcattgttaattaaatatactttcatgtttgcatatagttttacatattttataaaatattttgaataagacgaacggttaaacatgtattaaaaagtcaacagtgtcaaacattttgaaacggagggagtacttgttagtacatcgaagatttggtcgacagattccttcaacgaactaatgaatcagcaatcatcacttgagctggaagaccgaagcttttaatataacactagtccaaaaattccagttgcattttcacccctttgtttcctcatacggagtagaagtatataccaagaaccctgcatgtatgatgtatctgtttttgtcatatgagcaagacaatgcacgactgtgtaggtgctgtttggtttgctcctacaacttatctaagattgccacattcactactatacaagacatcaaatgtgccagtcaggaaaccctcgttgttgccggttttttcaaccggcaactgaaggcggcattaattagtgcgccgacagcaatatcgttttaaaaaccagcactaatgtggaatcgacgagccaaaaaaaaaggaaactggctcgagccaatacttcgagtcgatgagctcccacatgaaaaaacaaaaaatgatgaacagatcccacgtcaactcacatcaatagatgaataagaacaacacatgatgaataaatctcacatcaactcatgtcgacacatcaacatatttcacatcaattcttatagcaacaaatgaactcctacatgaacaagaacgcatctcacatgaacaacaacaagaatcaatatcaacgcatctcacagaacgcatctcaaagaacacatctcacaagaacgcaactcacatcgacgccgccgccgccggatccactacaggagactccgccgatgccgccctacctgccaccgccgccgccgtcggatccgccgtgggagagggcgccgccgccgccccacccactaccaccgccgctccacacaaccgtcgatgtcgccccgcccgctaccgccgccgacgccattggatccgccacgggaaaggccacccacatggagttagagaaactaggaaaaaaactgttgaactgagggatcaaacccaagacctccttgttcccacggaaggtctcaaccaccgggctatgtaacgatgttctaggattgtaacacacatttatttgaacctctttaaaccagcagtttgaccggtcgaaccaataaaccagtgaaccgagtgcctggtccggtcttaataactatggtgccaagcatgggggaaagctagctggcacgtgcgcgccagcggcacgcacttccgcgtaactaactccgttagttaacgctaatgacagtagattgaaaaaattttcagttagatttgaaaacttttgacttaagatttaaattttaaagtcaaattttgaaaactttcaactcaaattcgaaaactttcaactcgagattcgaaaactttcaagtccagatttgaaaattttgaaaactttcatcttgaaatttgaaaattttcaactcgagatttgaaaactttcaactcgagatttgaaaactttaaagtccagatttgaaaattttgaaaactttcaacttgagatttgaaaatttttaactcaagatttgaaaactttcaactcaagattcgaaaactttcaagtccagatttgaaaactttcaacttgagatttgaaaattttaactcaagatttaaaaaccttgaactcgagatttaaaaactttcaagtccaaatttagaaatttttaagttcagatttaaaaattactagtaaactaatcactagtaaaaaaaaataggaaactaatcactagtaaaactaattacgattttttctcctactcatacggcatcaaactgcgaagaaagcaaaacaagaaaaaaagaaaaacgacggtaggttagcgaaaaaaaatcgcgtgcgcgcgatgcgtgggccgtgtaggccgggagtgcacgctgccggcgcccgcgcacgaattaggattcttgccaagcatgtgggctgaatgaatcatataccgcatatgggatttacttctattgggcttccacctgtgaccgttgagggaataagttcatctgaggtccctttacttgtcaacaaatccgattttcgtccttgaaccctaaaccagatacaacgggtccctcaactatcaaaaccagtgcagataaggtcccacagcagtttagatggcggttttggctgatgtggctattttgactcggtcttcctcttacgtggcactaacgtggcgcttacgtggcaattcgatccggaaaaataataaaacccgtgggacccacatgtcagtttcacacacaaaattaattaaaaaggtgggacccacgtgggccccacatgtcatcctcagtcccctcctcttcttcctcctctcccccctatttcccctctcctcatctcactggcggccactgggaaagaaacggcgcgtgggcgccggccggagggaggagaggagtggcgcatgtgcgggaggcggcgggagagaaaggagccgcgtgcaggcgccggccggagggagggttggagcggcgcgtccgtgtagtcggcggccggcgagaaagggttgcggtagccgacttctccctctacttcctctcccgccgccgctgaagacgacgacgacgatgacagcgacgggtttgacggcgtcctcttcttcctcctctctccccatctccctgaagatgcacttaaatcccctagtgggttttggtgattaatgacaaggtggttaaagggaactaatgtgtttatcaagttttatacacaggagtttagtcccaaagtatgttgtgatggctaagaatacatggagaccccctaatttgaaagatcttcatgcgagaaggaccgaaagtggttagactaggttttacactttcaaaattgagtttaggaaaaaccgtactattaagaggggtttcaagtgtggttctagggtatacaaagtgctcttagtcatatccatgagtcaaaagatttttggaatcatttttgaaaaatgattttctccccgggatagagaggcctacccgtatgttctggccggaacttccgggcaccgaggtatagcgagaattttcctaagcgctgcccggaagttcctggcacttttacccggaacctcctggcaaccctccagttcaaatctgtgagtaacggctagatgacatcacctagccgttatatatagccaactcgaccccagctcattctttggccattccacttcagttctttcatgttctagggttttctagcctctcctaagctccctttgcttcctccactcaaatctagagcctatcttgagagattgagagaatagatgagagtgtaggtgtgttgtggagatggcttgaagattaggtttgattgagcactttggataccttgtgggctgtcacttgggcttattactctttgagatcttctcctagacggttaggtgtcgctcatgagcttccaaagatcttgtggatgtcccgggaaggtttgtaaaggttttcctcacctccgcaaggaaacgaggtaagtgagtaaagttcttgtgctgagctttcagaggttgtcctaggtagagcaacttgcacttgtggtcttttctagaaggaattgtgagttagatcttggtggtcactcaattctagaaaatgacctagaagtattgagttgaaggctgtggacttcctctgggatctttgcataagtgaggcaaggggttaatcgagacccggctctttggagcacctcaatggagagtaggattcgtgtgatccgaacttcgggaaaaaatctcctttgtctctattgtgcatgttctgtgattgtgcctactagtatcttgtgaactgtattctgtgaatctctgtgcttgttattgcttagctagaaactcattttactcggtgattttgatattctctattgcccggaagttcctggctcaagaactccggaagttccgggctactcatcactgcctagaagttccggtgttcatcaccaggaagtttcgggccctggtaaatttgaccgctgcgtttgtttttgaagaagttttcaggaacgcctattcaccccccctctaggccacatctctgcctgttcaattggtatcagagcctagtgctcctaattcaagcttcaccgcttggagagatccaagatgtcggacgtagggggagatgacgcgagtaatggaaatgaagatggagcgacaagcaagggaacacctgcatctaagggagtcactataccttttgattacagtaaaattaccattccctcacataactttgtctctgtgccttccgggcgtgctcctccatttgatgggaca

SEQ ID NO: 56966 - DNA, 5597 bp, Oryza sativa
  unsure (1)..(5597): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcaacccgtttcagactaagctgatcagaagaaggcattttaaaggttactgattttgtgtcatggcccttgccgagtccatgttgtgccagagccagttttgcttctttttttgcctgaaactcataacaatgtcagatatacacaacttcactttctttcccaaaagaaagctccacagcatgaactacagctggaaaaaactcccatacctttagctccttaatacgcttaaaatcttcatcagataagattttaccagcttcatcgcacgaagcttcagccttcttggctcctgccaacttcttcagagctcgaaggcttgcatctgcagcattaagttgccctatataatcactcaactttctcttatttgccttgcgactgctgttttttgacttatcatcctggtcactgtcatcatcctgatcagagccttcatcagaatcatccaatttctcactgagttcctcatcatcatcagattcagatacatcattctcctcatccatatcagagtccaattctagctcatcatcattttcttcactatcattgtcagagatgtcttgatcctcatctagttcctctgtatcatcttcatccccagatagttgatcttcctctttcataccttcatctgtgtcaagcttgtttgcttcagacgaaccatccaaattttgtttagtaccacgagcagattgcaactctttctcatcattagaatcaaaagcatcagactcatcgtctgagccttccccttctgatgaaaaatcttcatctagcaactcagctccaggcacatcagaagcgatagttgcttcgccgaatgcttttggtcgagccttcggatcagcaggacgcccacgatctttcttgactagcagagaaggacagatctgaacccaaaccaaaagaaggtttagctgaagtgaacaaaaagaaatcacagaatatgcaaaaggataagaactgacctcccggaataaagtaattagagaacgagcggcaatggaaacagctttttcatgggactttttgtataaaacaaggtcctggagtagatcttcattcatcaactgcaggtataacagaaggattaacagaggcctgctagatgaataaaataaatagaccaagaatatcttcctaaatatcttacaacccgcacagtacctcaggtggtaatgtagtatacaaacctgcatgtgtgttctcaacttctcatgcataagtgactaacgtgtcaggctacacaagactaaatgtggcctggtaaaaccatgtttataccttttcaattcttcattaagttacacttatatgcttaaaacctgtagcaatcgactatcacatccttttggagtttggactacgcaaccagtcatttaagactagtaaaaaaatgaaatcacaatttctactagagcatgtccagggcacaggaattaggtacaacaaaacatgaccaccataaaaatttaatgaatccatcacacaaatttaaggggtgtctggtcagaggtcagtagcactagaaagcaagagtacagatttgagcaaggtaagtaccaaaggtattctcatgcagatctctcgcacaacattcaagccaacagcaatagcctaaaatgagattggttagaaatatgccatgttagttggaaaatacttaaatatattagatatgtgatgagtgttatgcaaacctctgggcgagaacgatcatgcacaaattgatttactatctgcttaaacagtggttcaactgcatcaggaggcacctgaaattgaagcatattaatttagctgaatttggacaaagcaaaagaaatgatataagtagtgaaatataggagaagagcaaaagtgtttcaaccatatcatggcaagcctgtactgctgcagcaagtaaagttgttacatctcgttgatgaggctgcatcacagaaaggtagaaaacttattatcaaaactagtatgaactagtataatgcacgtgaggtgcaacggtttttttttctaattgtctattatattatcattatgctaattttgctgtcatttcgtaaagatgaaaattttcataatattctattgtcatattttcctttcgacgggatctatggcatgtgggggctaagagatacgcaactcacagtccgtgggtccaccaccactaccatcttttatattagtatagagtatagataaacattatatctaccataaggttgctacaagaagaacacatgccaagttaagaacatacctgaacgtatctttgaagatatggatagaagttcaacaaaaccaagtgatgcagcccaatagtcctcgctataacctttaacatcatcatccttacctgcaagcacccaaccaacattctctaaatttgaattaacgtttattttcgtttaaccatcggatggaactcacaacagacattgtgtttaaaaaataaactattgcacatctgggttccaattctcctacttgaatgctggttccaactatatacactcatgtataaaacttcagcagaaagctaaaagtactaagtaatgatagttctgacaattatatataactttttaaatctttacagaacaaggaatcttcagaacaaggaatggggccaacctcaaaccgctcattgcatttctggagccgagagaagagcttctcagcaaaaccctgtcagccaaaaaacgaaagcttcaatataacagtcaatatgtaaatgataacactctgaacaattatgggattacaccatttcccacctgaggatcctttaaatacgtcagtggtgaataataattggagccagtgtcctcagtggatttacgttgttgccttttcatactacgaatcacacgctgcaatttagctttcttctttttcttagtagcagcagtgcccttgtgatttgcctgagaaagtaatatgacaataaaatacattatatcagaaggcacgtaacagaaaaaagatgtaaaacactataaatcgaaataatggtaaaaattcaaataaccttgtaaacatcctctttactaagaataatttgagggttttgagcttcatcttcactgctggatgcatcactatcatcttcttgctcaacgttttcatacccaagaaggaatgaaatagcggctatcataattctgcatgtaaaagatatattttagatcaacacctattaataaacacaaagatgctggcagtatgtacctagaagaaccatggaaacaagcattgcatatagcatttgctgtgcggtcatcaaaccagaccctccgacggtgaagatcacatagaatagtaaaggccctctttgctctcgactcttcctcgccctgggaaacagcgaagcaagatgcataactaaacgaggtaggaagagaatcatgaatgtattcttgccactatgttaaacccgataatactaatcagtgcaagtgtggtatagtggtatgtcacaaacctgtaggaatgtgaaaaggatgttttgcagtttacgattcctggcttcattcttgtgggtctgattcattctcctgatactgtgtacaatatgtgagaatgctagttttttgacagcccggtcccctataacttgaagctccataaataactccattgtgtcctccagatcaacaatctaaacatcaaaaagcaatgtatacgaggagaatttactctacagtcatacgataatcccgttccaatccacacgatttgaacaaaatttaacttaatgtgaaatgaacagatgaactaaacaggcgtcaccttccgattcaccagtagtatcagcgcctgcacgaggtgcacacggagcccggacggcagcgcgcgcgcgttggtgtcaagcaggccaccaatctggtcgggcaagtcagcgaggtcgtccgggtagaagggcgcgacgtgggcgaggaacagcgcgaggtcgccgagctccttggccacctcccctccgccgccggacgaggacgtggaggccagtgccgcctgctgccggaagaggaacaccgatgactcgaagtggcgccgcagctggcggagctcctcctcgtacccctccgggtcgcgcttcatcttcgcctgcagcgccgggaggctctgccgctccccggccccgccggtggccgacgccgacgccgcctccggcgtgaacgccggcgcgtgctgacgaggcatcggagcggaaaatccggtgtcccccgccgccgccgccgctgaggtgagaatgctaaaaccctaggccgccgcaaaacttcccgggagaaccgatggcaagaggtagtcgacgatgcgagtgactgggctggccagttacagtacacgtccggcccattaatctagctaaatttggaccagtaaggcccatttttcctccctctagcaaagaaaataagtctaatttgaaagacctcggtcaaattgcatcaatcaaccgcaaaaccgggtatatcgcactctccaacttcaaaaaccggtataaatcgactcctttgatggtttgaaaatcgattttctactgatgtgttaaattaaccgtgatcaaacttattatatccgaattttactattgaaggagacaattcaattagaagcaagagatgagggaagaaaaatatacttagagcctctttatttagggaattttttcttggatttttaagtcgcctttttagtttatatgatttataggctaatggattgaagtactaagtttaatagtagggtcataactctatctagcgtaagaaaaaaaaacttcttcaacataatttttgatgatgagtacaaacgaaagaactgcatatttgttaagcttagactttccagctcataaggttaagagcctactataagcttcaaataatctatagtcaatctaatagttaatttatacaatagttaactataaatatacactaggggtgtgtttggttggacttttcaacctgcttttccttttgcaaaagtcaagagtcaaccaaaggacccaaaagcataagtgcttttgctccaagtgcttttgagggaaaaattacccacctctgccattatgaaaaaacggtccgatattcttttcctcgtctcctccttctcgcgagtcgtgacttcatggggcgagcgtcggccatcgggcgcattgggtgtccgccatcggcgccgcccccgcccttccccaaccgacgccgcccaacctgatgtcggcgcagcccccgcccttccccaaccg

SEQ ID NO: 56967 - DNA, 36492 bp, Oryza sativa
  unsure (1)..(36492): unsure at all n locations
ctcaactaaacacaccttaagagcttagactttccagctcataggcctaaacaaagaaggccttcttcctctcgcgaaccacgaggcccagttggctagtaatcgttcgcggctagccggcccaccggaccagcgcttcccccgccggcgtcgcgcgtacgtaggagacgacacgacgacttctccgtgagatcgcgcgaaaatcacgacctcaaccgtgcgacggggggcgcaagcgcgacatcacgcagcgtctcctccccacccacccgccacgcgcggcaccggcaagcggcgacgcgcgacggctgcgcggtcgttttcggcggcacgccctgcgcgcgcacataattcattctgctcttcccccacggtcgcgtggtcctttccgacgcccccgtccgtgacaaagccaggtttggtggcgagcgaacgagtgactcgatcatgccccgggtcgccgtcacgcagcagcgccctgtgtctgcccccgctccggcgatcgacggcgaccgatcgatcggcagctagcgacgcccgagcttacatgcgcgcgccgcgtcaccttcccgcgaccgatcgatccgtcaatcttccgctaccgtgtatacgcagcagtgtcggctgggacatgtacatacattatactaaaatacagtactacgagccgctttctgaaaaagaaaacgaaggccattattttcctctgtttcttctcttgtatttttctggttgcagcacagacgtcgtcgtcatcgttctatggagtcatgtacaaacatatttaaaaaagtcaacggaaacattttgagaaggagggagtattaaatcagcccgcttgatcgatatgggacctgttttctttttctagaatctatcattaatcagaaacgtacgcttagctagcagaaactggtagtctggtacggcgttctactgtacatacatcttggcaagaggtacaccggtctaacatcgactataccattgtcacgttttgcgtgaactgcaagagaacgcatcactgggcatcgctaggccactatcggtgccattatgtaggagtacaaggtaatcaatacactccctaatcaaaacaggattgcaatccagaacagcggtgacatctgtattaagctcgcagatactgtaccaattataactcgattactcaaacaacaaagcactggcacttcagtggaccacgtttggcaaggacgaaacgtggttttaaggcgaaaaaactcaggagctttgagaggggacagcagcggtcatgctcttttcccccaactaataaagcaccagaaatagtaaatggctagctgacaacgtacgccaagcatcattacaccaaacccccttcacaaatccatctttaaggccctcgtctgtgggccaattgtcgaaaatacgtcgtacggcgcgttagaaaagaatagtttataggttaaatttttctatatactagaaaaaaatgcccgtacgttacaacgggtgaagtcgattttaatcttattattgttatatgttttagttaaaatgaaattcactgtgagagttcgctttatatatttttagaaaatcatgagctatatttaggagtctaatcatctcaagttagcatgcaagttttttaaaacaaatttcttatatgatttcttctgtattaccaaaagtggacgattttaaaaaccgaatcaaatacggatacatatttttaaaagcaaacaaacttaaaaactgacgtatacacatatgacgtaccaaaataccgataaaaacatcttaaatttttataatagtagagatatgttcaatgaaaaaaattaaaataaactctaaaatttaaattttgacagcggttaattctatatagaggaaccaatgggagcctaagctcttttcagttactgtctgttggcttatgatgacacgctttttatactgtttgtaaaaaacttctctatatatatttttaaaatagtcttttaaagaaactataataattaagtatttaattaattataaactaatgatcttctcgtattgcgtaagacaaataagatttgaatacgctctaccgaacgcaacctaaaccggtaaggcacaaggcaattaagacctaatctcgcaacttgacgagacgagacaccaatttactaatactaacaaacagcaaatttctaattagcatcgcgtcgattgtccgatcattctcaggttccagtgcgcgaggtgactgacaagctagcttaactattcgttgagatttcaggaagaaaaagctgtcaaaagcttaataacaagacgtggcacctctaagctgttgattcccgaaaaggacaaagaaaacgaggagagcaacgtcgcaacatgccccggcccggcccggcccattatcagcaaggcccaaggcgacgcgaatctcgaagcccacaacatcgaagttgaccgttcaacagaaataccgaaaatacccctgactaaccaatcatattacgcgaatgaccctgcccgagccggccagccacttagacctggtcaccgccggcttgggctttaaactaacaccagtggcattgggtgtaaataaatcgaaatcggaggggtggggtgggtacccctgatgcgtcagcgttcaaaatatttcgaaatagctcggccgcctcgtcctcttcttctccttcctctctctctctcttctcccacacatctctcgctcagatccgagcgaggcgagaaatccatgaaaaatcgagggtaatctccgctcggtggcttcaaaaacttcgaatccttccccaatttcatcggctccgcagtttttttctcgaggtttttcggatctaaagcgcggctttgtcggcgcttgtaagccacgagagagagagattcttgtgccttcgagctcactccatccggccccaagaaagctcccctcctcccacccaccgccaccactgaggaggagagaaccctaactataacccctaatcctgccactaatcccagttcatggcctcctccctcacgccccgtagcccttacccggtaattttctctcttttgtggaaagaaatcgcctattttgggggagggttgattcatgggagcttagttcttgcgatttgtggggtgtggttgttgttgttgttgttgcagaagaaggagaacttgggcaacgcgcggcgggggatgggggtcaagcctggcccgcgccgcaatgtcctctcggcaatcaacaatggcggtggcacgaacagcgacacggcgtcggtggacggcggcgagggcggggctgggccggcggcgcctgtgatcgagttcaccgggagggaggatgtggagcggctgctcgccgagaagatgaaggggaagagcaagaccgactacaaggtgggttcttttgggggatttcttggcgttcgttctgtttgagaatttttggggggcgggtttcctgaatttggttggacctgtgcaggggagaactgagcagatgagtgagtacatcaagaagctgagagcttgcatccgctggtacattgagttggaggacggctacttggtcgagcaggagaagctccgtagtacgatggatgcagagaatgcccagcacgccaagttgggtaatgaattcgaatgcacttctcttttttttgtatttatttgatcacaccaagagaacaagatggtactcttttgggttttgagcattcatgtgtgctgtttggtcatcagagtaccatctcatcgtagtgactgagtttattctggtcatttatgttcttggggtactgtacttccagaggcccagcttagcagtgatctggaagagctgaaagctgcacacctgaacttgacgcggcagtgcgattcgttggaggaaagcttcaacaaggagaaggccgacaggatggttagaactcatctatcgcataataagctgcatagttatgtactgttgctgtgtgcctgtgtgattggtttcagccacggcttacacttgttgacctttaaactggcagcttgctgtggagtcctacgagaaggagaggcagcaaagggaatcggctgaggcgtccctcgacttgctgtcggtggacctggaaagagtcagccatgaagcaaaacggtttagtgagcaagtacgtgttcagaaatgttctattagtcttacatgaatttgagtcatatataatgttcctttctgatggatggaaattgtgaactagctgaaaatggtccaagacacgaacaaaagactgcaggagtacaacaccagcttgcagcaatacaacagtaatcttcaagctgatgcctctaagagtggggacatcatctcaaaactgcaaaaagagaagagtgccatgatggaaacaatggcttctctgaaagatttaaacaattcaatgaagaaccatttggattcttctagggtgagttgtgttttttcgtgaattgataatttttttgggcagtatagttcttgtttcacttaaacatttaattgttttgatttctgttagacttctcaacaagaggccattagaatgaaagaacaacttatgaaagaagtggattgccttagaattgagctacaccaaattagagaagaccgtgatcagtctgtttctcaagtaaataccttgagtgctgagcttgctaattacaaggaactagcaggcaagtctacaaaagactgtgaaagcttgagtgtaaaagtgtcagcctttgaggttagtggtttcagattaaccaaatcaatactttctgtgcgcaactatttggctcaccattatgcttctgctcaggaaacatgtagtatgcaacaagaacagattcaaactttgcagaaacaacttgcagttgcaacaaataaactgaaggttagaaataatattttgtcagtgctgatttacatgtgagatatgattatatgacatttgatctaattgtttacttttgcagcttgctgatgttactgcaattgaggcgatgacaggatatgaagaacaaaaggtgataataaaagatctggaagaacgtttggcatccgcagaatttcaaattgttgaagctgacaagctacgaaagaaactgcacaatacaatattggtaattgtttcagcatactagcacttcttactaaaaacaatttctctattttactgacagaagaaatttttgagtaaatactgaaattttttcatcttgctattgctacttgttactgattagcctttctatttgcaggagcttaaaggaaacatcagagtgttttgtagggtccgaccacttttgcaagacaacgattctagtggtgcagaagaagcccttatttcatatccaacatcagttgaatctgccgggcgtggtattgatttgatgaaccaaggtaaaatcatattcattgttgaagctaaacagaaactatgtttcccccactaagttttcagtggtaaagttaatcggagacttcattttattgttttgtgttgatgtaggtcagagattttccttctcatatgacaaagttttcgatcacggtgcttcacaagaagatgtgtttgtggaaatgtcacaactagttcaaagtgcacttgatgggtacaaggtatgaatatttcactacaacaatgaagtattggtgaataatctgttcatgaggttcctgtctctaataactcaaatatcctaactttattttttttatttcaagaacaaatgaaagttgttttaattgatatggtggcaccccaaattttatctcttcagcaccaccacataagcacaaatacatgctaaaagccgtgaacatcttacattgatgtttctagtatatatcacctgcattctgcatttgtataatcaccattatcttgaaactctgactgatgtttctagtttatttcagttttgaagtacttgtcaatttggtatgcttaagttatttttgcatgatgcaggtttgcatatttgcttatggtcaaacagggtctggtaaaacttatacaatgatgggtccaccagggcgtgatcagaaaggcatcatacctcgttctttggagcaaatttttaagacaagtcagtctcttgaatctcaaggatggaagtacagtatgcaggttagtatccatagtgcaatgcagattctgaagtgtacattctatgtagtgttgctgagagtttttcctatgtgcaggcatcaatgttggaaatatacaatgagacaattcgtgatttgttagcacctggtcggtctaataactttgatctgtctaccagtaaacaatacaccataaagcatgatccacaagggaacacaaccgtcactgaccttactgttgctgatgtttttagtagcgccgacgtaacttctcttctagcgaaagcatcccaaagcaggtaaatacgctttattcatttttaatcattcacttgtgccttgtaactgtttgctctaagggtattgaccattatcagtttaatgttatatttgaaatagcaatgctttggatatgtctagatgattctctcatctatcactcaaatatattagagagagcagaaacataagagggtttaccttttatacaagctagcacttattatctgaattcacatgtgtctgttagccacctagtctacatatcaacagtgagtctaaattttttttcaccacattgaaccaggtctgtgggtaggacccaaatgaatgaacaatcttcccggagccattttgttttcacactgaagatatctggatcaaatgaggtactcgcttcacccatattttagaatattaatcacagtgctgaaactttacaaactggtcacaatattttttttttcattttcatgctaactaaacagaaccactgaaacttgagcaaatgtatgtcactaattttcttttgatcttaatgcagaacactgggcaacaagtccaaggtgtccttaacttgattgatttagctggcagtgaacgccttgctaaaagtggctccacgggtgatcgtttgaaggaaactcaggtgagtgtgttcatcacaaatttacaatattcttatttgataatcacattgtcttatctgtttgttttctttatgtttcaggcaatcaataaaagcttgtcagctcttagcgatgttatctttgcaattgcgaaaggagacgatcatgtgcccttcaggaactcaaaacttacataccttttgcaggtgagtgacttgtgcaaatggatggtaatacaaaaacctgcaatccctgaatttatttgaaacatatttcttatatcaactttctattgcagccttgccttggaggtgattccaaaacgctgatgtttgtcaacatttctccggaggcatcatccgttggggagacgatttgttcactgaggttcgcttcaagggtaaatgcttgcgagatcggaataccaagacggcacacacaagcccggtccttcgattccaggctgagctatggctgaagttgctgtggccatcatgatgtgatgataatcgatcagcattggggatatcatttggctgaagctgatgaggccgcttgcttcttgtaacttgtacagtaggaaggagagtggcactgcgctagtgcgctgtgagcagaagagaacacgcatgcatcatgtgttttctttctgttgtagctgatttgagcaatattaactgcattgcaatgtattttctggagtaactttgtatgcaaccgtgggttccaaaatggtgtactacttttgcccggcagaacttcgctgctggctcctgcatcaaaatgatggttatgccacgaaatgtgtatcggttcgtgccatatgatttgtaactctgtatttccctgcgttttagttctgtcatggaatgcgtattcattctccgtcgatgcatccactgaactgcagtgcaaatgcagtcagtgctcatgaagtttttcagttgcaaacttggaatatattccacagaaccacagaacttgcggtggacgaagattaactgcaggtacatgattaattgaggtttattacttcaaatattaaaaaataatttatctaataatttaaaacaacttctatataagaaagttgcacaaaatgcactgtctagtagtttgaaaaacatgctaataaaaatgaggtaaaatcagtatcactgtatcacaatgagaaatgaacggactatgccttttttttttccttcttccaatcgatttcaagatgcactatggttaacggactaggccatactctttttagattactagagtgagctcgcgcgctacgctgcgcggtattgtagcatgtaagactgtaacgcacagaaagaaatgtacgattgcaaggtttgtctaagaggattacctaacaacaacagtcaattccttgtgtacctactaagaacattatttaacctgtatagttttttttttaataactgaagtcgccagaaacagttcctgatagttaataatttaaacaataatttcacaatacatagcaggggtggcaagcatagtatgactcatccaatatcaatgggcacaagatgcagttcgttatgtcaactaactgaaaatggaacatggttaaatttctcgtagttttgtttgcgaggactgcagtattaagataatatctgtaaactctagaactggccaaaaacccagtcagatgagacaatagtattgcatttatcaactatggtatgaaagaccgactacatatttcagattcattagttttaagaagagacttgacacttcactatgagaactttctgttcaagaaacatatccgcctcagcaattcagtcaacttagatcaccaggtgcaatggcaagcatctgctaaaatcatttcttgaacactaagaaaatatgtgccaagttaaatcattcctaagttaatagtttggagaattaacttagcatattgagagatgttactaagtcagtagaactcaaagtttggagaattaagtcagcacatggagagatgttactgagtcagtagaagaaactcaaattaatgaacagatcctcatttcagtcagtgttatgttactaatcagagcagtggactcttaaaatagccatgtaaatgaacttatggttcctgaaaagagacatttaaatgcaacaactgagtatccactgtgaatcaatggacgatgtatacatttacatcacctgtctgattaattagctaccaaactactttgagagttgaatatttgtatagctaaggcagttgtagatgacaaagatgatggatatacctgccttacagtatttcgaaaagaaaaagatcatcatggttaacacatgtgtagggatatttccataggtatttcaaatggttttcctgctttccgtaaaaaaaaaatggttttcctgctaagcatgagcttcaatcttgtcgcagtccttgaggagaatctatatgatattatgaaatatgttaagataaaaaagtgagcgaagtacatcaattatgcaagtgagaaaaggcagtcactactacatcagtgcaggaaacaccaattattcaagtgtgggattgaaccaccactgcagcatgatttttagcttggaaacaactttggaagtgatgtggtggcagaacacaccaatggaagagctatatctgcacaggctataaagaccatattgtttgtgctttgctgcactcaattggcttggcattgttaaactttgcactaggatcacctaggttagatctagtcgggtggttctatttgggtttgatgtttgaactatagagattgaaaacgggagagggtttagatagaccgaccggttgaggtgttggaggatgaagaagtgccggccatcgtcgtcgttggcgctcggttgtcgtggatgcggcgccggtgaggtcgacggcgatgacggctgcgggagtgacggtcgtagatgtcccggcgatgaggtctggcgcggcggtggcgcttcccgtcactggctgcgccccctctcgatcggattagggtttgtagggtggagttggcggcggcggtgaatctcgtaccatgtgccgtgccggcctccacccctcttttatatggcgcagtgtgacgggggcccaccagccattgggctgggcgcccccgatcagggcgcggtcaaggccctcttgagccgttgggctcaaggggagagagatctatctaacattctcccccttgatctcactttttcttttagctttttctattccatcacagatttgtaaatagagcatgtttcatcgtcacggtcaatcgccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagtgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaaccttttggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgtagctcctcctctggcgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcaactgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcgccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccaatgcttctgatcgctctttaattggataaatataaccatagcgggagtaatcatctgtgaatgttatgaacgagtcatagccatccacacttttcacaggaaatggaccacaaatatctgtatgaatgatctctaaaattcctgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagtttctttgcaaagaaggaacataaaagacatctcgaagtaaaagtatgaagccattcgcgagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaaatcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccattgtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaaggtcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaatcgacaaaataaaatggaaaaattgctactgttctcttttattcattttcggccccgagggacctaaattgaacttttccggcctttgccggtcggcctatggccactttgcgcgcgggcaagcgccccctcccctcccccaggccgcaacctgggcctgggccgggaaagccgccgccgcgcgctccccacttgggccgatttcggtccggccgccgccggccgtccgatcagctagggtttcgatcggacggccgggcgccgagatcggaggatcaaaaacccccctctcccggccggccgccgaaaaccctagcttctcttctcttctctctctcacgcgaccgcgtggacggcgtcgccatcgccggcgaccttcgcgccgccgcgccatggccggcgctcctttcttttctcttctccgctccccccaccgtctctaacccccaccgtgtgagagagagatggcgacgacggagatggcggcgccgccgcgggccccctcgccggcacgcgcgtgcaggtgcgcgcgcggccgtcgagtggctcctaggcggcgcctctttgcccctccccccctccgttgccggcgtcaacgacggccggcgacgaggtaagaataagggttagggtttttggttcttttgtccgtgcggatcttgtgcttttctttctttggatttctttccccgaaacgatctaaacactagggttgctctganaccattgttaaactttgcactaggatcacntaggttagatctagtcgggtggttctatttgggtttgatgtttgaactatagagattgaaaacgggagagggtttagatagaccgaccggttgaggtgttggaggatgaagaagtgccggccatcgtcgtcgttggcgctcggttgtcgtggatgcggcgccggtgaggtcgacggcgatgacggctgcgggagtgacggtcgtagatgtcccggcgatgaggtctggcgcggcggtggcgcttcccgtcactggctgcgccccctctcgatcggattagggtttgtagggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacaggcattggtaagttgatttggtgggcaaaagagttggatcggagtgctccaatctaacacagctcagccttcagagattaagaccacagcacattctataagagactaagaacagctcatacaaaagcatggagtatttttcctgtatggttcagaaaatgatcaatcggagtgctcttttttttgtcaaaatggtaacacatatacaacacaacaatttactaattacatataattaatgaataaaaataaataattgaaatgattaacttttcttttctctacggagaacatcggagagcaaagcacatgaaggatctcttctgcctatttaccttgtatttgtttgtcagtaatatgctggcagctccgttcctgaagatccatgagctgagcatagtggcttgcccctcccaacattagcatgtatcatgaagtctagccgtctgtttacctgtatgctgaaaaacaccaaataatttgtgtaagaagattctgctaaacttgttttaatcctaagctggccactttgacctttctttggagctcagttttggacaatgaagtagtggcatactgacatgcttaaagtacaggaacagaaaaatgaatagaatctcattcgcaggagaggatgagagctccttagtaattgtaacttctttcaccaatcaaaagtttagaacatgatttctctaaaaaaaagtttagaacattgaaagccctaatggaaggaagctattaatgtgagaattcatcctaataaaacatcaatgttgccagggaatcaacaggtttcagggaagctcaccagttcatgttttgcctcatgacatcacatcgactctctttccataagaggaattggcgcagagttcgaattatcagaaggcaacatttaaaaaagaaatagagagagaaatctggaggcaccaatattcggaaatgtgctgggttctatctgaatctttgaacgaacttcccaaacaaacatctgataaatttagcctaaattcagaacattatcttcaatttatgctagatgagagataagagaagggaaaccgtaccggaggaggacaggtagaccgtacgccgatttctgccattgaggaaatggttgtgtcagctagcaacaccgtcgggcaagtcgctgaggaagaattgaaagatccactccccgcccgccatctgtgctagcagtgagccaccgagtcgaccttgatgccgaagaagaaggcgacgctgcgatgccatgcggcacgccgatgctgaggacgggatggggagtatgtgatgctattcaagcttgttgtacgtgcagccacagtgaagaacataaaggggaacaaacaaattgggaagagatgcggatgcggagaggacgacgacgagcggatgccgagaagtggaagggggcaacgcggatggctcggcgagcagtaaaaccacgtctcggtaagggttggccgcgcaacctagaaggcagaaaacaaaaatcaaaatcaatgagcataggcatggtcagaagaacatcgacatcacaatggtgaaatccagagcgaagcacaactgaaaaagatcaaagcatacgggatgatgcgactagggaaagtaccgtctccacaaaaaacaggaactaagaggaagaagtaaggaacagaaccagcttcgaatgaaagaaagaaaggagcgatgcaggtaccctcgatctgctcctcatgggggtctccgcgcgtatttttagtggagcagccaaccctgtcattcccgtacaccatgacagagcactaccatggatgagagaggggctgctgggcattggagccttggaggtgtcgctgtctcgctgatggccgacacgcggcggtgccgattcgctgaagcggagcggacgagaaacacagccttcgctcaatcctagccggacatgggttggagaatgggcacgcgtcaagacggtagcggtggctcgcggatggctgagcatacagccaaaccacgacgacgcaaggccgcgccaccgatgccacgatggccagtaaaaggccgtcggtcgctgggccaaacaatcagctggcccatggtagcaggaccactgtaacgaaacaacgtgtccacaccgtattggatgcgcctctccaaatcgctaggagagcagctaatctagcacctttaaggcctccttcaatggttgagctagtgcactagctcatgcttgtccacctcatacaagagatagcaaaaagcctacctttttaataggttgtctcatagcacattgttcaaaatgctttgggttccacaacccctctcatattttgtttaggagcttagctcttgaagaagagatagtgcactctctctccttatcttctctctcttctacatcatacaaaagctgatgtggagatttatgagctagctgactcatccttgttggaggaggcctaagatagctaatccagcacctttaagatatttaatatatgtgtcagatcattttcttccggatcacttattttaaactacttcatctatctcaaaatattactaggattcatttggaagtatcctccatgttaggacagaggaagtcattattaaatttattttttaaaatatttaatttattcctatatgcaagtatatgctcctatccgttgcataatccgttcaatgactatatccgtctcaaaatacagtaacttttagctatgaattctaaaaatgattatattttagaacggaggaagtagtaaatctattttcttaaataaaaaaaaaaggaaaagcgagaatgagagaggtgcccccactatgcgattgccagctagcccatcacaagaagatcagaggccttcggacgcggctttttccggcgttccgccaccagtcttctcatctgcgactgcggcgctccccttccctaccggaatccccggttttgctgccccccagcccgcggagtggtcggatccttcttccgtatgcgtgcgtggtgtgcgtggagtttggttgtcgggttcaggttaaaaccctctgtagtttccatctccttttaccacttcccacatgctcgaatcgaagtaaatcgtgtgtagtagttttgagtagaatggcgctatgctatgctatgctacgctatgctacatcgtgtacttccaattgattcacagctcgcacgcttcaatctttgtagatcagtggtctgtttcactgctgtgagaaattgcgtgtggttttgcaattcatcggtgcttttttccccctttctttctaggttttgtgtatctaccgtctacagtcaccatggttggcaagctaatgggggattggaatataaatctctttttggtagttctttttttgtatgattgattttggcatgtctgtttgccatcaccttttttttttaattaggaccaccaatggatagggttgttggtattaaactcgcaccatatcaaatcatcatgttatctttctttttcaagtattctggactcgtggcctgcttgaaggaacaagggaacttctagagggtttcctctctcaaaaagctgttttttttttcataagtgagagcagttaaaccccaaatcttgttgaaacgattaaacttgccaaagctctcctagagactggattaatttctcatggttctgttcagtatcaaagtcttcaactaaaccgtaacactgaacttgagattttttattttttatttatttttctgagtaagagatattttatatgaagttactatgatgtccatcaaatttgaacacatccagacttgtaaatttcttggtctcgtctctacttttagttaacgcagaaaatgacaattcacagttattacttgctttgcaggaattctaggaatggcagcaaactaatcttctaacctcaggcagtccatgtttttgaggtgattctgtgacatgtgtgctaccttaagtaaaacaagctacgttttcccttccgtatggatctcctaatttgttcacttggtagctttaaactggatgttattgcaaggttgccacatgcaaaacttattactctagagcgggagaatacaaacttattgttctttgttattcgattattgcaataagaaatatatggaaattgcagtaggtgcgctctgcaaaatgatgatactttatgatatatccgatttcaaggagctaggaacacaaaaacatcgctttgtaatttaccatctccaatatgttctaacatccacaatttgttgtattgctaataaattgaccagctcatgtagaatacgttaccatttcagagctagtacccacctgataagcattccttttccactaggagataagctctctattaatttgctaccctttctgcatcacggcccttattcccgttgggcatatcttttatgtggttgatataagctcatagcttttgaagtactgcataggatactgactccagaagaaactaccagccaaaataaggcaggacccaccagctttagaatataaatccccatgcttatctaatcttcaggaggattgccacttctctttcctgtagacagtctgtgataattttgttctcttcttgttggggtcttggggaaaggagcaaggaggaggaggagaccaagaacacggagtgaaagggagagggttctgttcttgcttcttaggccatatggagatccagcagcagaagggggttggcaattccaaagttgtgaaggttgagaaggaggagtcatgggatctgttcgtcaatcaagcaagcaacgaaggccaccctgtgggttttttcttccttgccttgttcttcccccacctctttttttttcgccgggcttcccccacatctttcctgctttgtctctcatgatgaatattgatgttgtttattctcaagtcatattttggtcggcccacgatttttgtaattgctgtttgtagattataattttgttagaacgatatatgtataatagtttgtggggatggatgcttcatgcaacctgatttctgtaatcatgttcttttcgttctttctgggtctttctcgtttttctttcactgtaactgtaattgacaaactgagttccaaattgaaaattttcctgatgataattatccgctgcagttgcaccagaaatttctttttactcactcagaagttaacttggttattgacccctcgactttgtgtaggttgttgcccactttggggcttcatggtgtgtgacttcgctgtccatgaactacaagtttgaggagctagctcagacacaccctgagatactgttcctctatgtggatgttgatgatgtccaggtaaccattctctctgttttttttttaaagaaggaaaccattctcctatttttggtctcatgacgtgttgtttatgcatgtatttttggaatacatcccatggtcgtattttctctgagttgttctgaattctgaaagcgaagtgtcttttgaggaatagaaagtagagaaagtggatgcctaaactgataatttcacatagagttgtctagaaaatgtccttagacttcggagctttcatctttgatgttcaattgtttctactgaatatcatggcataaccatttgttacaaaactgctatgcatatatgctcattaaattagtttactgagccaagctgctatatcatataccgtgtgcatgcagagtgtttcgtccaagcttggagtgaaggccatgccgacattttttctcatcaaggacaaggaggtggtgaacaagattgttggtgccaacccagatgaggtcaagaagatggtggacgcttctgctgagtcctttggagttactgctcctcctgatatagtggtggaatagatatatagatgttgcctttatcttcagaaacttctctgtgaccgtgggtgcttcttggtcaggtccggaaaaatgcgtccatgtgtacattctagctttgctcctgtgactctgaatggtgtccctttgaactgataggcttgtgccttgcggtagtttgttctgcaggctgcagctgtggctttaccatgctctatgaaatttacttacatgtgtttccagttgaaaaatatgtggttcagacttcagagtttagactaaaaagatttgttgacagtatctggcatgcctagtagtgctttgccttttcacttcacatgatgatggatggtgtagttccaaagcgtactctgacgatgagctataaaaattgccatgatctctgcagccaccgcagaaagtgcacatccccaggtgtaagcaagtgtcacgagcagctgatttattcattgtaaaatctgcagatcatgttagtaggttgtaccgttatcttgctgttgcagggtactactaattaatgattagcttagcaaaagctctgcatttcaatcaaaagaatttgcatcataaaaggctctaacctaaagctgcatacctaaccacacctaggaatgaacaaaaaatgcaagctggtctttggcccagtgcaacatgtgaccaactatggacatgccactggttgtcttgaggccttccttcatctttgtgctccactattcaatcatccaaaatgagagtattaaaagctaaggggaaaaaagggcaaaagagaaataaaagtaagagaattattggaccaacaccatggaccctcaccacataacctgcaccatccaattctctgaagacccactgtagcattattctgaacttgtacacttcatttatcatcttgtcccagactccagttaattaccttcaatcaattactacctttttactagatgtgtcggcagagtagtgcatctcctatcactaacagcagacaagtttaggtgtgatatgatagcaactattgtttgtacctgagttagttagatcgatgcagagctgacttactggaataaactgcagaaacgagacttgccataatctgaatttctaactttactgtagtatgttttctgctgttcatatatacaacactgactaactgaacagtgagctgcactgactgcaaaagagattaaaatgttcagaaacatgcagtcaccgatggtgatcatttcactttaataatatgatgattaggtcgtgatactaacgaacctctctatatctccatctctctctctccttcacgtgaagcctcgcacgagtgcaaagccgacagccagcaccaccgccaaaaacgcgaggcgagttggagttggagctggatccctctcgccattgctctctctctccagcctcattctcttcccctctcgtgctctctgctgcgagtgcggctgcggcgttgcatcgcatgctctttgtgaattgtgggtgagagagcggtggccggacgagctcgccggagaggaggaagaagaagaagacgacgagcttagctttgcaatgtgctgctacgtggggaaggcgaccaagatcttcctgtgcctcgcggcggcgctcatcgtagtgggcctcgtcctgggcttcgggctggcccaccggacgtggggcgagcggaaggtccagccggactgccggtggcccgactgccagctccagccggcctacggcggcggcggcggcggcggcgaccctctcccggccacctccggcgccggcgacacgccgcccggcgtcccgctgacggagccggccgtggccgcgttccccggcgtcgcctctgcttcgtcggccgcgccgccgacggcgagcatgccgtaccttgggccgcccagcccgttcgcagtgggcctcgccccggcccatgggtgaaagcaagtcgcttcggagtatattttttttcttcttttttttttctgttgtatttttcttcttctgaatttgaaatactatgatggctgtgaattatttctacagttttgagtttctgcattttaagctggtctagccttctgtgccgttgatgatcattttggttggatataaataacgattttgattccaagtgttcttcggttcatgtgtttagggcttgtttagttggcaaaaaattttatccatgcatgtcacatcggttatacaaatacacatttgaagtattaaacgtagtctaataacaaaataaattataaattacgagacaaatttattaagcctaattaatcagtcaatagtaaatgtttactgtagcaccacattgtcaaatcatggcgcaattaggcttaaaagattcatctcgcattttcctaatgaactgtgtaattggtttttgtttttgtctatatttaatactccatgcatgtgtcgaaacattcgatgtgtcagcgtgaaaatttttgtttaaaaactaaacatacccttagtgctcatctttgaagacctgtagtagtccgtgcaaaataagtatattagggtgtgtttggttccacgtcaaaattagaagtttgactaaaattgaaagattgaagaaaaaaattgaaagtttatgagtgtagaaaatttttgatgtgatggaaaagctagaagtttcaagagaaagttgagaactaaacaagggcttattactctaatcctctcttgttttatattgtttttaataatcctcgtggctgtttatatctgcttagttgcaagttgcagcacagcaaaaaatcgatcagtaaaccaggaccgtccgatgttaatgcccaattaactaagatcatgggcgttgataatgatggttagtccgaatgctattgctaacaagagatttttctttgaacggtaacaagataattttaccgttgcaattacttattcgtttcctcctttcaaaatatcagtcgatttttcaggggttgacagcccccgttgcaacgcccaatagccactgacaggtggggccatctgaatttccgaggaatttcttccgaaaccgcatcatactttgcgttgagaaaaaaacaatttaaaacacacacgacccgtttccttccaacacaaggcacctccacgacgatttcaagccgcgaaccaatcgaaatttccaccctttcccgctcgcccgcgcccactgacacgtggggcccggcacgtgggccccacgcgtcagccacacacgagcgcgcccccggagaaaccggcgacgccttgataagtcccaggtttcccactcgtctttgcgagagagagtttttccgattcggccgccgcgcggccgtcacgaaccagataaaatctccacgcagttcccctcaaaaagaaatttggttgattttgatttgatttgattcgtgtgctccccgccgccttcgatccctccaacggataatcgccgccgacgacgacgattcggaggaggtaacttctttactactctctcttgcaagactggtttctttctttggggttattagcggttttggttcaaatggatggaatgcttttgtgagatgttttgtttcggggaggtgtgagagggttgttgcgatttgcgggagattttgattgcggcggatcatttttgaggaggagaaggcggtggctttgggcggatttcgcttaggtagggttttggtggattgggcggttttggggggaagttttaagcgatcgtgggcttgattagggttgtgcattcctgtagtcgaattgtttgattgttgtggagttggctttgccgttccttgtcgaaggcgatgcttgcgtgatggcacactcagttcatgttgtgacaattcttccttctttcaaaattttggcccttggattaatagttaatctttcatttgtgattttctttgaatagggtgctgcattttgatcaatacacttagcctaggaatgcattagtgtttacttccttaaatagttttatgtatcagtttattgcacatcactgtgcctggtttaggcaaatattgttcttgatgtaaaaaagtgttttttttaaaaaaatatttttaggtgttatttgcaacccttgtatgcaccaagttgaaattgtatttcctatctgggctattgcagtgccccttgaagaattaaaccacagttactgctgcaaattactgaatgcatcatttgttcagacttctgacttccaattcacaaattattttgcagaagatagtattcaagtgggttcatcaagataatttgtttgcagtgtgctggagatagtgtggtctgaccaggcttgttggggattagtgaagctaagcatcgcagatatctgacaacagagagttgatgcccatgtttgctagcacaatatggatattattgacttgtgttcagacagtgaagagtacttcagcccgtactcagatacagaagacaatcttgattttgacgatcccaatgatggtgttaaccaggtggttttgcacaacacagcatttggcaataatagttcagaactactagtcgggctggatgacgataactggttaaacaacactcatgctttatcctctcatagacctgctgagaatagatcagacattattgaaagcagcagcggtgtcaacactgactgtcagaatagtgcttggcaatacaggactcttccacataccttcatgagcagcagttacaagtctcgtccactttctctaacaggaggtaacaatgttgaaagtacacaccccactgtgaagcctaacactgtgcactataatggaattgggttcccttcacctgctattgcaagtggctacaagccatatgttagttatggccagggtgtttcaattgatgatgatgacggtgagtagaactatccttgattaacttgaaaagtatactgctgtaacttgcgattagtacaactaaagtttttcccttttgaaacctgtcagatgatgtctatgaggttctgcatcaaccatttccgttcagtcattcgagtttaggtgacaagaagatcgaggaagaatccacttggaagtacaatggttttcaaacaagttctgcctatggaatcgagatgcctacatctgcaatgtcaacaggttggaagctacctattaatagcaactgaaaagttaaaactgataatgatgatgttcatgtaccataattccctcaaatattctgatgggtgatcacataaaaatagttttactagtataaaatgcgatattagtaatttttttctctctgtttgaaacttgcaggtggtgtctctgcatatggaggtctaaactcacataggatctttcctccatcagtgccatacaacaattctgttaacaattttggagtcaatggccttggcactcagagccacttaaatatagaaaagaggctttttggccgtgatgagagggtggtgtatgatgaagccctgaaggtatagaatataattgtgtggtgattcaattttattgtacttactgtggattatacctttttaaaacaaaaaaatatattgtgcagcaaatcagtcaagaaacaacggaagaaaatttgcctgaaggtgttatgtcagtatcactccttaagcaccaggtaaagtttatattttgaaaatcttggttgtgtgataattctatttattctactgatcctgttcactgctatgttcttcattattgaaagagaatagcattagcttggatggtttccagggagaatagctcacattgttcaggtggaattttggcagacgatcaggttagttctattttctaccttgataactgttacttgttttactggatcccctatcttatagggacataactttatgtgacgcagggtcttgggaagacaatatcaactattgcccttatacaaaaggagagggttgagcagtctaagttcatgtctgctgatgtgggcagcatgaaatctgtagctaaccttgatgaggatgatgaagtagtgatagtcatggacaagaagcaactgaagggtgaatctgtgaatatgctacaggattcaacactgtttccatcatcagaagcagcaagtgatgccgcagatctgaagccctgggctagtctaccggggtctgctgttgatagaatggtaaatgctgtcaaagttgaacccaagaagaaggctagagtgagaccatcgccttcgtcaactttgaggtctgctaatagatcaactgcgggaacactagtggtgtgtccagccagcgttcttagacagtgggctagtgagttggctgccaaggttactgaaagttctaaattgtctgttttggtttatcatggaggttcaaggactaaagatccaactgagttgacaaaatatgatgttgttgtcaccacatacactattgtagccaatgaggtacccaaacaaaactttgatgaggatatggaggaaaagaacagcgaaacatatgggttatgtccagcattttctattggcaataaaagaaagaaagacagcgaaccaaagaagaaaaagaaacccaaaaattcagatgctgaccttgatggtggaccacttgccagagtgcgatggttcagagttgtgcttgatgaagctcaaacaataaagaatcacaatactcaagtggctagagcctgttgtggactgagagcaaaacggagatggtgtttatcaggaactcctatacaaaatacaattgatgatctgtatagttatttccgtttcttgaagtatgaaccatattctgtgtatggttcctttcgctctatgataaaataccaaatttctagagatgcaactcgtggatataagaaactccaagctgtcttgaagatagttctgttgcggcgcacaaaaggtaaaatagaaaatcatgactgcatatgtgtctgcaactttgtaccttttagttatctgctatatgaaacccacatcccattgcctctgatgcttactaattcctgacaataatcgttggtattactcacaactatgaaaatttaaaaatattgatattgattcattcattatatatgtgtgtgctggagctaatatatatgataatacgatatcatggcaaaatcaacttttacttggaaaaatgcaacctcttatcttggatctctagcattttatggaagtcatgaaatacatctgaaaatctggaatttgtgaaggtgggaaacataattgaaagagtactatctttttgggtggaatcatattgagtaccccgtaacattctgtttatttatatgttgcttgagttgatgttttcagcttcaatacttggttgcatatcttaaatttgtaagatgtgctttcagtttcagtgcatatggctgtttttttgttttcactggttctgatgttgtctaattaatctattttttggactgttcaaatacagaaacactaatcgatggagaaccaatcataaaattgccaccaaaaacgattcagctgagcaaaatagacttctcaaaagaggagcgaactttctatatgatgcttgaagaaggttctagggaaaagttcaaggtatggccacttcaattttgcctctttttttttctatcgaaaatattgcattactatgtcaactattagatcttaaatgaaaaagcgatcggcagttatggtgcatagatagatactgtccgttctctagatactcattatttgaacttagatatgctcggttttgatttattcctaactcagttgttgctgcaaggtcttagaatagcaccatatcaatactccatacattttgttttctactcttgtcttatccgatgaacacttagctgtattgtgcccacagcaattgtgaaggttttacttttaatgaacagaagccaagtttttacatttatcttcgtaagcacaagtaggtttgctagtcaatagtttaccatgttcagtgtgattacttttctttttcaaaatatttgcagtagttcagaaatttcaatgcaaaatgtttatactccatgttcatactacaggaatatgcttctgctgggacgataagagaaaattttgcaaacattcttgtattgctgctgcgacttcggcaggcttgtgaccatcctcttcttttgaagggaaaggaaaaagatttgattgatactggttctgtagaagtggcaaacaaacttcctaaggaaacagtgataaatttgcttggacagctggaaggagactatgcaatttgttccagatgcagtgtaagcaatctaatcacatactgtacatgcaaaaaaatagtattacattatcttcgaatagtttcttttatgaaaaagcaaaataaggatatcagaacaggattgtcatgtgtgtgtgattaaacaatcagtggtttaattttatctgaactgtcatgtgtgtgtgattaaacaatcagtagtttaattttatctgaactgtttgttactccatggatactaagataactacggtaatttgatttctgcgcgttttgcaggacccacctgaggatgttgttgtagcaacatgtggtcatgttttctgttatcagtgtgtgcataagagcttaacaagtgatgagaatgtctgtccctccccttcttgtgggaagaaattaagcgctcaaacagttttttcacctggagtgttaaggttttgtatagctgataaattggagtctggtgcaacaactagtagttctgtagaagcagatggctctccatcaatctgtgaaagcagttacatatcttctaagatcagggcaaccactgacatacttaactcaatcgtgaatacacctgctctaacttggagtgatactatggaatcaagtccaagtgaagtagccccttctaaggcgatagtattctcccagtggactggcttgctggacttgctggagctttcgctggatagcagccgtataaaattcagaaggcttgatggtgcaatgtctctcaacttaagagaagcagcagtgagagaattcaacactgatccagaggtacttttctgacgcccttcatctctatcttcttttttttgatgttacatgtagatggtcaacaaatataactaaatttcattcttcaggtgagagtgatgctcatgtcacttaaggctggaaatcttggtctcaacatggtagctgcttgccatgtgattatgattgatccatggtggaacccttatgctgaggaccaggcagttgatagagcacacagaattggtcagacccgtcctgtaaccgtttcccgcttaactatcaaagacacagtggaagatcggattttagctctacaggtatcattttggctgttacattttcatttcaaaagcatgagcctttcttcttttagatggtatgcacttcattagtcgtctggatgtaggatatgaactgaacatatttaacttcatcagttaaagatgcatttctacaaaatgaaaattttccattcttgcgtatactggttagcatgtatttttttcttgaaactaatatgaggtttaccttttttacaaagtagctgaaatcatgtaggcaatttcatgcattttttttcgattctctcgattgtaagggttgttaaataattggacatgctttggagctagactggtgatcaattcattttagacagtgtcaccatgcttgtgcatgttttcttttttactctccatttttgtcaacacaacttttatgttctcttgccaggagaagaagagaaagatggtccaatctgcttttggtgaggacaaacctggcggcagtgcaactcggctcaccatagatgatctccaatatctattcggaatatgagggcagctcatgatccttttgtggagctagctggtgaattttgtcgtagcaagactgacatagtcctatcagctatagctgatgacaaagccttagcaccattaatttatgcacccgatgttcctcaccatgggtgatgccatgtcttttgaattgctctgatcattggacagagagggttagttagcttttgtaattagattatgttcgccgtcgctggaatgggatgttaggaggtcttacatcagaagcagcctttttttgtgtgtatatatatatggcatgctaattttaatgttggttctctgatggaatgcattacaaagtacaaactgttactcctatgattgtgatggggaagtctttttcgccctttaaggagatgcccttcgtttcttgcgatgttatttaaataattattaaaaaaatgtaaaaaaaaactgtcattgcaggatggattaatatgtgatatttcactgcacaagcatgcaaattcaaatttgatattttttttacaatatgtagaagtcaaatttgtgaagtgctagcgatgctgtgtaaaattttcattagacaagttctgattttgtgtaatcaagcataactactaaattcattcaagaaaatatgcatacaaaaaacaagatcataacaaaagggaatccactgcacattacacaaataggaacaccgcaacgcaaagatctcaaacgacggaaatgctgccaataattcagagacgatcgagttcatgttcagagcgcaagaatggcgccggcgccgactgcgaggcccaccaccagcttggaggcgagctcggcgccgccgccggccgccgcgccgtacgacgacgagccgcccttggacgacgacggcggcgccgtcgagttggagaccgtgatggccaccttctggcccatgctgcagtgcgacccggacgaacaggcgaagtacctcgtcccgggcttgtcgaagacgacggtggtgctgccgccggcgtccgacgagagcggggcggcgaagctgcacgccgtgtagtccgccgccgacagctcgtcgacggtgtgcggcgtcccgtacgtgaacactgcgccacattacacacgccgatcgatcagctcagacgccattgttgccagatgccaagaacggaggaggaatggagaagctcactcaccgacgctgtcgccgacggcgaccgtgttcttggacgaccagtcgccgtagttcccgccggaggcccacttgatggcccacgtcttgctgccggcggcgagctcggcgacggtggccacggccatgaacgccaccaaggccttcaacgacgacgacgacgacgacattgttgcgagctcttgcacaagctagctaggaatggaagaggctgcagagaagctagctaataccagcaatggcgcagctactgcctgaatttatatatcaagctgctggttttgcaccagctggtggttggatcgtggatgacgatgaaaattttgtatagttacctgctcgtgccatgtcccatttaatttgcaatccaactaactaagaggttgacagcattatgccaatgatatggctaatatacaagtaatttaggcaatagttagttggattaatcgcatatctgggggagttcatacatatatgatcacggcactatgactatggcaggtttgattgatcggatcgaaggagttgacaaggtatcaattcagcaattcgattatactcgctccaaaaaaaaaatccaatttctaactataaatctagaaataggatatatctaaattcatagatatatatatacatgggctatactgctatgcatctaatgagaattgtcgatcgagctggcgctcactagctacccagcaagtggtagataattaagttccatctcaaaaaaacaaaaagaaaagaaaaagtttgtatattgtttatgtattgtgcattggggacctaggaagttgttttctgctgtattcggtgtatctaacactcacaaatattactagtaattagcagtgtatgttgcattattgaaatgatcatcacaagcaatctcgatgcacgtcttggttacaaaggttgaaggctggatgttgacttgacatggtgatggtgacgaacacataaactcggaatggaactgggctagtacatatactcccttaacccaatatagaatataatatgatacatcctacctacttctatacagattcatagtactagaggatgaattacattctatactacggattaggtacttggtggtggtttaattgctttagcattctttttgggggaattcttgcataagcatcagggatatgatgacaatgttagttgactggagttgataatcgcaatttcacatataccatatgtatgcagtttacaagtaacattcacatattccttatgtgtgtgcagttatgcatacaccggctgtcaatttgaaccaaaaatggcagtttccgttttcaacaaggaggcgtacttcccttgtttccgccttcatagctcgaacacgtatgttcatatccacacctctcccccaagtacgagacaaggtctcgagaacaaaaccccccaaaccccacggcggcggcggcgagcggcggcggaagaagcagccgcaagaggcagcagctcgcgctggcggcggcatgggtgggagcagcgcaagcccgtgtgacctggacagggagttcgcgccccaaatcgcccagctcctcgccacccctcctctccaacccgcgcaggtacgttttctttttccttcccttgcccatccatcctccgggtctcaaatctatctgcttgggaattgcttgtgctgcgattattgtttttccctgtagaaaggttgggtaatcattgtcgggaatttcgttataaggaagtgatactatgatgggtatatcttactatgattggtttcagttatcttactgagaaaggaggatttctttttggtccgcatggatggttttttttagattggtgagatgagaggcgaattgtttagtttacaacagtaacggtgtagtttaatgttttatttgcagaagtacaatcttaagtttgtcttttttgggtatcccagttagtgtgtagtgaatgtagctcgatggaggtatcaattcgacagaatagaaacaatcttttgtgttcttggcttctttctgtgttgcagttacaattgtctccttgaagccagtaaaattgtagtaaatcttttatggctttttttctccttccttggttactttagttcatgtattgctgacgatctgtagctcccatctgacacacagctatgctacttttgttttcaggaatactacaatgggctcatacagtccaggaaacatgatggtataagagtgaacttcagcagcaagcatgggaaaggtactggttactgaatacttatatatcttgtgcaatgcaatccggcaaacttggagtgcttgtataaagttggtgtcgggtaaaagccaagatacttaaccagttggttcttgcaggtgtttgtgcgaacaaggagtttgcagaaggggaccttattctgaaggatcaaatattggttggtgctcagcacagtcttaacaaggttcgtctgcttttgaagtgatcctaggtatttgttcccttctattttttgtgtgaactgctcctccctgaagtgtggtgtccattttgtgttttatttcagattgattgcgctgtgtgcagttattgctttcgcttcattggttctatagagttccagattggacgaagattgtattggcaaagcgttggttcaagcagtgactgcactaataggaggcattgccatgagagtgatttgggatcgagtgccagttcttctggtgcaacaaaggaaaacagtagtactttgccagaagaggtcttaggatcacttattactggtgacatgtcactgcctttcacagaccattttagtttgcctcaagttgttccttgtcgtggatgtgaggaagaacgctactgcaggtttgagtcactaaccattttacagttcacactttcttttggctgcaacacccaaagatgttaggaattttgtttgaggcataaatattttgttgatcaattcattctccatcataggttatagttgtcggtcgtgttaaaacttaaaacctaattatcttatcagaacatgtaacttgttcttgccgtcttagatagaaatgtaatcttggggtaaaaacataacttgttgattctgcatttttgtttagccaatcatgtgctgattccgactgggaaacttatcactctttgctgtgtactggatctaagactgaaccatcccagagatctgctcttcagaaattcatagaacatgcaaatggtaagtgcagtatgcagtgatcattatataccatcattacgaatttatgttgtgttcactattcattaaatgcagcatgcctagatcaattgttcctgattagtgatgattgtgattgaggttgtcagtctgttatctgctactgaccaatctttattttcagggtccaatgatatttttcttgttgctgtcaaggtatgtgat

SEQ ID NO: 56968 - DNA, 8032 bp, Oryza sativa
aaagattcaattgcaatttccttattgctaccaattgcagtcaatttaatatctcctgatcatgatgcatgagctcgatacaattttacatgtcaggctatcactttcactctgctgaggtacaagaaactcaaaacgcagcctgaatttcaaaataacacagatgaatcaaacttttctttgcttatggaagcatggaaaccactttcgatgggctacaaaaagaggtaaagtcatgaattcgcatgcaactattcatcccctctgataaagtagctgcgcgtatggcactaccagcagtgttattttaatgcacaatcgatagtttcttcatcaagtgtatatcaataattcaatggtactagtatatttccactcttctcatttataacagtcaataagatctctgttgcatggttgcatattttgttctctttttttggatttgttggcaagatgttattttcagctcagtgtggctttcactaccttgctctagctctacaagatcctttgagttgtttgcattgttgttccaccctaatatgtcccaaaaaaaaaaaatcttgttgcaggtggtgggactctgttgctttgcctgaggatgttgattcctgtgatgaagatacatttaggcagcaaattagggatctagcacttacggtaattatgctgtcacatatttcattcttttgaaactatataggtattctattcacaatattgtgctctgaaacgaagctttattcactagctcgtcagttaaaatataaaaatggcacacaagaagtggttattgttttgattgaaaagtgtcccacataccaatggattgatgggcagatcattatcttctgtgtttcgcagtcattgcagcttctcaaggatgctatttttgattctgagtgtgcaccctgtatcctttttggcatatactagatcagttcatatatataaataagtagcttcccttcacattcaagtaatcaagtttcattgactcacgtaaaaaaaaacggtcaccttgacatttcctagtgttctcacttgacgtgtatggccatttaattggcatgtttgagctgaacaatctgtaagtaaatctaattatttttcatttgtatatgtgcattacatactctgtcattgtttctttccatcaacagaaataagttctgtactgcatttgatgtaataacctcaatatatttccatcttttattccagtggtttggttgttccgtctccagtggaagactatttcatacatattgatgatcttccagatgatgagaaggtattttcactggttagccttagcttttcttgtggcattgttaatctgaagtgcaacatatcccaggaggaagctgaaaaggttacaaggccatttctagatgctttaggtgaagactatgcagctccttgtgagggtatgtggagcttcttcccaagtttatctccccccacagtaatgtcattttctatttacccagcagtattcgttcattctcttgtgaattttctcgttggcagggacggcattctttcctttgcaaagctgtatgaatcattcatgttgtccaaatgctaaagcatataaaagggatgaggtaatctatatttcttccagttgattcgctcatttttcacaccaaattgccagtcagcaatccgacaaaaccattgaactaccgttgcaggatactgatggtaatgcagtgataattgctctggagcctatcaagaaggacgatgaggtactgagctgttaacgcttatctcaaatattttttttcttgtgctgccagtgaaaaaagaaaacattgaaaacgttgttttgccaagtactaactgtgaaaattctagattaccatatcctacatcgatgaggatgtctcctacgaggagaggcaggcggagcttgcagattatggattcatctgtacgtgccctaggtgccaagaagaaaagcccaactgaacaagatccacagtttggaggttcctgaaatttatttttttggtgtggaatatgcaattgaagttttgacgactccatttattttattttttttgtctaggatatgcaattgagattttgacaactccaaaaatgttaggataggatatgcggaaagaatgatatgatacgtacttatttgagtggatgctggattttgctgtgctaatgttggatgctgcagaaagtttttattccttctgttcagttgagatttttccttttgtgaaaataacacatttctgggatgaatggccgaacaaataactggatgacaattttaagtatttcggttatacaggaacacaattgatacatggattatgctacagatgctatctctttccatagcttatggggagttgcagaaccagtttaacatgacacgacttttacacatggtacaagaaaaacgagttccatcattcaaggaaaaaaaatgaacaatgatgttcgtctcagttctcgctatgccattgtttgctggagctcacctgcagagagatagacagtataaattagaggaacggcgtgtagaattgtgcagtacatatattcagtccgtcatgtcttccggtcggttgagcatacaggttttatgtcaaatttggtgatgatatacaggtgctgctatcaatttcatgagaaacacgccgatgcacatgtcaaataataaattctctcctgctctacctcatattatcatctctgatcaaggcctccaaagaattgttccaagcttgtagagctgaaaacattggatgctactctttctgctcgttgtggagaaatatgtagttgatatttgataaacctctgcaagggagcatagcaactcaaaacctgcttctataagtatgatacttgattgttaaaattgtgacttacagctagctgatgaacaatttctggactagtatcaatgtgccaatcaggttccagttgccgcacaaaagaggtgcggccattttctgtactacagaagagaacctgccatttgaagaaatgttacataaggtccattgcgaacatccaatggctatacccaaatgaaaaaaaaaacgattaagcagttatatttctgaagtgacctcatcatgcggcttaccttgtcctttatcaatccactgttcgtaaaaagtccagcttcactcagggcagataacaccttttcctgcaacattattcagttgtgctgatgtcaagctataatagctcattcaaattccgtactaggcagtgtgtctatagtgatgattccaaaaatactcttctgcttttctttttttaaaaaaaaaaagaacccctgaacataatgaaataaaatagcagaccaggtagttgttcattcatcgtattattccgatatcaatggtaaattgattactgtttattccgcgtgcatatgccgatatcagtatatattgacatatcaagtcttgagcatacttgtaaagcgtaaaacataaatgcaacagaaaaaatgcatggtccttattacttactccgctttcatcgtcaagaatgcgctccatcagatagacatcacagaattttgcaatttctagaagaacctccaggacagaaggtctcactgtgacatggttctgaaaaaaaagtataattccgctaaattaaattcgttaacaaaaaacaggaaattttttttgcagcagcgcttttgctcacctggagctcctctggagttgtttcctccaaaatcacaccaagtaaccggcatgtaacctaaacattataattcacacatgggaaagaaacatgcattggtataacaaaactttaaatttcgtgaaaaaaaaaggtgtgaaagcagttgcttgcaaaatacccttcgtccttcgctcagtttatgcctaacaagctgctcaagagtcagctggagaagaatataagcaaactatcagtccaaggatcctaaaagcagatacatcatttcagtattcagaaaaggaaacaggcaatacgtttactggctggaaaagctggttgattgcttcctgtgctcttgaatctgctgaagatgaacaagcatccgttgaggtcaaagcacctggccgtgatctactgctggtgttgctaggtgatggagcaacgcgtctacgtggcctccgaggttgctcttgaggagctctcaacagtttccaggcaaagataagtgtgattgtaattgcggcaagtgtagtaaatgagcgaagtttctaaaatagaagattgaagtaattcaataattcttgtagcaagaattaataaaacggactttgtgtgtgagaaatcacaaaaaatggcaccaattcactcatccaaaccacaacaacgactgatacaagggattaaaaattgacaccaagtacaatcttttgtggaataatatgaatgctcatgctgttgcaagttgcaacatagggcccagaaggtcgattttcgagcgctacggcacttttaagtgctttcacgtgatttgatacctaaagtcgttttaatgacgttgtagcgcagatttctgagcatagaaatcggtttacctcgccgtgcatgcacatgtcatgttcgcatgtgtatgcctgtgcttgcatccattactagcctaggatctgcacgttgtattactaccgagttcttggaaatagcgttgtaaaacactacagtcaagagaacttacaaaacgacaacatgccattaacgaattatttagtgattcattaactgactatagaggtaagtagatcattcgatgatatcacataaagcaagccatcataaaagtttgcatctttctggccaaccaacacttctacatagtaactatttctcgcagcactattagcctattactaacctaaaggatacatcaaaatctcaactatcacaatgacccaaatacgaccacatttcccaaaagggagacatatcattagcgaactgcgaatccacgcctaaaaatttactacagcttctagcttgtacagctgctaagaacgaattaccaaatcgatgcttcgaactcatatgtatgtaataacaactaaacaatagtagaatggccacagtataaaatatagttccaaacaaaaaagactagccttccccacaaacaatcaagcaaggcgcgccacctttacaccacggaccaccacaaatccctaaacagcgaggaaaacctagagattatcaaaacaccgcaaaacacacgcgcgacacgggggggatcacagatccgagcggcaaacctggcgatcgaggtcgaacgggaggcgatcggagtagcgggcgagggcgtccactaggcgccgcaccagatcagccagctcgtcgtccttcccgccccccgccgcccccgcctccacccccgccgccgacgccgctgcccccgacgacatcggacgcgcgcccccgctgaccaccagaacaagaggaggaggaggaggaggacgccgcggcggcccgaaaccctagcgcgcccgctcgcggcggcgacggcgaggaggaggaggaggaggaggagaagatttggagggggcgaagtgtaaattgtgccgtctcttctacgagggggcgggctgcgacatgtcggagggaatgagggcggaggagagggaagctcgttgtttttgcttgcggcgtggtaggagacggttattttgcagttaggtccttgaagagtgtctttatttttggtaataggtctttcagttttttttttgttttactcccagtcacagtcttcatggttgaaccaaccaactgctcgaactatgactttgggtgtgttagttacgcgtaaaatttgaacgtgtcacatcggatatacggatacacatttaaagtattaaacgtaatctaataacaaaataaattaaagaatccgtatataaaccgcaagacgaatttattaagcctaattaatccatcattagaaaatgtttattgtagcatcacattgtcaaatcatggcgcaattagtcttaaaagtttcgtctcgcattttacacgcaatctgtgtaattagttgtttttttatttatatttaatactctatgcatgtgtccaaacattcgatgtgacatgtgtaaaatttttttttggcggggaactaaactggccatttgatgagttggttttcttctatggttggtctaattttgtactcctcggtatgagctttacatgatttcctctttattttttccctttgagaccttgatttcaacaaacttagcctgatccatcatgttttctgtacaaactattgaagtactgtggtttttttctctgcgaggttattagatggtgtttttacgacacattgacacacggaaaaagaacggaaaaaaacagtttctttttccgttttacacaagatggtggtgtgttcatgtatattttctccgtgttctaaaaaaatcaacatgattcataatattagaatatgttatatccggtattaggttgtttaatgcatgaaaagaaattccatcaaacaaccaactctacaacgactcgacgattgttccagattttcattttcattgctgaattgctgaacaggcaacgagtaatgttcgtgtatggcaaacatttgctaattggcactttggcaggtaattaatccgtctttaatttttttacagcctcaaaaactctcgttgataacctgatatatacacacagaacgcgctctttggcaacgctggctatactagcaatcgaaggaataccgcgacgacgacgacgacctgtgccgccgcacgccgttcgccgcctccgccgccgccgccgtacccaggctcctccagtcgtcgtgctgcgcggcgccgttcaccgccgcgcgttccagcagcttggacggcgagacggccgccattctccccgccttggcggcggcggcggccgacgcgccggcgagcatgtcgccgccgccgccgtccctccgcgcctccttctcgaggtgctcgcggtagagctcgtagacgcggtggctgagcatgacctcgaagtccagcacggcgaggagctccagctccagcctgttcatctccgcgttgctcacgccgccgacgcgcgcgaagaacgcgttgttgtggtggctgcacacacgcgcgcgaatggtaattaacccaacagaactgaagtatacagtatactccactaattcagaaactgtttttttttcctcactcgagtggaactacgctcatgcaactaaaaagtcactctcttttttttaaaaaaatatcaacatataacatttcactctagaaacattcaaattaaaattctagttctgacatacaaatagagaaaaacaacacatctaaactgctaatagtacataattttttattgtcatatttataatttttttatttctatatgtaggtcgaattttaaattgtatgtttatagttgatatatcttatcaaaatgttttaattttttatagtgacaggcataaaacgagtgtatgtacataaaagtggtaagaagatttcccaactactaggttactgtcacagtgtaagtactaactaagaagcaactaatcgctgaataaatgcaactaactactaatcgaatgatgacacatggtactagcactaatgatcgattactgacgcgaaaaatgacgttaagctgtattgatcatacgcatgtcagtatcagaagaatacgtacgtagggcaaccacctactgacctgatggccaaaggattaaattgagcatcaagaaaaggatggataaccctcggtcatttccatgccttgcaaagtctactccattaaaaaaaaataaggaaaaagtacgaattaccctccgaactatagcagtcgtctgaattaccccccctaaccacaaaaccggacatttttcaccctgaactatgtaaaccggacgaattacccccctcgacccaaatccgcggtggttttggtctggcggtccagtcagcaatttatttattaaaaaataggtgggccccacctgtcagtt

SEQ ID NO: 56969 - DNA, 41927 bp, Oryza sativa
  unsure (1)..(41927): unsure at all n locations
gccgccgccgccgcctagcctcgcctactccgccgcaccccgccgccgctcgccgcctcatcccccgccgctcgcctccaccgccgccgccgctccctgtcgcccgcctgcctccgtgtgcgtgagtgagaagagagtgagagaagagggagataagagagagaggggaatagttggataggagtatgacaagtgggttccatatttttttaataaataaaatactgactggactaccagcgtatgccacatagaccaaaaccaccgcggattaggtcgaggggggtaattcgtctgatttacatagttcggggtgaagaatatccagttttatggttcagggaggtaattcagacgaccgctatagttcggggggtgattcgtactttttccaaaaaataaataataattaccgatcgattaattcattcttatttaattgtggtattggttggtctcaatctacccattgactgttcatgcagtagtgactgcagatctgtggttatgtttccaactgttcatgataagaacaaacacagttgctgggattaatacacagacaaagtggccacaatctttgtgtttgttcttcatgtatcctaacaaaactgaggttcttttacatggttcaattatgtgtaagattttacttgcgaacgagtaaattagaggttaattaagaagagatgatttatgcttacaagtcgtcgagaaccttggaggcgacgaggaggcaggcgaggaggaggcggtggacgttgcgggaggcgacggcggcggcggggcggcggtgcgccgccatgtcgacgtacgcgtacgccaccacgtagcactccggctccagcccggcgtaccggtgcacgcgctccagatactgcgccacgccgatgcgcggcgccggcgcgcccctcgccgcctcgaacgccgccatccctgctcctagccccgccgccgcctcccctccgccgctcagcgcctccaccgcgtcgttccgcgccaccagccgctgcacggcgcgcgccaccatgtccagctccggcggcggcggagccgacgccgtcgccttctgccgcgacatctcgccgcccgctgccgcggcggcgtccatggccatgcacggcatcgacagcgtggagtggcgcgcgttagctcaagctgtagccctgtagctgattcggcttggcgcttttttttttcctctttttggttggcgggggattaaccgcgggaacggacggtggatgatgcggcggcggtggggccgtggccgtccgatgaagctgtctctcttcgattttaggaacggaattttctgtttcgcgattcagacaacaccagaatggactgttcaacccttatttccgattttgtcggcattccgtgccaaaatcgtgatccgaaatggttttttaggagtggtggacaggatgctcatcctctcccactcaccgctctttgctgtccataattttagcacagtttatcgttaaaaaatatacaacttttaaagcgataaactttaagaaaaaatatgtatatttagtttattgatgtcatattattctcatgtttttttttcatccgttcgtcatcgccacttactgaattctaccgtaatttttccccttaaaaattgcacacttggacacttggttcatttaagtccccctctcatgctctaattacgcgttcaccgctgactgaaatttgggttactagaaggattttgctcacaaacttttgactcttctatcagtcaagaaaaaggaaaacctttcactctacttgttaggcatgcggcatcaaagttttcttggtcagttttggacttgtggttggggctgcacggcctaatcaaagtgtgatccaaatgatggttttatgccatcatgggccagtggtgtcactataaattcaggcctgataagcactagtgttctgaatatcttcagagttcagaggtgaatacccaaaatattcagaaatcagtagtcatgagtttatacttttcagctggaacgaatttgctattgctcgagcaccgaatgtaggatcaactacttcacaatctccagaactccagaagaagtttatcactgaacacagttcatggacaaactacccggtaatccgaagaacaacacctgcaaaaaaaagatgtgaaagatcacatgtcaggttgtcttctccacaccgctttagctcacatggctggagaagcgagcatgtcaacttgggaagtgtgctaatgactccatgaaattaaaagatcggaacggtggggacgaagtaattaagcagatggggggctggtgctttctgacctccggaattcatgtctgaattctgaaaacacaccggacaaatgctccggtctgaaagatgacagccgttttttctctgttccttcctcctcgcttttattatggctttctgcaggatggtgcaggtgactgttggctcaattctggagaacgcttttcttggccattcactggcctgaaactctggatgatttgattggattgacatgatgcattgtatcatatgatggcctacatgctaccttgaactcctcaattgatcagagagaatcagttgcatttgcaaaattctgcaatcttctcatttcaggcttcagagatgctatgggctgcagttgcagtatcctggcatcaccaacctgacggtccttaatcgtagaattattgaaaatcttcactttatctgcataaaagaggtgacatgtagggacacggacaggcatagatcactcgctcgctaccttcctttggcataggttaagttaataatcattgtgattctctgcgatttattctctgcttgaagagttgggtgagtgagaataataaactttgatgttctggccgtgcagatctctctccctttctcacgtgccacggttgttcttggtcccatccaagaatgggctcccactgggaaggaaggaacaaaagttcagatctatgatctatcgatctgtgtttcctcacaacgacagtcacagtaagtcagtaaaaaaatactcaggtaattaattactgtcttaagctgtaaataatttttgtttacccggactgttctgttcctaatcatcatcgagaggaggagttggagatgatgttgtggatttcgaggcgagcagctttaccacgagatgaagcttcgtctagttatagccagcgatttgacagtatgcgaataatgtagagtgtgatgtgttgtaattgcttcaaaattaatttgctttttattgaaggtttcggttaacttttgtgcacactcgccagtgagagtttggagcgtagtaacatggtttggtgatcacttttttgtagggcagtactgagttaattataatatttagaaaaggattaccatgtggaaaagggattatggtacaaccaaactgtgatgagcagtaaggtgtgcaagcgtcggttcggtctactgatgttacaacagcaaacgaggaaaaatcatggccaatcgcttgactaaagttggagagaattaaaacaggagaggaaaacacaaagcttaagacaatagaggagagaacaatgctgtgttctttcgagagagttaccaactcatttttcacgtgcacgattttcaaattactaaacgatgtatttttttaaaaaaagtttctatacgtaagttgcttacattaattcatatttcaaaacaataacaaatacttaattaatcatgttattttaaaaataagttaatatgatttttaaagcaacttacacgctcactatacttcaaattaaaactaattaaagttaaatggtcatgtcttaacatgtccagattttaacatgttttactgccttacacgtccactgtacttcaaattattaaaaccaataaaagttaaacacgggtattgatctcacgagcatcatttacaaaacaatgcgaatctgaacctgtcaaattactacagctttgcaaaaaacaaaacaaaagaaaaaaaaaagataaaaaaggcttaaggcgaaaggaagtctcagacctaaaagagggccccacattttctttcaccttctcttccattccacctctccatctcgccggaatctcacctccgatccggcggcggcgccgccaccgacaccgagaaggggcgtcccctccctccgccaccgcgcgcgcggcacgaagagccaccggagcattcaggggaggggcgttgtagaagcgcgggcggggggaaggcggggatggagtcgatcatagcgcgggcgctggagtacacgctcaagtactggctcaagtccttctcccgcgaccagttcaagctgcagggccgcaccgcgcagctctccaatctcggttgggatccgcttctccggttgaggatgccaatttggtcgcctccgggtgctaactttttttttgggcgtgatttgggtgatgcagatatcaatggcgacgcgttgcacgcgagcctggtgctgcctccgtcgctcgccgtcgagaccgcgcgagtcgggaagctccagatcacggtaatggcgggagccctgacccggtgcctttgtatatgtcagtgtgcttactcttcccggcttctccccctgaaggcttaaggggtgcatttagtgttagatttcttattgtttggtttccaaatttagatgattttcgggagagcattgttttgcactttacttgcgcctctgcgtggtagaaatctgtgatgaacttgtgatttcgctctcatgtgatagattatagctctgggtttgaaacgtttgtgtgggaggctaagtgaatgatgattaggaagcagctatttgtacctgtcttgacaatgccatgaaatttggactcccattaatttttatcatgtggccatacctgtgaaaaatctagagaaataaagctgcccttggtattccttgcgcatctggttattgcaagttttggttgggtggtgatctcaggtaaatttggaaaattaaaatctatactccattagcattgacctcaaagcttcaggcaattattgaatagccattgggtacttgcaacttttggtgataagcttatttcgtttccttgctacagcttccatcagtgtcaaatgtgcaagtagaaccaattgtggtgaacattgataagcttgacctcgttcttgttgagaaggacaattctgaagatctttcaagcactagcaggcaaattcattcttctggctctggtctcatatggttgaatgagcacagtcatttactgatttcagtcttctctgtcattttgttttggtttgcagtgctttatcgccatcaccagctaaaaacagcggatatggatatgctgataaggtttatttctttgaccttgatgttcaacgtaaacacattccaaacttttactctgtaaaaaattcaatatgctgtctaaaaataaaaattgtcacttccagttatccatgatggttgcatccaatgcacctattttgctatctgatttgataattcttctatattcttatgtgatcttgtctgatattctgaaaagcaattctctgctcttttattacaatatatacaattttgaaaaaaaatacgtgcagaaaattgaactatggatagggcttaatttgctataccgtggttagattgcagatggaatgacagtccaagtcggtattgtgaaccttctattagaaacacatggtggtccacgtcatcaaggaggcgcaacttggtattcatctttgtttgaatgatttttggccctttttcttatggcttagctccatatctcagttcttgttcatttctcttattaatatctgtttcatgatgtagcttttccctgcaatgtttttctgcaaacaggaacattcattccatctttccttttcaggtcaccaccgctagcggctatcacatttcgtgatcttgtactgtacactacaaatgaaaaatggcaggtactcttgcaaattagattagcattaaatatagtaaatgattgcacttcagtacctgattagaatgccttttatataggctgtaaatctgaaagaagcaagggatttttcgaacaataaaggattcatttatatttttaaggtttggtactctccttttctctccagaagattaatgtttatttatgttgctaactgttctattgacatttcttaaaaaaaaaactgttctattggaaacataatgaactgagaaatgctacacttgaaaggatttatgaccacacacatttcttctttcaaattcacagaaattggaatggcaatcactgtcagttgatctgttacctcatcctgacatgttcacggatgctcggtttaactcttctagcagtgaagatggaaaacgagatgatgatggtgcaaaacgaatgttttttggtggtgaaagatttttggaaggaatatctggggaggccaacgtgagtgcttttgaacttcaggacatatcatatggaactcgatgtttttcttttcagtttctcttgaacttccctctttgtgtgcttggcttacacattgctttgaacatcagatcacagtcaaacgaacagagcaaaacaatcctgttgggcttgaagttcagctgcatattactgaagctctctgtcctgccttaagtgaacctggtatttggttacttttcatgatgcttgatcccttccctttctgaatgctgtttgaagtggtatttgagcttgaatgctattttattcaggtttgcgggcttttcttcggttcatgaccggggtatctgtgtgcctaaacaggggtgatgtggatccaaaagctcaacaggtttgccttttccatcatgcattttaatcactgcattgcatgcagtacagaagtaggatgtttattggttttctttgtgtccttatttcttttctgcttttcttttttgaccagcttgcagaagctgcaggatcttccttggtatccattattgtagatcatatattcctctgcattaaggatgctggtatgtaccagctctggaaaacttcaaatatgctatgtttactattctattctgactttaaaccattttgtcaacagagtttcagcttgaatttctgatgcagtctttattcttctcacgggtaaatttctttaccttccaatttattgtactgatgtcatctgctgatgatatgattgatttaggttatgtaatttatcttattgtactgatgtcatgacaatcgtttttaaatttgttgaaggcaagtgttcccgatggggggatttcaagaaacttgtcttgcataaagattgccgggctctttctgaggtactatatgttactccctctgtaccctaatgtcgtgaccgagaaaaattaccttttcccaaacgctagtgtattaatccccgtctcaggaaaagccggggtacaccacacaaacatgatacaaaaggcacatctttattatatcaataatatttacattattacaaaggcactttaggcctgacaatcaaaaataaacagcagcggactagcgggcctacggctccatcttcacaggcgctcaactggggtataagccaggactccacctaggacatcttctccaaagcttctcttactgaaggggggaaagatagagcaaggatgagtacaactacagtactcaacaagccacaccgggagatgcacgattaatgcaagggggtacaaggggtaataatataggggttaagttttgcagtaaacagcatttaaaagacacttagttgctcaaagctattttgtaaagacgatcctagagatacacaatattattaatcaagaccgtgaacccacacgaacctgccttaacccaaggcgtacgatgattcagaccgaactggcaacccgacctgggtcccagctcgtcccaagccaatccgggccaaccattccacattttagttgttaagcaagttttaagaattaaaccactaacttgggtacattgctaggcttgcccataatcgagggcgcggctattcgaatagattatactctgatcagaggtgtacatctttacccacaagacacatctttactccgcattccatggccgtggaacccgtcataaagaatgtgacataacccctttacccatcctagccatgacaaaagcaccgacccaacctcgcctacggccagaatcccgggataggtaggctaggattgaacccctagcagcagaacaccggccctgtgccatgacatctcgactaccgagccgcagcccgtgtagccttcatttgccctagagatgtccatcgagccccgatttcgtccatctctatccgtgtcctcttgccaggactagactgagcaccgagttaagccttacccattagacatgtggttagtacagtagtgctttgcaatagaggcccgaagactggtccttacggtggccgaggtgctcctaggaaaaccatgcacctcgagcccaacctaaaaccattttgggaggtttgaatagaggggggaggtgtgtgttcggagacctccggaatgacagaagctacgcgaagcacacaagcaaagctacaaccctgtaaagaagcaataacaatacataaaaagaaagcacatggttctttaggttataacaaacattaagagacttgaacgggtcgattcggagttcgtatggccaaggcatggtcatccgaagtttaatgctgttatatggagatttgcggattattataattaagctttgcaactataaaacatgtgtaagctctagcctggaaaagacaagaaggctgcgctgctgacatgcggaccccacatgtcaacctaagggaccacggtggaccgggtacacagagacagtccacgggtcgacgaaagcggacctcgtgtgttaaccgaggcaagtggccgacaaacggactctactaagacaccacagtgggcatgcacactgatggaatatctcatctgtcggtgtctatccgaaagacagagggcaccactaagcnaacgngtccaccacacgcacacacgaacgactaccgacaccggtacacgggtactggggtcgacaaccacacaacgggcacggggcaacaccgaaaggacgaggacggagcaacgagaggagggagtgggccgggaaggagaggagggaggggcggcccgggagaaggaagggagggggagggagctggtccgaggggagaggaggcccgagagagaagggaaaagggagggaggagagaaagactttgggctgaactcggcccaaaggaggaaggaggattatttttagttttctttttaataaactttcttaattgttgttgttgcttaataaatatttccggtgctctgaaaattcaagtaaaaatttgagggctccttttagaccaaggagaatttaacaaaaattctccgggccacattcgaatttttcttgtacgtattttagtgtttgccaatttcttttcgaattttaattaattctattattccttttagagaatgatttttatttcgggatgaatttatcaggacgtgacacctaatataagggattttgacattttgcttgcactgtttgatcactcgtcttattcaaaaaattttggaattattatttattttatttgtgatttactttattatccaaagtactttaagcacaacttttcgttttttatatttgcacaaatttttttgaagaagacgagtggtcaaacgttatatgaaaatagtgaatattccttatattagggggcggaggtagtacgtgcatccttgagtcctttttactggagattatatgcacctggaagttcatcgtaattcacttgctcagttacaatacatactaaattcagtgcattttgttgatgcctataagtatcacatgcattaagcccaacagaatttagttgagtgcattgctaggttaccaaaagatgcatatggtgcaaaataggatacattcacagtttaacttttcgtaagtaagggaatttgtgttctacctgtgctagaatttttgtttgagctatcaaagcaattgaagaacctctgttcgatcctcatgtactgacatgttatttctccagggacacattttctcgtccaccatgcacattgatacagccctctatgcaatctgttccacaagaacctccacctgtgcctgactttggtaagactttatgatacctttgctgagataaatgaattggtcaagtctaacgcctcctattgaattgccaggtcaaaatttttgtcctcaaatccatccatttgagaatcagcaattggaattcacgtcaggaattcctttattttccctctattgtcttcagctcactccttccccattacctccaaagtttgcttcaaaaactgtcatcacatgtgaacctcttatggtgtgtctccttaacattgagagtgaagtaatgctcaccctttttttctgcttaactaaacaccgcccatactttctcattcctaggtaaccctccaggagcaatcctgcttaagaattgcctcattcttggctgatggagttgtggccaaccgcagtgccatattgcctgattcttcaatcaacagtatgtcattttatattaaagaatttgatctctctattccattagatgctgaggaaatcacgaggtacagtggaactaagaatgtttgcccgcaatcatcatttatgggggcaagacttcatgtggaaaatctatacttctgcgagtcaccatcagaaaagtgtctgttgctaaaccttgacaaagatccagcttgcttccttctctgggggtaccaacctgttgatgcaagtcagaggaagtgggctactcgagcttctcatctaagcctctcacttgaaacctctagcacttcgaatgaacagagaacagttaggggctcctctccaagtttgtggaaatgtgttgagctggatgacatccggtttgaggcagctatggttacagctgatggtagccctttgttgattgtgccacccccagagggtgttgtgaggattggtgttgcttttcaacagtttacaaccaatacttcagtagagcagttgttttttgtgttaggtctctacacttattttggccaggttggagaacggatttcaaaggttagcaaaggtaactgctctgcgacaaagacatcagctgacaaacgtgagagaaaactgcctagtgacacagcagtgagcttaactatgaatagtctccaactcaatttcttggaatctttatcatcaaatgacttacaattgcccctggttcagtttggtggtgaggatctgtacctgaaagtttctcatcgcactcttggtggtgcctttgcagttacaactaacttgacatggaaaactgtctcagttaattgtttggaaggagaaagtgctatatttggtgagaatggcactgcagttactggtgaacctaatattttgttgcatgaaaatgggcatcccaatatgagagctgtgttttgggttgaccaccggaataagaaccagtctaaagaagctcgatttattgacatagacatcactcacgtaatgccttatgacatgcgggacatggagtgccatagcttgagtgtatcagctaaggtatctggtgttcgtcttggtggtggaatgagttatactgaatctttgctgcatcgatttggtatccttgggcctgatggtggtccaggggaaggtctcttgaggactctgaaagatttatcctctggtccacttgcgaaactattctcgccatctcacctcaccgacaaggaaggtagtgaattttctgtctttgccatttaatttgttaattcatgctggaaattttgttggtaagcatgcatgttgattgcttctgctcagttgcgagatatttttgctgtttttccttgtattattcatggattcttccccgttccccttgaattgcagatggaatgcccaattccaaagacaatgactacaattcgaagtttgacctggaggtgccagatgatcttgatgtgtcaattgagctacgaaactggctcttcgcccttgaaggcacagaagaagtaggagattggttatcgcctcatggcagtgatcatatcagtagagaagagaaatgttggcataccacattcacgaatctacatgtgtcaggcagaagtagtgatcggcctggatctgcggagaaggtgattcacaaaagggcccttccaatagaacgttttacggtatgtagtggattattttcatacttttgcatttctatgtggcacttttattttttatccagttcaattctgagacactatgctgcacttgcaggctggaattgaaggtttacaggcaataaaaccttgcctgagagatcaactaattggaaatgcaacatcaaataatcttcaaacaggcagtgtttttgataacacaagtagcattggtgaccaaggtgtcgatgttgaagcgaccatggtcatttgcgaagatgagattgaaggtcccaagtggacaatggataatgtcaagttttctgtaaaagaaccggtatgaacatcttctgaatatttgtccaaacctctcggaaattaacaactgcttcctgaactagttctgtttgtttgactcggcagattgaggcagttgcaacaaaagaagaattagagcatctcaccatgctttgtagatctgaagctgatgcaatggggaggatcactgctggaattctccgtctccttaagcttgataagtctcttggccaggggactatagaacaactcaggaacctaggtatgtgttccctacatgtaccctgatttattttcttgtagatgccatgctaccctgtgttttggacttttccccttcttttgctcctttttggtttgctatgaatttttactagtaatacactgctatcagctactccttctgtttcgtattataagtcgtttgactttttctatagtcaaactttgttaagtttgaccaaatttatagaaaaaattagtttcaaatatcaaattagtttcattaaatctaacattgaatatattttgataatatgtttgttttgtgttgaaaatactattatatttttctataaacttggtcaaacttaaagaagtttgactatgaaaaaagttaaacgatttataatatgaaatagagtgttctttatctaactcctttgttgggtcattaaatgctgcaaagaggagatctagttacggttttttatgcccaagtcgaaaaaacaatcctagataagacaaaactgtctccaaatttttcatcgggggtttttgccttggtgtatactgtcaacaaatgccacctgggagttattttgatctgatgctttgtgcttcagcaaattatgcagcaatcactattatttggttatatgccattgcttttctttcttgtttatgttactgtatttttatattccctcgtacaatttatgctgttaaaactgattcttttttggaaaatgcttacctacttcattttctcaaaacaattttagattatcttatgaaattgtgatgtcccaggaagcggaggaatcgacaatactttttcacctaggaagttgagcaggcagaacagttttggcagcataggtactcctaggactcctaatctgcactcaactacagatgcaggaacgaaagagttactggaatcaacagttgcttcattacaaatcgaaatcttagaatccaaggccaaatgtacagccctcgtttcccaggcgagcggtgtggaggatcagaaatgcgccgaagacatcaggcaattgaatgacaagctagagagcatgcaatccttggtgacaaaattgagaactttgatctaagttgcacatagttttttgtgtataggttcgtgcagtccaaaacttggaagtggctaatgctgtacttcctcttcattattctttttgtgtacatctttatgttccttggggtgtatacaggtggattctggaataatgagctgacacgcagcaaatataaaattttgtagctggaatgtcacatgtagcactgtgttcaaaacttcaagtgcagtcattaggaataacatttttgtcatctgtatgtgactcatgtagtatcatatgcaaagttttgctgttgtcacatacaccatctttctactggtggactgggtgttttgcgaccaaaatatgtatacataaataattttcaaaaagaacatatgtactaccaatatactctctgttttatattgttttatattataagtcgttttgatttttatcttagttaaacttatttaagtttaaccaaatttgtaggaaaaaaatatagtagcattttcaacaccaaacatactatcaaaatatactaaatgctagatttaataaaactaatttagtcttttatatattactaaattttcttaaaaattaaatcaaacttaaaaagtttgtaaaaaagtcaaaacgacttatagtatgaaaaagaggagcaagtttttcctctgatatctcacttagtactaatatcagcagtgaacctttatttttgtcatgtttcaattttttgtatggatttatcccgtgcaaaaattttagtaatgagaacaagatatgaggggataaatttgtaacaaaaatatttgaagtacaataaacctattggacctagatatatgtttgtatataggtgtattttatcggcatactcaatatacacgaaggcaaatgggtcattttcatgcccctccatattggcaatgtgacatgtcctacatatgctaaattggcaatatgtaaagatttactcttcaatgacattttttgtaatttcatccaaaaagagtggcatctcaatagtctagttgtaaaaatcgaactgaaccaagggtttaaccaaataaaccaaaaccaatgcctagtccgaagatataactgacttgagaaaaatcatttaaacccagatggtttactacataaccgaaggaaaattggggtggcgtagggattgaaccccccacggtcaaggcccatgggttctttcacaaccttacataacccttaaatattttcataccaaaaatgtataaaaaatgaacgcatcgtattttagacctaaccctcaaattttctaatcaaaatagttgggctcgttgctacctctatttgcatacatgcgtgcgcacctgactatttaggttagttgctataatggttttagaaaacgaaacaaatatatattttatgttgattattaaaccaaaattctctcaataaaatatataattttattattttattattgaaccgatggttgaaccggtgaatcggtggattcattcaccggttcgaacaccggtcgggtttagagaggcaatccgccgccgccgcctgcgccgatccccatccgccccgcgagcgagcagaggcggcgctgccgctcgtcctgctgcttccgccgcatccacatccttcgccgccgccgccgccgcctgcgccgatccccccatccatcccgcgagcgagcatcctgctgcttccgccgcatcctggttagcacatcctctttcccatctctccctctctctttttttttatcgaatttgcgttaaccctagcttctgttgcagaaatttggcttaaccttgatgtttgtttgttcccaaaaagtttgggggtgttgaactgaaccccccatgccccatgttagatccgcccatgaatggatcatgattcactccaaaacactatggagcatcctgttcctggagaggagcatgaggaggataacagcatgaaagtggatgtggcatttgatggagtgcacagcccgttccggtacaggcacaagaaaaggtccaaggtttgggaggagtacaagcccatctttctgaatgggaaggttcagtttgcggagtgtctctactgccataatcgcctcagctgcaaagattccaacggcacaagccatctatggcggcatcagaaaatctgccctggcaaggaggaagcggcgcagaggcgacagaaggattcctacttcccatgcggtataccattcttgcctattctgggttcattcattactcaatagtgtagataagttaacattggtgtggtttaggatcttgagatgtagatattcctttataaaggcgatttacctcaggaatataaataacgtttccatattttatatgcacagttttggtgaatgagaacgatccagtttcaccccacgatccggtcaatgatgttattacagagacgcttagtgatataaactcggtaacacccagcggtaacagattcacgtcaaaggtgtggaaggagtttacacctgtctatattgaggggaaactccaggctgcagattgcattcactgccagaagcgcctcagtgcgaataagttcggggggagaagccatctgagtcgacatcttataacctgtgcaggacgacgtggacgtgagggggccaaattcatcagaagggtttattttatccttctagcgtgcctagtttgaagtccagggtgcaagatgagctctcacctgccttgacaaatgggaaggttcagatcgcagaatactctagcaagcttctgagggcaagtagctctggtgactcgacccctaagcccattcgagtggtaccagcagagcattccgtgccgactccagattatacaagcctgatgaaacagaggacctcatttgtgaccactccagctggtcaggaaacatctgatccagacctagtcgggatgatagctttgcatggttatcctttgtcaattgtggagcacgaagaaatgatgagatttgtaaagaaactcaaccctgtggtcaatttagtctctcgcaatgctatggaagaacattgcttgacactatttcagaaggaaaaggaaaatataaagggtaaaattgcacatttttcccgacgtgtctctctgtcagcaagcatctggactcctgatggacctgagacaacagtaaattacctctgtttgacagcacattatattgatgaagactggaaagttcataggataataataaaatttggaatgttttggtccgcgcctgctgatttggaaaggatgatacattgtatggaagcctgtgtcccagagtctgagagcggatcatataatgtcatattggatgccattagagattggaatcttgatcagaagcttttaagcttgacttctgttggtgaagttaggggtgacaccaatacttcattgctaaaggaaatgcttatagagaagaagtgccttcctattggagggacgctattcaatgttgcctgtgtggactatgtccttaacagtattgttttcaaagtgcaagcagatatacttcgtcttgttggtgacatagtaatggattttttagtgtcattgacccagcagcagcttctggaagttatttcacagacgggtctaaagtgtccacaagaagatgctaagtggtggcacaaactttattttagacttgaagtgcttttgcatttcaagaagtcatttccttctgaagaaagggtgtccccagaagatacaaaaactgctgagtccgtttgcaagattttgaggacaatttatcgtgtcattgaagttatttccagccctagctctccgacagcaaatatatattttaacgagatatggaaagtcaggacagttttgcaagaagaagcattaaatgatcacagagaaatagctacagtggctatggtgatgcaggaagcattcaatgagtattggcaaaattcatatttgtggttggccatacctgttgtgctagaccctagattcaaattcagtttcattgagtttcgtctgaaacgagcttttggaacagattcggcaagctacctatctgtaatacgtgaaacagtccgggaactcttcaatgaatactgccattctttgaatcaggcaagtgatgttgtttcaaacagtgaagctttgtgtgcagatgataatgattcgttggaagattgggatcagcatctccatgaacaagcaagtcgtcagctatcttcggagcttgatgattaccttgaagatggtttagttcctagaaaggatgattttgatattttaaactggtggatgactcatagtactaagtacccaacacttgcaactattgcacgggacatcttagccatgccagcatctgctgttcaatctgaagcagcattcagtagcagtggaccagtaattccaaagcaccagagtacattaaacatcagaacaatcgaggcacttgtttgtactcgagattggatgagataaaactggtaagattctataaattgctactcagctccatcctatctttgtgattttggtagtgtgaacacactgtgatttagtccatgttttcttattaccagaatcttgtttccttgttttcctgtattggaagtttggaaccatactatatgatcagatgaatgtcagaaaccaaagcctacaatgttagtaactttatatggaagtacatattagaatcttacatgttcatgtgcaatcttagcagctacatcactttaggatgttttagatcatgcttgtaatttgtaattgaaacattttgatcccattggcaatcatgaatatcttgttctgtgattgcatgctttggatcacttaataagtttgtgcgttatagtttgtgtccatataatcatgatgatatctcattaggaacttgattcctcacatctttttgctatatgctcttacatgacaaaagaaggtcgctgttgaaatttcacttattaaatcaatgcagttctggtatatcctcatccaatctattcatgtgcaattgcttgaaaaatggtatgctgcagtgaactgttgagatgggttgcatgcagctttcgccggtggaagatttcaggcagtgtatgatggtgcttctgaccaaggataaccgctctgatgatcgagccccaacatggtgtatcaagcatttgggagctgttaaacttcatttcagtcgagatgtgtatgcatataaatgttactcccatcaccccatgcatttgcctggtgtagtgcagatgtatgccgttgtttagccaaagttcaggtcagcccagagccttaggtcaagtaggaactaggagttgtacgacgagaatgttgcaaatatcctctgttatgagcaattaatctgtgttatgtgcagccttgtttacctgcttatctgaattgtttgagggtacgtaggcaatgcgtgttgctgtctggtcctaatggaccgaatttaggatgtggcccactattcagcactatcccgtaaaggtaaatgttgtttaaaggcccaacagctgaacagcataaccctcatagtttattagagaataaaaattaatttataggtaaaatttgtatatatgtgtttttataacaacttaaaaactaatactgaaaaaaaattatgttgaacatatttaaaaatcaacttcaaaattaaatttgaaaattcaaacttgacttttcatttagcttgcgatgggctctagcctctggctagcatagcatgccatgtctgggagggggctggcccattggtcagacacaactgagccttctttttacatgggccggaattgtaggcccatgtacacagcccacaaggctattttctgggcctctatcctcctccacgccggggagccttccgtcgatgaggctccccgacgcgctcctccgccgcatcgccgtcaggaatggatagttccaaaaacccatcgatttaccacatgttccattaatgtaaataattctacatgctaatgctaaaatttaatttctactcccttcgtatcatttgaagtgcagccataattttccacactcaactttaatcattcttcttatttaattttttttaaaaaaattaaaaacataagttatgaataaagtattattcatgttttattatctcataaaaaaataattatcatattttttttcaaataagacgaaatattaaaattgagcatgaaaactcataattgtacttaaaatgggacggaggagtagctaagtagctagctaaattaagctagaagaagtcgatgccgcatcgcttctgctggaactccggcagcagctggccgtcgggcccgaccacgacgtcgcaggtggcgtgcaccgggtgccagtgcgacccccagaacgccacgcgcacccgtatcctcgaccggaccttcaccgtgaacgccacgccgccgccgccgccgcccgccgcggcggcggcagcgtccctcgccatcatgtccgtggcggcgccggccggcacggcgacgccctcgaacccgaccgccgacgtgcccctcggcggctcgtacagcggcccgccggtgaggtccttcccgtcgacgaccacctcgccgtcgccgcggtactgcaccgacatgtacacccggccgaagaagaaggcgaggtcgtggttcgggttgtggatcgtcagctggccggagagcgccaccgggccgccgccggactggacgccggcggcggtgaacgcggcgacgtggaaccgcggccggtgggggcggacgacgaggtagacgacgaagaggagcacgccggcgacgaggaggagggagaggaaccacgagcagagaagcttggtgcagcgcgtcaggtgcggccgctccctcggcagcgggcgccggatgcggccgccggcgatgaagcccgcggtggccgtcggcggctgcgacgacatggcggcgtattatatatacgtgtgcggcggccggcgagcttcgacgacgatgggatggagctcgttggtgcagcaaagcatgggcggcaaagcatcgccggagaagatggaattcgggagaggttaaggaggtgtgtacgcgtgtacatacgtagaggttgcatggcaagttggtttttgggtttcttttgttgcgcgtacatgggcgattctttgaggagatagcaaggaacaaaaggggtagcagtggccggttttcttcgtgttttggttctctaatctcctacttattttatttgaaaactagcatggtggcccacgcatattgcgcggctagcatcattatattttctgtcatataatagcatatatgttttctcaatgtattattcaaatatattaaaatgactacataattttaaattttgtactacctttacaaaactactaatgtataatattcatattgtattttatatatgtgttagttattaattatttttaatatcaaattttagttatttgtaaattatattcctatatggactctaggctcttctttcaatattatttatttttaattctgaacttttattatttataattgtatttctatgtggactttaaactcatcttttaatattctttaatttttaatttcgaatttcaggtacttctaaattgtaatcttatattaactttagactcttcttcccatatttttttaatttcaaattttagttatttgtaaattgtatttttatacgaactctaaactctacttttaattttattatgtttattccgaattttagttagttttaaattcctatatggactctatactctacttctaatattccatattttttaattcctaatttctattattttcttaattgtatttttatatggactctatactctacttctaatattccttatttttaattccgaatttctattatttcctaattgtatttctatatagactctatactgtacttctaatatttcttatttttaattacgaaattatattatttctatatggactctatgctctacttctattccttttttaattctgaatttcagttatttcctaattgtatttctgtatggactctagtctcctcttctaatattccttatttttttaattccgaatttcaactatttctaaattatatttctatatggactctagtctccacttctaatattccttattttttaattccgaatttcaactatttctaaattatatttctatatggactctgccttttctttttcttcgattaatgtgagaatttctaggccatgagagcgaacgtggaggcttccttttctatttctttaataatataatagatttcatattagtaaaatatttgtgtttgattacatggaagctagtggcacggctaatcagggtttgcaattttgaaacaggggcttttgccggtggggctaaagaaccgaaatcaccgaaatttcggtatttttaggccgatttttttttgaaaatttgatgtactttggatgaatttgaataaacttttaccaaattcacaaaaaaaagagaaaaaaactgaaaatttcaggagatatatgtgcttgctggtgggggcgaaattaccgaaatttccaaaaattcgtcccgaaattgcaatcattgcagctaatagtgttttcaaagatcaactagtttacaaacatcgatggtaattcgtagtgcagatggccgcccaacctgcccgagagttgcctccatcatttgggatctaagtgcgctcgcctaacatacgtggagagaaatagagcccgacagtaaaatatatcactcaatttctattaaatactggaggtgtgcaataaggagtgttaagatttcgggcaactaaatttttcaaaaatttaaagcgggtttctcacccttggatgatatatatttcaatggctctcatcaatcctctattatttatttaaaaatgactcttctttcatagataaaagtttaaacaacattttttctaacataaacatgaaataaatttgcaattaatattacaaaattaccggaaaaaatgttcaaacttggataagcataaatcaaaaccatttacaaaaaaaaaatgtagttcaaatgaacttaaattacacgtagcactataattttaggcttagcaatgtacaattttgggtgaaaattttcagacagttcaaatctagcaaatacatgtttctatttcaattaaggccagtaaattaatactactatacaggtagatgtaaaagttctgttgttactgcagatgttgatagtatggcgcaaggctggaaagtgatgaagaagcgagacttaagtttgagaagttgaccgagtagatatgccaccgtatgtacacaccatgtggagctagcttaatgacttggtatgcttcttcccccctggctagggtcactccatgaatatccacttcacaaagtaaacttttctgaccaaatggccagcgagcatatttcggcctcaagtttcttctgcagccgacatgacttcttgcttgtcgatactgctataatgcagaatcataattagcccaattcgttttttgatttctccatttcaatcagtaacacttaacacccaaaatcatacagttgctggatagcggtacattacatcacagtacttatcaaacatgtaacaccgaaggcattacgcaacattttatttccttgaatgaagcaaatagtttactttgattgtacatcataatacaaacaaaggcataacaaaacatatttcacaataattctacatataccaaggaatatcaaacagctaacacttcagacaaatgcagttcagcggttgtatatatatttgcagcctaattcacaaaggcacagtgcttcctgatctccccctgggcgccggtgagcacctgcatgttccccatcttcaccatggacgccgcgaagtcggcgaagaactccgccgggtagccggcgacgccggcctggcggaggatgtagcccctggtgaaagggtcgagcatgagcgtctcgtcggaggtgaagagcgccctgcccctggcgatgtgcctgtagtagctggtgtcgaacgtcctgaagctccccgggtccatctccaccagcgtcgtcttgtcgccgggctggcacttgctcttcagcctcggcacgtagtacttgtccagcgtcgggtcggccatcatcatgccgctgaagttgtacagccggctggcgaaggatgaacaatgggaggttccaagagtgtgcccacctgtgaacaatgtgtcacttctcaaattgcatatgcacatttgtgatgagttcttggtaattaaacaagtttggattgcaattttgccatggttttgaatctctggctatagctgtttgagaagagtcttagccactatagctccattaagttcgctatagctgtttgagaaggtcaatcgctaaatatcttaacccgctatttaaaaccatgaattttgcaagtgcacaaatgagtatggtgctgaacaggaaacgatgttttgaccactcgaataaagagctatgctgtgtttgaggataaagtggtcttggtctcctggcttggttctgtactgtgccatgtgattagaactaagaaccacatagttttgtacttcccattttgttgacttggtatgcgcatatgataccttcctttattaacaagttgtatagtaattaaataagtgatcacctttattggagaatgctactgggatatatcgggatcagcagagtgtttaaaaggagcacaggcaacagaaccgagagttgcaactttcagtaagtacagtataaatcatctagggagctagtctatgaagattaaacattgaagttagtgaagaatagtatatacctagcagaaccacctgatcctttgcgtcaaggccctttgggatgaagaattgatacaagttccgcgtggcatcgaagaaggggggagggaggttgttcacagcatcatccttcactgatcttgtcccatccctccgcccagttggaacttcccagtgaggccctttggtctgttgcacaagggaagaatagggacttttctcaactatagttctagttactgtaagcagcaagaaatccaatagccacgtagaatatggtgaaaatcaaactgtgtggttttccactattgtcggcctaaaacagccaattctcaccacttagccaaactatactaacttttctaactaaagaatgaactaagattaatgaacatggaagctagttcttaccaagaagacaacatctctggctaccagagcaaggatatcagcacaggacacaactccagggcaggcttgctccagcttagctttgacacggtctattgtgccaaaacctcgcagactgaggtttggtattgattccttctcagatggtgatcctggtgtgctatccagaagtatagagccatcgcaaccctgcaaaacacatagaggcacatagcttagtaggataaactcaattcaaaatcaaaacagctcagagcatggtaagcagtatgcatacattcacaaaacaatcatggaaatgcatgcgaagtagagggcctgcgagacttggaactcgggatatgatcttggtcatctcatcacgaacaatgacctctgcttttggacatgtgtattggtaaaagccaatgtttagccctggtggattggataatactaaggagaactgtaggacaagagaaaggacaaatccgaagaggagtctgtaaggcatgttgtgcatgactactgtggaaccactgcctatgatgaaagagttgccttctatgattgttgaggcaaattataacttgcagcctgctttatagctcagttgcttaggttgtactatagtaaacaagtgacataaaccatttcccacagcttcattttatttttcctaatgcaacaagcagatggtctaagacttggagatcgagattttacaagccctatgagttgtgtgcatgtacttcaattgaagaatacgcaagtcttggatcaggcatctagatagtattacctggtaatattgcataattagttggtggtggtcatccttcgtggcttgtgcacttgtgagtaatacaggctcttgtattgatgaataggtcacgacatgttgctaaaaggtaatactctctagctgttctaattttttattttaaatattatatgggttgaatttattctggtaaagaagttcagaaggattcaaagatatgagataatatatcagtttatccgttgtcgtttgttccagaggaaattgtgtatgttcatgcaaagtggaaaagaaagaaaaacaatccatttcctgttttgttagtatttaagggaaccagggaatataatatggttgcctcgctatgacattatcactgctagtttctcttgggattgcatctgaacactaaaggaactgcccataataatttcttaactggcaccagtcagttaaagtaaataatatcaaagcaacaacccattgtttgatgaaatcaatcttcttcctttgaaattaagttgagaaaaaaaaaggttgcatgacagttgtgctcgtgtcaatgaagcaaatcaagggagaaaagttagaagagaatcaacatgatcactgctagctaattattgaatgccaaacgggtgcagaagcatctcaggcaatgtgcagatacttcattttgaagcaaaatttaggtttgatcaagcatataaacactctaagaaagatgagaacatgatgtgcaagttatggaaaaagattctctatgtttgaataaaaaatgcaagagtttgtgtaagtaaaccttcagtgaatccctatcatactgagaaaatcggtccattggtcagatattagttgcagcctttaagttaataaataactgctgggctcaagataaccttccgctgagctctccagagaataataataaaaaaaaggtgaaaacaagtcaggagtagtgaacagaaccaatggtggacaccatagtgcgtgggggtacagatgcacccctaaaacttgaaaaaacaccaaatatataggattacatgtacgtatacaatgtgcacttagataagaatcccaaagtgttaaaaattttgtatgtaatacatgtcaaactttatttttctttatttttttagattccattggtctttatagggcatattttaatttgaaaacaaaaattcaagattaaacattggccattgatttctcagaattatattcttaatagctataaagccaatattttgtgaacgcactttgaaatatgaatctatgggcacaaatttcacattaaatatatattaattatattaatttgattaattgctggtcaaaatatacataatttgacattttgaaatttaaagatgccctataaaaaatcaatgcaggttttttttttctgtctgttgtaatggaatcatggaattttctctatcaatattccatactatctactagtgcatcattacatcttcacccctattgtcaaaatcctgcaccacaggagataacaatggtttaagtgttcactaccacatggcttgggcaatgtattcaattactcttggagtaactgaaaagtgatgtcttttggttgttcaagaattcaagtctaagacattcacagcaggtaaagaaatttttagttgacctagctcaaaatgtgtgcttcactcaaacagcaagggagtgcaggacagttttgaccatgaagttgttcaacaatggtggacattgacaagttcgaccttttccataggaattaaacagtactccaatttttacctcatgacttgttcatgcacataagaaaaaaaatgccaacccctttagtcatgttcagcagcaactcacagtctagttaatacttaataaatgttttctacgatattcttataggacatcaaaattgcttttaaaagagaagggttaatatcccataattattctgtctaatcaacgttatgtgacttgcaaaaacacatctacagtcctaaacaattatgggactaattaagatttaaagcacagtaacaattcagaaaattatttatcaaggaaagtaacccacagaagtcagatgaacaaaaaacttacactgaacgaacatgatggcaggtgaatttgtgataggtcaataggtcatgagctattcactgtttaactgaacaggcagaaattggttaactctggagtctgaactctgaagtgtgttgcggcttgtcaaagtggcccagaatttgaggttcatctgatgcatctatcagtggctaaaaactgtgatacaaatttcttgcagtggaaaagtttctgtcatattcagatgacactgaaaccaacttcctttccatctgttgtttcatctattacttctctcgtcctctgtgcatcctcccatagactacattctgcatacatgtttgcaagaacagcatagtttacagaactcccaggatctatactaaaaaggttcttggctgcagtttctccaagaagcatgtttccatgcaatttacaggctccaagcattgcacccagcattgatgagttgggttttaagtttgtcttctggacaagtttccatgcatcttctaactggcctccacgagcaagaaggtcaatagcagagctgtaatgctcagctcttggatcaataccatacctgctcatcatggaagtaaagtactccatccctttgtttgtcaaaccacaatgaccacatgcagatagaagagaaaggaatgtcacatcgtttggcctaacaccatcttccaccatcctattaaaaagagtcacagcatcttctccagaaccgtttcttccacaggcagtaataagtgacgtccaagaaatcacattccgatagggcatttcatcaaaagcacgcttggcatctgaaaattctcctgcctttgcatacatatcaaccagagcattgtccaatgcaatatcacccataggctgcttcttgcacatatatgcatgaatttgtgtcccaaatcttgcagaagcaacgcttgcacaaaggcaaagcactgagcttaatagaacaccatcaatccataaacccttccgatgaattttacagaagagctccattgcatcttcactgtagtttctatccatggtgtacccactgatcagtgcggttgatgacacgagatctggttcagagatggaatcatatatcactcttgcgctgctcatactccgacattttgcgtaagagttgataagtgatccgatgacaaccttttcatcccagtaacccaatttgatgatgcaactgtgaattagctcaacattgacagcaacaccgactattccacatgcttttagagcacttccaagcgtgtaatggtcaggaatcatcgctgtcaattattttgatgtaaaaaaaagaaagcactttcaattttagtgccaataccatcagcaaaaactaccttgcaatttcatgctaggacataataggcagcatgattacaggaaaaatgctcaagattgttaaagcaaaaggagggacggcataccttctttcagcattgaagagaataatccaagcgcatcaccgtcatgcccgcgttccacaaaccccctgatcagggcattccaggacaccacatccttcttccccatctccgcgaacagctgccgcgcatcctccacggacccgcacctcaggtgcatgtccatgagggcgctctgcacgaacatgtcgcccgcaaacctccccttggcagcgcacgcgtgcacctgctccccgctcctggcgcacccggcccccgcgcacgcgctggccgcgctcccgtacgtgaactggttcggccgcgcgcccgacgcgcgcatgagcgcgaacagctccagcgcctcccgcgggcgcccgttcctggcgtagccggagaccatggccgtccaggacacgacgctcctgtgcggcattccatcgaacaccttgcgggcggcggcgacgtcgccgaaccgcgcgtagaagatgacgagcttggtgctcaggtgcaggtccggaggagaggcggacgcggcggcgaccctgccgtggacggacttgccttgccggaatgcgcaggagctgatgcagcactggagcagggaggagtataatggggcggtgggtttcgcccccattaggagcgccattcgcgcgcgcttttctccctcctcggagcaattttgatctcccgagactcaacaattcatgaattcatgaatttatggcagggtttggcaatccaataatatgagcacgaaacacaccaggagcaaaaatctgaatatatttagattcagttctactaaccggcagtagaaatgagcagctgcaaatatatttttcatgcaaaagggctagaaaactgaactatacaaagttggcttcaatccataaatccaataaaggccttctgaagaatcaaattcagtcataccaccatcagttatccatctagcacatgaaaatcaaagtgtgaaaaaaaaggtgattggataaattaaacgtaccgttatgattcaatagcatagaagaaagattaaatggagaagaagaaaaaatggagatgaagaaaaaattatgtgcttttgcagattggaaagcagacaaaagggaatgaccaaattttttaggctgaagagaagaagcagaaagagataggacagaggggacgacaccaaaaacagttgaactgcagccgcgcagggacgctggtcgctggagccggcgaaggagctccttggcggcggccatggcgccgacggacgtgggtggcagcggcggctggagtaggacgcgatggttgggattggggaatggccgaatgggccctcaaccatttttgggcccaaaccaattttttttcaattttgctatatctcactcgaaagattttttcttatctctcactcgattttctcacttaaatttacagtgcattttcttgtaagttacagtgtaatttatgaaacttacattgtaacttttgtaagttacactgtaatttttgaatcttcgcatgtaaattttaaattttgtattggatttggtctttttcttttttattggatttggtctttttctcgaggatatggtaatttagtgtccattatggtgtttcttaattactttttactttttattatatctatcggattttaattcaaagattaaaaatctgtgtgatacgatcatcaaaatctgtgtgatacgatcatcaaaatctttcgaaagatgtataggtactcccattttttttaggcaccaaaccgcaccagcccaattgtgaaatcaaccaacaccattagaattccaagcatcagaagccgtaaagactgaaatgcgcatgaaatcaacaaacataccaggatagataaccaaaccaacatcgacaccccaattccaagcatcagaaaccgtcaagcgcaaacagattgatcaacaggcacgcgcaacagtggccggttacgaccatgtgagcaatgcacaaacagaatctcatctcggatcaaacatctcagaaacattaacagaagtagaatgataatatcatcgattggtaccgatgcacagtgaagcaaattgtactagtatggataatagtatcaacacaacttagggactctaaaccagaacacaacacaaccatgacacgatgatatgacagacgagcggcataggtataatgaagtccaatgctgcaccacagcacacgctcagagaccaccacggaggcgcaggacaaggtgcagggtggactccttctggatgttatagtcggcaagggtgcggccatcctcgagctgcttgccggcgaagatgaggcgctgctggtctggagggatgccctccttatcctggatcttggccttcacgttgtcgatggtgtcagaggactcaacctccagagtgatggtcttgccagtgagggtcttcacgaagatctgcatacctccacgaaggcgcaggacaaggtgcagggtggactccttctggatgttgtaatctgcaagggtgcgaccatcctcaagctgcttgccagcgaagatgaggcgctgctggtctggtggaataccctccttgtcctggatcttggccttcacattgtcgatcgtgtcagacgactcaacctccagggtgatggtcttgccggtgagggtcttcacgaagatctgcatacctccacgaaggcggaggaccaagtgcaaggtggactccttctggatgttatagtcagcaagggtgcggccgtcctcaagctgcttgccagcgaagatgagccgctgctggtctggtggaataccctccttgtcctggatcttggccttcacattgtcgatcgtgtcagaggactcaacctccaaggtgatcgtcttgccagtaagggtcttcacaaagatctgcataccgccccggaggcgcaggacaaggtgcagggtggattccttttggatgttgtagtctgcaagggtgcggccatcctcgagctgcttcccagcaaagatgagacgctgctggtctggtgggattccctccttgtcctggatcttggccttcacattatcgatcgtgtcggaggactcgacctccagggtaatggtcttgccggtgagggtcttcacgaatatttgcatgcctccacgaaggcggaggacaaggtgcaaggtggactccttctggatgttataatccgcgagagtacgcccatcctcaagctgcttgccagcgaagataaggcgttgctggtccggagggatgccctccttgtcctgaatcttagccttcacattgtcaatcgtatcggagaactcaacctccaaggtgatggtcttgccagtgagggtcttaacgaatatctgcatctggaagaggcaagaaaggattggaattaacataggtaaaaaaaagcagctggagaataagttggcaccagatcctacgatatcggtactgtcagctcaaaatagatgaacatatcaatcacatcatactacactacaattggacagcatcattaatcataagagcgctgctcacagctcacaccacatcaacaagcaacaaccaaaaatatcttcagataataacaaaactgacataagtaactacaggacaacagatctatgtaagaacacagaataaagccacctagttctagcatctgacagatttgatttgcacgagtaaagcaaataaaacgggtaaaaaaacacagtacaacatcagcactacagttcaactaggcaaagagccagatacaatacagattaaattgaccttagaacccaagctctacagttcaagtaggtgtacacgatacagatgtaattctctaacccagctccacacaattccaatccaaatccaggggaaaaaaactaagaacacaattccaatccaaatccagaggaaataaactatgtgtcgcctaactcaacctaaagattttaacctaacgagctattcatctattggaacaatatcagaacaatcccatccgaactaagcacaaataagtaaaactaaatctgatcacaaaactcaaactatgtggcaggatcaaaacataactgtgaactactcttattatccatcattagggtaatatatcgaaacaatccccatctgacacatcattagggtaatatatcgaaacaatccccatctgacacatcattagggtaatatatcgaaacaatccccatctgacagaacaatctcaaaaccaatccatctattagatcgatataaataacacagatccctacctcgattctcacgaaaccctaaatcaatgagagattaagaggattaccctaaaatcgcacgaaaccgtaactcgattaagaggtggatcaccctaaaatcgcacgaaaccctgagagattgagactaactcgcacgggatcctcctacgctttccaccacgagcatcaaaatcgcgagattagacgggcaccacgagagattcgaggattaggacgaggtgattgattagttaccttgacgaggcgattagagaacgcaaagcttcgctccccctccccttcggtcgattcgactcgctatgcgattaatggagagaaaacctctctatataaagcgtgggcaaggcggtgcgaggcagcatccggtgcggtcaccgccacgcgtacggcccaatggcagcaccacacgtgtccatgtagttggaggcgcgacacgtgtccggtcccggtacgaccatccagacggtgcccggaaccaactccgcgtcaggtcatgccgcctctctttgacgaagtcggcatgcctgatcaagaccgtacgtttccgatccaacgatcaggaaacatcgtacttgatctgctataagctgcgtgtgggccttaataatcctctggggaaatatttgtgggctgaaatgaacgggatattgggcctagacaaaccagggcccatgaattttacggcccaatagattgttgagacctaattggctaagcccaactcgcgcactctgaccaaccgatcggaagttcgcgtccacgccgccctgctcctccgtcgccgccggctcggcggctgacccccgcgccgccgcaccagctgcgcgcgcgcgcgcgcgcgcccccaccaccgcggcctctccctcccacgcgcagagggcacgggcagaggccgccgcggcgccgtactcgccggcgcttcgtcggcctcggcctcgggtcgaggccggtggcggggcctcgtcagatcgccccccttcctgtgcagtaagtatttcccacggacccaatatggattcgttgttctaatcgatagctgctatcagagatgggttcttctgcgtgatttacctgttcttcacatcctctgtcgatatggggttgggtggggttcgtttcttgcgctaatgcaagatttgaacttgcaggcgtgctctgctgtgtgtgcgtgtgtgtggcaatggcgttgatgcggcggagagtcgggggctacatttgctcggagctgtgtggctcggttatgaatcagaggctgtactcttcgagggtggactggaagcagcttcggcctatgatcctcaagaggataaagaaccgggcaaaggagtatccaatcaagcgcatgattccagtagcggaggaggtagtcaaggctagagagattgtcaccaaaggtgtctcgacgctgcttcaagttgttcccatacattcatgcaagtaagggcgagaaatgtggaatttttatgtatttgtctgtttgtcttaacacttggggaagatagtatggctaaacaagtgttttatttgtagtagatcaacttcaatttaggcatgcactaaaaatgttccagaacatccagaaatggggcaacattacaagattaccagtcttctatagattaccgttgttattgtgtaccttgattgcatatagccatgattgcttttcttgccatgccaagttaagagcagctctctctgatgtgcatgtttgatatcattttcttgattcctgtcctaaaatattattgaatctttctaacaccttgtgtttctattctcactgaaggttttgtcccgaagttcatattggagctgtagggcatgagatgcaatcctgtcatggtttcaagcgtatgatcaagaaccagccgcataaatggggtccaggatgcttgaatgacatccttatccctgttgaatccttccacctggaaaacacgttccaggatgagataaaacatgaccagaggtttgatttccctcgtgtcccagcggtactcgagctctgccatcaggcaggtgcagatatacctgatgaagtttggcataggagtggcacgtcatctgcaatagtcagagaaaatgatgaaaaacctgctgcttttttgccagaagagcttagattcataggtcagaggacaatagaagcatgggaaaggcttagattaggtgtgacaaaactcctattggtttacccatccaaagtgtgtgagcgttgctctgaagtgcatgttgggctgtcagggcacaaggccagaatgtgtggggtattcaagttcgagggctggcgtggtaaacacaagtggaagaaagccgatgtggatgacctagttcctccaaagattgtttggcaccagcgacctcatgatccaccggttctggtcgacgctgggagagactattatggtcatgcacctgcggtcattgagctttgtatgcaagtgggcgcaagagcacccccaaaataccattgcatgatgaaggcgcaaggcctagcaccgccaattaaatgaggccaggggatctaaggagttgattgccaaattagatcagcaccatgatgttatacaggaattgtacagatcagacatcaaaagaccaatgcagagaaactccaaggttgcaaatgttgtgattttgcccaagacattagttctttgaagactgcatgttatcagaattcaggaggtcagaactaacacaattatttatacccattgatctgagtgagagccctcagatgataacaagggaaaattgtttctgtggacaacttcgtgcatggtaatttatcgactatcagcattgttaagtattcagagcgattactttgctgccctttcatttgttcatcctccatcatttgccaagaatacgggtggaagggctttatgagcctgctgtttggtcttcttctcctctgcttgactactgtaacatcattggtttctgctgttttgtgtaaactttctcacattacctagacatccttataggcagttctgttataagttagccatgtagagacgccttgttgcaagctgcaacatatggtgtggaacatcacagaggaatgtaatatcacttgctgtattgtaagccctagtcaaaatccctccttgaagctgtaatctgtgtacagatttttacctggggctccttttgctgtgccaataattacagccacgttggctgattttttttttctggagataaatgaatggatggtgaagtttttgttctttgtatttgaagttgaacattacctcgagtacttgaccccatatgttgctgatgttttttcagttcaagtaatcttgtctctctatgaatgcatcattctggaaattaaagattacttggttggtatttgatgcgtctaacctgttattaaattttctctgcaaaacgtgtcactcaattgtacttcttccgtttcaagttataagggaactgttcactttgatgcaaaaaaaaccttaccaaaatttggatgccaaaattttggcaacttaccaaaattttggcaggattttttatatagttaccaaaatttagcagcaaactaaatgtagccatttttttttgtaactttaccaaaatttggtaaggttgaaaatgacatcaaattgaataggcccaagatgtttttgattttggtcaaagtcaaagtattttaagtttaaccaaatttatagaaaaaaatagtaatatttataacaacagcatagtaattgaataaattttcataatatatttttcttggattaaaaatattattatattttttctataaaattagtctaatttaaaatagtttgactcgtaacctgaaatgtatggagtaccatgtaaacactttttaccgtatgtggccgtaacctggaaggaaacattagcagaatttgcaaccgacatgatttccttggctaccaatcttccttctgcgcgtgcaattttggtacttccgtcagttccgtgtcgccgacgtacccggatagaaaccgtgagagccaagtttggcagcggcgtacgaggaggattctactcgcgacctgggtagtggggaccgtagatgcgccgtcggacggccgagatcacgccacgtctaacaacttatccgacgtggactccacgtacgacttggactcctcggcttgaacctttcgcgtcccctcataaatacacgcgaggaggcgccccctgattcgtgcaatgcaaaaaacgaacgcgaagaacacgaatcctccggcgatctcgagcgcaacgatccccagagccaagaaacccgccgctgccgccgtgtcgccgtcgtcgaagttggcgagcagcaacaaggtcaccaaggtgtcgccgccgccgccgcagttgtccgcgctgtgggccgccgcctcgtcgtccgacgaggaggaggaggccgtcgccgtcgccgtcgccgtcgtcccagcgccgccgccgccgcagccggcgagcaagaagggaaagtacgtcaagggccgcgcggcgtccaagaacaagtaccttgtcccccgccgcggcgaggaggatcaggcggcggagggcggcgggaacagcggcagcaagttgatgtccggggcgccggaggagttcggcctgccggcggggacgttcgacgcgttcgcggacgcggagggggaggacgccgccgcggccgcggcgccggcggcgactacgtgcacgtccgcgtgcagcagcgcaatgggcggaagacgctgaccaccgtgcaggggatcggcggcgagtacaactacgccaaggtgctccgcgacctcaagcgggagctctgctgcaacggcaacgtggtggaggacaaggagctcggcaagatcatccagctgcagggcgaccaccgcaacagcgtctccgacttcctcgccaaggccggcatggtccgcaaggacaacatcaaggtccacggattctaagtccagagagatcgtatatcacttgggttttagtataggttcttaattatcagttttgattagtataggttctggttcagtttagcagtgtgtcgtgtctgccgtaatggcttgcagtcgtcaggttgatcatgttaagcctcatacttcttttccgtattggtgtcaatggatgattttaagtatatcttgtttgcttactgttctctgaatacgtacttatccttgtgatgctctgcactttgcaacttgtgacacagatgatttttactggtgacaaaaaaaaattaaatactgaaaatatcgctctgaacaaatttgttggtgatacaaacaagtcaataatttcagagatcagcgtagtcgaagtcgtcgtcaaaatcttcgtcgtactctatctcacttacgtggctatgataatgtggtattgagctccacgggctgtcgtcgagcacgctccggaatcggctccgtaggaacgtgacggcctcccatgccgccatctgcttcgcctcctgcaccgacgacccgacctgcgtgaaacgcaagcaatcgcggttgagaacgttgacactcacggttacggcatggtagtcggcggcgccatcatcatcggcctccgtggtcgtcgtcgacgtcgtacgacggcggcggcggctagcgctgtaatagtaggttggctctttggttgctcccatgccgttgatgacctcccatagcagcagcgtggctccgaactccgtcaccggcggtggcaccatgctggcttcgacgcccaggtagcgctagctgcagcatgatgcactcccatggcgacgacggcttatggggtttttgctggtatctacggaagcagctggtccgcatgtcgtacgattgcaccgaccgcaatgcccaggaggagctgatcaccggaccatcaccggcggcgacggtgaccaccatgttcctctcgtcgtcgacgtaccaaatctgattctcggtgatcttgccgccggcgccggacgacgtgacatcgaacgcttggcaagaagcgtcgccgatgaagagcgcgtggccacgcagcctggggattctcgtcagccgcgtcttctttcgccaggatccccacgtctcgagtcgtgctcctcgaccacgtacaccttgaatctagatgtgtggtagcgcgccgcggcgcggccgccaccggtgtcggggacgcgggctctgccgaagtctctggaaactactagaaccttccccatcgtgtggcaggcaaccaggtagaactcggtgcggccaaacgccggcgcctgcttgtcgacatgcgtccaccgccactggtcgctgggcaagtgcgagtagtgctcgatgtccgcgtcgtcgaaggcgaagatctcctccgcttcggtgacggcgtacagcttcccttccaagaacacgatgtcttggatgtagaacaccctgctaatgtccgaccaagcattatcatcatcatcgggatgatgtttcttcttcttcctccccgggaggtggcagacgaagatcttgcctagccgcgccacgaacctcgatcgggtcggcgcgggcgatcgcagctaccgtgatgccgccgccgccgtcgccgtcggcggcggcgggggatgcggacatgacgaccttggtgatggtctctgggttggtccacatcggcagcttcacggtcgccatggtgaaagggttgaggaggaagggctggtagggaggaggcgacgacgtgggcaccatcgccagccagttgtcgaacgagccccggcagacgacgtcggtggcgccgccgtggaggctgcagacgcggtggatggcggcgtcgtggaggctgacgcagtggccaggggccacgagccacgggacggcggggcgcgggtagtgcgaacgctcggcggctcgccatgctcggcacacggcggcgaagcggaggcggtctcccagggcggggagcctctgcaggacgtcgcggagcaggtcgtcggggaggtcacaccacaactgtcacgccccgagctagtcccgaccggaactaacccgtgacgctccaaactaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcgtagccggcttgctcctggaagaactcctcatcagcaggatctgcttcatcttcttcagcaactggggggggatatttatatagagcaagggtgagtacgggggtactcagcaagccatgggaattaagtgtttaatgcaagcttcaaggaaaggctgtttgtttttgcgattggttttatttgaactcttttctaaaagcaactaagtgagtgcttctcaaacgacacggatgaggcagtgcgtctcgtccggtcggagtatgtgcaatgtatcagtctttagattttgaaacaaggttggcacccggccaaaagctttttaaacggccacccgggccaacacctttcaaacggccacccgggccaacaacttttaaacggccacccgggcctagctgatcccatcagctgcaggttttccaaacatagaacccagtttctcaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56970 - DNA, 4268 bp, Oryza sativa
  unsure (1)..(4268): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagagatttgtacctgagcaataagccagcccgaccccccctctcttgtcttctgtggatgagatgagagagctgttcttagtcttcagtatccaccctgtaaatgtgtaatcgattaggttgcttcggatcgtgtcggtatctttcaggattgctatgggtcgtggataaagtgttcattggttctttttaactcgggcttgcccttgtgcaaaattagaattcaagtcaaattgtttacaactttcttcaatgctgaggtatattgactttgatttggtcacctgatctctaatcccggagcatgaaacttccagcgccaccggcgagcaagaacaagtcccaattatttattatttttcagtctaaatatgaaggaaccctcacagcgcacattggcatcaaatgttagtgtttaattgaagatcaatctaatatagggctcattagcagtgttcaaataattgaagatcaatctaatatacacactaagcaatgctagttttcgagtctcccaacaccagtacacaaatgtacaaccaccatctagcctgaatatcaatcagacgacgaaacgggctcgtggttactttacaacaatcacgactgcatccccaaaatataacaacagcagctgtgcacctcaacatccaacaaactaaccgatggttcccccaaacttcgcattggaggaagggaaactttgcaagcaacagcatcattgcgagcttggctgttgcttcccatttcgcgggacgacctggcacacaaatgctagaaacagagggtgagattttatggcttgtatatgagcaacaggggtagagattgaatctcatgtgcttaccaaactagacgagggatatctatctatctatttattcctggagagctttcacacgggaggtaagctctctgacttgattcttgagtcgctcggggttgctgaagaaatcgacgaacacttgcctctccctcccaacttcatgagcgcgattctcaaagatctaatgtgcaattgagaccatgatgcttatcgatgaatatgtaacgcacaagctttgccatgttatttggtagggactagggaaaagaagcacatgataatacctttatcttttgggtgcgagccttcgttacttcttccacagaaacttcaacttgtgcgttggcattttccatatcatcgagtgctcgcatcagaggctgtgccaagcatagatttagttcacaagcacaggtaaaaacaattcataactttcaaaaggaaaaggaaggagtgctgaaaataacacgggagatataagaaatgggataattttaaggatgaaagaatgtacccaaggtgtcaatattggttctgcagtcgtcgatgatgcaaatagaagttgttccactgtttgaattagggtgcatctgcaagagtggaaaggatgaaaaatgactgctaaatttgaatttaaggaggccaaatcagtatataaatggactataatccgtaatgctaaaaactgtaggggctagtttttagaaaatgtaatgtagaggattggtggcaccgtggaagattcaccaccaccagctaaaaggaaatttatatttgagcagtagatgagggggctgagacaacagttcatcatgtataggtgaagacgcaaagttaagccaacaagcaaaccgtaccaaccaaagatccgttgcaaacttgaaaagtatcatctgtctcaatattcaacttgattatacatgaggacctcagagtcagtgacagttgacgcactcatggttgtctcaatattcaacttgattatacatgaggacctcagagtcagtcacagttgacgcactcatggttatcaaggcatcaccatagcgtcgctatggctgtaaggcgctgccaggagtaatggcgtctggcccaccttaccatactgcctatggactgccaggagttaggatgccttaccgccttaacaacatgggacactactgttctattcactaaaccaagaatgtgggtaggtttgcttagatcagaagaaacactaaaagcaacaattcaaaaatttgattttgcgtatttcaggcaggagataaagtaaaggcaactgatatttagacatagtgtgagctatagtatcacttacagttcattgatacatcttttgcgatcggctggcagagcactttcaagttcagactgaagagaaagcaaatcagattgaagggctgatatctgctgaaccaaggcatgcgctgacatgtatgttggcattgttgcttggacatctacagaagtgacatgaaacattgaatatcgaaattaaaacgttcaaacagctatctgagtagagttgtcacttgtcagcttacttgagtgaacacataagagatcccgtacggcatggaggagagtgtcacggtcatcaattgcaccttgctcacgcacctcggtcgcagcttgaattaatgaagtacaatggccctaaagaattaaaaaaaacatttctttgttaggtcaactaagaatcatttcttggaaaactaagaagggcagattgaacaaaaactaccgagtgtagcatgaaacatgtagacacataaaaaagaagaaatgacaacataggaggttctcaacaaatgagattgcttaccaaacgggtattgacagctgataggtagctttgcaactcggattctattactctaagcagtgaataggcgctagctatgtttttcctttcaagctggcaagcaatcttcagaaactggtgtctggctagctgattagccaagtgactgatgaactgcagaatgaagacagtgcagaatcagaaggatgtgtaataaaacaatcatatgcctggcagtatgtatgaccttggcagaaaaatgtaaaacactgttccatcaaatgcaaaagtagctggcttaaggtgatctcagcatgtattggtgcaagctagcagcacatttttcactgatcacttaaatttgtcttctgagtgtatacgaaaaacaaatagggtcaacaaggtgtagaacaaccagattttctaatgaatactcccaggggccaactaaatctaaacattgaaagtttgtcacaagaatatttggccccctaggctatttggtgcaagtgtcttaccacccatagatttgaaggcagaaggaaaaataggtaataacactatctgaatagttatctcgattataaactttcataacattatagaagataccaccaataagcaaacaaaggaactgctacaataaataagtgtacatgacatatataccatgtgatgaatgtgcataccgttttttgcctgttaatgtagtattcctggcgcatgacctttaaatcgtagtcccctacatatttgaatgctagaatatcaaggaaatgatacaacagaatcatgtaagccagcgaaagtaatgtaaatatcatcaacaaaccttgcaaaatatatgtgccttgaagttgagcgagttctgagcagaggcatggtatagtctggagggggagaacgagtgaatactgggaaaaacaagcctatctcgggaaaattttaaccatatgctaaaagaagtatgtctgatgcactgcagtaagaattactattggcatattatcctctaagtgctgaaagtatcttataagtgatgagtgtttttctttttcctgagaacttatagcagaacaaagctaatatctgcataacagattataatttctagctgcccgtggtttagagatttcacaactgaaagctattttatgacagtgcttggaacactttttcttctgaaataggaatttaatctgcaatgaatcattaaatcctaccagatgcaagtatgcaattcaacccttatggtattaaatggatgtggcattacgttgatgaaaactctgtcgaaaaccatatacatttcatcaattgacacgcaaacccatatgcatccagctaaacagactcatgaagtgccaatttttgtaactagggaatataatgtaagtattttgcaagaaaaggcagtgcctctacatgggtagagcatacctcagatac

SEQ ID NO: 56971 - DNA, 3288 bp, Oryza sativa
tgcaaaaagaagtgcaataggaagaaaaataagatcacttgaatatctcaataggcaccatataacaagattgcatgaaacattagcaactatgatgtgttcaacatagaggattccccttctgtttcatggtaaaaaaaaaaactatgatatgttcaaacagaaaggtttggaactttggataagcgataaatcaagggatagttacattgaacgaagtcgttgcaattcagccacacgctggtgatgatgtgatttttcagaatctcctgcataataggaatgagtttttcataattagttcattcaaagcacatcatactaatctaggatcagagttacgctctttaaataatataatcaatctattcattgcatacaatttactataactggtatttacctcttatcaagccattggtgatgtcgtcaagactaacccaggaacatttggacttcccttcctcagcaacaagtcgaaatggcccctgacagaaagtgttaaataaataagtaagcagaataagtgttaaataaataagtaagctgagaataacatgacagccaaagagaacctaccttctcaaattgcttcgagaaccagcggttcagctcctttgtacaagccaagtctccaacaacataagggtggaagtctgaatatgctaagtatatactttcatctgcacatatgaatgatgaatgagttatagaggaatcttattggataaaacacaatgttcatataagtgttagtattaagaaatagataaatatgaaagagagctctaagaaaacatggaatgttaacagctgtttgggatgggtacttgtttttaagatttcaaatttcttagccacagtacataataagaggattccattctgattactgtagttctctatgctcttgttgtctgatgattcgtaagccatcagtggcgcattattctttcttaagttgcatgcatgtaaaggtagcattaatcctggagtcctggacccctccatatatgtagtttacgtatatgtttgtataattataccagtagaatactcccttactattttctgcaaaataagctaaaaaaacaacagaactattatctataggtaaagagcataccatctcctgaatgataatgggccaattcctgggtagtagcagtgattcttccgagaactgcattcatctgaaagttagaagataatgaatcatcttaattgaacaatttcctcatgaaagaaactctagatatcttaaatatcttattgcataaataaatatatgccactgttcggaaatgaatcatggttaacaaagcatatgattgagatagaacttccacattcaatctttttaaggagatactaataggagatcaaaattatggagattgttggaaagaaaaatataagatgcaacataatgaaatatacctctaagtttctagaagaaagttgttcatccaatgatataagttgtccactaactgcagacatggcagttacacgtgcccgtctgccttggataagagtagaagcttgccctgcaagcaaatcaaactgtgcttgttgccgcgcaagctgcttctgtaattcaaaaacctcagctctgtatgctagtttttcttctctgcagcaatagcataataaaatacatgtcaggaaaagcacatccaatgtccaattggtaacttcaactagctagcatttggcaggaaccgggctccgcacaggagttttaaagtttaaaccagactacaaaatactagtgtcttgacatagctctccacattttggaattttagtcatggacttgagtggtatggtctgcgttacctggctagtttctttttcaccaaacagctattttacttgatttattgttttttgttttgagatttcaatgttttatactagttaaattatcatttccagcacgattcaaaatctggtcctagtatgattttttgagaaattggttctcagtagtgtgctccgtttggaatataaattctgaaaggacaaagttttttcccctataaaaactgaggtataatcgcatttcagttgggttctaggatttgagcccaagaatcaatgtaaatgtagtaagtgttcaatggtgatgccaatttccactataattttataagattgaacttccaagcataccggatatcaaggattgtttcttctgatccaaatacagcctcttgattatctttcttgcttgaaaaggctgaaatactatcaaaagcagagtccaaatcctcaccctgagaaaacaatgccaatgatagcatgagttttaaggtttagcaggatcacagatataagtgttcaaaaacacaagtggacaatacagcttatgttatagaatgtaaagaacaaaaacccaattttgagtttatagtttgtaagcagagtcccagatcttggatgggaatagttccttgaggttcagcatcccatgacaaccattgaaaactggctaatatcttatattttgccagaaaatctaggaaatttttttaatatcttagttgttcacaaactggaactcctgtcctagaggcatccaacatttggaagttggaaccatgcttgcacaatctgacaggagcagctccgcaacatcctatactgttaaagataacagaaattatacgttccagaaaggtcttggtgaatatacctctagcagcctaccctcttccacaagttgctcatacctgcaatgcaaaatctattttgtcatttgagaataactcaagcaaaagaagcaggggaagctttagaagtcatctatgcaaatatgttactaattaaatatggcaaccaaacaatggtaaattgtcctggttcatccaagattacacaatacaaatgcaggtgtgagtgaaaatgtaaatttagaagcatctcatgcacgatagtgatacagtaaaaaccaagtttttcaacacaatgccgcacatgatttgatagagtttgcccaatagttccgcaggatgttgagtactgctatgtgtttaagatgacaaatcaaaatgaatttgtaaaaaatcaggaatcctacgaaaaccttagctgcaggttcaatgaggttggcaaggaatcaaaagcgtagaaactatcataaatgatctctatgtggcataggtcacttctaaagccccattgtgccaggaaaaggagatgccagtagaatttcgatgtggcattgccatatgtcacatttgtacaatccatttttttcattatcccaaatgggcacacttt

SEQ ID NO: 56972 - DNA, 3621 bp, Oryza sativa
aaacatgccaacaagcaaaaatgcagctaccaatgaacttaccgagatgccaaacactagattcaaatgtgcaactaatcaacccgatcaagatctacagcaaaatcttcaaaaaaaaagctactgtaaaagcctattctcactaatccccccatattgtttctcatagaagcacaaacccacatctagaaccctagcaaaccacctccatcagctctccgaatcccgcaaccaccaacaccaccatatgcccccattccgcgctgcaagcatccactgtggacaccaactagcagagaatcacgacattacagctggttcatcctaagcatcagcagcagcagcaacaacaacaacaacaaccgccaaatcgagaccccaactcactgcgcgaggtgggagggggagaggacgttggaggggcggaggcaggagcagatccaggcgaggaggggccgcgcctcctcgtactggaacggccactcgagcgcgtccgcgtccagcgggtcctccccgtcgaaccccagctccgtcagcgccgcgcacagcgccgcgccgctcatctcctcccgattccaaacccagcagcagctcgctcgctcgcctgcctctcgcccggcaacctccgccgcccgcgtctcccggcggccgcagccgcagccgcggcggcgcgtgggtgggtgggtgggtggggtggtggttgggggcggcgcggccggcggcgaagcggaggcgagtggtggtgtgctttttcgcgtcgcgttcgttcgaaacaaagagaatttcggggatccggcgtgaaattggaaaagaaaaaaagcggtgtggtcgagtagtctgcgtgggcgggaatgagggcccaatggttggattttgcggcccatgtataagggtatggaggcccaataaagcgaatgcgagtagatcactcgtttggccctatgctccgtttttttttactagtttacatgtccgtcaggttaatataactagatgaatttcccgccatgttgctgcggaaaattaagttatattattatatgtacaaataagatgtaatatgattatcaaaactaaaacaaattgatagtacaattttgagactaaaaataattgagattgcatggttttatgacagaataaagaagagacaatttgaatcatatatctatcatccaaaggctaaaaataattagggtgatgtggattaatgagagaagagagaaatttcattaactacatttagtgggaatgaactatataagtatataggattagtgatagacaggaaatccgtatattgatgggagaagtccatgtgataaggatggacagtgattacttttaggtatacggacgtgctgcgcacgttgagacttgagaggaggggatgaaaagaggacgaatttttaagatagtagagataccatgacattgtgtagcaatggaattataattggttcagttttttaatatatattttttatttttgcatgaaaataatattttctttggtttagtatttttagggagttgttttcttacacgaggaaactacgatggtggggggaggactactccaatataaaatagcagaaaaaaaatatttttgagttgttatttactttttttttcaagtagtactacttgcatattcatccgccttcctctcctcccaccacccagaaaatcggtcgcatatcaatcctcctcctatccgcgaggagctgaatttcaattcatacttttgatattgccgggccggtcaagataggccaacctgatttacttaagactgaggaatataaacaaatatataaagttttgacttcaacaataaactgtcgaagtaaatagaagttgtcacaagagcaacctcccaaaagaaaacagattacactaagggattgctctcctatatttctaaaaaccacaacttcctttcaaatcgccacttcctctttaattgaaccaaacaggaaacctgccgagcgctgctgattctaaaatacacacgcgtatttctttccttccaaaccatccaacaaacaagcagtataaggctgtcaatggcgtccttgtagctgttctgaaaattttgccacattgctaaccaccattctcctaggtctaagcatgactcagatggcagcaggaagccaaccccaatctagctcttgatcattctccacatcctggtcatgtagatgcaagacacaaataggtgctcacaatcttcatcacccacccagcaaagttggcaaacatgttagtgcgactaaccacgcttacttagattatccgccgtgaggcagcgtcctttttcggccaaccacataaataatttcacctttgatggcgcttttgtttgccaaatcagagtaccacatcgtgccaccatgtattcatactcttaatatatcctcattcctaagttatagaacgcgttcaggtacaatccattctaattattatatggatctattgtattgtattgtaagcgtatgagtatgttactaattttaaaactaattaactcgtgcatcctcttctcacaatagagatttttgaacgccaaactgcagcaatatggagttgccaaagttcaaatattacaggctcaaatgtggaaatatgtccttgctctatcaatacaaaaaaagacaaagcttttgcctttgctagtttgtttttaaaaaaaaaaacattgtggaaaacatgcgaaacgaatgtgatttcaactacaacccagcgtccatgctggtttttttttttttttttttttttttttttttttttttttttttgcggggagcgtccatgctgttgattggattgaatttcagcaacatactgttagaagctggaatttcgtgagagagccgtgtactcctacgcttgctataatctgttttttcttctatacgaaacagcactacgatgcagagagcttaccagatcgaatcccttgttaacacagatacaggttgcttccaagtctactgtaccgataaaacctaacttaatctttaagaacgaattaccagtccggactacggacagataatcagggcaccaaagaaagtcgcattcttcttggacactaattataaatattaaacatggagtattaataaaacccatccatagtcttggactaattctcgagacgaatctattgagcctaattaatccatgattagcctatgtgatgctacagtaaacagtctctaattatggattaattaggcttaaaaaatttgtctcgcaaattagctttcatttatgtaattagttttgtaagtagtcaatatttaatactttaaattagtgtctaaatacatggtctaaagttaagttcctggatccaaacaccaccttctgattagctcagtacggtcactctctgttgcagctttgcttcgagggtggacctgcaggaataccgctaaaaaaaaagctactccctccgttataaaatacaacaatttttagccctcggtatttatcccaaaatataacaactttttcaccaacattatcttcccaaccaatcataatcctccaccattcacttttctcacctacctccattgctcatcaaatcgcaaaccttcacca

SEQ ID NO: 56973 - DNA, 7910 bp, Oryza sativa
gagtcccccacagcacccacgctggatccacccctggttgccatcataataactagtaagagtagcaaaactatgctatgcggttgcagctctgtggctgcgttcggcagaaaaaagagagagagtaactattgtcgacgtttgatggcgcgattccggtatttgcaaagtatggggatcgttggtactagggtatatgcgagactgaggtaaaagagatggagacgaggatttttatacaggttcgggcccttgaattgtcaggtaataaccctacatcctgttggccaaagccggtattgctcttattcaccataatcacaccaatacaatatttggggtagcctatctaactgttgtcgacatggcggtctgaaggtttgactcgtagtcgacaacagggcagtcttcctcctcgagttcgtgtccggcgagatcagagacaacgctagatccctacgaccagcctctgtaggtaccggatagggtcgatccaggcgtatctctgatgtcgatatccgatggcttgtcttggcgtttgttggcttgtattggcttgtggctttgtggcgtctatgttgtctgtgtcccctctcctcctagggggccttgtatttatacccataggtgtcctcttgtccaagtagaattagggaaactaatatggatacattccgagtagtccttgtcgtttccatgtagaactctagtcatccttccttatgcgaaacttctcctatatccgaaggttgtatccgtataagacatggtatgtggtgggtcctgtcgagatttagtcaactactattaggtatgtggtatccataaccctgacagtagcccccgacttcgatgcaaatgaacgaattcatattctcaaccgcgcgcagaccttggagtaactgttatcgtgctcacgtgaccgttctcggtgagttcagagataacgttagaattcctttatcagcctcgtgcgggcacctaaagggtttgtctgagtcaatctccgacgtcaaccaagaaagtacatagcatacgactaagtctcccgtcttgctgtaatcgagaatttggattgaagtcaagaaattttatctcgacgggtacaccatttcttcattttgtattccttgtcgagatccaccaaccgttcttgagcgatcgagaaggtgtagaatctgcgacgaagccttgtcaacatttgtcatactcgtcttagtcgatcttggtgtagaaccatagagacatggagccttcgtcaatgtcgaatagaattttcctgaaatcaatactcaggaaagaatattagatagaaatagcccccgagcgaatgctcaaagggtgaccaatgttataatatgtatggaaaactagaaatgagttaaatttacagaccaatgttttgtatatgagcgtcttctctcttaccgacttcgataagtcagtttgttgagtcatacactctccctaacccccagccttgtcttttttatacacgtgttacccaaaaatttatagaaaagctactcaaaaaatcatcttcatcatttttaaagtttgaaatagttaatactgaattaatcgtgcgctaataagtaatgactcatctagttttgcgtatcttgttatttttcgtcatctcaaacacgcctaggggcttattcggttcataagattttcaaattataggaatagaaaaaaaaaacagaatgacactactctaatccatatgaatttttctaagagatctcacttcatgctaagaatcctaccattattcttgtgaatttggaaggatctatgaatgatgcatatagaaaaaattgtaaggtttcaattcatacaataatgattatttggatattatttaaatcgaatgagcctccaagggagtaaattggaattgacgtatttggttcgatgctagcgtggtgcacgtgagatgaataggtagatattatcaatttttttttgttttggtggtatcgagtaaagttgaattgatgtacttggttcgatgctaacgtggtgaatgtgaaatggataggtaaatatcatccaaaaaaaaaaatcttggagggtagagtttctaaaggggtgctctaaagtaatttttctggttaggtagaaattcaattggcacggatttttttccttaaagaaatgtccttttcaattcttccaccactaaatctatgggtacactctcaacaaaatttagtgatattagtgatttaaatcctatctgagaaatttcttagtaattgcaaatctatactaatacagaaaaaaatcttagtaattacaaatctatactaatacagaaggtagcattagtaccaccaccactactcatgtacctagcggtaaccccaattacctaccgggacaaatactcaatccatcccaaaatatatattgcctataatacaaacttatagctagtaatacaaacttaaaaatatatattgcctataatacaaacttatagctagtaattactctagtactccctccgtcccataatataagagattttgagtttttacttatagtgtttgaccactcgtcttattaaaaaaaattatgcaaatataaaaaacgaaaagttatgcttaaagtactttggataataaagtaagtaaaaaaaataaataataattctaaaattttttgaataagacgagtggttaaacagtgtaagcaaaaactcaaaatcccttatattatgagacggagggagtattaaactgcttcaataaattaaaaaatgaagtagagtttagaatatgagaaacttttttttatatttttatcatcctcttagaatctttagttctcgacgtagtattaatttcgtccatttaaacatgtgttgagcgtttgtgtatttagtggtctgtgtgagtattttctatgaaagaaaaagatccataaagatatgaattcacataatatccctgttgtcttcgcttttctttttctagatttttgcgacggatatttgtgtcattttcgtgaaaatacgattctcaagaacatttcttccagtggtttgtttagaccacttgatattacgttaaatcaagtaaacaatctgtcgtgtaaaaaaaataataaaaaactgtttcaagccgggccaatatctgctcaaacctgaattcacattatatctgaatatctgctaaaatctgaattcattttatctatggctgtcagtttgtttgacgtgtcccaccttcgatcctactcactcagtccttaaaaaaataaatccattcttagcatcccaaggcaaaattagtgaaaagtaagaatgacaaaaatatcctcaatcattaaaaaaagtagtaagagtgatagataggtactccctccgtttcaggttgtaagactttctagctttgcccatattcatatagatgttaatgaatttatgtacacatatatggctagattcattactatatatatgaatatggataatgttataaaatcttataatatgaaacggatgaagtaaaatgtattgaagtgataaaacatcttagggtgtgtttggttcacggacatgcatggatgggatatggccatccatattttgttggatatggcaatccaattttttgtttgatttgtatggataaggcaatccaatttcttgtttggttgcagggatatagcatggatggaaaaagccataagttagtgggacccatttgtcatatatatttttttatcaaaatataatcatccgagatcttgtttttaatatttaattataacaaatataatggtgtaatcaaatcataaattagatagacggtttaggagaaaaaaatcatttggagcttgcttaacagaaaatcaaactaaccacacctaatcagaataagacacatcacccagaccaaaactgaatggcttcatccagccaaatcggccggatgcactcatccagcatatcgagagaatattccctattccgggccgccccatccaccttgccctccaaccaaacaccacagaaaatccggcggccatctcccatccagactcatccacccaaccaaacacacccttattttatatgctaagggtagataggatgatagaggttgtattttttttggataaaatttaaattttagaagttaagtttttttttttacaaagcgagtagaattgaaaaatgaaaaaaagaattgccaagtcgcacgtccccatcgccgatgatgccccaagattcctccttttcttcccgcgaaaaaaaaattcctcttttgcttccgccggcgagcgaccaaaaacacacacacagccgtaccacccacccaccaatcatttcgccatcgcaggtgaggtgagcccaccactccagtactccacgagagaccacgaggggaataacttattaagtaggcaaaatttggtataggacacccgaaaatcgtgtaattggcggtgagacatcgtaaaatcttggttttgccaacggacactacgaaatttgtgaaattggctgtgaaacaccggaggcaatattttatagtttccgagacaaagaggtcaaataattttttaaaagatcaatctacccctgcgcccagctgtccatctccctccccaacccgatttcccagtctcaaaccctaaccctaggcgatggtggggctggcgacggtggcggtgccagcgacggtgttgaggacggcgacgacggcggccactggagctgtgatgatgacgcagtaaatcgatccttgtggcaaacccgacgagtcctggcggcaagtgcgcggcgcggcggtttcaagccgatagcggtggacggcggagcttagtttctaaatggaggacacgttctctgcacagctgtcagttaattaactaattaagttgtcctttggtgacaaatatttcctggtgccatagaccaattagcttctgagtggattataaaaggagttgcatcatcgccgtgcaggattgaggtggaagaagcagccaaaaacagtaatggcgcaggcggagaagacgagcgagagattttctttgtatgcggaatctcctgctagcttgatgtcaggaacgcgccaggaacgggcctattcgcgtctgtgcgcggcgcgacgcggcgcgcacacgccatgccggcatgccgtggcataccagttgcgcaggggtggattggtcttttagaaaattatctgacctcttttatctcggaaattataaaatattgcctccggtgtctcacagccaatttcacaacattcataatgtccgtgggcaaagccaatattttgcagtgtctcacagccaattacacgattttcgggtgtcctgtagcaattttgcctattaagtactgtattaatttttaaaaatatgctacttaaaattttatttttaaaatctagattcgtagttaggattgtattttttatagaatgaaagggacactttctttgatctagtattagaatatatctcataaaaccaaactctattatattgtctccgtcataaaataagtttatttttcactcatcctactcatccatacttgatcaaattccgatacaattatttccaactttcacagactttgatatgatataactttaaaagcaaacttattttgggacgaactaaaaatgagcttatcatgggatggagcgagtagtttaaaaatatttatttttaaaatttaaaattaaaaaaatactatatccgttttatattataaaactttctagcattgcccacattcttttatatatatatatatatatatatatatatagatttattgacatctatatgaatatagacattgataaaagtcttataacctgaaacggtgtaagtagtaatcaaataaaatttcgaggggaatagtagctcattataacaagctactactactactactggtacccccattggtagcacgcaagccactttctccgagatcgccgcgatgacgacgacgacgacgacgagcgccatcggctccctcctcgtgctcctgcttgtggtggtggtgggaggggtgtgctccgcctccgtgggcggcggcggcggcggaggggaggcgtggcgggcggagcaggagcgggaccgggtggcgcgggtgcccgggcaggacttcgacgtcgggttcgcgcagtacgccgggtacgtcgccgtcagcgaggagcgcggcgcctcgctcttctactggttcttcgaggccgccgacgacccggcgtccaagcccctcgtgctctggctcaacggaggtgagcgcccgccgccgccaccgccccgcctctccgatttggtctcttgttgacttgtactgctgctgctgctgctgctgttttctcatccgagtccgagacgcacgacgaatagctgttgcgttcgtggttgggggaaagtcgctaccttccgttgattccttatctgatgagcagctttcttctgcaggattcggatgcacaatttggggttttggggggtggggattatgctaagactagtacatggagattagtcgatttgatatctcgagggttttagttattactgatgtggtagaaatgcacaagtaactgtaattcgttcgaggggggaagtatccgcagacggaggaggattgagatcctcagacatagtggctgacatgtgggcccgagagtgatgggtccacatgtcagtcacggtgaacagtaacgtcagtggatcttcttccgatgaggaggggctgttgtctctacacaatttccggatcaaactcattttcatttcttactaaaaaaacttatttttattttggagatacgaaagggcaaatattttttgtatggtactcgggttcttaaaattggtatagtttttcttattattgattcatatcatatttcacatttgggcaccacaattagcacttatctagaactcttatagtttaattttgtgatttttcccttttgttttcacatgtactaggctttactgaactaacctccaagcttccagcaatacctatcaaaattttccactacacagcattcatatacatcctctaaagccagcttattataattttttatagttaaaatatgagagaatttattctatgccactgagtttaccttaatttcaacgatttgccattgactttgtctccctctataatatgccactgactttatcatttttttcctacaacatgccattggggtggatacttttcaataaatgcctaaaatacccttcaggtcatacaagagaagacaattatttgacccactagaagttctaaaaacatgaaagtttttgtgtacttagccttcttacaaaatattaaagtttgtgtgtatattttaagattttctttcatgttttttttctaaaaaactattttatatagcatatgaaagaggaatcacatacacgaaagatagttgcataaaaaaaattatataacatgtgaatgatgatgtacaaaaagaacattaacacaaagtattctattagcatataaaacataaattatatatttttaaagataatacatgcaaaatgaaaatcttgatatatacacacagttctatattatgcaaggagtttacgcaaatttttttatatttttgtaggtcaatcaattgtaacctcttgtaagtcttgaaaggcattttaggcagttttgaaaaatatacactccaatggtgtattgtataaaaaattgaaaaagtcagtggcatattgtagatggagtcgatggcaaatcgttgaactagagtaaactcagtggcataaaatggtttctctcttaaaatatttcaagatgaccaggccaacttttctattcttacatgaggcaagatgttgtcggtgaatctgatttttttttcttg

SEQ ID NO: 56974 - DNA, 2408 bp, Oryza sativa
ttgcagtgctacgatccttgagttctgagagcacactactgattttactgcatttaatcttccagggccaggttgctcatcaattgcatatggcgttgcggaagaagtgggaccttttcatgttaatgcagatggacagggtgtacatctgaatccctattcgtggaaccaaggtaatattcaacagaagcaaaattgcctttactaacttaaatcctttatatggtatcgtcttctcttatttttatcattttgatacaccctactactagttgtcaggatgaacttggatacttttcttcataaaaaggaagaagcttggccctccttcgcattctctctctctctctcttaattctagtcaccctggagtgcatatgttatatcagtcttataacttattggactactagattggttgttggtatgatatacttgttaacaattcctgaaattttgcagtggcaaatatcttgttccttgattcaccagttggtgttggttattcgtactcaaacgcctctgatgatatattaaataatggggatgccaggactggtactttcactttgcttttcatgtggttgaaatgaaagttatgtcccccagatgtaacaatattatagtttgctcactgatattcttcttgtttcacagccaatgattctttgacgttcttaacaaagtggattgaacgatttcctcagtataaggggcgtgagttctacgtgacaggagagagttatgctggtcagcgactattttatgagcttctatttctatatcatccattatttcttgtatttactattaaaaaaattaagcccaactaaatcttaattggttaggccactatgttcctcaattagcacaagctataaagaggcaccatgaagccactggagacaaatcgatcaatctaaagggctatatggtatggctttggtgcttttgcttctagttctctaattttgttatgcaatttgattgcttagttcaaaagtagcaaatcatatgttttgattaaggcaccaattacatagctgccatcattttgaaattatgatggaagtgatttcctttgtgtttgtcttcccttaagatgtgtctctttttacaataattttgaacatattagctgataaaatgcaatgcacctcgtaatacatatattctcatttcgaacatgccattttcccaggaactgtattatttaatttattttctttgtatgtaatgacatgtttttgcaggcaggaaatgctctgttcgatgatttccacgatcaccttggcatatttcaattcatgtggaccaatggcttgatttctgatcaaacatacaggctactgaatgttttctgtgactacgagtcctttgtgcatacatcttcacagtgtaataagattcttgacattgctagtgacgaagctgggaatatcgattcgtatagcatcttcacacctacttgccatgcatcttttgcctcctcaaggaacaaagtcatgaaaaggttacatgtaagtattgaagctcctgcaactcaagttgagttttaatattttacatttacatgatactccctccgtttcaggttataagacgttttgactttagttaaagtcgaactgctttaaatttgatcaagtttgtagaaaaaaatagtaacatttttaacccaatacaaatttattttgaaaatatattcaattattgatttgatgaaactaatctagtattataaatattactatatttgtccataaacttagtcaaacttgaaacagtttgactttgattaaagtcaaaacgtcttataacctgaaacggagggagtattattaaaataaatttaatggtcttaatacttagccatgcatgcattgagttggttgctaagtaactctagtggaatcaagaaaatcgtaatgcttttctccagaaaaaaaaagaaaaacagtatagtgaaaagcaccatattttatctacttaaaaaagacgtccaaaagagttctgggcttgggcacaaaaactgattgtatacaagcaggtgaaactttcttgatctgaccatatgcatttgtattgcgtgcaattggtcgcacactgctcataaactcctctatgtatatgtttgtttttatctgattcacagtgatggtttgtatttatctgattcacagtgatggtttctttttatagtctgttgggaaaatgggagagcggtatgatccaggcactgaaaagcattcaactgtatacttcaatctggctaggtgcaaaaggcacttcatgttagtccgatcatcaacaaatctaaatgggaaacctgcaggtaaatcttatgttttttggaaactcggttgatattactgttgctgtggcacgcttgagtactaatgatgatt

SEQ ID NO: 56975 - DNA, 5875 bp, Oryza sativa
ctaaaaaacaccatgaatgttcaaaagcttgatagtttctggtttgttttgtgcacaatacgtctggtcctagacaactcatagttttattgtgggtatgtggtttagtggcacatatgtcctaaactcctaatggtctagtcacctaactttaagttgaaattatctggcattagagttgcagggagccaggaaatcactggcagagcccttgctcccaggagaaaaatctcacaagtcatatggctcattagctgtttcaggctacaacattctttgtgtttatcatttgtttgttactagatcaattattaatgttgtttggggaatctatcctccagttgtagcttctgaatctgtttgtgttcaatcaggttggtggctggactcaagggtacaagggactcaacttcgtgactgtgaggggcgcaggtcatgaggttcctctgcataggcccaaacaggctctaattctcatcaaatcattcttggctgggagcccaatgcccagtgttcaagatttttacagtgatgtgtaacatattttggctacaattatatattaccaagatcacaaaaggtaactcagacggggttgctagtatcacatggaactcgtaccatatattggtaacaattcttccctaaataaaatagggaacaaaatcatgaaatagttttcgtgccacgaatcgacactgtctgttgatattgatatgaacctaagacaaaagtattaatcaagggtgaacgttcacattgttgtcgtacaggatgtgtataacattgttgtgtataacaaaactattaatcaagggtgaatgttcacattgttgtcgacaggatgtgtgtacagcatacatttttatttccttttccgtaagatgtggctgaatgctaatgttatgtccagttttatttttcatcttcctttaatccgtatgaacaaatctttatgctcctgctacctgtctatacttgttcaatatagttctctatgagtacaaatgattgctatagtgttattctgtcatatgtcatctgtattcatagttacaaatcatactagttattgccatctttaaaatctgtgtccttactaatactttgcagatgaacacctctatatttttgcagccatttccagaaaacctgtaggagatagtccatcacacaaggtttgcataccttatccttctatatgtgcttgttcatgtcatttttttttcaggttttagtgttaccacttaatgaaacatgcatcatcctccactaaaaaagaaagccaagccacattcttgcccttttatctttcaggaagcctccttttttgttcttttacttgtcgtctgctattagttgcgccttttggaaaggctttttcgattggtgatgtctttccaaccaagattttcactttgaaggatggagttattgtagcacgaagcattagttttgtgcactatgtttgatatccaccctgatgaacctatgttaagccatgaaattttattttagcttgatcagcagtatactttagaatggctaggttgtacatttgatacttttcccttttcatgtctgatagtgttatgataatatgaatatgtgcaagctgaaatgtactgtcaataacatgaccgaagcatgcaaccagcaacctaagtaattttgttttctatagaagttttataattaaactttgataggatcataggacacatgcttgaaccacatttagctatgtcgattgtccattaaggccataatcactatgccgtaattaacttatgcttgcctttttctgctgtcttagatatttccaatgcctgttgctatcaagtatttggcatgcatgtttgacctttagatctccatgaccaattcaccttccactcaaataacctttttacttctggcttatgtaaaaatgtaaataacatttcaagttgtccagtcaatgcccaatccttaactttcatcaagtgtgggtgcgtgggcacacctatgttgtttagtactactcgatctgttttgacatcctgtaaaactttaggctttgaaaaattcagtgtggacacacaacacatcgcctagtcaatgccctcgcatgaactttcatcggtgtggatgtggggcacaacctacagtacatactacctccgtttttaatacacgacaccccgttagctttctgacaaacgtttgaccattcgtcttattcaaaacttttatgcaaatatatataaaaaattatgcttaaagaacatttaatgataaatcaagtcacaataaaataataaacgataaatgataattacataattttttttgaatatgatgaataatcaaacgtatcttaaaaaaccaacaatgtcatacattaaaaacagagaatgtcataaaatactcttacatgttttgacattccaaaaaaacttaactttgggtgtgtttagttccttaaaaaaattagaagtttgaaaaaagttggaagtttgaaaaaaatgttgtgtataggaaagtttttttttatgtgatggaaagttagaaatagggaaaaactaaacacggcctttgtgcggattttatttaatatagacacaaccatattacacaagggtgttagttgggcaagtagagttctgtttggcttaactccaacattgacaactactcgattggcgagacggttgacacgtgtgccgaaacctcttctcacacgtgacgtgacacagctagctttgtcaccctttgccgatttgtcgcaagtagcctttctttggagagatcacgtcacaccacttactaccatcacagctgctgcttctcccactgtatgtgacctgtaactctttcggcttctatgatatgatattgttaagtaatcaatcaagcaatcaagcaccttctccgcttgtccctctcgttactcgcatgtcactatcaccgagcacaagaacatcaatcgacaagcctccccaaccccaccatcacacccgttgcgatccttcgcaacgggtcgccacatcacaccgcacacgcgcacacacgcagcaatacagtaggagaggtggggattctccgtgtacgaacagagtacaacttgggtagcgtttaggaattgttgttttataattgttgggtcactaattaaacgcatgcgtgttatataggggcttaaatctccctggcctgctgcctaaacgatgtgatcacgaggactccactggtcaatgatcacgcgtgcgtgcagagttttacttagtagaacagcgtgtgcctttggtgatatatatatatccttaggtcgacatctggtttgcgaaatactgtatgatgtttccgattgcaaaagtagaaatgatatctcactaattagagagagatcaggacactatccttatctctctagatgctcctttttcttacatgccatctaaatagttatgtcttttaaaaaaagatagattaatatatattgtatcatttcaccaatgcaaattcaaatttaacttctataagtttaaaaaacaaatatgaccaccactatagtttaatttgttaagtcgttctttttgttgcaactcgaagagaagtcaagtagtgatgtttgaatgttagatgacgctacagatgctagaaaatgggggcaatgtgtggtgtctcatttgagaagatgcttttactttgttgaatagtgtgtgcttactgttaggtcgattgctggtttgtgaaactactgtacgatgtttcacattgcaaaggtaaaaataaatatatctagggggattaaccattggtctcgtagttagatagtgtcagagaataagggtgacggtggtggtggctgatttcatagaaggtgctgttgaagtgagatggcatagaggttgtgcattggtggtggtggttgtttttttttttttttgggcgggggaggaggggatataaggcccgtttagttggcaaaaaaaaattgttttggggtgtcatatcgaatatacggacacacatttgaagtattaaacgttgtctaataacaaaataaattatagattctgtctgaaaactacgagatgaatttattaggcctaattaatctgttattagcaaatgtttattgtagcaccacattgtcaaatcatgacgcaattagacttgaaatatttgtctcgcaatttacatgcaatctgtgtaattggttttttttgtctacatttaatactccattccatctatgtgtccaaacatttgatgtgatagggtggaaatttttgttttgagaactacacagagcctgaataggagaatgtaatccgacaactacatggatctcaaaataattacaatcatctcaagataactaagagttaacccaaaaaagaataattagcacataaaaaatcttttatttgagaaatcatgtcagtccaaaggtaggaacacatgtaccaaagaaattaacaataacagtttgatataaataagttcacggaattcctatatttcttttaacagattgtcttaagaaaatctgtcagattttggatcctgattggatctaagatttgtgcatgaggtggaaaaaaaaaagcacacatgactacgggagtcaaatcctattccctagaccgaggtcccgtcacgctaccaccgtaaggcatattttttattagttacacaccatttatatgcaagtaatattgtaacttacaatacattacacaataattatacatttgctgtatttgacatattttaaggggattttctgtcaaatgttatatagacagttccgtacgtttacatgtttttcatttccctcaaacaagcaacataaaaaaaaaaaactccagcgaagtaagctcaatacaatttggaccataattccatgataaacaaaactagcccaggtttgacacctaaatggcagctgcatatgagatcaatcaccaacccatgtacatgtacacatgtccaacactacaaccccttatccagattgcaaagtcaaacatttggcgccaaattgaaaatccctttctacagcagttaggcctcccgcctttttttcttgcttcctcctctccagcttctacctcccctctccttcttcttcctctataaaaaccatggcattgtagcacacgttgctatcaaatgatcacctcacccacctccacgccaccgccctttcggcctcaatggccaacttgctcctcatcccaatcatcatctgctacctcgtgccgatcgctgtcgccgtcgacgcaccaccaccagtaatggcggccgccgctgtcgccgacgactggtctgcgctgctcgctttcttgtccaatgtgtcggccgattccggtggtgtcgctctcgccgactggggacgctcgccggagttctgcaactggacgggcgtggtgtgcggcggcggcgagcggcggcgggtcacgcagctggtgctcgccgggcgtgggctccgcggcgtggtgtcgccggcgctggggcggctggagttcgtcacggttcttgatctctcgaacaatggtttctccggcgagataccggcggagctcgcgtcgctgtcgaggctgacgcagctgagcctgacgggcaaccgcctcgagggcgccatccccgccggcatcgggctgctccggcggctctacttcctcgacctcagcggcaaccgcctctccggcggcatcccggcgacgctgttctgcaactgcaccgcgctgcagtacgtcgacctcgccaacaactccctcgccggcgacatcccgtactccggcgagtgccgcctccccagcctccgctacctcctcctctggtcgaacgacctctccggcctgatcccgccggcgctgtcgaa

SEQ ID NO: 56976 - DNA, 5306 bp, Oryza sativa
ttgccgcggctccagtatctctacctctcgtacaacaacctgtccagccatggcggcaacaccgacctcgcccccttcttccgctccttgacgaattgcacgcgcttgcaggagctcgagctcgccggcaacgacctcggcggcgagctcccggcgttcgtcggcgagctctcgcgcgagttccggcaaatccacctcgaggacaacgccatcacgggcgcgatcccgcccagcatcgccggcctcgtcaacctcacctacctcaacctctccaataacatgctcaatggctcgatcccgccggagatgtcgcggctgcggcggctcgagcggctttacctctccaacaacctcctcgccggcgagatcccgcgatccatcggcgagatgccgcacctcggcctcgtcgacctctccggcaaccggctcgccggcaccatcccggacacgttctccaacctgacgcagctgaggcggctaatgctgcaccacaaccacctctccggcgatgttccagcgagcctcggcgactgcctgaaccttgagatcttggacctctcctacaatggcttgcaggggcggatccctccgcgcgtcgccgccatgagcggcctcaagctgtacctgaacctgtcgaacaaccacctcgaggggcctctccccctcgagctcggcaagatggacatggtcctggcgctcgacctgtcggagaacgcgctcgccggcgcggtcccggcgcagctcggcggttgcgtcgcgctcgagtacctcaacctgtcgggcaacgcgctgcgcggcgcgctcccggcgcccgtcgcggcgctcccgttcctgcaggtgctcgacgtgtcgcgcaaccggctctccggcgagctgcctgtgtcctccctgcaggcgtcgacgtcgctacgggacgcgaacttctcctgcaacaacttctccggcgcggtgccgcgcggcgccggcgtgctcgcgaacctctcggcggcggcgttccgaggcaaccccggcctatgcgggtacgtccccggcattgccgcgtgcggggcggcgacggcgagacgcacgcgccaccgccgcgcggtgctccccgccgtcgtcggcatcgtcgccgccgtgtgcgccatgctgtgcgcggtggtgtgccggtcgatggcggcggcgagagcgaagcggcagtcggtccggctcgtcgacgtcgaggactaccaggcggcggcggagagggagcacccgaggatatcgtaccgggagctcgccgaggccaccggcggcttcgtccagtcgagcctgatcggcgccgggcggttcgggcgcgtctacgaggggacgctccgcggcggcgcgcgcgtcgccgtgaaggtgctcgacccgaagggcggcggcgaggtctccggcagcttcaagcgggagtgcgaggtgctccggcgaacccggcacaagaacctcgtcagggtgatcaccacctgcagcacggccaccttccacgcgctcgtcctcccgctcatgccgcacggcagcctcgagggccacctctacccgccggagcgcggcgccggcggcggcgccggcggcggcgacgggctggacttcgggcggctgatgagcgtcgtgagcgacgtcgcggaggggctcgcgtacctgcaccactacgcgccggtgagggtggtgcactgcgacctcaagcccagcaacgtcctcctcgacgacgacatgcgcgccgtgatctccgacttcggcatcgccaagctcatctccggcgccgccgccgccgtcggagacggcggcgccagcagcacgagcgacgagtccgcaccgtgcaactccatcaccggactcttgcaaggctcggtcggatacatcgcgcctggtacgtgcacgtcgcatgcatccatgcatccattcacacaacttttttgcaattaacttgcacttatctcaccatcttattactaatcggaattgtgcatgtattctgagaaaaaaaaaactttcgaacgttactatagtgtatactatagctgtagtaattataatatgattatactatagttatattataactatattataactataatatagttatattatagtgtaattgtactataactatattgtaatatctatataagttacatataaaattatatatacaaattatattatagttgtagtgaaattatatcacagatacatatatatttagatttgaaagtttttcagttttttaagatagtcccttactaattacgtgtttgattttgtgattagaatatggattaggagggcatccatctcgacagggtgacgtgtacagcttcggcgtgatgatactcgagctgatcaccgggaagaggccgaccgacgtcatcttccacgagggcctcacgctgcacgactgggtcaggcgacactacccgcacgacgtcgccgccgtcgtcgcgcacgcgccgtggcgccgggaggcgccgtcgccgatgtcgacggcggcgtcgccggcggcggccgacgtggccgccgtcgagctcatcgagctcgggctcgtgtgcacgcagcactcgccggcgctgcggccgagcatggtggacgtctgccacgagatcacgttgctcaacgaggctatcaggaggcacgccgccgccgccgccgccatcgccgccgccaccgacgaggacgaggacgacgacgacggcaggtcgttgtcgacgaccaaggacgactcgctgttctccaattaattaacacctaattagccacgagaaacttctcgtcacaatcctcatttcgccattgttaatattattgagacctttgagaaggatcggagaaatcactagtgcttccttctcgtagcgcatttgagttagctctcatgatctctaatcatctctgccttggtagggaatgtgattagtatattggtttattggatggttaggggatcgcctactaactagtgctaaattctttctgttattaattcatcaatggaagctgcactcgattaatctgttcatgttgcaaacatgtcggactccattagcaaccggccatgcatatacttgaataagaacaacgtacagctgaaggaggaagagaaatggatcttgatcagttaggtcattattcaggtgctaatgatcaaacataaacaaatccaaatgctgcaaaagtcgtcactgttcgatgcatctgatgatatcatgctgtcttccaattcaccacccagcaatgtagtttaattttgttcttgatttgacaagaacttccatgctactgccagatttttttaggcttttcaattagcacgcttgctggcttttagtcaggttcaggattagcagaaagcgactgacacacaatatactggttttactcatgaattaaagattgtttttgagagatatgaattgaagattgttacctgaagcattttaggttttaaattgctagtgtttgtggggttttgacctgaatatataaaacctagtggcgactttgcaaagtgttctgcatccatgagcttttggacttttatgttctagtagtcagacttttatatcaggatattgtaagatgtgtaagaaagggtaaggcaatgtagttcaaagtgtgatcttgtgtttatatgttcatacttactctgactagtgaccttacatcatttcattaacttaaactgaaagaacaaagtactgaagatatgtagtcaatggcaggaaatacaagatgatctctgcaaggtaaagagccttaaagaactgaacaatattgtgggcatgcacacatgacagatcatgcataataataagatagtataaattacaattgttgttgcagtcttgcaggcagatcagcaataagcaaagattgatgtgatggtaactaagatctagctagataaaggtgtgagtgacttctcattcatgttgcaattgcgtaccaaactggcagtatgacgcattttggttgatttgtttgctcctctttatcatacaaaagatgctgttccactggcttttctttgcaaaagaaaactgcagacaaaaacaaaacaaaagaaaaggttacaggtcttccatttcagagtgtgatccatctaatgatctgaatcagatgatggtagctttagtgctttccttgcatgtcttatcatgttaccttccaatttggaattacctatatatagttcttcaaggtttaatccttactcttaattattcacaacaacaaaaccttcctagaagtaccaaatattatcactaaagtagtactagctaggacacatgcactcgatgtcgggtgtgttcggaacacctggtttccaacacgaagtacccacacagaaaacggagcggtctattagcgcgtgattaattaagtattagctatttttttaaaatggattaatttgattttttaagaaactttcgtataaaaactttttaaaaaaaacacaccgtttagcagtttgaaaagcgttcacgcggaaaacgagagaaataggttggtaagaaggggcgccgaacacataaactagttttctacaagagatgttttataatggtctttgctggtagtataattaatctaaattatttatgctttctaatccaatgatcatatttttatactattatcttaactactaatagtagaataatttttgaactggtagtaaagctcatacatcaatagttgagttcacttctactagtgataattttgacattagaatattattagttctttaagatttaatgtctactcttaattattcacaacaacaaaagctttagaaccaccaaatttatcactaaagaagtgaatacataggatacatcactcaagagcttaaactagtttcccatgaatactacccaataattagctttcctgttcagtttaagatcgacaaactggtccgaagaatattgacgaagataatccactaaattaaaactaatatcctaaatcgaaatgctaatttaatcatatactaactacgttaaaataatcaactatgtttatgtttcgtaccagttatattagctttgtctatgagaagcattaatggactgtgatttattactataacttcttaaaacgatagtaatcagttttttttaacgaatcaacgagcgccaatttcattgaatagagaaggagaactttacaaagcgaaaggaaaaaagaaaggagctaggacctttggtccgagctaactaaaagaaagccagctattaagacttatcgctcctgctaagacccaagttttggcctcttccttaatcttggctaaa

SEQ ID NO: 56977 - DNA, 27066 bp, Oryza sativa
ttggaggctacgtatacaagcggcgcaacatccttcaatctcctcccctgcgtccaggccgattctcagaagcttattttggcaccaatagtaatcagttaggcaggagtatcaactaaacttaaaattcagttgttttgttgacattaccaagcatctacacaatgtaggctacacaagcatattcagagagcaggtttgacctacctctgtaaaatgtgtatttcttgattgcaacaacctgtaatcctaactaaaattgctgcctttgtggaggtagaatctgtgccacttcactagaaaaatgtgccactttgaactctgtttcttaattggaaaaacaatgttaaagtaaaaataagaatttcttttaccaacaaagtaaaattaagatttaaccctagatccccaaagacctatagttaattaattaatagacctattgctttgtgagtaatgccagccggtccacaccataaacacgaacacgcatctcagccgaaagccagttaattaatcaacatatagcggcatacagctaagtactagtaattagtctggcctcagttttggggatttagcaactgcagagctattcaaagaatctctaactcgctaaacacttcaaactcattattattttttgaaagttaatagtatataaaatatagaaattagtagacaataaaaaaaaaccatgggtttttcatattctcatccgctgcttctcataatctcttgctttaaaacattactctaccttagattttactactagataactaagtagtactaatatatttcgatcaaatcgcgattaacataggactgtttcgctgtgtacgcgtgcaccgtacctttttgtacgcacgcatacatgatcacacgcagctagcactttaatcaccctgtctaacccactgtcaattatttatttaaccatttccatccctaatccattccgacggtcaaaccaaacatgtatatccacaccaatgggccccaactttcagtgagacaccggagacgctgagcccattcacgttgcgccacgtgtcctattcgcacgatgtcaaatacttggcgccaaggtgtaacggctgcggctagagcttatagcccaaacggtagttaggcagccatgtctcccccccttcctttccctcctttaaaatccccagcggtgtagcaaacgtagctatcaagagcatttgcattttgcacccaatgtcttaagaggttagaaccacatgctctcttcctcctccctcccatggcgcccgtgcccatctccgtcttcgtcttcgtcttcatcttcattttcttcctcctcgacggctcgataccgactctcgggtcaaatgaccattccgcgcttatgtccttcaagtctggtgtgtctaatgatcctaatggagcactcgccaactggggatccctcaatgtgtgcaattggaccggtgtctcttgcgacgcgtcgagacggcgtgtcgtgaagctgatgctacgagaccagaagctctccggtgaggtctctcccgcgctcggcaatctatcccaccttaatatactcaatctctcggggaacctcttcgccgggagagttccgccggagcttgggaatctcttccgactcaccttgcttgacatttcgtcgaacacctttgtcgggagagtcccggctgagcttgggaacctctctagcctaaatacacttgatctctcccgaaacctcttcaccggcgaagtgccgccggagctcggcgacctctctaagcttcagcagctcagccttggtaacaatctcctggagggtaaaattccggtggagctcacgcgcatgtcgaacctgagctacctcaacctcggcgagaacaacctctccggccgcatcccgccggccatcttctgcaacttctcctccttgcagtacattgatctctcctccaactcgctcgacggcgagatccccatagattgcccgctccccaacctgatgttcctcgtcttgtgggcgaacaacctcgtcggcgagatccctcgctcgctgtcgaactcgacgaatctcaaatggcttctgctggagtcgaattacctctccggcgagctccccgccgacatgttcggcggcatgaggaagttagagctcttgtacctatcgttcaactacctcaggagcccagagaacaacaccaaccttgagcctttctttgcctcgctgaccaactgcaccagcctcaaggagctcggcgtcgccggcaacgagctcgccggcgtgatcccgccgatcgccggccgcctcggcccgggcctcacgcagctccacctcgagtacaacagcatcttcggcgcgatccctgcgaacctctccaacctcaccaacctcacggcgctcaacctgtcgcacaacctcatcaatggctccatcccgccggcggccgtcgccggcatgcggcggctagagcggctgtacctctccgacaacatgctctccggcgagatcccgccgtcgctcggggaggtcccgcggctcgggctcgtcgacctctcgcgcaaccggctcgccggcggcatcccggccgccgcgctctccaacctcacccagctccggtggctcgtcctgcatcacaaccacctcgccggagtcatccctcccggcatcgcgcaatgcgtgaacctccagaatcttgatctctctcacaacatgttgagaggcaagatccctgatgatttgtcggagctgagtgggctgctttatttgaatctttcgagtaatttgttggaagggatgatcccggcgaccatcggcaggatggcgatgctgcaggtgctcaacctgtcgtcgaaccggctctccggcgacatcccgacgcagatcggcggctgcgtcgcgctcgagtacgtcaacgtctccggcaacgcgctggagggcggcctccccgacgccgtcgccgcgctgccgttcttgcaggttcttgacgtgtcctacaatggcctctcgggcgctctgcctccgtcgttgggggcggcggcgtcgctgcggcgggtgaatttctcctacaatgggttctccggcgaggtgccgggtgatggcgccttcgcgagcttccccgacgacgcgttcctcggcgacgatgggctgtgcggggtgaggcctggcatggctcggtgcggcggccgccgcggcgagaagcgccgcgtgctccatgaccggcgcgtgttgctgccgattgttgtcacggtggttggcttcacgctggcgattctcggcgtcgtcgcgtgccgtgcggcggcgagggcggaggtggtgaggcgagacgcgcgccggtcgatgctgctcgccggcggcgcaggcgacgagccgggcgagagggaccacccgaggatctcgcaccgggagctcgccgaggcgacgggcggcttcgatcaggcgagcctgatcggcgccgggcggttcgggcgcgtctacgaggggacgctccgcgacggcacgcgcgtcgccgtgaaggtgctcgacccgaagagcggcggcgaggtgtcccggagcttcaagcgggagtgcgaggtgctccggcggacgcgccaccggaacctggtgcgcgtggtcaccacctgcagccagccggacttccacgcgctcgtgctcccgctgatgcgcaacgggagcctcgagggccgcctctacccgcgagacggccgcgccgggcgcggcctcggcctcgcccagctcgtcgccgtcgccgccgacgtcgccgaggggctcgcctacctgcaccactacgcgccggtgagggtggtgcactgcgacctcaagcccagcaacgtcctcctcgacgacgacatgaccgccgtcgtcgccgactttggcatcgccaagctggtcaagaacgccgacggcgacgtcaccaccaactccggcagcatcgccgccgcctcatctgatccttgcaactccatcaccggattgttacaaggctcagtcggctacattgcaccaggtatacttaactaatcaacttagctattataatcatcacaaaatttgtactaatcttaattatcatcttctaatcttgaactaattacgtgtttgattttgtgattagaatatggattaggagggcatccatctacacagggtgacgtgtacagcttcggcgtgatgatactcgagctgatcaccgggaagaggccaactgacgtcatcttccacgagggcctcacgctgcacgactgggtcaggcgacactacccgcacgacgtcgccgccgtggtggcgcggtcgtggctgacggacgccgccgtgggctacgacgtcgtggcggagctgatcaacgtcgggctcgcgtgcacgcagcactcgccgccggcgcggccgaccatggtggaggtgtgccacgagatggcgctcctcaaggaggacctcgccaagcacgggcacggcggcagcggcggcgacgtggtcgccgccgcgacggtgatggccgcggcggcgccgccgtcggtggcgatgacggcgagcgagcggtcgtgctccacctcggactcgtctttgagttactagcgttatggcccaaaaagattaattcgtggtgtagtgtagtgtaatacaaacttcatgcactgcacattttgatgcttaaatttaactcgtattttaggacattttgatgtgccatttagtgttagcacaatgctttttttgaaatttctctcttgattaatcgagtggaagaagatgcaacgaagtatcaatgtatacatatatatgttttttttttcaaaagccatgtatagttaaagagaatgtctgtaaaaagaagtatgaactactgggttggtgaaagtcagtgctaatttagtttgttcaaattatttttgagttctttggcctctaatggggatttcacttttcgattaaaactatagatgtctaaagaacaaatcaacactgaccgttgaccaaagggctgcgatctcgagttcagacaattactcgtgacatgttttactatatagtatttcacttgacaataacatgtctcacaatcgtgctgaaacactaacatttcaacgcgaaacgtcaccccatattgtggagtgtttcaccctgagaatttatccataggatagtcaactaatatccactagaacaatgtttgttttacacatagatacaatctcactctcacctgttatttacacaagactcaaataattataaaagaaataaaaaaatgataacatcaatgatataaatctacagataaacatgcaaggtaagttcaatttacaataagagaaaataaacaaaaataataaaattagacaacaaatagtacgtatagcgcaaatatttttttcttcatgtgtagagtgaatagtgggtgaatagtacctgtatttttgtaagtcggacatgacattaccaatatgagtttctttttttttttgaaagagaaactgtgtgcaagtacaatgtcataagcacctcaaccttgaattgaaaaaagagaagaaactacatgatatcaccaatatctacgtggaaattaggcatttccttttgacaaaccttgaatcaaactgaagcaatggtgcagaagcacactagggaaactctttttatttcctggtaggcgtccactcgtttattaaatgtcacttaaatgattaaagtttttttaaaaaattaaaaaaaaagattaatatgtaatatatcacctcataaaacaagcaattttaaatttaacttcttccagttataacgaaagtaacaattttgacatgaatacgatttacagtagccgtgtgtttatagagtggtatattacatattaatctatattataatttattttaaattattttaaccgtgtagttgatatgtaaaatacgagtggacgcccatgggataattagaatccctctccaagcacactattgtctcttggatccgagcgtatgcagtggtcgttgtcatcctcgcagcaacacttcctccaagcaccgtccttgaggcgagcgatctcctgcgccacgtcatccatggtgggcctcatcgccggcacgatccgagagcacgcgacgccgagctcaagcagctccaccacgacatgcgtctcatgtcgcggcgacgtcgccgccgagagctcgacggcggcgaccacatcgtcgtccgacgacaagcgcctcttgacccactcgtgcaggctgtgcccctcctcggcgatcacctccgtcggccgcttcccggtgatcatctccattagcagcaccccgaagctgtacacgtcgccttgcgtcgacgggttgcaccccaatccatactctgcatcaatggatcaaaaaatcttaaaactcggcttggaacgcgggaatttttcttgattcctactcccttcgcactaaaataaaccaacctcgtattggacgtgatacattataatacgatgaatctgaacacctaaaccaacctcgtaccaaatatgatacatctagtatgataaatttagacatcagcgtgagattgacttattttagaatggatggagcacatgaattgggttgtttcatatgaaatgatacgacacatcctaatacgatgaatctggacagcagtacaaggttagttaattttagcatggacggagtacatgaattgtactgtttaatatgaaattatgcgtagtaagttttgatatgaattggactatttcttgtgaagatacgggattgatcgattaccgggagcgatgtagccgacggagccttggagcaatcgagtgatggagctgcgtggataaggagtggatgatgcgtcgtcgtcgtcgtcgtcaatggcgtctggatctttggcatcctcctgctgcgccaccagcttcgacacgccgaagtcggagacgatggccgtcatgtcgtcgtcgaggaggacgttgctgggcttgaggtcgcagtggacgaccccgaacggcgcgtggtggtgcaggtacgccatcccgtcggcgacgttgcctgcgatgctcagcagcagctccaggtccagccgccggtgggccttggccgccggcttgccgccgggaggcggcggcggcggcgggtggatgaggccgtcgaggctgccgttcgccatgaacgggagcacgaccgccttgaactccggcgagctgcacgccgtgatcacgcggatgaggttccggtgccggatgctccgcaacacccggcactccctctcgaagctgccggcgacgacgacatcatcgccggcgcgaagcaccttcacggcgaccaccgtgccgccgtggagaacgcccctgtagacatggccgtacccccctttcccgatcaggttcgcctccgaaaagccgccggtcgcgtcgacgagctcgcggtgtgagatcctcggatgctcgctgtttctctcatccatgacgccgccgctgcttagatgtggactgactgaggttgtcgtcaacttcttcaaccatgtcaacgccatggcagaaacaccggcaacgacagcgacggcgacggcgactatgcagaggaggcgccggtggacatgcctcctccggtcgcatcgagccattccggcgatagacccgcataggccggggttaccgacgaaggagtcatcggtgaggttcgcgaaggcgccttcaccggacacctcgccggagaacttgttgtaggagaagttggcgtaccggagcgccggcgacgcttgcagagacggtggaagaacgccggtgaggccattggaggagacatcaaggacatggaggtttggtagcttgccaatggaggttggcaagctaccctgaagcgaatttcccgacagattgatgtactccagcgcgacgcagccggcgatcgtcgccgggatcgcgccggagaggttgttcatggagagatcaagagcttcggtcatttccatgttgccaatttgcagtggcacatggccatccaagagattgttagagaggttgagatacacatggaagtttcctagcactgtaatttctgaaggaatctggcctgtcagcttattgtaagaaagatccaatatcaggctgcaattgaggccaggtggtatggttcctgacagcatgttgtggtgaagaacaaggtgatccaattgagttaggttggataatgactctggtagtgtgccttggagcttattctgagacaggttaatggtctctaaacgctggctttcgccgacggatctcggtatttcgccgacgatctgattgttcgacaggtctagtagcgcgagccgcggcggccggagtatctccggcgggatcggcccttccagcatgttgccaaacaagcacaattctgtcaggttgacaaggtttccgatggccggaggaattttaccgacgaactcgttgccactcaggaaaagcgaggagaggttggccgacgacacgttgccgatgatcgccgggatctctccgccgacgccggccgacgcgacgccgagctccagcaagccggtgcagttcaccagggaggagaagaacggcacgaggttggtgttgccatcgctgctggagaaatggttgtgcgagaggtagaggaagacgaggctcggcatgctgccgaacatctccggcggaagctcgccggagagggagttgtcctggaggagcagccaccggagatccgtgcagttggacagcgccggcgggatcacgccggagagcgcgttgccgaagaggctgagctgcctcagcgccgggaggccgcggcaccgcggccggagggggatgtcgccggtgagggagttgccgctcatgccgatgaaggtcaggccggagcagttgcagaagacggcctccgggatgccgccggcgaggccgttgccgtcgagggtgaggtaggtgacgctcgtcaggcggccgagcgcctccgggatctggccgccgaggaggttgtagtggaggctcagctccctcagccgcggcagcgcgccgagctccggcgggacgccgccggcgaggtggttcccgtcgagatacagcctctcgagcatggagaggttggcgatcgccggagagatgacgccggcgaggttggagttcgacaggagcagcccggtcacgcgcccggagcgattgtcacatctgacgcccgtccagttgcacatggcagcagccggggagccccagtcggagaggttgccatggacgccggagctgaaggagaggagcgccgcgcggtcggtggcggcggtggaagcagcgggtggagcatggccggagatagcaaccacggcgatggcggagaggatggcgaggaacctaggcattgtcaacggggttacgaggatgtgcatgcatgcatggatcaaatcaagatagtaggttatattagtgcctaattaacctgtgctactaattgctttggagtgtagaatgagtgaatgacagctctagcttagatatggggaccagctaaccttccagttctgaagagaggctatggctaatgacagatatttatagatggtatattggtatatgagcagtgtttgcaatttcggaatgaaattttggaaattttttaaatatcggtaatttcactccccacatgcaagcacatatctcgctcgaaattttcggtttttttctaaagttttgtgaatttgtttaaagtttattcaaattcgtcaaattttcaaaaaaaaaaatcggccaaaaaataccaaaatttacaaaatttcggtgatttcagttcattcggcccccaccagtaaaaacccctgtttcaaaattgcgaaattgcaaaccctgtataggagaaatttcattccggcttcggttagcccagagctgattataagctctaatagtttatcaaaataatttatagatagaattttatggatgtatccttaacgacttaatagttaatgctgaaaaaggaagtacgttaaaacaccctaaaattaactccaaattaagttttaaaatttcaattttgatagcgttttattttcaaatgatggacccctaggtacagtaagtgcaagctgaagagcaatgttggatgaatggtgagatggagggaaagctttattgggtcggtcaactgggtcctaccagccgttgaattgaagggtcaatgctttcttgccatcaaattttcactcaacgattaggctggatagtggatagtggataatggcaaatctgtgattgattaattaatgggatgatcatgtcaggtgattggacaaaattgaaccgcatgcgaatggcgatgcttttttctttttctttttcttttttgtctgtgagcaagaaaagcatcgtccaacgcattacacatttttgttggtgtactttactcccttaccaagttaccatttaaaattttaacaccatcccatggtacacaccagaatgaacaagtgtgggaacaattcaattttctatgaatttggaaatgttcccatattccaaacaatcatataaataaataaacctatacaaagaatcaaaagtgccaaatataacgatgcaatgtccaatgctgtggtgctgccagagagttctatgtaggacagtacgagtatcaatgattccatgtacagcccaaaacctgagtaccaatttactcactttgtctcgaaataaaccaaccttaaaatagaatcagatataaagtatgtccagatttgttgtcacatcctaatacgagggttaatttattttgacacagagggagtatgatagagcaaaaatgatgacatagtgatgatatatatggttggatgtagaggccaggtaaaaaaatgcccttatctaaaaaaagtgatgatatatgcgcctcaaagtagattctgacgacacccacaacaacggatacttccttcgtacctccgtaccagaaaaaaaactaacttctaatgctgcaacagaagtgctttttttaagcacggagggagtattaaggaacaaatgcattggaatgtaacttcacgaaaatatatggaacaaaaaggatgctgcaacagagacggttacaggggccagataagcttacagatttgatatcctataagtctcatgttacaactatatacgtgcacatatatataaccggtgagtaattttacacaagaaaaaaatgatatataatcaagtaaaactctaattatgaggcaaggcatatgtacagaagagcttagctgaagtgtgacctctagtacttatgccgcaaggagtttctggatgtccttctgcaagagatgtatataaagaagactgtgagcaacggggaatggcacaatgcattaaacagaataatgcggcacaagtgatttggaatattataaccaaaagagggttcagggatgtgcatctcaaccaaatgcataaacttttatatggaaagcacttgaaataattcaaaggtaattagtacatttagcaaagctatcttcatgacactaaaatatagcatgaaaattggccgaaagtaaaatagtgaatcgattcaataataagaaaaattgacttgtgactgatggactctggctttccactctgtgatgataacacaacgcaattacatgtgacaatgcacctagtactgcaaattggtatatttttataccaaagcaagcaccatgagtctaaagctccatatttgatgaaatggctacagtttagggatatatcctttaacggttagtaccatctgaagttctgaaccacattatctatttgcagcttgcattccaactgagcaactctcaactgagttctgggactatattaaagcaaatagccaatagagcccatgcaaactccataggcagcctcaggccatctgggctctggtgcaaataggtatatctaagggctccccaacactattgtaagaccgtcagatcagtgctctagtgttcatttttgttagacctggaaaggtcaataattaggtggacgccaacaacacaccaagggactgtatccattaattcttaatataataatgaggtaatgactttttagtaatgtcaactcttactaaagaggaaaaaaaattctagattgaatctttacagctggggaaaattggcatagaaatatatattacgacaatggcatggttcaaagagatttgcacaatatcttgcaaccactattagggctgcctcaccatcagtacctaggtacacaaaaaaatatgcaaaacatgcttgcttctttccaaaagtatgcatacatggtaggctcacaaaggctagtccattaatcttcttacaaatgcagtgtaacatatgttgggaatcttagtagagacagataactgaagttagtaaggttacaatacatattgatagatatgaattatttcattgatcttcaaagttgtacagaaaaaaatatatttcgagaactcaatctggcaaaccaagcgaatacaataaagcaagggtgttatgataaaggcagaaacaaaattcacctcaatctggaatggtgaagttgtaggtgggtatctctcaacaacttttccagttttgtccaccaagaacttctcaaaattccatttcacaagatcacccaaaaatcctccagcactcgacttaagaaacttataaataggggctgtgttaggcccgttgacatcaacctgccattgcacgtacaagcacagaaatgcatcatgcattcatatactattaattggcaggaaatattgagccaatcgcttcttacaatggagttaacataccttgtcaaaaataggaaattcagctttaaaccttgtacaagcaaactgcttaatctgcgggtttgacccaggttcttgtgcaccaaactgattgcaaggaaatgcaagaatctcaaatcctgcaaaatcagatgaagtattggactaaggtgatatcgcatacagtatatgaatccatgttcattccatgcctacagaagctttgaaaaaagaaaataaaagagccaagtgttgtctagtttcttatgcaatagctgaacaattcaatgcaccaaaacctaaaccagtgattatattaccttgagtcttgtacttctcataaagatgagatagttccgtgtaatttgctgttgtcagcccactggaatttaatttaaagaacagcgtgaagtttaatgccaggtaatgctgtataacttactatattagtatacagtatatcagaggagcaatgtattaagaaaaaataccactgagatgcaacattaacaattagcagcgcccttcccttgaacttgctaagcgcaacatcttttccatcaatgtcctgcacaaaacagagcaattttgttcaggcatgcatctcaacctataattctggcacaatgtgcccttgatagctggagctgtgacatgtcaatttgcagtacaaaccaacaaagcttctgactgcattaatctgatttggctaaatttcaatcacgttcaacgacacatctttcggtgatcaatctatggttacagttatgtgcacttataagcctatgactcagacaaacctcaaaaatacctagttactgaaattcagcacatcatttctacctaagtaccaacaattctgatacaggacgcccctgataggcgatagctgatttgctaatgttataatgtcataacatgagaggttggaagtgttctcaggataattgtatcgccttgatgtaattgttgagttcaatcaaagcttccattatctaaaaaaataatgtcaaaacaggagattttgtaaatacaacagcattcaccttaatccgtttccattatctaaaaaacaaaacagcattcacctgacccagccaattgcaaacacgttcaacaacagaacaaaatttaaacgataatctatcgatatatacgtgcttccaaggtgtacctacctcaacaacactaccagccacatcaaccacacacaccgcaacatccaaattctcaaaacctaacgcgcctcatgccctcacccatatcccatcgtcacatcacacgcaacgaatccaaactaaagcgcgggggcggtaccagtaccagtaccacgaggggcaaaagggatcgaaatcacgagggctcgaaatgccacaaccttgacggtgaagtcgtggacgctcttcccggtggcggcggtggcgtaggcgacccctggcgcccacctccgcgacggcgccgcgacgacgggcaccgccgcgctcccgtgcgtcgtcgccgccccccactgccgcgccgggaggaggaagcggcccgcggaggcggaggcggaggcggggcgcgtggccggcgcgaggcaggtgaagcgggccgcggccgccgccgtggtggtggtggtggacgccatgtggctcgcgctggcgtgcgccgcgtgtggctgtgtcgaggggagaggagaggaagtggaagcgaggcggcaggggtggttactggttagcgtagtggttgcggcgccggattggctcgcggcgattctggttaaggagcgggggaatttttgtggatacggccctgaggaagaacagatttctggaatagtatttgtgctgcattagatttgctccttttgtttttttttttgagaaaatgatataggagtacgagatttttggattgaatgctacgttaagatatactaaaaatccaagagatactccctaagatcattaatatttaatttttataacatgatttagttaatttttatgatcaaatatttatgaccaaaagactgaacaacagtttctcctgggttgtttgtcgatatgatggatgcatgaagctgtggaccaaagactatctgtgtttaagaggttaaccttgtgagctccataccattattcgagaaatttaacattgaggggttatttggttgaaaaccacaatatatcataatttgccacatattaagtgaggcaggttcgattatattagttatgtgtttagttcataaccacacttcacatattttttttatccattaaattagtcattagtcaatgactaaaaaaagtgtggcaaggttatctcttgctaactagttttgctaggctccagctccagctccacccctcatagagctggagctgtgacaaacatatcctaaagtgtggctttaaggggctgcttggttactaacaaaaatttgcctcaatttaccacaagtatggcaagtagaattgactaagttagtatagtgtttggttctagccacaagttagtcatgccaaatttgttggccagatcttaggtaagttagcttaaactctatgacaactctaagtacaaccccttaatttgccatccgcattcgaaattgtgcgcatagtctttccttccaaaagtttggaccatatccaaattgtaggaaccccaagggtgttacgtggaaaagaggcgggtgttgtttagctggtgctgtgggctggtggggaagcggacacgtgaaatgctgcgggacctcgcgcgcgttgcagcgttgggcgggtgttggtcattttcagtgggagagcctccgcgcatgggtagaacgtagaacaaattgtcaccaggcaattgtcaccatctttttaggtggtgtttggatccagggtctttaactttagtctctatatttagatactaatttagagtattaaatatagactacttgcaaaactaattacataaataaaagctaatttgtgagacaatttttttaagcctaattaatcaataattagtgaatatttactgtagcatcacataggctaattatggattaattaggctcaatagattcgtctcgcgaattagtccaagattatggatgagttttattaatagtctacgtttaatatttataattagagtccaaacatctgatgtgatagggacttgaaaagttttagtcccacgccttatccgcttcgttgcaacgtccagagtcttgcatttattaaggcccctggagctgtagtactactgttttctttttcccttttattttttgcccattttttgtggtggcacatggttcgtttgccgtcgctctggactgcttaatcctttggaatgtgatagtttggagggtaccccataaaccattttgtaggaggtttataagaaggtcaacatctttttttaagacgcatgcgagctttcacttaacgtgtgcttgttggtttatcagctagagacactaataattttttgaaacttagttttaaaggattttatgatttttattaacatagtctatttttcagcgttagtttctgaaaagcaaattgtttttttagtggctttgttcgtacttatccaaatggtatccattctactagggtccaaatagcagtacgagctactttttcatttttcgttttcaaaccgtttaacagtgtattttttaaaaaacaaatctattttttaaatttgtatatctaatactcccctttccactttatattataactttataagtcgtttgacttttttttccagttgacctaatttatagaaaaatatagtactccatgctatcaaaacaaacatatttcaatgttaaaatttaacagaactaatttaatattttagaagttgctaaatatttttaaatttgtttaaacttaacaatttttttttaaaaaacacttcaatatgaaactgagggatcgagggagtaacttgattaatccgtacgtctatcaactcagcccgaaacgctggatcgaacccctctacaagtccacattcatcttgaccatccatctccgatcggacggtcgatcatccatgttacactgaagtttgaacctgacgagaccacccatcgtctccctccctcaccgccgcgcgtgtcgatgcctcctccgcgccgccgcccgccctccgccgccgacgccgccgccctccgccgcccctacctccgcctcgtcgcgctctcctccacgctccgccacctcgaccagatcctcgccgtctccctcgcctccggccactacccgctcgaccccgccccggccacctccctcctcctccgctacgcctcgctccgcgcccccaccggccacctcctccgcctcttccgcggcttcccccgccccgaccggttcctccgcaacgcgctcctccgctccctcccgtcgctccgcccccgcctcctcttcccctgccccgactccttctccttcgcgttcgccgccacctcgctcgccgccttgtgctcccgtggaggcggcgccgcgtcgtcttccgcggcgcgcgcgctgcacgcgctcgctgtggctgcgggctacgcggcggacacgttcgtggcgtccgcattggccaagctgtacttcgtgctgtccagggtcgaccatgcacgcaaggtgttcgacacggtgccttcgccggataccgtcctgtggaacacgctgctggctgggctttccggttcggaggccgtggagtcattcgcgcggatggtgtgtgatgggtcggtgcggcctgacgcgaccacgctggcttccgtcctgccagccgcggcggaggtggcagatgtaacaatgggaaggtgcgtgcattcgttcgcagagaaatgcgggttggcagagcatgagcatgttcttaccgggctcatctcgctgtactccaagtgcggggatgtggaatcagcacggtgtctctttgacatgatggagaagccagatttagttgcctacaatgctttaatctctggttattctgtgaatggcatggttggttcatcagttaatctctttactgagttgatgaccctggggttgtggccaaactcgagcacactggtggcactgattccagtgcacagtccatttgggcatgatctgcttgctcaatgtttacatggatttgtcctcaagtctgggtttactgccaattctccagtgtcaacagcaattacaactttgcactgtaggttaaatgatatggagtctgcaagaaaggcctttgatacgatgccagagaagaccatggaatcatggaatgcaatgatatcagggtatgctcagaatggcttgacagagatggcagtggcactctttgagcaaatggtgaagcttaatgtgcgaccgaatccaatcacaatctcaagcactctttccgcatgtgcacagcttggagctttgtccctggggaagtggctgcacaggattatcactgaggaggacttggagcccaatgtctatgtcatgacagcgctcatcgacatgtatgcaaaatgtggaagcatttctgaagctcggagaatcttcaacactatggataacaagaatgtggtctcgtggaatgcaatgatagctggatatggccttcatggccaaggtgctgaagctttgaagctctacaaggacatgctggatgcacatcttcttccaacaagtgctaccttcctgtcagtactctatgcatgcagccatggagggttggttgaggaagggtggaaagttttccggtcaatgaccgatgattatgcgatcaatccaggtattgagcactgcacatgcatggtggacctccttggcagagctggccagctcaaggaggcttttgagctcatctctgaattccccaagagcgctgtcggacctggcgtatggggggcattgcttggcgcttgcatggttcataaggatagtgatcttgcaaaattggcctcccagaagttattcgaacttgatccagaaaacagcggctactatgttctgctctctaatctgcacacatccaagaagcaatactctgaagcagctgtggtaaggcaggaggcaaagagcaggaagctggtaaaaacaccagggtatactctaatcgagataggcaataagccacatgttttcatggccggtgaccgtgcccacccacagtctgaggccatctattcgtatttggagaagctaactgcaaagatgattgaggctggataccgaccagagacagaggcagcattgtatgatgtcgaggaggaagagaaggagcacatggtgaaagtgcatagcgaaaagttggcaattgcctttggattactcagtactgaaccggggacggaaatcaggatcataaagaatcttagggtgtgcctagactgccacaacgccaccaagttcatatccaaggtgacacagaggctgattgtggttagggatgcttcacggtttcatcatttcagagatggggtttgctcctgtggagattactggtgattcaattcagctgaatgaagtgcctctggtcccgagcatatgattgacttattctggtgatgaaagaaacgatcgtctcttactctttggaagagtatctgagccactgggatcaagaattgcaaccatagaaagccaattttcattggaccaggagaatttcagaactgaccgataaactaacatagcaggttacagattcaatttcgtagtgttggaacaagcacatttgtaatgcatcacaaagtgaatcttttgccaattggccattggcgttggatttaaatggcataacttgacttaggaagaggaaaacagtatgtcagtctatgcctctataagtgtttctctcgccagtagaatgatgagagaagtcatctcacgaactacgagggaaacacaagctttgtaacagtctgcaagtgcccaataggatggtgaaagaagtcacaaaaaaattactccaggtcaaatgcgatctatatcagttgcttgcttttcctttaacaaatctacacctatacattttatgcctaacatgctgaaaggactgcagtatctcagcatcgattgtgctccgtttgcttttggggtttcgttgtcttgatcatttgaaaattcttcagcagatgggcgataagtgcatctccagttctctatatgcatgttcacttgtgtcaactatcggcttctatgcccattccaactgcttcaaggttcacatgcatcctgatgaatagaagatgggcaggttgcttcaatgctttgaactttgaagctttgtatcaatcttgagacaaatttgatggttgtgatagtgcatgtacataatcaaacttgtacatgtgggaaaacagttcttgcagatgggtgtcatctttccaactagaagccttcctgttgcaattggacacagttatattagcgtctttcaagcaatattactatatttgtgaaatatagtcaatttatattattgtgcagtagtagcaggagccaaatatttatctttgaactgtaagtatgaagaaatgattgtttaagtagcttggttgatcaaaagattaagagtaatgtatgagaaatgtcgatgactgttaggcttcctgagagaggagataacttccaaactaaatgagaagcaagactacttgttcctacctagtccatcggtgcttggctgcttgtagttagactctgtagaccattcaatttgtgaaagtgacatttttggagctcaatggggataataatggatcttcaattcttcatgagctggtacacataacttccatgcattcacaaggaattgtgcactccatacagagagtattactgccttattctcgttctgcttctttggtaatccttcaccagtataatatttttgcacatctaaaaacttcttgctttcatgttaccactgccatatgtcctcaacagtgcatatagatgttaccaaacaccaaatgatacagctccatggtcttttctattttgcaagcacctctgtgtcgtcatcatccattttcatgccccacggagctgcatccaggcagtttcacgagtccctgttcctgcatccatctcctgatggtttgagatttatcccaccttccatacgaggtgtacaagttggacatcagcacataaaaatctggtgtttcaggatgaagtgctgccatcttcttgatggcttcttctccaaactctaacctggaatgtagcttgcacccatggagaaaggatccccagacactaattcctgctttgattggcatattctgtatgaactccaatgcttcctccagatttccggcacgggccatcacatcaaccatacatgcatagtgcttcatggaaggggtgatgttaaaatgtcgtgccatgctatcaaaatactcctttcctgcagtaaccattccagtatggctgcaagcggaaagtatgcttgtgaacactacttcattcgggtggatattttctttcagcatttcattgaaaagatcgatagaaccagctgaatcaccctgcatgccataaccgccaatcattgcagaccaagtgacagaattacggtcagtcatatcattgaaaaccctctgagcagatgggagatcagcacacttgctgtacaggttcagcagagcagtattgacatagatattggacataaatgcatattttatcgcataagtatgaaaacctttaccaatatgcagatctgccaagcatacgcaagctgacaaggcattcaccacagagatggcatcaggtgatataccctgcatcctcatccggttgaatagtaccagtgattcattggccatcccattctcagagtagcctgccatcattgaattccatgcgacaacatccttgatcaaaatccttccaaatatgctgttagcttctggcaaagcttgacattttgcatacatatcgacaagtgcattcctgaccacatcagattccatcgttcccaacttaacccctatagcatgaacagatcttcccaggggtaagtggcgtaactgagcagaagcggaaataacagtggctatggtaactgaattgggaacaatgctcacgaatttcttgtgaagaaaaagctgtagtgcatcaagaggcctcttattctgtgtgtacccaacaatcatcgccgtccacaaaacaatgtcaacaaactcgagctcatcaaacacacgtcgagcatcctctactttctcgcacttggcatacatatctagcagagaggcactgatgaaagagttagtagataacccgtatttgataactgatccatggatccacctcccttggtgcaaaccaccgagcatggcgcaagccgcaagaacactcaccatagtgtattcgctcggatgcacattgtcttgtctcatctcattaaacagaaccaatccttcttcagctataccattctggatggaaccgctcagcatcgacgtccacgacaccacattccgttcaggaactctatcgaacaccttccgggcgttctccaggtctccagctttcgcatacatgtcgaccaagctgttcatcacgaatccatccgcgccgccggctttgacgacgtcgcagtgcagcctcctcccgtaccggaagtccgccgacctgacgcaggccttgagcgcgagggacagcacgacgtcggcctgcgccgccgcggggcaccgccgcctcatgtcccggtggagcgcgacggcgtcggcgtggctccccgcgtcgacgagccacccgagcatgaccctgtaggcgtacgcgtccgggcggggcgtcccgtcgagcaccccgcgcgcggaggcgaggtcgccgagcgccgcgtagcagctgagcagcttggtgcgggcgcggatgccgcggaggaggccgctcgtgaggaggaggaggcgcccgtggagcgcgcgcagggagcggagggtcccgcatgccgggaggaggaggacgagagcggaggcgtcgcggggagcggaggcgcgcgccaggtgctcgacggaatgcgcggccggcgggtgcattggagtctcggactctgggtttcctcgttgcacgagcgcatccaatttgggacttcgaatgtggaatccaatggattagccgtgcgacgggctaggcccaatggtgatctaaggcccattaatcattgatcagtggttgggaatttcattttggaaaggaataagttcactttgactcccttaaatgtgacccgaatctaattcataactctaaaccgcaaaaccagatatctttacccctaaactgttaaaaccggtgcaatttgactccctcagcggttttgctgacgtggcgcctacgtggcgatattgaccgagtcttcattccacatggcgatgacgtggcacttacgtggcattagaattaaaaaaatgcgtggacccattagtcattcatacaaaaagaaatattcacacaaaaaaatgcgtgatgatgctgccgccgagctctatggcggcctgacccccgccgagatgagtggtgtagacgtggccgcttgggcgggcgtgaccctctaggatgagcacgcggatgccgaagcggagcagctggcgggcggtgcggcgaggctggcgccgacgacgagcacggatgcggcgaggcgctgcagcgcattgggggagagagagagagagagaagggagaggcaggaggaagaaggaaggagacagggaggtcccacatgtcagtgggctcaattttttattgtgtgaatgactaatgggtcccacgcatttttttaattctaatgccacgtaattgccacatcaacaccacgtggaacaaagactcggtcaatattgctacgtaggcgccacgtcagcaaaaccgccctccaaaaccgctgagggagtcaaattgcaccggttttaacagtttaggggtcaagatatctggttttgccgttcagggttatgaattagattcgggtcacatttaagggagtcaaagtgaacttattccttttgaaaaacaaaattcttctgctttactagttacatcatgtactcatatgttgtaacgggccaagcttatataattttttaaaaaagagcccatatattttaacagatcatacccatataattaaagaggggttgggagcgagactaagaatagaatactaggtctggtggttacttttcgcgtagtacgtgctgcgcgagtcgagttgggaggaggtgatgaaaggaggacgactccgcttgtaatttagttttcatatcacccagaattctaatatcatatatatatatatatatatatatatatatatatatatatatatatatatatattttctctcgaataccaaaagagtgcaacttaaatctcttatcatctttgcttgggctatggcttattattacctaagaataatatacggagcaaccaaaaaatgattttggagtaagatttttatacatctactttagcaacccaaagattaaggctgaaaaacagacaataaaaaactatctaaaataattttaaaattcaaatttggctctatcttaagtttagaaaggaaatttaactacgctaaaagttgagaagtttaaaccagcatttttttaatttatttatgcgctggtaaaagtttacctcatcccttcttgtccacctcaattgcgtggggaaatagagtaatcaattattgtaacaaacaattagttttcaataatgaaaagatgatgtgaggccatgactttataggttgatatgactattaatattgagggtatagaccaattagcacgatttttgtcccattgctggttttaagatcatgtaaagatgatgacacaagctttatggcttcaacgttacaaatgtactgtattactgtgttgttgtgatgtgaggatgatttaagatgatgtcacaaactttaggggttaagtggactatctaatagcttgggtagtaaaatgaagtattgtccttctgttgatctatatgatgcgaaaaaaaatatataaaccacaatacagttcatgccttgctgaaatgtgttgatgtataaagacaacaacacagttgtaattcaatagtagatggacaatgtgcatatatacaagacaacaagcaggtatatatataaagatcttttatattgatggtgcatgtacctatctcatggacttctttgatgaatcatgatttggtggaagatgttgcagcatcactgtttttttctagacgacatggtaaattaatgccacagtttcatgatgcatgtcctatagctaattctgcattttgttagcagtatttgcctccgtggctccatgcatgtctccgtgtacagcactaacaaacagaagaggacaaatcaagggtgtttctatatgcatttgtacagatcatccgtcatgttcactcacatgcaaaaaaaaaactactaattgtgtcttaagtcttcattttatacgcatatataatcataaatggaaccatcctgtgtacgtatgctatcataaatggaaccatcctgtgcatgctcttaattaatccctattacctttcaagcaatatatatatctagcaatataaaaacacattagtttcttggattgatcatggagcgcatgaatgtcgatagagcaaagattgctcctgtataggacgaagggttagatgcatgagaaaatggacaaccattgaaatttgtagcatgcatgcatatataaatgagttatatacttttatatgtattgtccttgtgttgatttaaggattttttttaagaaacatagtacaaccattgaaattgtagcatgcatatgaattagtatatacgtttatatgtattgtccttgtgttgatttaagattgttttttttaagaaacatagtacaaacactgaaagtaagtacaatgaccttgaaacacatccaatcaccttaaaacatctacaagaactgaaggaggcagataagtccacttgatcaaatgactgctctatttgtagaatttatggtagtaatattagtaaatgtcttgagccgtggtcctttatagtcaaagttatttgcttcattagttgggtttccaactttccatcaactgctggctctgtggaatttactctttaaaatatgcctgactgttccttgtggtcctacaattcttttcctcccttgttgcacaagaatatcttttattttggtggcaaatcattcaatcaatctacacatttttgactgcataggaaaggtatgtgaacagatgggacataaataatgaaggttgtttagaaaagcaagaaaattgtgcttacactttgactccaaaatccagcataccctatcattagatcgacatacattgaagtacatatgagaaagcatcttcagtctaatgggtagctagagtaatccgcgagtgactctacctactattgttcaaaacatagtagtcacatttacctgcagatgtgtaagtttttggtagaagttcgtaggtgttgagtgtgtcctcgtgtgggttctccatataatacagaaatataaataatgcctccttttttaagtgtatgttattcttaacttttgaatataacgtttaactatttatcttactaaaaacacgtgtgcatcatttaactatgtaaagtagtaggtaattattttatcatcaaaagcagttaatttaagcatatggtttacatatatggattacatatttaatttgtactaaattttttaggaatatagttaaactcattttttatataaaaaacaaataacatcacatttaaaaacggtgagagtatttgcctatagtgaacacatatgtgattgaaaatggagcaatattagtcaacaaaagtcaccggcgttggtggcgccactccaccagacgcccaactttgctgcacggatttaggtaggtacgagaaaactactgacagaaacaagcactgccccattttattttattattattgagaggaccaagagtcaacttagtttgacgtgatgccacaatatttgatcaagctggacactgtgacatacgatggctggccaataattattttgccatctagcttgaagtggcagagttactaattaaacttactccgtacttataaaagaagtcgtttaggacaatgtttaagtaaaaaatttagaatataaatcatgaatatctctcaagttgttgagtttaaaaatgtaaaaattatatgaatagatttgtcttgaaaaatactttcataaaagtatacatatatcacttttcaataaatattttttatggaaacatgaagtcaaagttgtgttttggagac

SEQ ID NO: 56978 - DNA, 1184 bp, Oryza sativa
ttttattcaaaaaatttatgtaattatcatttattttattgtgacttgattgatcatcaaatgttctttaagcatgacataaatatttttatatttacacaaaaattttgaataagacgaatagtcaaacgttaatcaaaaagttaatggcttcatatattaaaatacagagagagtatcaattctttgttcagtacggaggccgagatctgtgatgcgaaaataccgggacggcggacagaatctaattaaatcggatcgcgtggatgacagatgatgcatggcgggcgtcgggcgatatgagacggataaaaatcaggtgtgtgatgaaaataaaattacctattttttaaataatttcgattagatttctggactggtatatatatatagacctgtatttaatttctctggggtagctcgtattaaggacacccatacatggagtacatgttaacatgtatgctgtggattaaggaattgactgcatctcttagcagagattcctccaatgggacagaaaaaaaaacagttgctttactcctataaagcacgtatggcctgatgttaaaacctgcaccacgcatgaatagattgtccacacgagacttgtactggcttgatgggttggaaggcaaagtctgccatagcttgataggtccctagcaagattatttatttgtggcttccagacaatttggtaaaccaaactttagttactatccataaaaatattaaatatataggcccacattagtttggcaagattagcaagattggctttctagtaatgttgtggctcaattttctctaatcatgcatgactttactgactaagaatctcttttgtaatagagagaacacttggataattggatgcttgcatacacgcgcatcacactaaagatcattgcttcttaaatcttaagcagctgcaatattgtcggatatttcaaatttttcataaaggaaaaagtcccagagtcttattataagtggtgggctagccggtttaagttaaagcctccacaaccttttaggctgagttaagatgttttgttcactttcccaaatccacctctctcgtttttcacttgtacgtttttcaaattactaaatggtgtgtctttcgtaaaaattttctaaataaaagttgttttttaaaaaaaatcatattaatccat

SEQ ID NO: 56979 - DNA, 2286 bp, Oryza sativa
taagatcgtctcattcaaattagttaagatgtcttattgtttcaactatattaagataatagtctctaagtgatgtgtaactaattaagagctcatcactagctttgtacatacactaatgaactcattttcagtatctatacttctttcaaaataaggcagtgattatgacagtgaagttgccacctccaccaactattgacaggctatacccgtctacggtatttgtatagtataagaatcgttggtactagggtatacatgatattgaggtaaaagcgataggagacagagattttatataggttcgttcgaaccccctaactaacaggtaatagtcatactcctatttatcgaagccggtattgcctttatatatatatatatatatatatatatatatatatatatatatatatcaatcacacaagtacaatatatggtatgagctaatctagtttccatcagcctaacagcatagagtactcacatgtggtcggcgactagcgtagtcagctttcttaaatatattgggtagctctagattcatcatgtcggtctctattgcaccatattgggtttatctaggtatatattgtcttgtcttgtcttccatgttagtctctctcttaacctcctatggatgtcttgtatttatacccttaagtaccctcctatccaagtaaaactagggaaacaggtatgtaaaaactatccaagtagtcctaggactatgtttctccttctttatctggaacaccttctatatataagctgacttgattctgtataagacttgatatatagtgggcctcaccgagcctaacacaaaagtatttggtataatttatctgtaatactaacaaatattgtatagagtattattacttatttatattttttttacctactcttcctttgcatatttacatataaaagtcattttacgtatgattctacattattttatcttaaaatataaaatataagtttattatgcaaaggcatatacatgcaaagggacaaaattgtcaaaaagaactttcaattaatttgttccaagcaatattagcatacattcaatttaatcaggggaaactattctaaactataaggtgacgtcccatcgatatttgcatgccacttaaatagttatgaaaaaaatttaacttttacattttgcaacgaaaaaaattgactgtgaatacacgtaaactagttgtattttaatttgttttttcgttgtgacttgtagaagttgaattttaatttgcatgtttgtgaagtgatatatcacatgttaataatttttttcaaatttttttaatttattttatgacgtacgaataaccaggggacgtcccctccatagtttaaattaaattcactctcttaatcattagccgggtacttaaatagttagtcgatcgaaaaaatagaactcatcaattcttcagtgccaaaaactcatttggaattggaaactgtcagctccaccaaccacgaacttcgcctctatttaagcgaacgaaacacacgcagaaacctgcactaccatctcaccactgatcagtagctagctcgtgaagaagccatggcgacggtggacgtgctgacgtcggaggtggtcgtccccgccggcgagacgccggcgggcgccgtctggctgtccaacctcgacctcgccgcgcgccgcggctacacgccgacggtgttcttctaccgccacaacggcgagccggggttcttcgcggccgacgccatgagggacagcctcgccagggcgctcgtggcgttctacccggtcgccggccgcctcgggctcgacggcgacggccgcgtccaggtcgactgcaccggcgagggcgtggtgttcgccacggcgaggtccgggcactacgcgctcgacgacctgatgggcgagttcgtgccgtgcgacgagatgcgcgacctgttcgtgcccgcggcgccggcggcggcgagctgctgcccgcgcggcggcgcgctgctgctggtgcaggtcacgtacctgcggtgcggcggcgtcgtgctcggcatggcgctgcaccactccatcgccgacgggcggagcgcggcgcacttcgtggagacgtgggcgagcatcgcgcgcggcgcgcccgccgcggacgcgcccgtgccgccatgcttcgaccacaggctgctcgccgcgcggccggcgcgcgcggtgctgtacgccacccggagtacaagcccgagccggcgccgccggcgcgcgccgccacggcgtccacgtacgcgagcgcc

SEQ ID NO: 56980 - DNA, 21911 bp, Oryza sativa
ccgctgccgccggggtacttcggcaacgcggtgatccgcacgtcgacggcggcgacggccggggaggtggtgtcgagccccgtggggcacgcggcgcggcgggcgcgcgcggcgacgagccagggcgaggactacgcgcggtcggtggtggactacctggagggcgtggacgccatgaacctgccgaggagcggcgtctcgcgggcggacctccgcgccatcagctggctgggcatgtcgctcgccgacgccgacttcgggtggggctcgccggcgttcatgggtccggcgatcatgtactacagcgggttcgtgtacgtgatgaacgcgccggggaaggacggcgccgtcgcgctggcgctgtcgctggagccggagagcatgccggagttcaggaaggtgttcgccgacgaggtggcgcgattggcatgacacgagtacacgacgctccctgcggttgcatgcatggtgtccacgtaaacgttacgtacgttggcatttcgtatacgtatacgatcgagcttgatgtaagtctgtaatgtgtatgcatgtacgtactgtacgtatatatgtacgtacatgtagaatgttaccgtgcgtatacatataagatatacataaatctggagtttccggattcacgtatgaaagtgaagggtgtagtgtatattcaagcaggcatggcataattaatcacaatatttgaattgaacttgctaagctagctagtgctgatgcgatctccacgtgcttatttgtaggggtgcttttttaataatgtttagtatgagtgctagccctaccaaaagttttgtgatagtgactcatcttcctagtatgttgcaatatggaccttataatcccccttctacttttaccgtttttagtaagagattaaggatgaaaaaaagactaaaatacccttgaggtatgattatggatagaaaggtggtctagggctataatgggaataaatttgaattcgagttaattaatgagacaagtaccgcaccaaaaccccttaaaattttaggccaaaactagaatggataaattccttacgttatgagatagaggtcatattttaccaggagtacttcaattctttctctcccacaaactctctcatgtggatgtcttatggcaaaagtctactttacattccttcactatttgttgagatggtccttcctctcttatctcgctgcccctatcaccgttcctatggtttcatccattccccctaccccgcaccttcctctcctcctctactgatgtgccttcctccttgcccgtcttctcatgcctcaccaccaccggcctccctgcttccttcctctccatctattggttacccctcgccatagctttctaggcttcatgatcggtggcctcctagagctcgagcttaagtggcggtggcaatcggtgcagagctcgagtggcggtgtagagcctcccaatatgcttcgaggagggccagcgtgaggtgcaacccccatatccaccataatcaccacctgggtttcgtgatagtccgtggggaggacaaggacaaaaggagttcaatagcaatggtaggggagctaggcggtgcgatctgttttcaccaccacctccaggtcatccttcccgctttcacatccaccttctcctcgtcgatctatcccccttcgccattatcatgcggtcggccaccaggctgccacctacttggagccatgctgttggtgtagtccacaggaatgagagggaaaagaggagcaagagaaggtggaggaagaagacccgttgtcgtgcaggttaattccatttgtatttttactgaatgtaatgccacatatacatcacatcggatgtaactatcgtcaaaaccacctagagaggtaaaataaaccgatattaataattaagagaggtcatatacttggtttggttttattgtttaagttttattgtttaaggaggaaaatcacgaactgacccgtagttaagagacgtaatctggatactttttctatgttttgcatactcctagaaatggaccaaatactcggccagtccatggtcaggagcctaggaacttaggaagcctggttgaagtgggcaaaatgtcttctcaaaaaaaaaaaagtgggcaaaatgtcaccagacaccggctagcaaaatattcggtccaaaaatagactaaggtggtctggtgttgacccatttcttggttcgcccctaagtacttcctctgtcgggtttaaatttgaatgcttgctcgtttgattaaaaagattgttaggatagaatatgcaagtgtttaagtatgcacttgcagttgcagatatgtacgcaagtctatgcatggcactcctagtaggcttttttttttcaaaaaacaatccggcggttgaccactcatagtgaatacagtcaaccataaaagtcttaaatcatggggcttgaggctaggttatacaatttctttctcaacttctgcttatttatttttcgcgtccacgcttttttttaaaaaaataaagaaaattgttcctaaaaaatcagaataatttatttattttaaaagtttttagctaatactccctattgtattttaatgtataacgccgttgactttttatatacttttgatcattcgtcttatttaaaaaatgagtaaatttcacaaaactacaggtattttgcataatttatcacaaaaatatagatttaagagcttgtttcacaaaactacagacttagtatgtccgtttatcacaaaactacaggtactttgtacaacctatcacaaaactatatatttaagaacttgtttcacaaaactatagatttagtgtattcgtttatcacagaactacacatttagtgtcttcatttatcataaaactacaaatttaattagtatctccattatcacgaaactacaggttttaacaatgctgaaacatgtagtttgtgataatgaagacactaaaacctgtagttttgtgataaatgaagatattaaatctatagttttgtgaaacaatatcttaaatctgtaggtttgtgatatattgtgcaaagtacctgtagttttatgataaacgaagacattgaatctgtagttttgtgaaataagttcttaaatatgtaattttgtgatagatcgtgcaaagtatacgtagttttatgaaatttactcttaaaatttatgtaattataatttattttattatgacttgatttaattatcatcaaacatttttttaaggatgacataaatatttttaaataaaacaaatggtcaaatgttgataaaaagtcaacggtgtcatacattaaaatactgtgggaataattaattaatcatcattagctgatgaggtgtatcgtttttttctaccgaacgaattagttacgaactcagaggcgttcaacacatccttagagactgcttttccggttgaaaaagcatacccatgattacttgacgggtggaaattggacacagattttgcgtcgtgcaacttttgactgaagttagtgaagcatacacacgtagcaactagcatgcatgacggatggtgatgcgcacacgtacagtcgttggaaaatattgttagctttgtgcttcggtcgtgcaataatacccagaaaaagtacgaactatcctctaaactatcagactgtatgaattatttctctgaaccacaaaaccagacatttttcacccctacctatttaaaccgaacaaataacctctctctcccggcttaatccacaattattttggtcctacgtggtagtccagtcaacaaacattttttacaaaaatcggaagacccaaccagtcagtttctcaccctctctatatctctctctattctatctctttccccaattcgtccctccgctctctctctctctctccctcttctccctcccctcacctccatcactcaccggcagcagtgagttgagaacggcggaggcgggggcgaagccggccagctgggggtggtagaggggggccgaggacggcgacgggctggagtgcagacagcgcggatccagaaaaatgatgcggcggttggcccggacggtgtgctctacctcctcctccaccgccgatcgcccgagctcgccgcctccaccactggccacccgagatcgctctgcctctgctgctagccacccgagctcgctccgcgtctgcctctgacgccgaccgcccaagtttgctccacctccgcctccaccatcggcaccagaggtcgctccacctccgccgttgggtaaattacactttttccataatatattttaaaatttagagtaaattctagtttgggttagtatttttttttaccaaactttcattttggactacccctaacctaaagttttcacataaagctgagatacgtttacctcttttgcactttggatcaccctctccatctctttctttgccacgtccagctctcaccaatcaccacctggagcttgattgatgaggcaccggtgagcctctcttctcccacaccagtgagctccttccctatctctttctccctcggataccctagtgtctcaaccaccgatgccgctggatcaaaaagtaggggcagcaaggtggcaacaagcttcgccgccaggttagaatgacgcaagggcagtccatcggtttaagacgacagagagatgtaggtggtggtgggagctagaggtggagaagagagagctgaagaaagagtggcccacaatgtaaaaggggtaaacatacctagctttatgtgaaaattttgaattgggggtagtccaaaagtgaaactttggtaaaaagaacctactctaaactacaatttactctaaaattaacagtttctacaattaaattgaagctatgatactctcattggttataaatacagtatttgacagttaagactacatctaataaaaaaagttgaattttgaccaccaataaaacttctcaaatgcttagtattttataaaagaaaagttatatgcatagattagccttaaaagttatcatgatcttattagagtttattaacttgtcctgatacctaaaattaatggctaaagtttcataactttgatcgactaccgaatattgtgactgtaaagacagatgcaatagagacatttgaagagtgacatttggtaagggaggcaaatagttagattcagagcatgattcaagttttatgtacggatttttaataagtacatgatttcattatttgttaaaacacgcgagtgtaaggccccctttgatttggaggaaaaatataggaattttgtaagattatgatcctataggattttttttcctatatgaccctttgaaacaaatgattgaaaactattgaatcctatgaaatttctaaggaaagtctcaatccacaaagttttagaggatttttaacatgaggtccaacttcatgagtttctattgagtctatctctctcatctcattcctatatttttcttgcggtttaattaaacgattattcctgtatttttttctacgttttacagtcctctattttgtaataaaatttctatcaaaatcctatattttacttattccttcattttctcactccttttattcagaggagcccttgtgtgcactacatgtcagtgcttcgtgtgttgtggtggccgcaataagtctggaaaaaaagggcagtttgaccactcatcatgaacgaataccatcaaccgtggaggtctaaattgtgggggtttgtggagtactttagccaattctgctagattgcctatccggtggaacctactttaaattcactactagcaaatttaattggacagagatttgcatcgtgcaacttttgactgaagtaaattaaacacgcatacctcataagttattttaactttttcacaaatcatacttatttagctttgtccaaatttataagaaaatatagtaatatttcaacataaaaaatattaaaatatatttaatattggatttaagaaaattaatttaatgctataaatattattatatttttctatatatttgttaattttttaagaagatattttaaaaaagtcaaagtaaattataatatatgaaacgaaggtaggacgtagcacgcccgatggtgaattggtgatgtacagcagtacattactaagaaaaatattcttacctccctgttttggtcatacagtttacatctttttagtattaaaaataaaatttgtagttacagtgaaactatagttacagcgagactcctatcaaaaatgagatacatgtgaactatggtaatttgttcaaggggcaattacatccatgcccttactttgaaagccaattacggttttacccccactttttagggtttgcatttttatcctcaccttttaaatttgaatcagccgtgtaccatcacttctaacagttagttttaacagtgttagttgtagagaaaaggacatttatacccttggtggttattgtattttggcctctatttttttcagccttgtgtgattttgcccctattttgtgatttcagctggtgtgattgttataaataattcaaatatgagcatttcttgtgatgtttttgtactttaaaaaaaatcacaaatactaggcaattacaaaatttgaccaaaatttgaataaaattttgacaacatttcgacagaattttgacacaactagcacaagtcacatatatagcaagcattacaaagtgtcctatacaaataagtcacgatacgtataagtcatctgttggaattaatgaatgggccttagcccactcgaagattaattctttggaaaatcacaaaagcccacctcatgggatggcatgcatgtggagtttagtaccaccttacttattctaggagagggggacctccttaaaagggaggatgccctcctagccacttgaagcatgtgtggtggagagaagaggggaaacacacgcgcgcgctcgctcgcctcgcctggcagggcaggcggcgcgcgtgcacgacgtacgcgtcgaatggtccaaaaaattggctcctcacccttgcgcaaatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcgtcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttacgcatatttgatatgttcatgttattctgcgtagtttacatgtgtagatctaatgatgcgttcatgctagttttcatctgtaatgtcataatttatttatggaataaattaaatcattatatgcccataatctcaacaatccaaaaaaccttattataggcactgtgattttactatggctggttttgccggtgcactgaggccggataaattcaccggtgtgcattttaagagatggcagatcagggtcactctgtggctgacagctatgaaatgcttctgggtgagtacgggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctaaagtttacttcgggaaagatcgtgcagctgaagaacgtgcagcatgtcccttctatcgacaagaatcttgttagtggctcccgtctgactagagacggatttaagttggtttttgagtctaataaagtagtcgtgtctaaacatggatattttattggtaaaggttatgagtgcggaggcctgttccgcttttccttttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtagactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcaaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtatgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattggggcttcactatactgggtatcctgtggtactggagggttatagtgattctaactggatctctgatgtggatgagatcaaagccactagtggatatgttttcacactggttggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctatcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggttgtaacccagtctatgtgatcggagatcccgtgaattagatcctgggaagaacaaaccattaataaactagaggagagtaccaatatatataccctatccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcacagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcgtcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctttaatgtcatgatttatttatggaataaattaaatcattatatgcccataatctcaacatcatcgagcacaaatattacttagtgtccacagatcaaaccttaacagagacagatctcactgaggtgaagttaatcgaggggtggaaggggaggaactcgtcgatggtgtagatgtacttcttcttggagataaacttcttcatcgaagcagtcacccggatcgttttcttggggtcgccgtccaggacgatgatgaggtggtacggctggaagaagggccttgcacaaccacacagagccacagaaaagacatcttcttttgaatcagaatgccaccttgcactttgaacgataagcccaagagcaaacctaccaccttgctcgtgcttcctcccaaatcctcttcccaaatgaagccacacacgcttaactttgaccaggacgaacccatgatagataccaattcaaaaaagaaaaagaaaaagaggcaaattcaaaatcttcacacacgacgcacctcgatgctcttcaccgccggcttgttgagccccttcaggtgccggtgcggtgcgccctcccctccggagacctcgccgccgcgcacaacaggcagaccaccgccaccagcagcagccaccaccgccgcgcgtggtggccatgtgcggctcgcctcctcacgcctccaccgctccctcctcaaatcgcacttcacttcacccccactttctcttcaccgacgaactcacctcactgccgccgccgccgcctccgcgcgctccctccctcgccgcagcctccgcgccgcgggcacgccgtcgggaacaagatccagctcgttctaagtcagaagcacatggtactctgacagggggattttcagccgtccgatccacaacgaacagatcgatacagtaccgtgaatagtattttccaaacagcaactctaaaccatatttttcactgtttcgcactgttgctacagtgttacgtcagaggaactgtagcacgtgacgcagattactgtacacctctgacttagaacgagctaagtcaaggagccggttccacgccgtcggcgctagcgtttctccctctatcagtcaggccctatccactccctaggggtacaaaggtaattgcatatttatccataccctaaaaccttttctttattttcttttgtatttctttaacataaaacgtgggacctaccaaacggctgtcacaagtgagggtagacggctggttcagattcaaaaaataggggtaaaactgcaaaccctaaaaagtgggggtaaaacagcaattggctttcaaagtaggggcatagatgcaattatccctttgttgaatattaagttgtatgtcgacccaatcttcggagatgtacttatagagaaggaataggtttgccttgtccggcggcagcgaacgcgcgcggcacgcgcactgccacaccagcgccaccaccgcgcggaacgtggacgcccccgcgcacgccgccttcagcgcgcccacctgctgcttcgtcagcgtgatgatggcgctcgcgtacgtggacgccgtggcggcgtgcgccggcgccggcgccggctcgggcttgtactccgggtggtcgtacagcaccgcgcgggccggccgcgcggcgagcagcttgtggtcgaagcacggcggcacgggcgcgtccccggcgggcgcgccgcgcacgatgctcgcccacgtctccgcgaagtgcgccgcgctcctcgcgtccaccaccgagtggtgcagcgccatgccgagcacgacgccgccgcaccgcaggtgcgtgacctgcaccagcagcagcgcgcacggcgggttcggcggcggcgtcgggggcacgaacaggtcgcgcatctcgtcgcacggcacgaactcgttcatcaggtcgtccagcgcgtagtgcccggacctcgccgtgacgaacaccgcgccctcgccggtgcagtcgatctggacgcgcccgtcttcgccgccgccggcgagcccgagccggccggcgagcgggtagaacggcaccagagccctggcgaggccgtccctcacggcgtccgccgcgaagaacgccgcctcgtcgtcgccgttccgccggtagaagtacaccgtcggcgtgtacccgcgccgcgcggcgaggtcgaggttggacagccacacggcgcccgccggcgtctcctccgccggggcgaccacctccgacgtcaacacctccaccgtggccatcacagttagtacaaatttttggtcgccggcggcgaggtctcggtctcgttcacgttcacgttgatccgtgtgccgcgcgctacgtttttttggtggtttttcgtggccattttgggttggtttatatagagagagcgaggcatgtgtgcatgcagtggtgtgggttggtgagttgggttgggtgtatgaaatggttggcacgatgggtgtgcagcaaaggcagtgaagtctctgcagtcaaattgcagaaaaaagatcaataagactactgtcacgtagaacgagtccatttgtttttgaccggagatgcaagtcacactaggccagccatacttaatagtggtactagtagatgcgtagtaggtgtataaggggtttaagaataacgaggtatctcttctatcagtgtcactttgatacttaggatcagaattattaattaagtattaattattttaaatttaaaaatggattaatataaattttagaacaactttcctgtagaatttttttacaaatatatacaccgtttaacggttcagaaacatgcacgcggtgaatgaaagaaatctcctttctttttgtccatggctcaaaagtagtataatttgtaagaagaaacaacaaattgtaggggttacaaactaatattttttttctgtatatatgtacttgtatgttgaatatgtacttaacatcatgtggaaatggataatatatgagaataaacaacaaattgtaggggttacaaactgatattttttttctgtatatatgtacttgtaagaagaaacaacaaattgtaggggttacaaactgatttttttttctgtatgtatgtacttgtatgttgaatctgtactaaacatcatgtgaaaatgggcaaatggttcgtccttaaattactgtattgagttgagactgtcgaggttttcccattgagattcgagagtattcggaaaacgtgcgaatctcgcatcatatgattctcgtagaagtttcactgcagttaatcatacgtacagtagagtaactgtttgtgttatgctcattgctcccctttgcgtgtttctgctctgcatgttaattctactttttcatagcatctatagttttgtagctaggtttgaatcaagtaaagattagtgctgagaaaaactaagttgttttcactcggttttggacgtttggtggactagctaatataatcaggttgaactgagcgcacacgttttctttagaatctccacaaacttcgtcaccacgtagctaatggtgagctaagagcaaaaattaccaacatcgtgtctaacgttcaagctgaatgttttcaataaagtggatgtgaaaactagtaaagagtcgctagtgggacctgaaaaggaaaataaagtagttttgttagttatccttgtaaggctgtctttagttggatccaaagtttgaattttggttgaaatttgagatgatgtgactgaaaagttgtgtgtgtatgacaggttgatatgatggaaaaggactgagtttgaatccaaactttggatctaaacacagcctaagtaacttactactaattaatgttagctctttactgactgaagtgtagatgcatttccaatgcagaaattacccaggccctgtttgaagagcttttggtgacagtaatttttctctagaatcttcacgtttctaaacagtccagattcttatatattcatattaagataatatgtagttatagaatttagaaaataaattaaaagccaaaaacttaaaaacctatttttctatatatattctcaccggcgctatctctgaatcatattactggaaagaagatttttgcaggcggctgaaattgctttatgcagacagccacacacgtcgcatctaagtaaatgcctgcgaaaatgtatatcttcgcaggcggacggtctacccgcctaggaaaaactttttttttaaataggaaaaactttttatatgaaaggcttatctcattcttataagtagaagtgaaaacctaacaactacggccgctcgatagaatagagccactggtgctttctttttatgtggaatcatatgaagtcgagatgctgattgtaattaactagttagtgtgtgtttgccgcttggacgtttggtggaatagctagctaagcagtttgaactgatcgtgcacgtttttagaatctccataacctcgtcatcatctagctaatgatgagctaagagcgcaaaacagtgacgtcaagctgcataaacctcttcaacatcaatataccgtggtatttgaaaagtggtaaagaatataattgcaggggagaacctgaaaaaggaaaatgaatggttttatagagtattataatcatccttgttattattagcactagtattttcatatagtatcagagtattaatcatccttgttattggcagtagtattttcatagtattatctccgtctacatatacagggatttttgactatatatgcgtacatgtaggcggaggcggaaatatatatgtattattctccgtaaataattattttgtcagttgtacatatatgatctcaaatcgattttcatggttttttttctttgtttgtgtggaaccatagtaaaccaaatactgacgataactaaccaagtgtgtgcttggaatggtatttttctggctgggttagttccacgctaaaattgaaagtttaaagaaattggaacgatgtgatggagaagttggaagtttgtgtgtgtagaaaaattcgatgtgacgaaaaagttaaatgtttaaagaaaaaaggttggaatctaaatagggcctaagactcgtgactgatcttagatcagacaggtggaagagatgacagatttgagagagggataaggacgaatgggatgaaaggaggaggagggtcaatttagtaagaaaaaactatatagatgcattgaagtggtaagttgtagtatatatttgatttctgtcaaactgtaaaaccatgtatccaaatatatgaataatatgatatttataaggtagtgtttagatttaggaactaaatcacatcggatattttgacactaattaaaagtattaaacatagactaataataaaactaattgcataaacgagagctaattcgcaagacaatttttttaagtctaattaattcataattagcacatgtttactgtagcatcacatacgctaaacatggattaattaggctcaatagattctctcactgattagtccagggttatgaaatggtttttatcattagtctacatttaatacttttaattagtgtcaaatatgtagtatgatagggactaaaaattttttttccgtgatccaaacagcccctatcaaagaaaaaatgtaatggtacgaatttaattgagccactaatttagctatggtcgcacacgaaaaaaatgcactaattaccgtcggcatctggtctggtccggtctggtcccatattactgtgcatttgtacgattgtactcgagctgtggaaaaaaaaaaacctcagcttgtgtgtttagtttacattaaaattagaagtttggttgaaattggaacgatatgatggaaaagttagaagcttgtgtgtaggaaaattttaatgtgacaaaaaagttaaaagtttaaagaaaaactttagatctaaagagggcctaatgcagctccagtggagaactggagaatcaatggcgatgatgcacatggcaattaatgagccgagacgacgttgactatgaaggacaagaggttcagtctccggtggccaacgaggcatggagctgcgccgcctaaaatcgacgggaatctgatggacgtggtgtagcctacaccgtgtactctaggtcgcatcgctcgcaggggttggtggcctggacccgtgtacagatgattacggaggcaattaggcatgggttggtcgcttcctccgctgaaaccaagcaaaattttcagctccctgtcgctggtcctgtcatttcagtattgttgtgatgcgtctcgcgttacttatcaacgccctcattggatggcaaatgctttggctgataagccatttaagcaaaataagctaaccaatttgtattgaagtttggctgaattggaggtagctttggctgatcagccaaagtatttggccaaccgatgaggccgcaaggtggcagcaccaaccaccaacgatcgtagactttgtggtacaagttctttctagctaattgattcggggtacttaaaaaaacaccatatcccgtgttagattaacgtattttggaacatagatactatgaatcacattcgacataattttagaagaatttgcacatatttttaagcttaggatttgtatcatgattgatgctctgactccgatgatccagctctagtgacccccttctcctctaactccaaatatcccagcgaatggaagtggagtttgggtttagggccttggattgggaggggtgagagaaagcggaagaagggagagatcgctaggtttaaagtgatagctatggaaggtgacggctaggggtggacatggaagggtggcgaggtgttggcaccagcgcgagagccatgggaataaagtagggaggtggattggcattaaagttgagagcaaagcgagcttgtgattaggaggcgacggccaatgataatgatagtggatccgacaacagggagtcattggagacgggaaaaacagcgagacaagggaacctttccgtcaccggcttagagaacgaggagaggaggaggaggccggtcagaaagggcctggccgatcaagccatcgacacctttcagatttccagccaaccgacgaggccaactggtggcgaaggacgccaggtcaatgagataggggcctagttcgcgtcctgtggcagctaggagggaagacacaaaatgaggaaggggttagggtttagggaattcacaccaaatttagagcagcatgattgaatgggagttttgaatcaaatagaccttttttttcaataggagggttacagacttacagtttatagagtcatcgatagaaagatatcaaaactgaaatgtggctagttactagaccagcctcaaatacacacgcagggaactatttattaaggactacccattggacgattcaagcaataccctctttcatatatgaaactcatttttaatgttaccaaacaactgcattgttgtgtgaggccgctgattaaacactcctgcgttcctttctttctaaatctgccatcacatcgatagtacaagcgtatcaaacgactttccatagctgttccgaaaaagaaactggggcttttttcagccaccaatctcctagctccatgtccatcttgctcagcccttggacaactgttaggccagtttggccggcatagctaaaaggtgtgtggttgtgatcgtttagtttagtttagtttaatcgatggacaaatccaattacgtaattaattaatcggttaatcgaagagacaaggttaataaaataataataattagttgtgctgtcataaagtgttagtttgttaaatactcctctgattaagggctaaatcaaggagggacctacagtgtaaacactggtgtcaggtaacaccgataattttcagcaaaacttatggctaaactgtttgtctgtatatattataacactatgatcaaaaatataattagcatactatgactctgatcaacaaatcaattttctggatccatcgctagctaaatggaaactcaattcatgttttgtgctaacaaattaacacatgtctcactgccgttaacagtttctcgcatctcggtaataagcaactgctttctaacgacgcattttcaaaccgatgacgaattgtaatttagctggatcgaagacgaagacaccgtgatatttatactttcaagaagattctcctagatgatcaccataaggaatctccttcactaatcacaggacttgcgtcttcatcacgccagtattgccttcgtcacgctagcatcaccattcatcagcaactggagataatggttttgctaaacctgtggcaacatattttagggttgattaagagcaattaagcgtggcacctgatcaagctccaacgcctccacttattagcaatttgcaggctagagaaattaataataaatttatttttcttctcacacttttttagaaaacagagcattgtaattccagtgtaagtttttaatgtacagtgtaattactttgaaagtttatggtgtaattgtaatgtatgagtgtaggtaattggcagtgtaaaaacgatggctactttaagatgaaaaaagttatgctataaatatatctacttccatatgagatatataactcaacaaacatgtaaggccaaatttaactttacaagttataaaaaaataaaaaaataaaatgaaactacttaacatacacattcaaagtatatttgttattttt

SEQ ID NO: 56981 - DNA, 4068 bp, Oryza sativa
tcatagaagttaagtaaaagtcgatggtatattatagaacgtgacaaagtcagtggcaaatcgtagagctatgacaaactcagtggcatataatggattgtctctttttttaattattgagatgatatataagaaacgagaggatatcaatgtcatctccagtgatgaaaacactttccaaaaaaattgaaggcaaaccaatcttcttcttcttttttaattgcaagcgctagacgatggcttgaaaactccaagcccctaacccaatttcataggcccagttgaagcccgaagacatgattaggtaggaatgatgaacttattccatccaactatccaagcaaatgatggccgacgactcgacaacaaactgctcttcaacaaacgggctgaaatcagttctattgaagtggacttctgtttcgtggtagaaagaattgaacacaaactacttaaaatcagagttatatgtatgccccaagatcacattgcagtcttgcagacacatttacaaattgcctctcatgattcggcaatttgcattactgaagaacaatcttaaactgtcgattctaggacaagattgagagagtttgttgtgacacccagaataccaataagcgaagcggcatatttgcaaactaaaaataatttatgaataaaaccttttatatacgtgttcttagcgatctgaaagtaaaggctgaaaaataaacttcgatggaaaaaaaccataaaattaactccaaatttaagattgaaaattcaaatttttactgataagtataagtataaggaaaagatgaggctcgtaatctcgtactgttttgatgtactttagctgagagaattattaattgatgtacatgcagagtgattttatcgatccccttaagaattattacttgctgtaccagattttgtagtatagaatttagtgactctaatttcaaaataaaaaaaggaatcatatctcttcaaagacaataaaattcctcaagcatataatacgtgacaccaagtaactgaggatgttgcaacaccgtagcatatactgcacgggtgcatcctctttatatgctaaaacactgtatgcatgtgacaacatgtcttattttttcttcgggcaaggcgaagagacgccagccaaatttattagtatcttttaaaaatttcacaaagctacatatattttagtcaaattatcacaaaactacatatttaaggtgtaatattgtaaaactatagattttataacgaagttatcacgaaactatatattttagagtttaaatccttagcactagtgttatatttgagttataaacgtttaagttttgtgattggagactgcacgctatgatcggcaaaaatgcctgcctctagccaaacttttcattctgcggcaatgacccgtatcactttttttttttaaacacatcaactttattaagcaagaacagagttaggggataaaccccattacatatccaagcaaaagagccatccctaagaaaggagggttaactgaactacgaaagcaaccttcctgaaataacctaacatcagaaaaatgacccgtatcactttgtgcgacggttgccatactgccttagaagattccgtcgttcctctccatccacagcatccaaaccactacatatcgtcatcgaaagaacggcggtcagctttgcacatcattttacagcacgtacgagctccaccaaatctaaaagtccaaggcaccggttaggtcaaagatgatacttcctccgtttcacaatataagtcattctagtatttcccatatttatattaatgttaagatagataacatcaatatgaatgtgggaaatgctagaataacatcaatatgaatgtgggaaatgatagaatgacttacattgtgaaacggagacagtactaaatatccttccctttttatatgaagttggctagattaaaattgaactaaccaacgtcatatttggataggagattaggagtagatctccggtaatgacataataacaacatatatatatatatatatatatatatagtaaatttgtttggtgctccatggtgcccgggcaccattgttgaaattgagtatatacccaattcaaatgagtatgaaactttttcaattacctaggtattaacattaactactttactaactagtttaaagcaagtttgaactgaatttgaacttgtttttgttagattttgattctaggtatatagcatccatacatataattagttaggtatgtaatcatgtattgtgaaataaagttaaatttgagttgttttgttgataagtataggtatgaatcaaattattataactaggtatatactcacaatttgaaaattttaaaaaatttgagtgattttgtgcattagataccatggtgccccatatgagtggcctatatatatatatatatatatatcatcgtcatcattattatgggcatcatatcatcatcatcattgttatcctcatcatcttattatgcaatcttgctatactgtttcagcagttaatttcataatttgctgtgctgctgaaacattattttaatttgtggtgattaaacaaattaggttttagatgtagccgccattgacacgaatgacttggccgttgatccacccggcggcgtcggtgcagaggaagcccaccaccggcgccacgtccatcggctcgccgatccgccccatcgggcactcgccggcgacggcagcgacgcgctcctcgctcttgccggcgtagaacatcggcgtcgcgaccggccccggcgccacgctgttcgccgtgatccccgtcccggcgagctccttggccagcaccttcgtcatcgcctccaccgccgccttcgtcgccacgtacgcgccgtacccgggccggagggaccccacgttggacgacgagaaggtgacgacgcgcccgccgccgccgcgcgccagccgccgcgccgcctcgcggcagcacaggaacgtgccgcgcgcgttcacggcgaacgcgcggtcccactgctccggcgacgtgtccgcgatgcgcgggtacgcgccgtcctgcacgccggcggcggccaccaggacgtgcaggtccgggccgaacgcctcccgcgccgcgtcgaacaggcgcgacacctgcgcgtggtccgacacgtccgcggccaccgcgacggcgcgcggcgccgtcgcggagtcgttgagcgacgcgacgagctgctcggcgggggctgggtcgccgacgtagccgaccacgacgcgggctccgagggacacgaggtgcgcggtgaccgcggcgccaatgccgccggcgccgcccgtgacgatagctacccggcggtgaagcggccgatggccgggaaaattgggggaggagccattgacgccggtgaacggtggtggcacctgtgggtttctcaccagagagttccaatcacttcccatggctttcacatgcactaataatcactacaaacaatcgattagcctctatcacttgttatatatatacttcttccgtttcacaatataaatacatacagtatataaaagaacaaaaactactgtcgatagaaaatagtgagaaaatttccgatttttcagtcatcggatgccctttgagattcatgctcgtgcagattctttttccaagttgttgaatgtactttgagatccattgctagcacaaagagagaaaaggagcattaaactcgtgtgtttttttaaaaaaaaatacagtacatgcagatgcagatttttttttgaagttattgaatgtactttgagattcattctagcacgaagacaggaaataagcatcaaactatagtacatgctcgtgagattttttttttcagatgttgaatgtactttgagattcatgctagcacgacgacaagaaaggagcatcaaactcgtgacgagtttttttaaaaaatatatatatagcacatgctcgtgcagattttttttcagatgttgaatgtactttgagattcatgctagcatgacgacaggaaaggagcaccaaactcgtgacga

SEQ ID NO: 56982 - DNA, 14449 bp, Oryza sativa
taaaattttgacagatataattatagtgcaattatagtgtaattacactgtaacttatatgtaattacactgtaacttgcatgtaactacagtgtaacttatatgtaagtttcacataattttgaatcgttagatctattacaagatttgttttagtgaggaagaaaacaaatcatagcacacacatatgtgaaagaatttgttcccacgacctccaatttaccgaaataacatgttacggagagatttttgaaagttacatacaagttacattatagttacagtgtaattacatgcaagttacagtgtaattacactatgattgtactgtaattacatctatcaaatttttgggggaaaatttgtcgacaaatatatagaaaaatcgttggttggtgggatggggaggaatgcttggcagaaatccaaggggtccagggaccacccggagcacctcttgaagtcgtccctgattactcgaaaagatgtcttcttatttttcatgttctttataaagtcactaaaaaaatttagaaatatatatgtatatgatatgttactgtacaaaattcaacttatataagtataaaaaacattaaatttaacgtgtaattcgcggtcaaaattattgtttttgtttttaattgtacaggtcgaatgcgaacttgcctattaattgagagaataacatatcacatattgatttatcttactaaatatttttaaatgttttaatgaatttttagataatatggacaaaaggagaggggacatcctctagaagggggtaagaaataaaatccatctcactcttcttcctcgaacgtgctgtccgacacggcgccaccgttaccagaacatgcatgcatgcatgcatgcgaaaggacgaccctcaacaacattggactgtgatgactgatgtaatagcagtcatggaggttgggacgtatgaggaacaccatcgttgattggtaagatccaaacaagcacttggccagtgcttgataggagcaatccaactatccaagagatgaggtggtggtactgtattatgcatgaaacagccaagtgacacctcaacaacaagataccttatccattatcttatctaaaaaaaatctcgcttgtcggtttgttaaccagcgacgaacgaattgtgagaaaaagtagtgctacacgtgcgtgcatgcttgtttttcttcttagacatgcatgtctttttcttccttcttataaagttttctctcaaattaattacttatccgatatacaattcgattctaccaatgtgttcgttacaattaaatcttcacaacaagatcttacatgattatattacaataaaaaatatttatatttgtaaattacttttattatatacgtaagttacttttatcatatatatatatatatatatatatatatatatatatatatatatatatatatgttacttttagatttaactaagttacttcttatacatgtaaaagtaaatttaataaagtctaaaaggtatttacatgtattataaaagtatcttaaaacaaaacggaagtaactttgtcatgacattagaagtaaattcattaaagttactttctttttgttataattaagttacttctataatatatgtaaattaattttaagctttattgaatttacttttatatgtcgaagaaataatttagtgaaatctaaaagtaatttagatttattataaaagtaatttataatttttcatcaaaatatcatgtgagatcttgttataaagatttaattgttacaaacacaacgatgtaatcggatcatagaccggatgagtaatttaagagaactttatttgaaatataggtggatagagtctcttataggtggagtggtagctggtttagacaaactagctaccactagctgtgtagtcacgtcctatataagtgttgggcatatttcatgttttggttttccaacagacacaattatatacgtgtagtcttttttgctgcttagggacgtgtagtgaacagtcgttgttagccttatcaacgtgaatcgatctactgctagatccagcaaatttgatgaggaggcacgcaagtgataaaagtctcctactacttgaagagaagtaggggaggtcggcgaattttttctagaaataatacgattttaatggaaaatcgcaaaatataggtcggttaggtgaaatcgtaagtttagcactctgtcgaacaactatggttcgacagggtagttggtccactaaaaaaaataaaaaaagtacatgaacagtgttgcgcagtggtaatgttcgatatgtccgcatgaacagtgctattctcttttttttaaatttttttatcaccctgtcgagctgcgattgttcgatagggtggtaaacttgcgattttgcctaaccgacctatatttttacgattttccattaaaattgtattgtttctaaaaaaatttcaaaggtcggcgagggaaaagggggtggaatcagggggagagagaaagagtatgtatgtatgtacacatttttcaagaattttagttaaatttattagtttccaagcacaacatgcattggaaaattgtatgcataggagacagtctcataaatttcaagtacacactatatatacatgaaaattatgataaaaattaattgcaagaaggctagccaacgggatcttgtccagatgggatataagtggataatcttatccgttcccccttgcttccatctctctctctctctccccgtccatctcttcatcccctgccgctcctctcttctatcgccctccgtctgaaggtggattctaaacactcgaatggatgtccgctcattaagtgcatgccaactaaataatcatgaaaaaatttcaaaaacatttacaagatagattgatatatatatatatatatatatatatatatatatatatatatatatatatatatatatatatatatatatatatatatatataactaaaaattcaacttttataagttgtaacaaaaataacaaatttagctgcaaatatacatatactaatcagagtttgatttattatttttgttacaactttgtagaagtcgaatttgaacttgcatgtttgtgggggtgatatgttacatatgaatctatcttgtcaaattttttgaattttttcatacctatttagttgacatgcaataaatggatgggtgtccacctaggtgattaaaagtgtttcccccctcggcctccactcttctctccctctctaacgcattgcttcattcctagcagggttggagtgagagcatgccccatggcgaggtggctctgaaggctcgagtcattcctctctatggtggagttgtccgcaagagccctcacggtaaggccgggtggtgtccgcgctcgttcgcgctgtcggtggtgaccatagggctctcacgtgctagaggcttgggaagagctgcgggacttgtttgggggagtttaagattctgagaagcagctgctaagaagctcgctggtgagaatctggagaagctgggaaacccagcttctgacttctagttcatttctagattttacaactacagagtctcagaatctgggtaagaagctagactgtttgggggagcttctggcaactgtagattctaggagaagccacagctgctagaagctcctccaaacagagccgtgaagagttcaagctgggaggtgagttgaggtgttcgtcttgccgccgcacacgatgtccccaaccatcatgctcacatgtgtgtcgaggatgacatcaaggaggaatggcgtccctccatctcccatgaagtggtagccatcttatctccattcttgctttgcctcctttcccttctcatagctctagtcgtcgtgaaggtctggtacccaagaatcatgcctgatacccacatatacctgacgtctaaatatcaagtctctaatacttgggtatcaagtaattgatacctcgattgttcaggccaatacccacaagtaccacacatgatacttgggtattgggtatgcatgcaaatacctaggtattaggtgaagtgggtgtgttgtgtctctcacgaggtatgtctcttagagcacccgcaatggtaaagtaaggtgctatctataaaacatgtacatctcagcaatagactagattaatagtaaaccacctcaatagtatgtctacatgggtatctatagctctctcatatattgcctcgtttttctctatagactatatctaagttagtagatagctttgctctctcttaatttaatatcttccatgtaggaaaatatgctgacatggatctcttgtaaagagcatatagacaaccattgtgggtgcccttacgaggagacgtgcactggcgcgtggaccacatggagctaagtgatcgtaatgagtggttctcttgtcctaaggacaggaacatgtacggtagtcgtcatcaaacaattctctactattataaaaattaaagatgtttttgccgatattttggtacgtcatccgtatttgagtcgggttttaagttcattcgtttttgaaaataggatccgtgtttgagttagattttaagcttgttttcttctggaagtataggagtcgtataagaaatctttgaaaaaaaaactcgcatgttaacttgagatgaaataaagactcctaattacagttcatgattttctaaaaagaatatccaagcaaatttccacagtgaatttaaccctagctaaaccatataacaataataaaattaaaatagtatttatccgtcgcaacgcacgggtattttttttctagtaattacctatgtgaaaaaaggagactggagagaaacatacttacgtacgtttacaataaacaatagagattaacaatctcaccaggaaaaaaaattaaaagagtgacagaaatcaatatttttttttcgggaaaaatcaatatatttttaacaaaatcgttataaattcggcttaattaaaaaaaaagttggtgttgagctcgaatggagctaacacttgagctcctcatagaacacatccttgaacttggcaaggctctcggggtccatggccacgacgacgtcgagccggccgtcgccgtcgtctcggcctggcacgaggtagacgaggccgctgaactggaggcacgcacgccccatgaacgccggccgcccccagccgaagtcggcgtcgtagagcggcagcccctgccagctgatcacccacaggtcactctccggcatcacccactcccccttgcggagccccgccgcgccgccgctcgccgccgccgccgtctgctccaggtggtccagcagcgaccggacgtagccgtcgtcgagccgcgcggtggcggcggacaccttctccgcgacggcgccgagcggcccggcggcgacgatgtcgctcaccttggacaccgccgacgcgcggaagatggcgttgccgaggtagccgcgcgggagcggcgggtgcaggcgggtgcgcgcgtcggcggtcatgtacagcctcgtcgccgcctccgttccggcgacggcgagcccgcgcgccttgcacgcgcaccgccacacgtgcgcgaccaccgccgtaaaagtggacagcctcttgccggcgccggcgccggcgcccttgagcgcgttgagctggttcttggacatggggaggatggccgagtcgaacggcagctttgaaccgccgccgcggcgacgggagtactcggcgtggtcgaagcgcacggcgggaggggagcgcgcgcggaggagcgtgcggtcgagccacggccgctgcaccgccgccgccgccgcctcgccgtcgccggcgacgtccctcgcaatggcggcccacgtgttgacgaagtccagcgccgcgaggccgtccgccgccgtgtgatggatcgccgcgcccaggcacacccctccacacctaaagaacgtcacctggaacatggccaagatgctggcagcggcgacatcggccgccgggacaagcatccgccggagctcgtccgacggggcgaggtcgcccaggtcgtcaatggtggcgccactccgcgccgtgacgaagagcacgccctcgccggtgcagctgatctccggcctgccggcgctgtcctgagcgaggcggccggcgagggggtagaaggggacgagcaccttggacagggcggccttgaggacgtccggcgagaaaaacgccgcgtcggagtcggggccagttcgccggtagacgtagacggtgggggtgtggctcctggccaccagcaggtcgaggttggagagccatatcctgtgctccggcgtcgcctcgccggccgtcaccatggaggacttgacgatctccactgccatggatgcgagaagatgcttttctctactactccactctacttgtcacgtgttttgcaaaatgcaaaatgcgagaagatgcagtaatatactccctcggtctcaaaattactccttccgtttcatattacataagtcgttcgatttttttttctaatcatactttgttaaatttgattaaatttataaaaaaaagttagcaatatctaaaatatcaaatcaattacattaaatctaacattaaatatatttcgataatatgcttgttttgtgtcgatgatactgctatatctttttataaatttgatcaaatgacttataatatgataaatcggaggaagtaagagaatttgatggatcgtatacatcatacacaagtacacatccaattaaaatcgaaagtcctaacgggcgatcgatcgctgggcacgatcagtccccctccccacatcgatcacccccttcttcatgtgattttcttttttggcaccgtattactttcctattttaataaatttatacacctaaagtttgtgcacctcaagtttacacatctcaagtttaacagagaccccaaatttataagtcaaaagtttatatatccgattcaaatttgaatctgaattcaaatattttttatatatagtatttctatacatctaaatattatacacctaaagtttatagacccaaagtttatatatccgatttaaatttgaatttcaatttgaatttaaatattttttaatatataattttttctaacgtttgttttttttatttgtttaaaaatttatggtgtagtaggaagagaagtaggggaggaggaaggggagaggagtgtgtttagggggatggggggtgacacccgcgcattagtactacccaattaaaatccctttatgttatgaatccaattaaaggaggctgcaggtaacaggttacgtagagtgggccagcaacaaatattgggcctggcccagtggcagctcagctccaaatccacaagcgcctagccggagcagcccgaccgccatggcactcctcgccgccgccgccgccgcccgccgcttctctcgcagcctccgccgcttcagctcctatgccgcgtctggaggagaagaagcaggaggagtgcccgcgggcgtggtggagcccgagtcccccgtccgcgcgccgccggacgagcagttcgctgcgtgggtcgcgcggctccggccgggcttcacggcgggggacctggccgaggcgatctcctccgagcgcgacccggacctcgcgctcgcgctcttccggtgggcggcgctccgcccggggttccgccacgcgcccgcgtcctacctcgcggcgctgaccgcggcctcctccggccgccgccccgccgccgcggagaacctcgtctacgacgtcctcgccggggcgtgcggccccgacctccggctcttcaacgcctgcctccgcttctgctgcgcccgccgccgcctcttcccgctcgccttcgacatgttcaacaagatgcggtcgctcccggcatccgccgcctgccgcccggacgtcgagacctacacgctcctcctcacctccgtcgtgcgccgcgtccgccgcccgccggcgtccatggtctacctccacgccgtccggtccctctcccgccagatgaaggcctccggcgtggtcccggacaccttcctcctcaacctaatcatcaaggcctatgcccggtgccttgaggtagacgatgcactcaaggtgttccgtgaaatgccgctatacggctgtgaggccaatgagttcacctatggctacattgtcaaggccatgttccagaagggcaggactgacaaaggaatggtgtactttcgggaggcgagggagaagggatttgtgccgactggtggcgtgtacatgacggccgtgtcagcgctagcgttggagtggagatttgaggaatcaagaaatgttcttatagatatgctggattgcaagaggaagccagatatgatcacctacaggacactgatggaggagatgtgcagggctgggcgcgcagaggatgcgttcgagctgctggaggagctgaaggagaggaagcgagggccgttagaccagaggatgtactcagaattgcttgatgggttgcactggatttctcaaccacatcaggatagggtttctccctgtgacaagcgttctgatgactgaaatgctttgatcaatggattgatttgcattgtatgatggtgatcataggcataaaaagatcgaattgatggctgcctgagaagactgcatacctctgcttgaatattcaagatgaattgatgcagaggagctactctgggattaactgattgactccaatttgcacaagcaaatgtgggtatggctgattcaaagccaaggggttggagaaatctgcaaatgtcttgcaggtgggatcaaaattccgtgcgagcgtatggcaactattgttgattggtgtctagtgatagctgataaacacggctaaaagggcaatttctagagtaaatcatgcagagaaagttgtttcaggtatcatatatgatatgagcagctacgcaacaaatttttagcaagtcagtacatttttagttgttttttctcacaatgttcaatacctaagtgatgaatattttatgccaaagagcaattgttcattatacagatataaattgatattacatatatatctacaacaatcatgtgcccttttcatgtttcagaatgctcccgtgtatagtacaactcttatgtgaggatacaactaaaagttcagtttctccttcatatcaggattttgagtgtccaaaccctaacattgactctgcaactgcaagtaggaaactaccccctggacaagcaaattgtgggctggatatatactaaggatcattcatgctaaactatacttacagatagactatgtgatggaagcaacttcacagtccgacattagcaaaacgactttttttttttaactgtatcaagattaatgattttgtttttaaacagcaatagaagcagcaaactaatcagtgagtgaagccaggttatatcctctcttatctatggattaatacatataacatatttcttcagagatagtaccagttgtgacagaggtgccagttgcagtaccaacctaacttttgtctgaaaacaattgttgcccttggtctacgatacttgaggcgccaatctgttgttaatcagctgtgtcagtatgttatcatcctaatcgaagtgaatcagcataaaatccaatatattgctgagcatgtgccatcacagtatcccaccgagtttttacgtatgcccgttgtttgtaaatttgtatggcaatgaatctaacctgcgttacatggacacaatggatcatgtgtgcatctgaaagaaagaaaattaaacctccatttctcccacatgccaatcggcagagcctgcaatgaagctgcaatttctattttacaatccattaactcgaatggttcacattcgattgaaaaaaaaaattgtaccttccagttgcttgtgcgcagtgtacaccattttgattgaacgctagatcctgacccctagaggtaagatggttttcgctaatttttggtcaaacctactgtttcaaatttgaatatctgaaaatatatgaaatttcacttgaaatttgcttaatttccgtgtcgaaacctcaaaattttacagttttcgatcggctctcgtcgttcctgttgcacgttgttccgctctctctctctctccccccaattttgcagctttctttgaagctggcaaaccaagaaaccttcgacgctaagcagacgtcgtggcaagctgcgtcccgtcgatccgtcaacggccaatctaatatttttatttccgcgtggtgtgatcaaaactagtacccacccacgaaggaagatagcggtaggattttttttttttcgtttatttgttttccgcgaaacgcacggcgtcacgagtccagcaaacagcaagagaagagaagagaagagaagagaacgcgtcccgcttccgactccggcgagagcgagaccgagagcgcgcggcggcggcggcggccggaggaggagaagacgatgggttgctgctgccggtgcctggagatcctctgcgccatcctcctcccaccgctcggcgtctgcctccgccatggctgctgcaccgtccgtaccctaatccgatcccctcctctcctctcctctgccctagctgattaattatttattaattcctctgatgatttctttcttttctcttggcgttgttgggagggagcagatggagttctggattagcgtgctgctcaccatcctcgggtacctccccggcgtcctctacgccgtctacgtcatcgtctccgtcgaccccgaccgcgaacgccgccgccgcgtcgaccccgacgaatacatctacgtcgcctgaccatctgtggagtacttagtaggtgattaatttagctcctggaaagcatatccttgttcctagtcctattacctatatctgctcctgttccacccttcaatttgtaaactggtactagcacatctgcagcctttggacaagtcgaatcgggtcggaatttgttaccgtagttcaactgtgttactgtgaccgtttgattgctggatcaattgctctcaagtctcaacttgtgttgttcttcagttgctgaatttattgacagcctgaaatgaggatttggcatgctaagagaattgagtgtaactagtactcctatctgataacctgcctttttttagccctagagttcttcgacagagataagaatcttccctttcagtgatcaatcaattttgcaatcatccggatcgaacattagcccaaatttaatttttcaagggaaagaaacattttcttcaatctctttttcaatgactaatgataagctagatgatcagagtttatgttccctaccagctatcgatgtaaaattgcagctgatctaacgtgtctagtacatctgctcaaggggagttagcagaaaaactagaccatcagagtatgttaacctagaatcacatgttagatgccttggcaaatcgtgagaatcttgagaatttgtcatccacaagaacctctgggtttccttcttcaacctaaatttggagaaaaaatgagttagataatgtcatgttaaggagcatttcaagaaagcacaatcatgctgcagaggaatgatatttgccgtgatggtaactactccatccaggcaatatttgaggctgatgccgctaatcgcagcagtgctgggcgtcaaatatttccgattggaggtagttggaagtgcatatttttgaaccatatttttgaacctcccttctcgtttatattatcgcttggttcttgtagtgaagagttattatggcatctatgttaatataatgttatgaacttatgactcctgtgttagcctctcccctaagaaattaaaaatctccttgatcatttaatggtggcacttaccaattttccttgatcaagaactagaatactgtccatcttcatcactgttgaaattcgatgtgctatcgtcagaactgtcatgcctttgcattcagcagaaatagtattttgcaacaaggaggctgtctgattgtcaacattagctgtgcattcatcaaggcagagtatctgtaaaatagtgacaactttaacttcattgagcaaaagtgacacattcatcaacacgaaacttaaaatctgatacaagttttgctgctcataaaaactgataaaacatccaaaataacatggtaatacaagcaatgttcaaattgtaaagtagtataccttggatgatttaaggatagcacgggcaagacacaggagttgtctctgacctactgaaaaagacgcaccactttctttcacatggatgtcaagtccacctatagattcaatctctgtcttcatatgacacttatcaagagcttcccatatcctgagatctgttgttctattaaaagggtctagattttccctatcatgaacatttgtcattagaaaagttaaagagttttgagtataggtgtgtctatgtttcgctcagtctttccaggcatgaaaattgactgaggcatgagaagctggtaataagggagactagtagttacctcaaagacccatcgaacaaaaacgggctctgtgggactactgcaaaatgtccacgaagatctcggacagcaagtttggccacatcaaagtcatctactaagatgcggccattacagattggagctaaacgaagaagtgcattcagtatactggatttgcctgctccagtcctccctattattccaacctaattcataaaccagggagtaaatatattcagtatagtggatttgcctgctcaattgcccagttagtccaaactgataagccagggggcagatttattgatgactccataaaaaagattcaacaagaatgcattggtaccgtcatacctgcatgcctgatgaaataaagaacgaaacatcattcaaagccgggggtaaatcctccttgtaccttagagtaacacgctcaaactcaatgttcccctctgttggccagccactgtgaggggattccgatccatgaagttcttcttgaggtatgccaacatactgctaacaacactgaattattagagcaaaagatgataacacactgaaagtaagttcaggttctacttttacctcaacaactctctcaacagaaatcatttccttttctgtctctgtaaaggtggttaagaagccattcaacaatggtacaacgggtgcggcatatgacagcgccaggccgacctgcagtatatatttatacttattctctagatacttggaacatatctagatagcgataatcatgaaatcagtgtgtgtataaacctaccagtccaggtgtaccaaaattaataacagatttactattgaagccaacaatggccataatggcgatgaacagaattataaaacctgccaacaactgaagtagtttgctggtcagtgcagtgtttgtgatatatgcttaactgatgtagaaaaattcttgattccatggtagacgatggatgttagtcatctgacaagagtgatacctggagtctcaatgagagccacagaccagcaaccagttcacaataggatgttttctggtatagtgtcacatgttggatgaatctttctaagaagaatccctatatgttatactaccacggtcagtatcccaaacaaaccatgccagcgattgccactagcgaacaatgttctaacagtcaattttgtatgtaaatgttcgggtaaatttagtatcatttcagaaaaagtctagatgcagttgacatacttctttttgaaatgctcttattgttgatgaaccatcaagtgtctctgtaaaagatgaatatattggtgaacgagcaacactgtcaagtcgtcgtacttcacgtgatgtagacctataatagaactgcactgatcattagtttgttactccaaaagtagaacgtaaaaacgtatatagtgtgataaatcattatcagcagacatcaaagaggaatgctagagtctttgatcaaaagagcaaaacagcagagcacctagtggcagacatcaaagaggaagtagcagtttggagagctgcgggggtatttgaaagttgtgaggagtagccctagcattaccgcagtttttctttctttgcttcccctccccactcctgtttccaggggtcttaacctctggaccgacagtataatgtcgtgtaaaatatgtacttattccccctttcaatcttaatgaaatttggtcggctccttcgccgacccggcaaaaaaaaaataataaatcattatcaactatagtcaaaataagaatcagacactgcactgtaaatgaattctggttcagaagatcaagatacaacactcgtgcagcactgcacattagcttcctgcaatatcttattagttaatgttatgcaacagaacttgttatcgtcagagctg

SEQ ID NO: 56983 - DNA, 1535 bp, Oryza sativa
taagtaaccaaagatcattgccattacgagatgcttgcattaagaacacacttagacatatcagaaaagcaattgaccatcccgcgaatgctgcatactttctgcaaagcataaacaccattttggattgcatgtagtactaagactatgtaacttctattattcaacctcagttaaaataacttctattattcaatgcaataaataaccagttacacaaaatcactcacttgtacacactaagctctaccatgccttctttcctggcctctacagaattctgctctctttgttcctcgtgatcaactactgagtcattgtcaatcaggccattagtctcggattcatgggcgacgctcactcctttgtttttctcagaaaatgttgatgagataacccttgaactctctggcttagacagtgtcgagtatggagttgctaagaaagagtccaacgtcccaaaccacttaacaagcccattagccatgaccactatcatatctgctgcggaaattgcctgaagaacaagggaatggtgttgttcttttgatggacctaactttgtttgggcgtgattaaataaatattacctgaagattgtgggtgcttaatattcgtgtttttctcttcattttgggccccataatggctttttccaagatatacgaagcaacttgtgagtcaactgaactaagtacatcgtcaaacaagtaaacatcagagtcatgatacaaagccctgcaagggtaaagatcatagcgttagaacatacttttggactttcccatgtcaattgcacaacattgttaacatataaccttgctaattcctttaaaaaaaaaatctgaccttgctaaggctaaacgggctctttgtccaccagataagttaagacctttctctccaatatgtgacatatctcccccaaccattgctgagatatcaacatcaagggtacaagcatgtatcacttcttcgtacctgtatgaacattgacacgcaatactgattaaaaatgcaaaacaataaacaccggtcgacggtcgtttcaggttttggaaaacataaccttaacaaaacaaagtgatcaaaacgagtaaaggtacctccttggatcaaattcttctccaagcaaaatattatctcgcaatgaaccagacagtatccaaggcacctgcacaacatccgcgacatgctttaccaagttgaactacaaaactgaagaaatttctaaatcaagaagtacaacctgtggtacatatgcaattgaaccataggaggtaatggaaccactggtaacatgaatttctccgatgatagagttcagcaaagatgatttgccacaaccaacctgcaagtgggcataatgtaattcctcaattaactgagaactgcagtggccactgacaagtatttacaaaagagagtttatttctatcccttatgcaaaactaaggtgcctaaaactcgaggttgtaaatgtttcgcgacattgatgaagttaagctcatggaatggtattagaagaatagtaa

SEQ ID NO: 56984 - DNA, 2469 bp, Oryza sativa
ttgttaccctgattgcatgtgtccaaacatatcatcaggatattgttttaccgtggcagcatccagcgagtggcccattatagcaaatatggaaaaggtgaaaagagagaacaatgttggtgtggttgcccagaaatagacacaccaagcgtccagatatttgcgagtcttattaggaaagaggagacacttgtgagtttcacatataaatgtaactaattaaaggaaaattgataatgagaagttgcacaccgcaagatgcttcacttctaattctcttctttccaccaaacgttgagtgaataatctctcccagctgtacatcttcactgttctaatatgtgctaacagttctcctgcacaacttatcctgttcatggaaaaatatcgattgtgcctaattagtcagtattgcataaatccatcaaatttcgtgattctattcttatttttcattttcttacaataatttgtgagtatatatatctcatcgtgatatgccaatagaaagaagagaacactgcaacataacagataagctccccaaaaacaaacttagacggatttttggtctcacctctcatctttatgtttcatcatcttttctgtcgcgtgagctattcttgtagagatccatttgttcactgtgcatgtacagcattggttacaagaaaaggacaagaaatacggatatgttaggaacttagaataatattctgaataaaaaatgagcataatcttgaactattgattatatcaaggagtaccataattcgtgtactaaaaagtaaccagagtagctttaatattcatacatacatgtatttcatttagcataggatcatgtacccctaatgtattgcaaacaaaagagatgaatgaagcaagggaccaaagaatgatatgtgcataaagttgcaatgcatgacctggcaaacctcttgaaatatacagaagaaccatggaaaatcaagcagtacctggcattagtatgactgttattgccaatccagataaaaatgcatagttcacttgagtatacaatagatagagagcaactcctatctgcaatggcaagctaagaagatgccaaaccacacaactcatcaaataatgtggcacgagtcaattccttaataggcaaacattagataaagaaaaaggatacctccaagcatcatgaaggctgttacataagtttattgtgcggtcagaatcaacagacatgaaggtctgaatctctcttcagaaaacctacaacgctcagatagactgagacataggcactgttttttaaggtccatacataataagtaacgcaaaaattatgcttgaagtttagtatggaaggtgttaaaaaattcgagcctccagcgttgaactggcagaacaagaggacatatacaggaatcataaaagatatgctaccgcagttatacactataaaataacgatgcataactgcatatgcattatttttaggagtgcaattagatactacattgtggtattatcaaagaacaagatcagccatgcttaagaaagtccaacaagtttgtactcttagtgttgctagagcacccttcagactttttctcctctccctataatttcagtgtttgtaccagatgttgcctgtttgatacctcttcttaatgcaaaaatatgtgtgaaatttttgcacattgactaaaggggtaattattgtacaacgcaaatagacaggacatgtttgaattgcttgactttttctttaaaaaaatatataggataacacttacaggtaaagaataggaatggtcataccttccgataaattattcccatgatgcttgatcgtaacatcaactttagcttagctagacgaaaggagtactgactatctaaaaacgacctagtgaatgtgaacaagaatgtaaaaaaacatatgataataaatgaggtgatacataactgagtgacagagcttttcattaaaaaaaactgttcattgaaaaggtaaaaacaattcatttgtgtcaacatttggcatgcccaactcaacgaggatttgaacataccttgtaaaagtggaattcgcagaaaaatttaaaagtggaatttgcagaaaaattaaagtggaatttgcaaaaaaaaaaaatgaagattagtttttccaaaaaaaaaaaataaagttcagatttaccagagacaaaatttcaatacctaaaactgatcagaactagagttgaagcatcaacataaacactcttaatggataatattgttgaagtttcagttaaacctcataagttaccagtgtatattatatctaataggttcagatactatctctatacattcaaaactaaaggagttaaaaagagatgtttagaagtatctaagttttagggtgcacaaaaatcatgcacaaatttacaatacatggatatggggaagccaaacttatttctggtaacaagacatact

SEQ ID NO: 56985 - DNA, 12780 bp, Oryza sativa
acatttgattccactattaccaccatgccatcacaaatgtacattctatgcaaaaatttgtaacctgtcagctttacgattgtaatttccagaaattggtgcttagcatttgcagttaaacatgcctgccgtgcaacacacaaataacattctacagacgtattaaaaataatgtatttcctagggcaagaagctcacatttacttcagacagttagataagattaatgtaggaccaacgctaaccaacataaacattatgatctgggtagaatggtttgattgtacacagaaacccaaatagctcatgacaaaaataacataccaagttggtcacttcagcctcagctttttcatcatctggaacaaggggatcttcaatagagttcatttctctaaaatagcatggatttaaaagcagctttagagaaattgtgaggaacaggatcattaaccattagatatgtaacgaagaaaacaaaagagtagctaggttgttgttcccgtaataactaagtctgatatgcctaggttaaagggaaggacatgaacaaatgcatcaggattcatggctccaaaagaaataacttcgtctatagttaactttgcctcattgcatcaacttcacatgcacgatacaacatggcacatgagcttactaataatacctactaatcaaaagttgcataccctacatattcatgacttagctagagttgacaaacaatatgtatagctcccaagtataacttaaaacccaggatatgttcggttaacgtttaaccggctacctctgcataaacagcagaatttacacttcgagttacatatgattgaccaaagctcaaattgacagttggcaattgacatctgacaattgggagcattacttttgcagttgctaaagataacagaatcgtgcagaagaataatttaaaaggattacttatttgctgatgaacttttgagaaatctactgtaactcagtaccatggcgggccgtgaccccacagcccgcatgtcattgagaaaatgagtggcatattaggatcaaaccaaataccttttattgtgtggttggtccactacagtagacacaactacaaagaggccaaatacaattgccatagagaatgagatgatctccttaaaatataacactgcctgtaaagagttccaaataaaagaatagattagatgtctattttgaacacctgttccttgccaatttgcatgcaacagttgtcaagttaaacactacaatgaacacgaagaatatcataaaacagaagaaattgtataaatatgtcataattcatatcaaaacggaacaatatgtaaagggaaaggaagaaatattgtaaaataacaaaatacctttaatactgtgagcttgtactgcaaatgaggtatctcaagaagaatcttcaaaatccagcagaaacacatgattgggttgtagaatacgaaccaaggtccatggactgagacaagacctacaaccatctattcaatggcaccaactataacagtttgttttcaataatttgtatgactggaaaggtagagcacaatcttcacagactcacagtaatgaagttcttacccacacaagaaactgggaggacctgaagaacgactcgtagttcacaacatctttcccctcaattttgttctttataagcataactatttcaagaaaagaaaggcaggctgcaaaaccaggcacaccgaaaacaaaccacttctccagaaaacccatcctgacattctaaagcaataggcaaaattaatatattagaatatttcagtaaaagataataaacaacataaagcaaaaattgatgctaattatcaagcttaagtaacatggtttgagtgcttcattttatctttcatttataataaattaatagttggaccttcttggtcctactgttcttttcaagaaaaagaacgttcaagtattgtttctacaaaaacatagaatacgaactagattgctgaaactaattatgataagattttcttgagtcaaagcaaacccaatggtttcaaagtccaaataagttacttcctccgtttcatattataagactctagcattgcccacatttatatatatattaatgaatctagacatatatgtgtgtctagattcattaacatctatatgaatgtggacaatgctagaaagtcttataacttgaaacggaggtagtattcaataaaaggatctcggcctctatttaatttagtagaagtatagtgaatgacccctgtttttgccacttcgtgcacaaaaacatcattatgcttgaagttcacgctatcctaagttcctaacaactcataccatcagttgtgaatataaatagctttagcttccactatcccgtttataatctcaaccatatctgttactgaacaccgtcattccaaaaacagaaacaatcagcaatgcaaccataaaagcttcatctatatgaaataccaattcacatccaacatgcgagacatgctgatacaatgtttttttttactctggatacgatgttatcttagctatgaaacaaacatttgtatgactagttcacacttcagatacctaacaaaagaaattgcagcaaacatgtgaacaatttgttggaaattaagccaatgccccgctaacgctagtgatcacttcctacacctttgtactcctgaagtttgatttccatagacattgtgaattcaaaaaccgattatccatttccttcctacgactttgtagtttgtactcgtgaattttgctgacaaagggcaataaacagagcagatctactacctcagttctccgcgcgttcctcctggagatgaagagcacaacggcagcaccagccgcaaccacatttccgctcaatcccaacaccgtagaatgttaaggcctaaacaacacaataaaccacgcaaacacaaacgcgccgaagccgaagcgcgatcaaccgccatcgcagagaccacgaacaccaccaaatttctcgaacgaaaccaaaggatataaatcggagaaacacggggtgaatcgcctcccgtcccacgcctgcacccaaaaaaaaaacatcacttcaaatgaaaacaaaaccaaaaaaaaaaactctcatgatcgctgctccagcattcgactccgacgaggaggaaggggattgggagggttttaggagaagctcaccgcgggatcgccggggcagacgaaatccatctccccggcgccgccgccgcgcctcctcgcccactcactcgctcacccgagcgcgtcgcgtcgtcgctctcgtctcctctcgactctcgtcgtctccgctcctctgagttctgacaccctcgactcgctcaacgcgccgtgcattgcaactcctcctcgaatatgagccactgatccgtgggacccacggtacatgggccccacgcaccaacgtccacgtgtgcagcggggtagggttcggcctaggtgagaaaagtatcgaaggagaaaaggtgcttttcggccttgggcgaaaagccgcgcaaccgcactcgcgggccgtacgcgaaggattggccaatgacaaggtgggccccgctgacgtcgggcccacaggtcagtgtctcaggacggaatcttccgagctcggatcgcaccgggaagtggagttgattttttggcgctagcttttttgggcttttggactgttcactaacgtgacacgcacgtaggggaggaaagaaacgaagcgccacgtggcccagatgcactgactgagatgggccggattgatgctaggtttgggccgagagatttactgtcttacgggggcccatcaaaggcggtttctgagacgtagttctttgctgggcctggtccacgggttggcattgggaggttgggctaggcgaggactttgctgtggtggcattgtgtcattgtggtgactttgctgtggtggcattgtgtcatggaataagttcactttaggtccctctatttgtcgcccagtctgattttcttccctaaaccgcaaaaccgggtatgacccatcccccaacttacgaaaatcgggcaaacgaggtccctcgacggttttgatagtggttttgggtgacatggcgcctacgtggctaatttgactcggttttcatctgacgtggcgcttacgtggcaaatccggaaaaataataaaactcgtgggccccacatgtcagtttcacaaacaaaataattaaaaaatggtgggacccacgtgggccccatatgccatcctcactcttctctcttctctatcctctctctcccctcttctctctatcccttccctctctccggccgatggagtagggcgagcggcggccgtcccggggcagcgcctgcacgagctgcgactcgaggcggcgcatgaggcgggagttgcgccgcgtgactgctgcgtacgcgtcgccgccgccggcgtcggcgtcgttgcaggacgcgctcttgggaagcatgccggcttgttgcaggtgcgcctcgacgccgtacgactgctcaactgcagcgatgaccctccgaaggttgtccagcgcctgcagcaggtccctctggaacaccgggtccgtcaacggcgacctcgccgcgccggatgattcgtacaatgacgacgacgatgcctcggacggttggtatcccgacgaccccatcgacgacgacgatagttcttgggcaataagctgcttgtgcaatatgctgccgagctacatcacataataattctattatatgactgtaagaatcacagattatccagagagggttcaaaatgaatttgtatttactctcttatttatgtatttcaggctgaaattgggaggcagacagcatcagaacgtcaatgggaggtctacagattcctccagttcttgggagctcagaggcgacgcccggcggcggtagctcgcggcagcagacgtcggcacgtcgttgtctaaaccatagctcgatccatcatccctgaacacacccatgtcgccgctcatcggccgcctggttatccgcgacatcggccggagttcgctgatgcggctgtgcatcggcgagccacctctctcttcgcccgattgctcgccgcttcttgaaccagtcctaatgctgccccgatcaaatgctgtgtagggagccgagctggtccgcaccggcggctactcgccgccgccgccgctcgccgcagcaaggggagggagtagagagagggcgcaccgcagtgtgcgccttgccgacccgccttcgccgctcgccgcagcaaggggagggaggagagagagggcgcgccgccgtcgcgccttgccggccggccgccgccgctcgctgcagtaggggagggaggagagagagaggggggacagggatttaggaagagagagtagagagagattgagaggatagagagaagagggaggagtgaggatgacattggggcccacgtgggtcccaccatttttattattttgtgtatgaaactgacatgtgggtcccacatgttttattatttttccggatcgaattgccacttaagcgccacgtcattgccacgtcagatgaagaccgagtcaaattagccacgtagacgccacgtcagccaaaaccgttatcaaaacagccgagagacctcgtttactcggttttcgtaagttgggggatgggttatacctggttttgcagtttagggacgaaaatcagactgggtgacaaatagagggacctaaagtgaacttattccttgtgtcattgtgggttatgttcactttgggaaaaaaaattagataatagaaacaattttgctatatatttgtcgataaattttcttctaaattttgacagatataattacagtacaatcatttaattatactgtaacttggatgtaattacactgtaacttgtatgtaactataatattatttgcatgtaacttttacatgattttgaacagttagatttgtttcaaaatttgtacaagcgaagaaaaaaaaattgtttcaaaatttatacaagtgaagaaagaaaaaagccattgtgcgcatatatgtgagaggattcgttcccatgacctccgttttcactgaaatagtatgttacaaagaaaattttgaaagttacatatatgttacagtgtaattaaatcacgattatactataattacatctataaaatttttaggataaaatttgtggacaaatgtataggtgatctgtgagactatgtaaaactaatattagaaaaaatctcggttcaatgaaaagatacatttaatatataccgtgtttcttttcattcgtgatatagaaacgatcaagctggtttgattcttttttcaccaccgaaacgtctacggtgacttcgtaaacctttagataagttcactcggtctttggaggtgctcattttggggcgcgggggggagggggggtgtacagtgtacagatttatatttttaggggtaagtgtccgcgcgtttatatgagtgcctatgtttcaccaaggaaaatactccatgtgactttattaatcttaaaatatcctagtctagagatagtatatacgtgcatatcaatttatgaaaggtgagtgtacacgtattatataagcgtatgcatatgtacatccacgctacaggcatgtacatgtaaatgcttcttaattctctattcaacacgtactttagggatgggtaaaacagataaattcgtaacatgacgtagaaatatagaattaacgattgtttaggtgagaccatcaaatgttcaaaacaatcctcttggagacgacgaggctagttagcttttgtgtggctatgaatttatcgatcacgtttggaaatttgcaaggataactcgtagagttggctgcgttcgtagccttttcccggagccgacaaggcaaagctccggttggatacaccctacaccaaagcctcaaaggctatatggaatgtttatgctacctacaactctataagtagtggtaatatattgtaaatcgtccattttacgagtatgtttcaatatattatatatatatattatttcctttatatatatataggtaaattaactagtgctacatggagtatgggctccaaaatttaaattgagtatatatccaatttaaatgagtataaattttttttaaatgtttagatatgaacattaacttctttactaacaagttcaaacaagtttgaactgagattgaactttttttttcgttagattttggttctaggtatataacatccaaacatataattcgttaggtatgtaataatgaattgtgaaataaagttgagtttgagttgttttgttattaagtatttgtatgaatcgaattcatatacctaggtatatactcacaatttgaaaattttaaaaaatttgagaaaatttgtgtgttttataccttggagcccgggtaccatggagtcccatatgtgtatcatataaatatatatatatatatatatatatatatatatatatatatatatatatatatatatatatatatatatatatatatatatatatattaataatcaaaatttacacagaatataagtatttctggacactgatttcaatgcatcgaatctaagaattttttagccaattaagtgattatgagggaatctaagcgattaaaaattcaaaaattgatcgttggagtgaatgcagggatatctttttaactcttattcttcgctaaacaacaaaaatacgaatattttcgagtggagagggtggaacttttaatatccactccttgttccacgaaaattaccttattggcttattcgtatgtgtagcgtgtgcgactgtgcgctctttttataaataaagagaaaaatatcacgaaataaaacgatctcaacaccatcaaacaatgtcatcaccatgtcgctacacatgcatgtaaaggtttagttttttttgctggaggaggcaagacagtaagaacatgcatcctccaatccattattttctttctgatgcagtcattctaaaaagacgaacaagttccaagatttcaagtgcattcaaatcaccaaactttccgatcgatctccaccatcatcttctagtcatatttttcatcgatcccacaatgatatatcaccacgtgcatcgtttcccacaatgcatatgaatgattttggagcagcggaaatcgtgcagaaggaatacacggctccgtcagcggtttcagctgttagtgagttctggcatgtgctgtgtaactgttcagccagtccgtggttggtttttcttttcttataacccgtctagttttttacttctgcttattaaaaatataattggcagctctcctgccggtttagtttaaaaaaagaatgtgtggctttgcataaaaatcgcagaaattcaaacggatttgctataaatgtgtcgccagattttctaagaaaaaacagtcgaattgttgcccgtacgatattcatcgagattcgcgccagtgcaaaggaaaaaaattcaggcgcagtggtggggagtcgaactctggtctcttcggtcttagacagagtgactaaccaactcagcataataggattaatgatttcaatgccaaaattaagttaaaattcattcacgaggtacttacagtacttactccatacttacatatcacttacataccacttacaccacacttacatatcacttacataccacttacaccacacttacaacgtaattacataccacatacactacagttacaatgtaattatataccacttacactataattacataccacttacattactagttatagaataattacattgtaatttttatgtgtttttaatcatatggtttaaaaaataaaatacgtactagtccctaattaatcataaaagggtgtacgtagttggaggtccactgagtcgttaggtatggattagcagtagagaaaaatccgactgcgtttgggttcgttttatggcgaatgatttgtagatagtcccaattcaaatagaaacagaaagacatattttccgatacctttctttacgaaaggtgccaaacgaacatctctgaaccttcttttgtttttcctttgaatggcatctctgaaccttttgtgttagcttaaacaaatcatcatcatcatcatcttgatcaaatgtttggcagagaacaaagtacatatcacacgccaataaggtcgaatccacaaagggatttttggatattgttgacatggaaagacgagttaggagcacaatcacacacaacattcagaggagtacgaaaactttttccaaagggaaaaaacatccacaagaaaccaaaagaaaagagagaaagtagaatgcaattgaccaacaaaactacaacagcacaccaagagaaaaaaaaaaggaagaagaaagtagcacacacagatggtttcagcaaaagagttttggtgaaatcctagaggttggcgctgctgcagcgtcagcagcaggaggaggtgctgctttggagaagccaacttggctgggtaggccaaggtagagcattctttttgtctcttgttagagtggcatcccctgcacttatgcaccccaaagggggagaagaaaaggcaggcctagcagtggctgaaaaattgggtaaatgcatagctatctatatttttaaactctttatttgaaattttggaaatgaaccaaattctaattggttggcttcgttcggaacggtttttttgttggtgggcttataccggcatgcgaaataagatgggtcattagcatgtgattcattcagaaactattataaatgtggatatttttgttttatttgaatttttatggaacttctatataaaaagtttttgtacaaatacaccgtttagtagtttgggtcttcaggaaacgtactcacggacaatgatggagtagcctagccgagaatccaatcaaaatgcagcctttgttgataaatctttagttaattcaatgttttagagctcctctgttgtcaaacaaaatcactgcataactcaaaccatatatcttagtatgtcttttatttttgccaattacatttttctctaatttatactgcttccttagtgtagttttggtcacatactgactttggttttgaacccaactataaaaatgtgagaaggataaggacaatgttcagcttgtatgcaggaattccgctgacaatagtcatacaaaaatttatcatcatggatggagatttaattagcgataggatttcgtgaataatgttttttcatcctgtgttagttggttcttgtcttcacattgaatgtgggatgtagttgttggtgctgcaaactttatagtaataattacttatttcttttgttaaaataaagatcaggtttttccatcatctagagagagaaccctagtgaacattttgtaatgttgttgtctcatcacaatacaatcatatatcgctctttatatgttactactactaagggttgcttgcttgatagacacaatttatctaagtttaccatagcttaagttagataaattgatcaagatagacacacgtttgatttgtagccacatttatgataaatttccttttttcgtcccatatgcaattgaaaagagagagagagagagaaggcaaacttgcctaaaactaactaaagtatggattcagttttgttagccaagccctttggcaggtcagtcaaaacaaattatgacaagcttagacaaattaaggtcttgtttagtttccaaacaaaaaattttcaccatgtcacatcgaatgtttggacacatgcaaggagtattatatatggaaaattaataatttcacggattgcgtgtaaattgcgagatgaatattttaagcataattgcgccatgatttgataatgtggtgctacagaaaacatttgctaatgacagattaattatgcttaataaatttgtctcacagtttataggtggaatatgtaatttgttttgttattagtctacgtttaatactacaaatgtgtgtccgtatatccaatgtgacacgccaaaaaatttcgttcgcgaactaaacaggccctaaggtggtcagccaaatagccctgcaactttcacagccatcgcaaatgtaccccttgggtatgatttgggcgaattttggagcctgaagtgtggcctgtttggtacagctccaactcctcaatttagctctaggagttgagtctggagtggagttgtggagctgtctaaacccagctccataactctagtttattttgtgagagagctccacacagctccactcccagttttggtggagctgaaactgtttggctgagcttcagctctacgaggggtggagctggaactggagctatgccaaacaggcccatactatgccttttgtttggtcaatcggtctcacgcgatgcatcgtcacactcacaaatggacttagcttgcagtatggtcagccattgtctatcagtcaacatgtaaagctgtagcttcccattctctgaaagactgaaactgaaagcgcttgctttgcttgagatggatgcactttcatgctgtaataatacattgatagtaaaaccatagaccgcgcagataccacctgctttcagccagccatcaactgatcaactacctagccccattcagatcaaattggaaaccggaattgagctgtttcctgcgaaattcatgtacatcttcccttacaaagggttattttggaacaaaggattttcatatgaaatttgtaggattaaaatcttatggagctatttgatttgaaggatttggctaaaaatctcacagaagtccttaatttcctccctttttttttgaaggatttcaaacataagctcgaatcttatggtatttttacctttcctctcaactctatattaataatattttccatatgaggtatgcaaacaaactgtttcacaaaaattctcgtgtgtttcaattccttaggattgtatatattaggagcgatattctggtgctctctaatgatagtattatactattgataaaataatctgaatcgtttgttattaaggataaattagtattttaccaatacagtgattaggggtaactttgtcatttatgtttgttttcctagctagatcgatttgtgatcatccattacattggcatcactcatattccataaaaaaagctaaaaagaagaaaaaaaaggtctagccacagctaaatgacgattatacctctccatatatattttttataataatatctctacgtttctattatcgttagatgaggtggtagtgtaattagttctgaacccttcaaccaaacatatcaatggttaagattgctttctactagtcttgactagtagatagagcatcgtaatggggctcatatatgttttgactttttctttctacgtttttttccttattttttggatttccagttcctgtgttttaaagtagctataagagccagtgaaatttcacccgttgataccgcatctcactgtgtgtaataaaccagcaaacgtactccctcctccaaaaaaaaaaaagacaaaccctagtttccgtgtccaatgtttgaccgtccgtcttatttgaaaaaattatgaaaaaaattaaaaagacaagtcatgtataaaatattaatcatgttttatcatctaacaataatgaaaatacgaattataaaaaaatttcatataagacggacagtcaaa

SEQ ID NO: 56986 - DNA, 5396 bp, Oryza sativa
  unsure (1)..(5396): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatagttaagagcaggtgagccattctcactgcattattgtcccgtgacatgagctgcagtgtttttcttgtggatccactttgtgcattcaaatcccatgccatgtagcctcaggtgcacatggatctcaacaatcctctgttttgtgtagaagcctgctgctgcgtcccgtaattaagctcagattgaattattgatctcctctaccgccaaaatgcgtacaccggtgtttaaatgcgtgcagccggatgtagttgatgcagtctgtattgggtactctgcagtacccggtttgccgtgtgtacaatgtcacgctggacattggttaggccctctttgtttaggcttaggcttattggcctagacttttaagttagcttattggcttatatgatttataagccggtggatttaatgtcctaagtttagtggttgagccatacatctacctcacataagcaaaaaaaagcttctccaacctagcttttggcttaatagtgttagagtggcttatggcttcaaaaaagacaaacggaaaagctgcctgtttgtttaggcttagacttttcgacttataagttgtcttataagcctagccgatggtcctctcctcccccttttttgtgaactgccagcaggtgacctatgataaagagaggtcgatgcatcatgtcctgtttgcatctccatgactccatgcgtatgtacagtttctgcttcaatgctgcaacagataatgatggaagaggtagttggaaatgtcctgttattaacacgctgataatgatatggttattggatcggtgagacctggttggctggttggctcacaaggctcaactgtcaaatgcaggtgatctcaacggtaactgatcgagtgagctcgcgctgcactgcaactgaaagcctggggattgttactgattggcgatggacctggagacagagacagtgacattcgcgtgcaacgtactactcctgcttaacctctggagtagggcatcatcaagcattaatcgcctcctttccaacacgtacaattacccccttggaaatcaatcagctggggcattcagatggataaaatcaagaattgtttggctgaggaatttcacgaagaacaccaaatgtttgtttggattaggagaagtacagtactacgcactatggagactttggacaggaaaacaaggttcgccttggaatggacggcactacggtctacgacaaatctggcgtggcaccatctccgatcagccatttctgaattcaaaaaacacatagccatatgtccgggtgtttttaaggttgtgtttggttcacactgaagtttgaaagtttggttaaaattggtacgatatgatagaaaagttgtgtgtatgaaaggtttgatgtgatggaaagttgaaagtttggaaaaaaaactttggaactaaacagggctgttcacgcaaaaattgaaagtttggttgaaattggaacgatgtgacagaaaagttgaaaatttgtgtgtagaaaaattttgatgtgatgaaaaagttaaaagtttaaagaaaaaaattgtaactaaacagtcgaactgttgaagttatcatcggaatagcagcaaaagcctgaattcaaaaaacccctctagtcctttccactatccgtctctctctgactgcagcggatgtcagccaaaaagccgtaaaaaagtcccctgctggcacgcagacgcagccacgcaagcccggcccaattcaaaatggctgccaccctcaaacggtcggatcccaccagcagccaaagcagcgatccccaccacccgctcccccgatccgacggtccagatcttcccccagaattcaaaacctcgtttgaaacggcggagcacaacgcccatcggggccaatccagctattgagtgagtcctcgtctcctcgggaataaattccgaaactcatccccaacgcgagggcagagggacctgtcgggcagcggctacaactacaagagaggaagagcgaggctgtgaaggaggaggaggaggacggccgcgtggggtgagttggtgtaatgattcaccaatcctctctccatagctgaagcttctcgctatgatgatggccggcgcttgatggtgattagcgtctcgttgatcgcagcagcagcagcagcagcaggaggaggagcggctattcttctcggcgcgctggcgatcggcgtcgcttcgaggagggggagagcggcggccgccggaggcggaggagaaggggaggagcggatcggaggtaactatagccagaccttgccttttcttcccccctcgcgtaattcttttttttgttactactgtctttacgcctcgctttctttctcgctcgtgctcggttggtacgcttccaagctaagcatccgtttctctcgcctccacctttcnggccgccgcctccctttctccgcngtgttcactttacattagatcctctttaactttcttattttttttaaaaaaaaatcaactctcagactgatcgagagatcgatttgagtgagctctagttttgaaaaccacatataagagataggtttccttctctagagtgttcgccggcgatgccaacgccgccggcaacgacacggcacggcggcggttaattccgtagctttggaggggtagaaaagtcacttcacctcacctcaccccaacccacccacccgctccccccaaacagcgccgttactgcgtgcggtccagttgtctagcgaccaccacccaatgacacctgggccccgcacgacagatccccgactttggatgccaaaaacggcggggccccgcaccctcgccacctgtgcgtaatcgagtactagtccgttccgatccgtgggcccgatggtgtgtggcgcttcgggctcggtcggtttgcttgattcggctcatgatgcggtccggccgtgtgaggctgacatggtgggccccacaaacccggtgcgcgcgccatgccaagttgccacgagcccccacgagcttttaatccgtgcggaaaaaagtggttggttgacgcgaaaaggcgccgtgtaatcgccaggtcgcatgcgcggtggccgccactgacgtgtgggccctgcccgtcctttttttcattcttaacctttttttcatttactttcgtagctaaaccatggttaagttgttaattatactaccaataatctcgagtcagtcaaggtggagtctttttggttctttttattttccttcgatgtgcatgcgtggtaggttagggttcatgataaaaatgtgtaaaagcatcctggtggagttatatatggctgcagcttttgacaagaactcggttcgtttacgatacgttcccccacgcaattatttcgccatgattcttctgtgttaagaaagggcgagatctttgggttagaatacaagaaagtcgtgtgaaaattgtgggcgattaaatcttcccctttcgcaaagcttgtcttaagcactcatctttcgctttaaatcgcaatcttttctttcagatcaaagcaaatactaggagaactagctaggtagcccgcgcaattgctagcacccatataaaattatatattttttaatatgattttacttaaaatttatttaatagttatctcgttgtcttgagatttgaaagatcaaatcttatcatcctcgtgtttctaattttataatttttctaatagtataagagttttaatttcagtttttctttaattgtgagaactgcgtcgcatgggccagtctgtttagttgagatgtaacatgcagaatcgaatgctgtagctcacaacagtatacattagttttagtattcaatccacttgttgatttcatccacttttcctttcggttgttctcattcactctccaccaaccttgccaccattctgtccagtcaaaacttgaatttgttaaaccaagcattgataatttgtcagaaaattccgggaattttgaataggactttttgtacccagcacgtcgtttttattctttgtcacgagcatttacttctccggaattcacatttcgatccagagaagaacatcgggctggggcactgtagcagctcatctcagtggggcgaatggttagcggtagctttccaagatcagatttttgattcgttttttaagtaggattccttgcccatgtctgcttctagcttcttctcggctgattgctcttttttcccagatttgtctgcttcgttcttggctgaactgagagtgagcactaatctactccatactccgaacactgcagatcacgaggtgcggtgttgtagcttcgaccgaggaatgagcttgcattgctgtccggcggccggcgacccgccggcgccggccgggacggcggaggagctgctggagcgggcgcggtcgctggtgccggcggcgctggacgcggcgcgcgcggcgaccggcttcggcggccggtggaaggttatcgcggcgaggctggagagggtgccgccgtgcctgtccgacctgtccagccacccgtgcttctccaagaactcgctctgccgcgagcttctgcagtcggtggccgccacgctcgccgaggccgccgagctcggggcgcgctgccgcgagccgccgagggccgggaagctgcagatgcagagtgacctcgacgcgctcgccgggaagctcgacctgaacctccgggattgcgcgctgcttatcaagaccggtgtgctgtccgacgcgaccgtgccaccggtggcgccggcggctgaggcggcggcgcagacggatgtgcgggagctgcttgcgaggcttcagatcgggcacgcggaggcgaagcaccgggcggtggatgggctcctcgacgcgctacgcgaggacgagaagagcgtgctgtcggcgctcggccgcggcaacgtggcggcgctggtgcagctgctgacggcgacggcgcccaagatcagggagaaggcggccaccgtcctctgcttgctggccgagtccggcagctgcgagtgcttgctggtgtcggagggcgcgctgccgccgctcatccggctggtcgagtccggcagcctggtcggccgggagaaggccgtgatcacgctgcagcggctgtccatgtcgcccgacattgcccgcgccatcgtcggccacagcggcgtccgcccgctgatcgacatctgccagaccggggactcctactcgcagtccgcggcggccggcgc

SEQ ID NO: 56987 - DNA, 2965 bp, Oryza sativa
ggacagcctggtgtcgctgggcgtgctcccccgcctcgtccacgtgctccgcgagggctccgtgggcgcgcagcaggcggccgcggcggcgatctgcagggtgtcgagctcgtcggagatgaagcgcctggtcggcgagcacgggtgcatgccgctgctggtgcggctgctggaggcgaagtcgaacggcgcgcgcgaggtggcggcgcaggcggtggcgagcctgatgagctgcctggcgaacgccagggacatcaagaaggacgagaagagcgtccccaacctggtgcagctgctggagccgagcccccagaacacggccaagaagtacgccatctcctgcctcctcacgctgtcggcgagcaagcgctgcaagaagctgatgatctcgcacggcgccattggctacctcaagaagctctccgagatggacgtcgccggcgccaagaagctgctcgagaagcttgagcgaggcaagctgcgcaacctcttcagtaggaagtaaaaaccgaagcgaacgaccaccagtagcagtaagctagtagccttcctttttgccgtaaactgtataaaaatcccgtgctgtttttcatagcctctatgaagtgtaagtggggtgcagagagcatcggcgtttatctgatctggacataaacccgttgtaatatcgtcgccgtctaattccgctgtgtatggaactctgaatcattgcagtttccgtgtcagtgctaataatcatttgcaatgttcagacataatcatttgcactgtctttgcagttacatgaccacattgtcagtgttcatagcacagaaacacccaagctcttgtaagcagattgcatggttgaagtactgctactaatcactgtcaatggctgcaggtatcttgttataagcagattgctgggtgattatttcagagtaattggggcatgatttggacaagtctcaagcaggtgaccgcaccgcacgcacgcgccaatgatcagtgtactggagtactggtgaatgggtgatgattgtgcaggtaaacgggcgtaatccgcgagtgttacgcggctggtgatcggtccccttcgccttttgctacaggtgacgggcgatcaagtgatcaacacatgcgttgttgatccgggaaaaggggtttgcttggcccagcgagaagacagatgagcgagtgatggctggtgattgagcaccgctgcgtgcgtcgattccgaatgcttgtctcatctgccacggcagtaaaagccaaaggtaaatatacctcatataataaccagagatgtgatatattagtactatcataaatttgtttttcacaatcccacgtatatcaatataaaaccaaaaagacttagaatattcatactctatcaaaatctcaatgcaattattcatcactttgtatactctcaatacaatgattttctactttcacaaactccgatacaataattactctaaaaataatcttattttggaacaaatgaaatgagcttaaaaataaatttatcatgggacaaggaagtaacatttaggtaatatttttttagatgatttattgaaagaatttttgaaaaggcactattttgtcctaaaaaaggtcaattctaactataaacctgaacatacatgtatccaggttagctaagattggattttttttatagggcggtttggtacactgcaagatgtaaaagaaagatttgcaatgtgatcgagtgtagtaaacgtataaaagaggataatatgatatattccctctgttcttaaaatataacaatttttaatattttaagtttgtcccaaataaaacctcttcactgttccattcttaaccagtcacagttttcacaattaaaattctccatcactcttctctcctcaaccatcataaacttattctatttaatttcacgtattttcttaattaatatttgtatccttacctaaaactccttacattttaagagagaggtgatattatgtacttcctttatttcaaaataaacaaactatataggatatgccatatttttattattattatgaatgtttcagggaccacctatacatttgtcgacaaatttttttctaaaaatttgacagatataattatagtacaatcgtagtgtaattacactgtaacttgcatgtaactacagtgtaacttgtatataagtttcacgtaattttgaatcgttagatctattacaatatttgttctagtgaggaagaaaaaaaatcacaacacacacatatgtgaaaggatttgttcccatgacctccattttaccgaaataacatgttacggagagatttttgatagttacatacaagttacattatagttacagtgtaattacatgcaagttgtaatgtaattatactacgattgtactgtaattacatccgtcaaatttttggaagaaaatttgtcgacaaatatatagcaaaattgtttcacaagaactaccacacgtgccgttccatcgaagcctttttagcatctgaactaacccactacgaaatttcagggcccaaaggccagcaaaccgcggggagatctcgtgggctagaagaccgtagctttatccggcccattccagaaaagccctgcaatacgacgtacgcaggtctccgtgccggtgtctgtcctcccgcgacggcggagacgtccggccgccgccggcgaccgaagcttcaccgttttccatcctaacccaccggtaaatcgatgcccttttcctttttcattctaccacccaggttgcttgcccgtttgaaagggctgaatagatgaatggatgatacattttctgaatttgttacaatattttagagtataaaagcatgaattaatacaagtttaaaaggttatcttagaacaacatattacaaacaatatatatatatatatatatatatatatatatatatatatatatatatatatatat

SEQ ID NO: 56988 - DNA, 23153 bp, Oryza sativa
acaaaaactttcaaattttggataaaaattctgaaatgtcagactttaagtttttggccaaatgttgaatatttacaatcttatgtttatgatatggtattttggaatttttgtccatattttggaagtttttagctcagggtattttggtcatttggataaaattgtacagtactaacgtagactaaccggacggcgatggtaaatcataggggttaaataaaagtcgatggcatattatagaacgcgataaagtcagtagcaaatcgtagagctgtgacaaactcagtggcatataatggattgtctctgtaatctccgaaccccatgacggcttgacctatttgattttgaactgttttctttggcagtgcgcgaatgattctattgtttgcatcactgtttacactgagcgcataatgggagagttgcagcttttttttaagtgaaagtgctgttacagtatcactagccgtttgcacagtactcctcctatactttttttttttttgaaaacttttgttcctgttcttgggccagataagcccatgcattgaacatggatgtgcaactagtgacataggagtatcggatatggagtatttatataatagatgtgcattttacacatggatgtttatgtcaacatctaatctcactaactattctgatcatgtagacctagcagctacaacatgtaaaacgagttgattctaaatcgaaattaagtagtaactcgaactttgtgaagtcatttggtcaattttaagaggtttgacaagtgtcagtacaggcgtacagaatctgttaagctcagcagcggaagtctaccaaccgaggatttgatgccaacgaggcaatgagctgtatagaagtgcaaatggcaaccattaactttggtttcatgacaccaaaattgggttttttgaactgtacctttgttcattcttctcatccaactttcctgcgaatttatttatttttcattttcgaaatgcaaactgtttcttggataagctgacaggagtcacaggaccttatattcttgcccatcacaccgaatcaggtatgtgcctcttgctaaaccggtgatggcgaccatatgaggtagactggcgattttattgataatctctcctacctgcaatggttacctgtttcttgcattgcaactttgcaactgatagtatcatgtatggtagtgtggcaacttgcatgatagagtgatttttactgtgtttgaggagtaaccaataattttttttattaatttgtggctcctcatctctactctaaagagagaatattatccaaacaaatctgcaaagatggtaatctgctatatgcgactaatcgttttgtgtggacctaaatgatagcaacatctatctcttttctgttgttgtggggcaaggtgtacgttctgccaaaagtatgaaggagacatgatatcgcttgaaaaaggataaaaagcaactgaatatttcagtacaacgctctgttttataaccagccggactcagcctttttcactctcagtattgtcactgtaataagtttattatatgattcagccgaatatttcctcctgaattttttctttccttctccctggagcgtgtggctcatccactacgtataaggtgacaaagaaaacaatatcatgctgaaaattctatcatgtattggagaggcatattagcatatactacatatcagaagcaaagttcaggaaattctgtcagatgcagcctgaaattttatctctctcataacaccaatatatacaactttcagcaagttctgaagtaagtctactacatctcaaagtctcaaactactatactgttcttattgtacaaaaaaggaaggatgaacagccgaatagtcaaaagagagaacaattttcacgaacagacgagttcttcagaacagttaagaatcagttcagctctgcaggagtacctgctgcctccagaacagttaagaatcagttcagctctgcagggagtacctgctgcctccaagtccttcacagcatcagggccatggagttgaagctggagaagcggctgagcatgtcggcggaggtgaagctcgggtgggtgatgctccggtggaactcctggagcctcttgaggaagaggacgatccgccggcaaggcacgaagacgagggtcagtgggatgagcagtatgcctagctccatcaccggcatggccacagccttcactggtcgatggctctattcaactctttggagtgtggtgtgcttctctctcttggtagtgatgtggtgtgcctcaagttgtttatatagaggaaagtgttgccattgccacccaccatgaacttgtttggacattactttcggttgtggggagctgaacattatgatatttttattccttgtcatgtatactgcctttatcccacatggatttactatttcctctgttcgtaaatacaaggaatgcacctagaaatgcttatatttatagattgagttagtaggatcataaattatgaggaattttacagtttttaaaaagtaccttgaggtatctaaattttacactaaaattttaatatcttgaggtacttaatagaggtaccaaattttacacttaaaaaatatggtacctctggtcctatagtacttcctcaagaatggtaaaaattactcatagcctatagcgcaactataactctaacacttcaacgttgttagaatcaaattgaaaggttcgaattggctcatgaatcatataggtagttatctataccacttaaaatgttagtagtggtggtgtctgttttcacacctatcactgatatttgggccccacaatatatactatcacaccaactttcaatgagtactcccctgtttaactgttagctctccccaaattttaaaaccaccttacttattcaataagaaaaaacatagtactatttgaactaaatgagtacttattcattgatttaataagctagagacttttttttcggttacaacgcacaagctcttggctagtatatatagacaaaatctcttattttttggagggggacattagtaatttaggttcctgcaattacggattaatcattttctctgctactgttaaagcggagtcgttgttgtcctcctctccctaaaagaacaccatgctgaaaaaacaacccacccaaaaagcaatgtatttgtacgaaaatcaacatgctacttgccagaaaaactgaatagataaaactaaatcctataatactattcgtctttatttctttcaatttcattgtaaagtacgtgcatagcactaatatcaggaaagtatggaggagtagtactaattgtaaactatccatatggatttttttggataatggaaatggattacatctccggcttctgtcataagacacacaaccataagtttaatagtaataaaaaggtaagataaaagtaaatcaaatgagaaataaggtgatgggacaaatccccaactcccatttattattgactagcgttaaaccatataaaatattttagctagcaattcttatggaactacgtcacctatagtagaataagagacccttggctaccgattctaaaagtgtagcaccattacacatagtatcatagtatcatgctctatccatatgaatttatcctacggtatgttcattacatgatggactcgtcagtgagcatctagctagtcactagtcagttgagatgtacattcagaaaggtacatgtcgatattttgcgaatcatctgacctaacagttgtccctaatcatgcttatattaacatgacgagctagcctgtcagtcttccctagaaatgatataaagtcagaaattagtaggcagtgttttgtccacagctagctttatagcttttcaccgttactagtagtattgtcttttctgttcgccgtagccattcagacattcaatgatgttattataccttctcattttgttcagactcactgtctttcttttgtgtttgccttgggtgaagttgttagttctagaagtattcttgcataaaaaccgttgtagcactaactgtgctgccaacagattgtgactgcttttgtatcttatttatcacagttaccagccaacagattgtgattggatcaatacaagcaaatacagtcacattctgatctctctattcattggttcttcttcagattacagctccactttgctgcggttcggttaagagtagtagtttgtttttataactgtgtttttgggttgcacctaaagctaaaatcttccatgttccaagttttttttttcgattactcaaaagatgcacgcgcacacacataccacagcacctactagtgagcctacacatgctcaaagacatactagaaataaaaacggagcggatacggacgaataatactcataccatatttgttatcacttttttttaccggatatgaaaacgaatacgaatacggatagctcgaatacggaaataaatacggattatctcgaatacgaataaaaatcgaatatgatcagacataaatacggaaacaaatttttctcagagtacgaaaaccaactcaacttctaatagaaacaaatatcaacttatataattagctcattttatataaaatgaagtataatttataaatatttttaaaaatttaaataatattaatagtatggactagtgttaagagataaactactattaaaatctataaagtcatattgaaggttatagagttagaaagaaatgggatatgtcttatggcttctgcggatatctgaatagcactgttcaccggatatccgaattattatccgtatctgacggaaaccccgataccatatccgggagaaaatatccgtattcgtatccatatccgaaaggtatccgtatcattttttgttcggagcggacggaaactatccattccgttttcatccctagagacgacgattaatcttttcaggtatacgcaaggagcctttttttttaattaagaggagtaaaaagtttgtacaacgaaaccaaagagcagcagaagacaggagaactggaagggggggactaaagcctaatctcgcgaagaaagactgtgacctaaaagctcctagcaactagaggcgaaacaccggtacagcagcgttggctaaccgccacaacgccgccttgtcgaccattcctctggctacctccacccaacttttgtgctgctgattgaagactcgattgtttcgttctttccaaataaaccaacgattaattactgcattaacttaatttctattgaaagcccttttgtgtgtactgtgcagtagccacataccacttttgtttatgtaccttttccctttttctttgcgtgtgtgacacttaatttgttaaatgctattagttggaaaagcctgtccaatattagccaaagcatatgtctctttctgcacattctgatccacctaaatctggatttgcacctctaacgatctcatcgattgttctctccatcttacatgcctacatcacatcacacagtatcatacaaagcttggcgcatcatttcggttacagacgatcaagcgtgaggaatcatttgcagatctggaggtggcgataacgtaatcccttttctgaagcttctgttgctgaaacaccaactcttgtaccgatctggaagctgcatgcatctggcattcatcctacgatctccatgcccatcgatcttggaagatagtgtgacatctgacgccgatatatgctaatatgcatatgcctctactccaattttgccccggcaatgatgcggctacctgtgaccgtttcagtcttgttacctgatggattcatgtgagaaaagaaaagttttgcgagaaacgcccagggatcttccggcttgcttcacaaggtggtgggctaaataacctgggttcgaaacatcactctttctaattatttgatacggatttgctatcctactgtcgacagtttttaggggtgaaaactgtcgaatttttaaccgtacgatatgctttgagatttgtgctgtgaaggaaaaaatggaaaaaaaaattaaccgtacgatatgctttgagatttgtgctgtgagggaaaaaatggaaaaaaaagtttttaggggtgaaaactgtcgaatttttaactgtacgatatgctttgagatttgtgctgtgaaggaaaaaatggaaaaataaattaaccgtacgatatactttgagatttgtgctgtgaaggaaaaatgatttgtgttgtgaaggaaaaaatggaaaaataaattaaccgtacgatatactttgagatttgtgctgtgaaggaaaaatggaaaaaaaacctgatgcttgtggccaggattgaaccagagacctgcagcttgcatgctcgttcaactaaccaattgctccatccaatttttcagagttatatatgagttacatattacttatattgtagttacatagtagttacaattacaattgaaagtttttcattaaaaaaatgtcgaatgttgtatagctactccctatttgatattaggtcattctctaatattcacgtctttttaaagaaaagttttgcagctgaaaactactgtcagcaatgtgaccaaggcaccaaaccgtgatgaattttcgttggaagtcggtgagtgatgttagtgtgaagtgtgcgtgaagtcacagtgatgagtgggtgagtgattggttaatacatagccttataggaagccatgttagggtgatggtatccgggggcaacgaacgtcctcctgtctggtgacacagtgtactgatcaggagtgagcgcgcatgtgcggcagcagatgaggcttactccttcagtcaaaaaaaaaaaaagaaactctgagtttccgtgtctaactttaactgtccgtcttatatgaattttttttataatttatattttcattgttgttagatgataaaacatgattaatattttatgcgtgacttgtctttttaatttttttttataaatttttcaaataagacggacggtcaaacgttggacacggaaatcagggtttgtcttttttaggacggagggagtagaactcaatcatgcagtacttaagtaactacttccactgctctagaaaaaaaacaatttttggttatgtatctatatggttttttccttaaaaaatattttctggttatggatctatatggttttttctgggttggaaggtgtagcttatgtgctgttcaaataagttcggcaagaatctgagttttaatgttacctgtttgacaaatgattatttagaaaaatctgtttaaattccaggattttatttctgtggatcttgcctgaccgtgggacctaactgatagcaacacaacatattttcttttgcaggataagattggcattccttgtcatagggcataaatactgtgaaatgatgtaggcttgcttgaaaaaaaggagaattggatgaggaactaatcatttcagcacaatcaatgttaaaattttcagaaaatccacattgtggacgattttgccctcgaaggagagagcagaagcacaatggaggtgatgccatgctgctcaatatagcattctgactttgaaatattacgaattcgagtataggatacataaatctagcttccccaaattgatccttagttctctcttgtgcatgctgaatttacaactggaatatttccttcctgtactttttcgatccatcgagccgacaaagaaaacaagaatcatgcaggaatttctctcaggtcaacgagaagatgaaaaattcagtaagttctgatgttcttgtacataagattaagtaagttcagaccacttgagctttgcttatggtacacaagatgaaaaatgcagtaagttcatgtacatctcagattactggagctagcttatggtacacagaaagatgaaaaattcagagagagaactcctttggatcttccaacgaacaaaaagagaaagagatgaagagctacagcacgagctgaattagcatcagcaataatccagcaccatggccaaaagccatctgagtttccgactagatcaaccaagaaaagcacccacatataccttcttcagactttctcagagcacgaagaccatgttgtcgttgagcccggagaatcggctgagcatgtcggcggaggcgcgccgccgcggccgcgtcatgctccggtggaacccctggagctgcttgaggaggagcacgatccgccggcacgggacgaagaagagggtgagcgggatgagccacacgcccagctccaccaccagcatggcagccaccctaagctccctcgagctcactcaaactgaaactgaaactgatggcactgcagctgttttgggttctggagtgtgctttcctctcgcttaattatgcttcactttgcttatatagttagataactaactagatagatgtcgctaaagcctttactctacctcgtgtttgacaaattgacagcatcagcagagattcaatcagggctatctgctggacccatttttactaacggttcttggaagaaactggagaacacagattcagagagttttttttaacagagccacagattcggagatttgctctaatggttttcttttacccagtggctttcatcctacatggatatgcttcgtgcttgtccatggtggtagtgagcttcagtgaacaagctatctttcggttgagacggacagaaacatctcgatctgatgcgtacgccatcagctgctgtcgtcttgtcgcatttgctaaaaaaaatattatgatcaagcatttcagcatgtggggtttccaaccacttgatatgagatcagaaatttgtgagtgccgttgagtgtcaacagctagtgtggctcttcacagtttttgggtagccctgacataacctccggtgtcttttctgttcgttttaaccattttactgattcggtaaccctgtaatcttgcattaaccctaataagtgtttctgtcatttcgtcctgattataaaccgtaacgcttatcagtgaaaaaaaaatgtatttttataaatatgttttagtgacttaaaaaccaacaacagaaaataaactacgatgaaaaaccatcgaaatcacctataaaattaagtttaaaatttacattttggttgcagtgataaactgaagagcaaacgattgtgcatttcttttgtcaaccttgttacgactgtttcgtatggtattgtgtacagattcttaggatgcttggataaagaagcaacctccaaaggtagcaacttctctcacagatcaagaactgcccatctcgtttgattggagcaagttgtgtgcattcatattctatcagaaaagggacaaaacaaagaagatcatgggtgttctttttcttcttattgtaatagaaaagtttgatagggaaggttactgataaacattaagatacatctcaatggattaatttaaaggtaaggctatttttttttcactttcacaggtcctgaacctttaatattccagcttaactacccattttcttatatttcatccggctttccccttgtgatttgagtgttgtatgatgtatcgcattgattaattgttgtttgtgcgctagggtggttgggagttcttgtccggattagctatgcacatgtcccctttggtcacaaatattgtactgtatttcttaaccccacgaaattggaatcttgtcaggtcgagttgtatgaatgtatcatgctcctacttgctactagtagtacaattccttcatttgactcatcctctcagttcagtggaatcattgcagatgaggcccctctgtgttgcgttgctgcacaccaactcttgtgaagttcaggaatttcgcacgcatatgctccaacttctaatacatcagctttgtctgcttgtgagttgagaggaacgggattttacagctgaaacaaccgtgagcttttgtgaccaaaaccatggcgagtttttcgattttccttgggaaactgatggctgatgcgagtgtgaactgtgaagtaacactgatgagtgatgtgtgggtgttgactctttgttcagacagcggccgtgcaaccaaaagtctcgtcctacactctggctgtgtttagttcacactgaagtttaaaagtttggttgaaattggaacgatgtgactgaaaagttgtgtgtatgaaaattttgatgtgatggaaagttgaaagtttggaaaaaaaaactttggaactaaacagggcctgagtctctcagaaaaaaaatcaactttcgctgatgaaactgaacaagtatttgtaatgaggtgatcgatcaggcgaggacacgccggagccggagggcgggttgtcgctggttggagctgaaacctgaactgattgacaaacagtatacctgaaattgtgcatggttgattcatgcttaccagtcttttccctggtaatctggaatgatggaacagaagcggagacactgagacaacggttagccaatttatgaatagtttgataaactgattgagtggaacggcagcggaacatcgatgagatatctgagatttctgtctcaaaattcgtctaggaaaaattgcacagtcggtttttatggcgggattacgggattagtaataacttgtatggggcttcgttcagttcatattgggcttataatgggactcgattcggccttctcactgctgggctcttttgttatgagaaatgggcccttatgggatatgctaagttaacgggctgactgtttctgttcgtagtgagattttaatgggcctcatctacagtgtattggccattttctgaggataaagagggaggagaaagttaactgacatgtgggcccaaaatttatttttattgttttactcactgacctgtgggtcccattaaggtttgtttcaattttagtgccacgtaagcgctgcgtcgatgtcacatgagatgaagaccaagtcagctcgccacgtaagtgccacgaagggcaaaacagctgagagagtcggtttgcaacggttttgaaagttagggaacaggttatgcccggttctgtggttgagagatgcgattcaaccagccgcaagagtttagggacgctaagtagacttattcctgttacgtttgaaactcgacccatagtcgagggatcttaagtagacttacgcccattggtcggcccatctaaacccagtccatcgatccaggcgctggacgcgggcagcagcagcagcaaagtcagcggcaaccagcaaccgcttctgtaggagaggcagcgccgcgggcagccggccggagatggccggcgccggcgccggcgagagcctggacctccccgtggtggacctagcgtcctccgacctcgccgccgccgccaaatccgtccgaaaggttctcgcctgattccggattctgctcttctactcctaccaatctgggaggccgcctgtgagcgcagtgagcaagcgtgattcgtgttggtgtgtggtttggttttgcaggcttgcgtggagtacggattcttctacgtggtcaaccatggagccgagggattggcggagaaggtgttcggggagagcagcaagtttttcgagcagccgctgggggagaagatggcgctgctgaggaacagaaactacctggggtacaccccgcttggcgccgataagctcgacgcctcgtccaaattcaaaggtctgcgcctcatgttccatagccaattcttcgcttgagctttgcagtttgcagtttgcactgctcttctatagccaatttgagcctaaggggtgtctagctaggtaactgtaataatagaagatgacgagttgtgtcggcaaaaggcagaacttgacaaattagtgcctgatgatgaagtattctttacgcgtacaaggctatataagtacattaagaatgtcccaatgcttgtgaatgattccttttagaaatgattacaagtcatggctctggtttgatcgacctgaaggtcgcacaatcttcaattagtacaaggccaatataattcgagatgaagcagataactggataagtgctgaagaaccatttaccactttaacgtatcctctctgcctctagtttgaacagccgatacatcttgtcgattttaccttcttgtgtttgtaatgatgcagttgagacttttgtttgtgatttgtgatccaggagatctcaatgaaaattactgtatcggacctatcagaaaagaaggttatcagaatgatgctaaccaatggccttctgaaggcaattccccctcctcttctttttctttgttgtcatttcttcgagaacataaataaattctttctttgggtatagagaatttcccatgttggaaggagacaatgaagctataccatgaaactgcactgtaagttatcattttgcccatctcagcaaaggaaatttaactgctgtgatgcaatctacaacaatcagtccatcattaattcgctgcatcagcattgtgtttgtaatacttttatataactatttgtctcaaatttgaatattcctatttattcgctacctcttccagtgctactggtaaaaggatactctctctaattgctctgagtttgaatctcgacgttgaattctttgactgcccagtggcctttcttcggttattgcactacccaggtaaccttagtgcgagtccctttataatatgaaattaaccaaagttgcattctaataatatgcagcagagtgctaagttgagcattttcattattgtcgagccaattgagcttcttttcctccttacacaaacacacagtacttattggttttgtatgaatagaaaatatttttaaatgcaggtgaagctaacgagtccgatgatggcaattatggtgcatcagctcactcagactatggagtactaacacttgtagcaacagatggcactcctgggctgcaggtacaccatgttctcacaaattttgattctccatctcagttctgttctcttttgcagctaattgatcatttaaaacaatataggagtatgctcataatattttatgaggatgagattattgcccaccttttaccactttcaagcaaaacaatacctcttctttagaaaagtagaaatataatatgcataattttttgcacttatgttctggtttctctcactgttttgagttttcagatatgcagggagaaggataggtgcccccagctttgggaagacgttcatcacattgaagggtaaataacaaatatttttttagtaaaaaaaacaaatattttttatgatattaatgaataacaatttcatatatatcattgctttgtcttttttagaaaatggattaaaatccggtctctacatccaaactggatgtacatagccctacatcatatgaaattgctttacgccattgctttgttcttagctttctggacctcaattctgtgtgctccttagataatgcgttgtcttgtgttatgtatctgtagggccctgattgttaatatcggcgatttgctacaaaggtggactaattgtgttttcaggtaccatcttttcttacttctgttatcctattctgtggttgtgaggaagcctcatgtactgtgctggctgttttaaataagttcaaacgaactattacagttgtgagtagttgcccccaagaactttctgttttctgcaactcgatatggttaaatatgttagaaggcacagcactttctcaatgataaattggttaggcttgtcaatatcatgaacaagttagaccatgttcgtgtggttccttacaaattcagggtgctgttttatgacattatacacttcttttcctattttatccctatggaaaagaacaattttttgattgttctcgttcttttgctgacttgtaggtctacactgcatcgcgttgttgcagttggtaaagagcgatactctgtgagtaactgagtataactaacacctgaaatcagaaattcataactgagttttagctcctattgaactcatgttgtaaagtcgggtgaacttcttattggtaaaaccaccattgataatatatagcatttcgccaactaaatattgcatcctttttggtgcacgttctttcttacacatgtttttcaatttgtcaggtggctttctttcttcacacaaaccctgatttagtggttcaatgcttggaaagctgctgcagtgaggcatgcccaccgaggtcttcttcctcctgttaagcttagcattattgcagttctttcatgcttgcttctcactgttagaaattgatgcacgttcaggttcccacctataaggagcggcgactatttggaagaccgattgagggctagatacaaataatcctacgttggctgcgtacatccatgttggatgtaaaggccaggttttaatccattttctgaaaaacacaaataatcctacgtttttaaatgtgtaaagcttaagattagtgaacttcagtgagcagctattccgttgagatggacggaaacatcttgatcttatatgtagcccatctgctgttgctgatttctcgcgtgtgttaatactagctttacttatgagcaatcatgtcagcatctggtgaaatttgtaaccgccttcgagtgtcaacatatatttttgctcttcactgttttcaggaagactggacataacctccactgtattttctgttgccaaaacattggtatagagttttttgtataaagattcttatgatgctttcacgattaaggaagacacaaataaagtaactttgctctcagatcaagaactgcccatctgtgtttgattgaagcaagttgtatggtttcacattctgtagtaagggacaagagcaagaaattcatgtgttttttctattgtaattgaaaattttgacgggggaagcgctgatatgcatacttcctgtgtgttctaaagcctgtgccttctacatgttgcagctccatttttgccatagtttagtaagcagcagctctgatgagtgataagtggacaattgatcagctctaatgaggctggaacctgaaatgaaatgactgacaaccagtatccagaattggtcctggtctgttctataattggcttttcatgggcctctcctgtacggtcgtattttctctctgctgggctgtaatcttgtgcgagattggccatgcctttgtaagaaatgggccttagtgggccatgtttactgtagctgggccctgtttgtttgtccagtgatggcccacctgtcagtccagtccgtggatacagacgccggaagcggatggacgtgactcccgctcgggcgcccggtggaaggagattaaaatcgggcgtcagcacccgatttactacgtgtaaactcatttttctcttaaattactcatccaaataatgatccgattgcaccattaaattcattgcaattaaatattaaaaaaacaagactatattccgacgaaaaaaatagcttattattaaattatttttaaatattgcacgatgtttcactaggtatataaaaacaagatcgaaagtgtttcactcgtttaaatcgggtgttatttcaccttatataaaaataaatatttcagcaaatagcgaaagaatgtttcagttcactgcaacattagatctatacataatgaaacattatgagtacactaggtgaatattttcggtggaacagaaaataaaccaaattattttaatagagagtttttaaaatatatgggtgatttgttgcaatgaagttgtgtgggtgtgtggaagtggcaggtgggtccgtgaggagagggagacacgtgggtgggccgcagggcgagcgtccgatcctggcgcacccgcgccggtcgaccgagaactagcattctcggaagcggacagcagcagaagcaacaagcagcaaccacttcccggcgggagaggcagctggaagccggagatggtcgccgccgccggagatcgcctggatctccccgtggtggacctcgcgtcctccgacctccgatcctccgccgaatccatccgaaaggtgcgcgcccttctccccgtggcaatttccgccaacttctgcgaggctccgctatgttccgtgggtgcggcgacgaggaagcgtgattcgtgtggtgtggattggtttcgcaggcttgcgtggagtgcggattcttctacgtggtcaaccatgggatcgaggaggggttgctggagaaggtgttcgcggagaacaggaggtttttcgagcagccgctggaggagaagatggcgctgctgaggaacagcagccacctggggtacaccccgccctacaccgagaagctcgacgcctcgtccaaattcagaggtcttcgccttctattagtcgattcatcgctagcttgcgatttgctgcatgctgacccgtctttttttaatggcaaaattaggtttgtgttaagtgaaattttagagatttgctctggtccaacaaaaagtaccttttggtaccggtacctcacggtaccaaatcgtttccgatcgttggatctaacaatgcccatcctgccagctagatccaatgatcggaaatgatttggtaccgtaaggtattggtacctcgagatactttttgttgaatcggagcaaatctcgaaattttaagcctaaagtgtgcctgatagtactagataggttaatttaatagtagaacgtgaggagctggaatgggatgacccttgtgttagcaaaagacagagcttgacaagtcaatgcctgatggaatatccctccatcccactcactaagacacacgcattttaagatttgactttttaaatatttgactaataaatagtttattatgaattaaattttcatggttattgatgaaaataatatcattgaattgtcatttgaatttactttatatgattatgattttgttgctacaaacgttgtagtatactagtatatgagaaatttaaagtcaaagatagactactaagtttgatagcaccttagtgagtgggagagagggagtataagctaattaaaaatgtcccattgcttgtgaacgatgtcttttaaaactggccacaagccatgggtcaggtttgatacacctgaagatcacataatcttcaattagtaaaaggtggatatgattcaagatggagcacataatgagacaagtgctgaagaaccatttaccagtttaccacatcctcactgcctatagtttgaacaattgatacatcttgtagattttaccttctggtgttttgtagtaatgtagttgagattgttttctgtgattttgtgatccaggagaccttagtgagacattcaaaattgggcctattggagacgaaggttttcagaatgatgctaaccaatggccttctgaaggtaaatcccactccccaccctccaccctttccaaaacataaacaaaaccctttccaaaacataaccaaattctatatttgggtgcagagcgcctgccatgttggaaggagacaatgaaactgtaccgtggaaccgcactgtaagttttcattttgctcgtctcagtgaaggaaattcaataattatattgctatcgacagccatccgtccatcactgattcgccgcgtcagtattgtgtttgtgtaatacttctatatgactgtttcattcatgatttgaatattcccacttatttgctactacttccaggggtactggcaaacggatactctctctagttgctctgagtttgaatctagacgctgaattctttgactgcccattggcatttcttcgattgttgcactacccaggtcaccttattgcatgtccctttctcatatgaagttaaccaaagttgtggagtaatgatatgcagtgtactgctatgtacatgcttgataatgtccttatctcgcttcttgccatgtcagaatgcagattgatgcttggatttgttcttttgcactgatttgttcaacaaatttctttctttgaacaaaatgctgtatgtcattctaaaggatgaagaacatgatatcctcctattgatgtagctttattgggttggcccttgggaacattacaaatatgtcaagtaaattataatgaaaaagtcatactgctacttgcatggtctcaattgcattttttactaaaacttcgtttaatatctcacttgttaacttgcactagtagctgacagagtagatctgcgtgatagaaatcgctaacagttcaaactaatttatcttgatgctgacatactgtatactggagtgtaatgataaatatgttcttgtaaatcaatatgaacctaagttatggaggttcctaaggtagctttgttttctgcattgttttgcttgctattgtcatactggaaagtaggatatgaactgaaaatatcatgaaacttcaacctgcttctaggaacttttgttttggaggactgactttgtttcgttgttattgtgttttcttccttatatagtagttattggttttgtctgaatagaaaataattctaaatgtaggtgaaatcaacgagtccgatgatggcaactatggagcatcagctcactcagattatggaatactaacccttctagcaacagatggcattcctgggctgcaggtacaccatgttcttcacatatattaattcaccaatttcaattctgttctcttttccagctaatcaatcatgtagacaaatacatgctcagaaggtttggtgagaatggggttatgtgatcaccttttaccactttcaagcaaaacaatactttcctgtttagaaaagcagaaaaataatatgtattatttatttttacatttatattctagttttctcactgttgtgcgtttgcagatatgcagggagaaggataggcatccccagctctgggaagatgttcatcacatcgatgggtaaatagtaaaatactttttggtgatattaatgaataacaattccaaatatactgttgctttgctcttagctctctggatcactgtcttgtgtgctccttagataaccaggtcttgtgtacagggctctgattattaacattggcgatttgctagaaaggtggacaaactgtgttttcaggtatcatccgtttgtacttcaattaatccattatgtggttgtgaggaagcctcatgtgctgtggtgactgttaagaaagttcaaataaaccagctacagttgtgagtagtttaaccaaaaactttctgttttttgcaactcgatatgattaaatatgctcgaaagcacaatgctttctaagttggtttaggcttgtcaatatcatgagcaggatagatcatgtccgtgttgtttctgaaattctacaggtcttttcgagttctgaaatttaaggaaaaagccttgtgtatgaattttgattattcttgctcttttgctgacttgtaggtctacactgcatcgtgttgtggcagttggtaaagagcgatactctgtgagtattactaaccactgaaattagaatttcattattgaggggtttcagctcattgaattattgctattttttgtggaagctcccattgaattcatgttctagagttggatgaaccccgctttaagggaaaactaacactgataatatatagcacttcagtgacttagactaaattgtgtgcttaacttcaggacctttctggtggacattctttcatacgcaagttttttttttttttaaatttgtcaggtggctttctttcttgacccagaccctgatttagtggttcagtgcttggaaagctgttgtagtgaggcatgcccaccaaggtcctcttctttctcaatcttagcattagtctagttcctttggcacttgcttctcatattgtttgaaatttgatgcattttcaggttcccacctataaaaagtggagactatttggaagagcgcttgagctctacatataaataaggaaaaatttgctacatgacacctaaagtttgttgttttagccgtaggacactcaaagaacgtgtaagcatggtaattatctgctggacaccgaacacactattttattattatattcgatgccaatggagggagaaacagtaatgaaagtacacatttacccttgtgttggtaaggtgtgtctagttcgaagcagccgctgtaattcttaatgctgctgccccagcagtagcttaaatgtaatgcagctaattacgtatcatattatgtacgatcatgactcaaaattagttaacattggaatgatctttccagaaataaaaaggaagttaactcgctcgccgcttgaatccaccgctcgccgattgaatccgctgttgcgcgctcgttgcttcaatcggccgccgcactcgccgcttcaatccgatattgcactcgctgcttgaatctgtcgctggcctaactttagtatctgtatacaaaactaattacataaataaaagttaatttgcgagataaattttttaagcctaattaatctataattagagaatgtttactgtagcatcacataggctaatcatggattaattaggctcaatagattcatcaagcgaattagtccaagattatggatgtgttttattaatagtctatgtttaatatttataattagtatccaaacatccgatgtgatagggacttaaaagttttagtcccatctaaacagggtctaaagctcacagccgatggtcaaccttgcaatcacagcaccatcgtcaccaccaaaacctaggattttagaaatttgaaccagacctactcgggttaaaaagaaactagcctcatgggtaaacttgtcccttttaaaagtttctccctctatttgaatcaaatataataaaataatgtgtttggtatccaacagctaattgtcaatttgccatgttttcacggtgtcctctagcatatatgcgatctttggatgtcctgtggctaagaccataaattttagatgtgttgatgtgaaaaacacgaggcctgaaagatctgcttaacttcagtgcaggtccaaaaatattgcttttaggttcgtgagcgtgccagttgatttgatcctgcaatcaacaagaaataaagacaaagaaaccgcggttaaatccataaatgatagccgatcggctagccgccgatgacatatcatttaactttaagctggtgtcatatgtgaattgataagtaatcatgaataaataagaaagaactaaatctactcgatcggttgtagatgttaacaatatataatccttatgtcgatatatacttaaatcaagtgattgggatagatcggtcgccatgccgagacaatataaatcacttagatcaaaatatatactaacaatgagattatagatgttcatagcatagccgatcagatagatctagcatgtatcggctaatactccgataccactctatattaagatattaaagcaagcaaaatatatcaaacagaagcctaatatattttattgtaataagatcttaacataatggcagatctagcatatcgattaagcacatgaaatataaagctaaatcaggtaagaccggctgaaaccccaatactaccctaatcggcaaccaaaagcaggctagagattaagattctaataatgacttataagatcaaactcaactgatgcagctataagtatgaaaagaaggacaacatctagatgatcaagccgttgtatgttttatagagtggtagatatcatgtataatctaagtcaacatagatatttaacctaattggctgccttccaataatagatgttagccggttgaaggttagacaacgatattgtcgaagattatacagagtatatgataactcgacgaattacataaacaagactagagtatcatgaagatggaagcactaatcccgagaatgcaagccgccataacaagttttacccctagttgaagatcgaaaacgatgcagctcaacccgaaagcaagaactcgtcgaaacaaaacgaaagtaaaagggtggcgatgcgctgagattgtattgaacgtgtgttgttgtattacatgaggctcggggtctattaatacccgagatttacaaaatatgtccgtgtcggacacgactcttatctctaacaaactctaagataccataagtctttgcgacagacttttgcccaaacatatctctaagaaaattacatgaaatatcctaattaatagatacaattgtcttctcaagactcgatccatacatggcaatcctcatgaagcacattaactcaacccgacagcgtgtaccgctccacattgttggcatcggctcaatcggccaaccttgtccgactcgaactctgccgatcctgatcatagccgattcggaattttagccgattctcgctttgtttccggaacgatctctatcttgaattccgcttcgatttatcttcatctccgatacttggattaccaaaatttgttgttaacaagatgtcctattgctaattttgcctacaacatttttacatgtgtaaagcttaaaattgataactggctcccattaaattggctgctacatgttgcagctccatttttaccataatttagtatgaagcagctctgatgagtgatgattgactattgactagtgagcagtgagtgatcagtggttgatcactgatcaggctgaaacctgaaatgaaaggaaaaagtccactttgactcccttaattgtatgccgaatctaattcgtacccctcaaccagaaaaccagagagaacgactccccgaactattgaaaccggtgcaatttgactcccttagcggtattggagggcggttttgctgatgtggcgctgacgtggcggtattgacccggtcttcgtcccacgtggcgcttaagtggcattagaattaaaaaaaaatgtgggacccatctgtcattcacaccaaaaaaaatatatttgtgggacccattgacatgtggggcccacatatcatcctctatctccaacccttcttcctcctcccttcctctcacatgagctgcgtcctcggccgcccct

SEQ ID NO: 56989 - DNA, 45483 bp, Oryza sativa
aagccgcccgccgtcgccaagaagcggccgaggaggaggaggagaagaagccgccgaagcaggctaggagggagaggcacgcatggtcgtcgcggtctgccgccgccgaggcggtcggcctggggctcggggggagcttcgccaacagggcgcgcggggagcaggtggcggccggctggcccgcctggctctccgccgtcgtcggcgaggccatcgacggctggaccctgcgccgcgccgactccttcgagaagatcgacaaggtacgtactcctgccctcgcgctcgccattgttggtggtgggggaagggaactgagctcatcggtcttgtcggtggcgcagatcgggcaggggacgtacatcaacgtgtacaaggcgcgggacacggtgacgggcaagatcgtggcgctcaagaaggtgcgccgcccccaccccggcgcgcgacatccccgcccgcaccggccgccgccgcctccccccagccgctccctcgtgccttcctcgccgccacggcctcctcgccccactgcgcccccgcgtccccgacgccggcaccgccgcccccgcccttcaccggccctaccgtccgatgggaaggagaaaaagggagagaaaagatagagaagggagagagagggaggaggaagaagggtgggagagagaggatgacatgtgggccccacatgtcaatgggtcccacaatatttttttttgtgtgaatgacatatgggtcccacgtatatttttttaattgtaatgccacttaagcgccacgtgagacaaagactgggttagcgccgccacgtcagcaaaaccgccctccattaccgctgggagagtcaaattgcaccgttttcaatagttcggggagtcgttctatccggttttctggttgaggggtacgaattagattcggcgtacaattaagggatttaaagtggactttttccgaaatgaaatgactggtaatcagtactcggaattgggcctagtcaagtctataataggcttttcatgggcctctcgcgatgggttagtcgtagtttctctctgctgggctgtatcttgtacgagacgggcactaatcttttattcggcattgttcgtttaatcccaaagggattttggtgggatgaaaagcccttccttttcaattgggtagggggtggtaattggggaatctcaagcatccgtttgcatttaagttactgagcttttactggaaatttgatgctgagcttttactggaaatttgatggctgaatggcagatacaagtatcaagtcgcacttatgtgatgcgtggctattaaacagtaagtgatcagtgatcaggctcaaaactgaactaacaactactatccgaaattgcgcgtcgtcgcttcagtcttttccggttttccctgaaaactaggatgtaatggaagccctggtgcgagatgatgcaatccacgaacagtttgatgacatatctgaaatttctgtctcaaattcatctagaaaaaatgattaaaaatgataaatgatatgcagccgatctatgatggagcagctggattattttcgggacatttaactttagaccacttttaagatgtgtcaattaattatttgccactcgctgtctatgacatgtgggctctcatgtgtctatgatatgtgggtccagtgacaaatcatttatcaccatccgtaagagtggtaaataattaattattccattatcttcaggtgaattgcctgtactttgtcttgcataattggcctcgtttaattcataataggcttcttaatgggcctttctttgtacgtgatgggatactaggccattagtgggcctaagtttctctctgctgggctattctctggttgtaaatgggccccaaatctttgagtaatgggccgttcgtggtcccgttttaccctagatgggccaagtttgcttccttctctgtaagcccagttaccgtggggatacagccgccggcggacgcggagggcggcggcggcagcagcagcaaaccgccgctttggcagaagaggaatccgggatggccggcggcggcggcggcgggaatcgcctggacctccccgtggtggacctcgcgtcctccgacccccgagccgccgccgagtccatccgaaaggtacccaatccattccggattccatggcaattttcctggaaacaatctgttccgtgggcgcggcggcggcggggagagagagagaacagggcgtgattcgtgtggtgtggtttggttttgcaggcgtgcgtggagtccggattcttctacgtggtcaaccatggggtggaggagggattgctgaagaggttgttcgcggagagctcgaagttcttcgagctgccgatggaggagaagatagcgctgcggaggaacagcaaccaccggggatacaccccgccctacgccgagaagctcgatccctcgtccaaattcgaaggtctgcgcctcctgttttgctctgctcgccgtgttaaactgctaattgttaaacctaagcatcctctcctttttgaagactgttgataaatttaatcctgaagtgtatgggataacactggcaagttagtataatagtagcacatgacagagccggagtgacccttttgtcggcaaaaatcagaagttgacatgttagtgcctgattatggaatattctttattagcagtattaagcaaattaaaaatgttccgatgtttgtgaaagatgcttttaaaaactgaactaggaaccatggttctggtttgatctatcctgaacatctcacaatcttcaataagtacaaggtgcatggagtaataaatacaagcgctcactgcctatactttgaacaaccgctaggttttgtggattttaccttctggtgtttgtagtgatgtacttatttaagatctgtaactgtgatttatgatacaggagacctcaaggaaagtttctatattgggcctattggagatgaaggtttgcagaatgatgctaaccagtggccttctgaaggtactcccttctccttttttatcacttctttccaaaacataaataaattctatctttggctacagagcgcttaccaagtcggagggagacaattaagatgtaccatgcaagtgcactgtaagtcctcgttttgctcatctcacttaaggaaatccattaattgtattacgtcagcattgtgtttgtataatactttggtgttatttgtttaaataatttaaatattcctgcttatttgctaccactactaggtctactggcaaaaggatactctctctaatcgctctgagtttgaatcttgacgctgaattctttgagaacattggtgccttcagctgcccatcagcatttcttcgattattgcactacccaggtcaacttatttcatgctcctgtatgtcatatgacattaaccaaagtagtattctcatgatatgcagagaaatgctaaaaacatgtgtgctggtctttaggttgcttcttgttgtgttggattgctgataattgccaatggtttctttagctctgatttattcaacaagtttatttatttcaaacatgaatgagtgcactatatgtcattctaaagaatgaagaacttgatatcatcctattgttgtggtattgtcgtgtgggtgctcagaaacattacaaatctgtccattacagtgaatagggaaattgctactttcatgatcgcaattataatctttttctaaactataacaatttcatttgttagctaaaacttgcattgaagactacttttcagtttgtaaaaatatcttaactgttaacttacagtagcagctaatggagcagatctgtgtgatctctattgctaaaatttctcaaagcaactgtcttgctgctgcccgctgtttgctggagcataatgataaatatgttattgtaatctgtaagtcaatgttaatctaagttttaaagataccttaggttgcttcattttgttgattgttttgcttacctgttattatactggaaagcgggatgtgaactgaaaatatcgtgaagcttcttcaagcttctaggaacgtttgtttttgtgagctgactgtgtttccttcttgctgtggagctagttaagcgttgtgtttttcgtccgtactgtagtatttattggttttatctaaatagaaaataattttaaatgtaggtgaagtagacgactctgatgatggcaattatggtgcatcagctcactctgattatggaatgataaccctcctagcaacagacggcactcctgggctacaggtacaacattttctttgcacaataaattcaccaacttagctaaccaatcatgtagacaaatatatggtcagaaggtttggtgaggatggggttatgttcccaccttttaccactttcaagcaaaaaatagctcttgtttagaaaagtaagaatatctgttgtgaatttgcagatatgcagggaaaagaataggaatccccagctctgggaagatgttcatcacattgatgggtaaataaaagtaaataagtttttttaatatattaatggaaaaaaatcaaataaatcattactttgttgtttaatttgctggtctcttgtaccctcagggccctgattgttaacattggcgatttgctagaaaggtggacgaattgtatttacaggtacccttttccttttatttttgatgacatattctgtggttgtgaggaagcctcatgtaccatggttgttaaaaagctcaaacaaaccagttacaattgtgagtagttgcaccaagaactttctattttttgcaattcgacatggctaaatttgttgtatgacacaatgttttcttaacaagaagttggtttaggattgtctcatgaacaggttagaccatttcagtgtgtttttgaaattctataattcttttggagttctgttttattacattatacacttccttttctattttatatctctaagaaagaaaaaccttgtatatgaattttgaatgttctccctcttttgctgacttgtaggtctacagtgcaccgtgttgttgcagttggtaaagagcgatattctgtgagtattatgactgctgaattcagaatttcataattgagagttcttttttttttcctggggaatcaaggggttttgtcacctgctgaatacatgttgtatagtcaggtggacctattcatgtgcaaactatcactgataatatagacgtaacgtttcagcgacttaaattgcgtgcttaatgttaggacctttttggtgcactctcttacacatgttcttcaatttgtcaggcggctttttttcttgacccaaaccctgatttagtggttcagtgtttggaaagctgttgcagcgagtcatgcccaccgaggttctcttcctcctttaggctttagcacaagtctagttccttttattatgcttgcttctcatactgcttgaaatttgattcattttcaggttctcacctataaagagtggcgactatttgaaagagcgattgagcgctacatacaaatagtcctatgctttttcatgtgtaaggcttaacataaggttatttaaattccgttctgatttgcagtgattttttaggtggcccgtggagctacctcgggctcagttcctttgcttggacacttgacagtttacataaaaaaatgtgaattggatctgcatatcttttccaaaaacgcgcaagagaactacacaagttcaagcagtggatttttaggtcgacactaaccgtgtggaactgtggatgcaggtaaaaggaggctaacatgtgctacacggccggccatcgttctccattgtccatttttcttctgcgtttagacatcacagtagtccagaaggttgtttgtgttgttttactgtaacgctgtaaagaaaaagtctgcagtgatgtgctatgcttgatttctctctccactgctcgacaccaacctgaactttttattgtttgtcgttcaaaaaaaaaactttttattgtcacctgcgagctgactggtgtttggactagtattcttgttgacttggtaaagaaactccagtttgatcctgggaggcaagtgattccccatctccatccttcactttctaactcttgacaaagtgaagttgagttgtgatatctagattttgttcatacctgatgaacgcgactaaatatgccatcgagaagattgtgatgtcctgcatggctaacaactgcttgccatatggcttttttacattttggaccttttttaaaacttattttacaaatatatcttaaaaaaacttattccgcctttggtggcaccaatgtcattggtaccatggttcaacatgacggtgccgatgccccctagctttcccaaagaagccaagtcacttgtatgatggcgaatggcaccgatgacctatttgtaaaaaaattgaaaagaacttatttgtaataaaaatatttataaaataagtccttagcactaataaccttgatgctaaggacttatttgtaaataatttttattacaaataagtttttttttgatttttttaggttctcgacggcaatgtcgttggcatcgtgaaaaggatctattcctgctataagtttttttcgaggaactatttgtaaactaagtttttgcaagagaccaaaagtgaaaaaaaaatccactgcttgccatgaccggatccatgagcatgtcaaagagttacaagtgtgtatgctacaacttggtctgaaacggcagcttggtgggtggcggcttccatgacaagttcagaatggtcatcggatccatgcaaaagctcaaactactcatggttcgagccgttgctgttgattcgcttgccggtgaaagctcggaactctggcaagaagactggtgaccaaatgaagtagtatggtcaagcagagatggtagattattttagagcacgtttggtacagctctaactcctaaatttagctctaatagttaagtctggagtggagttgtggacctgcctaaacccagctccacaactctagtttatttggtgagagagctccacccagctacactcccatttggtggagttgaaactgtttggctgagctctaacttcagaaggggtggagctaaagttagagctgtgccaaatagaccggaagtgtcacacaactacacgtacaaagtgacaaatctcacctcaccaaacaggtcaatgacaggtgcgtttaggtattctgcgactctttgcaatgcgtaataattacatgattacatagagacaagcacattaaatatacgttgattaatctcggcatggcatcaaatacaaacacacggacaggtcaaacctgtacagtatgaatagagttacagtgtctactactgcttggtgacaactcaaaaattggttcgtcaagaaattcaggctgatatttgaaaactgcatgggagagttgccaaagttattatacttgaagtgaaagagatgtctttgattaatttcgtccaatgtttctagacacatgcatcatgtatctcaactcctcaaactccaccaaaaatattgctcaaattagtaaactaaaactatacagctagtgtcaacatgttatccaattcagaaacactaattatttctacatgtggcatgctgaaaattaatctgatgcctaacctctcctactgataccaaacctcaagaatattaactgcagctggtctttttctgctcgaatgaatgtagctgcacgcaaggagaagcctatagggttttgtgggcgggcagcttaattgcaagattaattttagtggagaagtacattacggtttataatcagatcttacctgatcaagatcatcatgcttaatatcgttataaaactaaatgcaaaaccgggtgctgagttgcctgcggcttaccacgttgcgacgacatgaatgaaaagagaaaaacatgaggctacaattaatggatttcggacgtcagaggaatctcccacaagttagcatagcaagccagctgataggactaaatatatagttaattcgttaaatttatagtcgtctcaaataaaaaaaaaggttgatcttatgttgacctttcaaagtcaacaattatataagcactaaatttttatcattcatgtattatgtagtatatgttttaagaatatttcactaaaaatatacatttttaagtgtatacttaccgattttttaaggaggtaccataattttcttgttaattttatatatatattaccttgtgatacaataataccacgtaggtagtgaaaggtattaaaatttacgctaaggctatgtttggttaatccccaagagggagggattggaggagatttattccacacctattgtggtgtggaattattccccctcaaacccctccaatccccttcaaccccctctaaaccgaacaaggcctaaaacataaggtgttctccagactagcatcttttgaaggtccaaaataatctttttacttatcaaaattacaaatttaggcagtttttttatttggaaaaatagtacagtttgacctttcaaaaactaggacgagttctatgattagtatgttgggtttttagctgtttgactttcgaaaaagtattttatctacacgtcccatggtgattggacgacttatatatcctcaagcggccggcaaggtcagtcaacaatttttttattcttgaaaggtacaaacaaattgattggcaacgtacgtaattgacaattaagttcgacaagcactgcctttgaagctagcaaatatatatcgtaagtggttggatcatcaacaatttaacgcaaaagcaaaaaaatggacagaggaagattgatcaggggcaccctccacttaccgtttctcaccggacaatagtcaaatagttagaatatttgcctcagctgccaggtcaaagcaaatgatggatcttcatcctctacggagtccacgcggttttttggggtctatgggcctcctgtgatgtgcctcaattctacggtagaccggtgtggctaagtgcacctaatacttccttcatctcaatttaatcatctcttaagatttttttttgtcttctcaaattgatcatcttttaatctctgtctattcgtattttcgtgcataaataaatggcattattctacatgtctatttgtctatgcatgcaggagtaaatgtcatcctcgtatgcctggcatgcatgcaattgcacgtttgcatgcctgatcctatcttcctatatagttgtacccatttagtttacttctataaagtagggcatgcaagaagtcacatcatcaataattctaagccatcgtatcgcattagtacatacttatcagccgttggatcaagaagctactcatccatctaatttaataattgattactcatccagtcacctccctttagattataatcacgtgtgacattgttatccattctttacataataatatgttttctcctcccaagtcctctccaagataatgcaaacttatcttctttatttaatacaactcaaattgttgtataacatgttagttttgttttgttataaacaattggataacatatagtaatcaggcatcattaacccaaacctgttttcgaaacaagctcgagataaaagcaaagaggtgcaaactactctaattatgacgatatccagattgtgcatgaaaataacttttgtatattataacaatacacaataacattttaaaacaaacatgaattgtattgtaatagcagatcgatgctatatatgaagccacattatttgaaacattgattgtatttgatgtaaaactagcaaatcccgcggcaaggcacggggtgccaactagtatatataacatcttagtcgatgaggtttaattttagaaggaataatactttcttacctaggtctcggcaccatttataagtatgatgctcaatttggaaaggagggagtagagtttaactggtagtgctgcggaccatcatggtttaaataatagacttgacataaatgtcgataaattttaaaagttaaaattttcaatgggtaagtgcattcccatattttgggaggtcaatatctcctaatttccatattatggtggccaccaatgccataagggtccctcaaacaataagataggtggacttttttctcttccccaacaccaagacatcaaactagaaaaaaaatattttaaaacaaggtgtaaagtgatgaaaaatatgaaataaaaaattataagggactaattttattttatatttttttaggatttaaagtgtacggtgaggttctctttacttaattctcgttgcaacgcacgtacatttttttatatataattgaaattctcatgattggatggatatatcacagaactccatttgtatcaaaatccgggaattctgtgttagggggataaatatatttgtgtaacaatatagagaccatcggatcaacatggaagagacacgtatgtttccaaactaatcattagtacaaccatacaataggctataatactgataatattatcaaagtaaattttactttgagccactcttataggccaaagtttcacaatggactggaggtagttcatctttttacataacaccacatatgtttgcactttgaccggggttcataacttatgccttgatatctatttctccaagtagtgaaatttgatctttgaaatgttcatatgtagtaacaaaatctatttatctttgaatgttcatttgtaatgaaatcccatttattttgtaggatgtattataacataataatgtacatttgttggttcttatgctatatggtgtaaaccccgatccaaagtgtaaagataggtagctatatgttgtaaagtgaaaaatataggcatgatcctagtccataataaaaagaattggtcaataagagtggcccaaagtaaaaattactctaataataataataataataataataataataataataataataataataataataataataataataataataataataataatatgaaatgacccctacgtaactacttccaaacaacaacaatttaattccatcctccggtagagagaaattatataaattctccaaaacaagggaaatatctctactacttactcaaaaaagggaactgttgaggaagcactggtgatgtggtggtgaagtcgtagttgcatgatttcatccaccagagtttaaatcccagtgcctacgaatattacatatatgcaggtggaatttcaggagaattttagtaagatcatggatatgccactggttttcgtctcttaaagtgtgttaggggaaacatatgtggggtgtgaatatggtgttgcatgtgtagtgtggtgtgtgcatgtatgattgccgtgtaatcgggaaaaaaaagaaaccgttgctttatggtagggtgttcttgacgttatgttggattcaggacctgtttagatgtttaatacactttgccaaactttcataccataagtttagcttagccacggtaccatagctatagctcgaactaaacacttgcatataaaagtgaaacctagctagttatgggtttgtggcaaattaaagtttgaccacgaaccaaacaacattcttaaacagtttgtgtttagtttctgtcatgctgaactgctaggtccagtagttatctgtaatttgtaaactcttttgcagccttctagatatgacaggcactgttttgtttgtaatgatcagttagctccattcatattttgaaactgaaatttggagatcatgtatatggactatggttgacattacaaaatgaatgtagatatgtcaggcacgtacctcgggtacgcatgcactgttacaaaatgaattcagctgaccctctcttttacttctggttataaacaaatagttgacattttggttgatttgaggataaagtttcggtcgagtaagttgtacatcattgtatctgaaaattggtttgcaatctaagttttctgaacaatatcagcacacgatagtggctagctagctactagacagattgtgtacttctggcagctcgaatactaggaagctatagctagtgcactagtagtaaattgttagcaaattagttgactatccaagtaaaggcatatttaaatcacttaagaatggaaggaaatgtattaaacttgtacgacatgtatctatatcctatatatttttaaagtttatccccattaatatatttcttttctctcattaagcaacatcagcttaattatttctaaactttggatgatctatagtccaaattatctccctcctttccgtatcccataaagtcatattaccttagttttatcttttaatgattaatctatattatcttctttttcttctgtcattgaggacacatcatcttagttttacttttaaatgattaacctatatatgatttaaattgttataaactgcaatatcttaattatttatattcttttccatggtcgaccaaaagataaaaattatatagagcatataaagttatatcgtctagctattaattacatgttatttatattattatcatacaaaactcctgcaacaatgtgcggggccttgtctgtcaggttgatgattcagtcaatggtgccggatttagggttcataaagttttttttggtgacggtggtttagaatcttacaaaagaatgaagatggtggccgatgctcattcatgttttgttacatgtgttagagttgctcggcattgtgactgctcgtctgcttactcgcggaatttcaatatttacagtttctttgttctatcttagtatctaactttttcattattttttataacaagaggactattgtaaatttgtaatattctttcctgttctgccaaaaaaaatggcattgcaatgccggatctttgatgaatagtaggggccggccggaaagcaatgaagttcaatttacttttagtaccccgtcatgacccacaaattcaggattttactatgctgcactttattactattctgtcgcaaattaagaacacaaatagtacgtctatgagcaaaagtcaaacagttttttctttttcatgataatgatcaagtcggacttttccccttatttttttttcatcaggccgggcagctccaacatttccatgtaatataaggagggaaggagaataatattgcagaaaattaagcattgacttgatttcattagcccattttgtacaaatttcatttgccaaattgcatccaataacattccttgtcttcataactccgacagcgaatttaacaattttaactagattgagacaacctaaagaaacgctaaaagtaacaaatttattttgaaaacatacctataaaattgtgtggtggcaattagtctatttaatcagtgaagtgcttttgcagaaataacccatcacctctcgcgcgcctactatataaatagatccctcgctgctcattttctcctcgtccagcttcaagctctcaactttctcatcactcgtctcctcgatttatttgtctccttccatccagacacctcgagccggcgatcgatcatccaaaccaagctccgccgcccgagacgacgaagtcgacgtcgccgccgccgccgctcgccgccggcacacagctagctgcaagctgctagacgacgacgtcgagctgatccgttctaaaacatcactataaactaatccatgtcctgttcttgatatccctctctctgttgcatcgaatgaccctatccatttcggccttagctatcttgctataaagctcgtggtagcttgttacctttgctagagttttgaattcctcatcttctcccgccgtttttagctagctgttttgttgcacacgtgcaacacaggacaagacgtgtgtaagagcttggatactgccgccatcgctgccatgtgcgaggctctcgttgaccggcaactcctccccccgtgcggttgcaatggcggcggcgacgtcgttgtcgttgtggtgccgaagacgtcggcggcgccggtgttggaggacaggccgaagacgtcggcggcggcggtgagcaagggcggcgaggcggcgtcgatcctgcggctgtcattgccgatgatcatgacggggctgatactgtacatccggccgatgatctcgatgctgttcctcggccggctcggcgagctcgcgctcgccggcgggtcgctcgccatcggattcgccaacatcacggggtactccgtgctgtccggcctcgccatgggcatggagccggtgtgcggccaggccgtgggcgccgggaacctccccctcgtcggcgccaccatgcagcggatggtgctcctcctcctcgccgtgtccgtgcccgtcgccttcctctgggcgtggatggagccgctcctcctgctgtgcggccaggacgccgccatcgccgccgccgcgcagcgctacattctcttctgcctccccgacctcctcttcctctcgctcctccacccgctccggatctacctccgcgtccagtcgatcaacctgccgctcacggcgtgcgccgcgctcgccgtcgccgcccacctccccatcaaccacctcctcgtctccgtcctcggcctcggcatcgagggcgtcgcgctcgcctccgcctgggccaacctcaacctggtcatcttcctcctcgccttcgtctacgtctccggcgtgcaccgcgacaccgggggattctcgctgccgcgcaagatgttcaaggacgtcgacgggtgggtgcggctggtcaggctggccgccgagagctgcgccagcgtctgcctcgaatggtggtggtacgagatcatgatcctgctctgcggcctcctcgccaaccccagggccaccgtggcgtccatggggatcctcatccagaccacgtcgctgctctacatcttcccgtcgtcgctcagcttcggcgtgtccacgagggtcagcaacgagctcggcgcgaaccggccgtccgccgcgcgcgccgcggcgagggcggggctcgcgctgagcgccgtccagggcctcgcctccctcgcgttcgccgtgtccgtgcgcggcgcgtgggcgcgcatgttcacgccggacgccgacatcctcgcgctcacggcatcggtgctgccgatcctcggcctctgcgagctcggcaactgcccgcagaccaccggctgcggcgtgctccggggcagcgcgcggccgagagacggcgcccacatcaacctcggcgcgttctacggcgtcggcacgccggtcgccgtcgggctcgcgttctgggcgggcatggacttcagggggctctggctcggcctcctcgccgcgcaggcggcgtgcgtcgcggtgatgctcgtcgtgatccagcgcacggactgggacgtacaagccaagctcgcgcaggtgctcgccggcgccgcggccagtggcggcgaccacggcgtcaacgaagccggtgggaatgacgcggtcgcgcacgtcaaggtcgcggcgccccacggcgacgaggactcgagcttgctcatcaccgtgagcacgtagctgaccggagcaacgccgtgacaacgacgacgtacggccatgtctacgtacgtatgaaccacggtaactagctactccctccgtcttaaaatataatcatttttagctatgaatctagacaagtatgtgtctagatttataagccaaaagttgctatattttgagacggaggtaaaagtcattgtgtcgtgtgaaagcacaaagttcttccggagtctgaactctgaacattttttttggcagttcgcatgagttggtcagtgtatgtacggttatacttatacacttaattatacctagtatatagtgccatagttattgcagaaaaacacctgagcttaattttggtgaaaaatagctcggtgtttcctgtaattacatggccttcatagaacagtattaggtggtgttgagcgaactaatcagcacctagttaattgtcttcggttttagtaggtggcctgaggactcgtattttttgtatattttattcttttccacaagttatgtattgtcatgggtatatatatacttgtatatgtacacacaaaattgaaaactaagtgaaatttcggtgttccttttatattttgttggtacataattgctgtagtacaattcacacagatatgatgaaaattagtttagtagatggatcatgtacgccctcattcccagcgtgaaatccaaatagttatgaattttttttaaaaaaataaaagcatgtattgttgttgtgtactatatcgatcgaccacacaaacatccctgttaaatccgttcattcatcttttttttctcaaacaagcaagataactgcctgtcattttttaaaaagagaataaatgagttcatcttgtacacaaaattttagaaatctaactgtaatgtgactacacactttttatagtctaattttaattgtctctccatgtgtacagaaaatttaacatcttttttaggggagggatatataaaatctttattattagaagtttctataaccattgttgaccacatgaaaacaattgatgtcacatgcctaaaattgtttaaaaatagaagttctaatggaagatacatatccagttttcatacatgataactagtcaaactagtcaaattactcatgcgttgcaaaggattatccaaatagacaaaaaacaatttgaaaaaaatatttatctctagttgattatattcaaacaagattcttcatgcatcttaaaaaaaaaagtataccatctattttgaataggtatgttagtacactaacttcaattaatgtacggaatcttatgatcctatatactcactagtaaccatcatcatcaagagttatttgaagtagtatatataaatccgtgtatccaacagataagaaaactataacctttatgatgggacaaatgtagtataaaaaaaaatgctattggacataccataacaatttgttatgtaacaactaaaacagtaatctattagagcgtctgtatacaaatctacaatatataattagttgcatctcaaactcaattcggcctccgttcccatagcttccacggtagcttaagcagaatctaacaggctaagaaaaccttcctaccaccaagctagctagcgatcccggccgccaccttaatcctatcttactataaagttatctcccactaactccttaagtttaacatgcaaagatgccacatcatcatccactaacaagatgccacatcatcatccactaattaataagatgtcacgtcatcatccactaacaatcatcacatttaaacattatgcaaacatgctatatctttatagtttttataatttaagagctttttaaatacaaacatgttaaattatcatctaacataattcacataatgttttaatgtatatcttcatattaaattcccgcagcaatgcgcggggtttcacctagttaatcaaatattaaaacccaatttgtatagcaccagagttaatattgcaaagtggagtcgtaggtgcatgattccattgctataatttaaattatagttcccacaaatattaaacgcatactctctcctttttaaaatgtaagagattttggaaggatgtgactcatcctaatattacgaatctggaatatgtcacgtcccaccaaaatcccttctattatggggcgaaggaagtatgcatgtagtaatgtacttagactttcaacatgattttaataagatcagggattttaatgtgttagaaaacgtattcgtggagtacgagtgtaatactgttacgtgtgtaatggtatgtgcatctccgtgtaattgaaaaaaaaaaattaatgcaaagtataccggccctatagtacgtaagcgagaatatatacgtacgtaggcgcttacgcacgcgcccacaaacaaataatcaggtggcgtctgatcattgccactgttccctacgtaggcggccggcgtcgctgtcgatggcatgtcggccggggttgggtttgctagctgcaggctgtcttcccggccgccggcaccgtacccggccacgcgcgcgcggaggccggtgagaacggcggcgcgtagattagattgtccgcttcctcccatgccgccgcggcgccgtgtcgttggaattcgatcgagatcggctgtgtcggcaagttgaccatctatcgatcggcaattcggcatcgacacgacgtacgacgacgacgacgccacatgtgcatgcttatggtgaactactccctccgtcccataatataagggattttaagtttttacttgcaacgtttgaccactcgtcttattcaaaattttttaaaattattatttattttatttgttacttactttattatctacatcatcactttaagtacaacttttcgttttttatatttgtaaaaaaatttcaataagacgagtggtcaaatattgcaaataaattaaaacttaaaatcccttatattgtgcgacggagggagtacctagcttcgtcgcatatgcagccgtacgtatatgagtacgtatacttgcgttctcacgtcacatcgtccattgcaggctcttccccgctgcttgcccactggcgtgtgggccctaattagtgtgcaacagcggcttaggggcttaggatgtatttagttcacgctaaaattaaaaatttgattaaaattaaaacaatgtaacggaaaagttggaaatttgtgtgtgtataaaagttttgatgtgatagaaaagttaaaagtttgaaaaaaattttggcactaaacttggccttagttatattatggctagtcgatgcaccatacattaaaaaaaactatattttttttacaagtacaagtcgaatatataccactaaatacaagtgccaactcatatatattacccacctatatatattatgtccccatgcacacacttatatagctaccatgcatataaacaagattagaggccagtctcatatagtatgagttttggccatcaaacgcgtctacatgtatatactgaatttctcttgctctctagatttggcagttattacttggtcaaaaatattttggtttcttatataagcctgatattaaatgtcactaagaattactctctcgttcacgaatatatactcgtcaatttttatccattttatttattggcaaatatttttcacttcatgttttcgaatgtatttttttttctcatcttactcattaatttcatctttcatgttctctcaaccacacatttaggcttgttcggttaatccttacccccatgagattgaagggatcaattttacacctattaaattgtgaaattaattctcctcgattatctccaatggttctagaagcatctagctagttagctttgaaaggtactccatatcatatatggcgatataatatgaaagcaaatgattacctagatatatcgatccatgttatggtcaaaagtaataattaagtagttatgaacgaagggagtatattttttaataaaaataaaacttctatcatggaaaatatattaatatggttatctctaacaagtatatatattagtaagcaatatatatactagtacatagcacacggtgtctgaacatcgacatatggagagcttgccatcgttttcgcagtactggctgtgatctaatttacaattattgctcaagctacaattggtgtttgctctttgctttcgttaacctgctgccccatttgcaagttgtttgttgtatattttctgtaaaaccaatcatgtgcgtcatcagcatataattaacaacgcacataatatgaatagatcgattcgtctacgtattgctgcatctttgtgtactttgaaaaagaatctagctagctgagatgtacgtacgtatggaaaaggattccgttgttatattaattccacgctttcgttttctcaactgtaaagcttgtcaatgcatgtcagcgtcagttgtttttcccttagactactgtaggatcgaacacaaaaaaccaaacttaccagaggggggtgaaaggggggtgaatggtaggaaaaaccaaaaacccaaaaacttttagcggaaataaaagttaccctcaaattgaaaatctcgatgtagtcctgtcgccgccgccggtcggacagctcacacgccgccggaacccaaagaaacacaaatcgaagaactctcaaagtagatgacaactttattgcttctctctatttttacaaagtgcaacaacagcactctttacaaaaatctcgactaaactcgaaaccctaactaaactatcaactcaattgttctcaaaagcgataccgggaagcctcacgctccctctctatttataaaaaaaaaaaactccctactcaaagtaggtgtagaactcctattcacaatagaactcaatccctgatattccaaatcttcacaatttctctaacaaatccacagccacatccaatcggactgcctccgtcccggtcgtcgcgatcgcctggccacctgagccgactcggcctgccatctaaccgagccgccgctgctgccaaccatcggcatgcatacatacatgtatcagcatgcatatatgcatacacgtcacgctacagtaccacgagtactgtagcacatatactcatcctccaatttcttaaccaatttcctcctcgaacaccgacgcttgcatgcacacctcgtgaagcccgttgcgaagatcttttccacacgatatccatccaccgtatgctatctcatatccaacttcgtcacccggtatccttgaccgtctggacctcaactcctccctgagtctagtcccgatccccaccgttgaccgaagttgatctccaagaatcctgactctagtcaccttctcacatggtatcctgaccgcactagacctctgttcctccttaaaacatagtcccgttcctcaccattgaccaaggctaacctcaagtcacctgcacacaatcagacaaaacaacagttcctgggcacagatatcacaacctgacccacattagtcgcacgcactcacaccaacatccacacatactctcaaaccaattcattgattaaatcatttacaaaaccaattattcatcacaaatattaatcatgacaataatttcacaactacttcagcatatgacaactaaaaaagtgcatgtaacatatgcagagtaattaattaggcattttgatgttataaatgcataatgcagaaggaaaaatggtgcacaaattactgctagctgtgagagtaataatccatacaacgactatgagcacatcctcaattaactcgctctttttgagaaaaaaaggttggtcgcttaagggtaaaatgttacactggaatagttctataacctcatctcgttccagctgatcttccgtggctgcaaatatatgtgcggtatgtttgtgctttttgtatatatgattatttgtttatagaaaaaatattgcatctttgcatattttttttcgcgatcgtaaaaaagattgcacgtcaatatattacaataaaagagtttttgttacacaatgcaatttgccaaaccggcctatgccaagggaagggagaaaacaaagacaaaaaccaaggaagaaaaagaaaactcatacgacggataaacgctactccaatcagcgggatggggagggcgggaagggagcagagccatactacactcccaacaaatccccaaaagaagcaatgcctgctaacaaccatagatggccctccaagaggatggactctagaaccactaagaccgaagagagagcgcagagtcgaaaatcctggagctccgttccttctacagttaccaagagaccaagaggactagggagtcaaagccggcacggaggtgcttaggtaagcaggccctagaagatggccaccagtcctggtgctagctgccacggaggagagagagggcaacccagccaggaggcgacagcacccgtagctagacctgtcgagcgaacacgcagtcgaggaggatgtggttcgccgtctcaagctcctgagcgcaaaaggggcaggccgagtggctatcgatgccacacttccgaaggagatcagccgtccaacaacactgctgaaatgcaaaccagaggaagaatttgcatttagcataacccttcacgtgccagagaagatcagcacaagcaaaggagtgctggccatagaataacgcctggtacgctgaacgtgccgagtagcgttggtcactcgtcaagcgcgcatctttgcatatgaatatacatacacacatttgaggaaattttatttattatattttatacttaattagtacattaatttagtttgcattgctacacaagaacgctatgctggtatatatatgactgctcacctatatatatgatgcaaacagcaagttatcacgaaattagtctcaaaatatggaatgtatatagaagaccatgtaatttgtaagagagatgtgtttaactttttaaaaacttcaagatcacacaaccccttcaatcttctcaaacacaaaatagttacaaattctctgccaaaaaaatccacatgcactagaggcaaccaatttttttttctcaatgtgtagactttaaaattttacgagtaaagcacaagacctgttcctaaaattaaagcgaggttatattcccaattttaggccctatttagtttacgaaaagaaaatttttgggtgtcacatcggatatttgaccggatgtcggaaggggttttcggacacgaatgaaaaaactaatttcataactcgtctgtaaaccgcgagacgaatcttttgagcctaattaagcactgtagcactttatggctaattatggactaattaggctcaaaagattcgtgtcgcgatttccatgcaaaccgtacaattagtttttgtttttatctatatttaatactctatgcatgtgttcaaagattcgatgtgatgtttttaggaaaaaaattttgggaactaaaccaagccttgcaagttcagcatttaggtcgataatcctatatattttagagtaccactgctctctactagtagtataaagtaatccaaaccattgatcttatttgatcgaagggttaagatctatttctagctactaccatccaacttaacaggagtagaaatatggaggggtattattgtcccgggaaaaaatatggagggggtataatcataatttatcactgattaaccctagcggccattcattcgatccttcctcacgccgcgatccaatttctcgatggaatctgtatgtgtttgatgcgtttgagactgttgaacactggattcaagtcatgatgcatgccagcgattaagctatgattatcgtgactagcgtgaaactccggtgattatcgtgactagcgtgattaagctatgccaccgattaagtcagatccaagggccgatgccagcgacctgctgacccgtgaggggaaaaaatgaaaatggctaagttaccctcgtaactgtgttaataagttactattttatccttaataagaaacggttcagatctttttattggtagtataattctaactaatagaaaacaccgaagtattgtcctatatattttaatgtatcttagcaagtccaaaacacatttaagtgggtttgaccgtcgatgtgtggctgtatgtccaccatgactggacaatatttgcatttagctccctccaatgtttgttcgcaccggtgacgccgcatcgaactgaccggccggccggtcaaggaagctgcagcgaggtagcaccgtagcagtgctcctgaagagcgcgatcaccttggtctccttcagaccgagctacataataaatcaacctcacaaaatatgatgtatactaacactacaaatctagatatacgtgtattcaaatttttagtattaggatgagtcacatttcgtatgaggttatgttgagattcttaatgttaggatgcatcacatactgtatgaggttatgttcagatttttagtattagaatacgtcacatcctgtacgaggttgttttattacaggacggagcgagtaggcgtcatccccctagctagctggcccagcgatcaagtatacgtaaccgcgcgctggcatggactgctgctgcctggagtgtactgtagcggcgctaggtggctgtatacttgaagcagtacgtcgatcgtacgtgttgtgtacgagtgcttgatattcatactgtttttttgtttctcatgccatcctgaaatagaccaaacagtaattaatttatgctttgtttgtttgcttccgtaggtagcttaaaaagattatataatgaatatataatcaaataccacagtacccttctagaaagcaaatacattaagctatgtatagtgtatgtactactactccgtattagctagctagagatcgatctgcagatcagatcagctgtcacgcgtggcctctgacgccttgaatgaggtaagttaattaacacttgttgtaaaatgtaaagagggcaaccgcggcagatcgatcgatcgatcgatcttcagaataatgcgatcggtgcctcagttccattggctatttctgatggccggctgggccgggttgcatttttgcatctaatataccagttcagaaaccaaaaggatacatatctttttgtactatcaattattattctgtcatgtattccgatgtgctgcatatcctatagcatttgcccttcgagctccgaagagactggccgggatcgaactaatttacacagcaaatgcagagggtaataattaagaaacactgcaatctatagtattatacttcatgctggttgaggtgcatatcgcttctatgcctatatctaactggtactgtaagttgacattttgatgtctcatattgaaaattctcaagggctcaaaagtcccattttttaattggttgaccatgcatgaggatgtacatagcagtgggacatggtcagagatgatctagatggatggcaaactaggggctgaactgtctactacctgcatggttacatgccagcacgctcacatgaaacctgcaagatgaacaagactaaccaatgatcttgtgtacaatgtacggcttcttcatgcgtgtaccaatggggattcgctgactagatggcggcatacattttatgcgagagaaacctttaattcgttcagagtattcagtgttgtgccatgttcaatgtgtaattattctactaccatgtatagatgccaaggtttaatataaagtatgtatagtccactggcttgatataatcgcaacataagttatagttcttctccgaacaaaccatatataaatagaaaagtagcactgaccgaatgtgctagttttttacgcaaacacgcaaaagtcttgcgtgcaatctatgtattagaaggtagaaatagttgcatagacgatgcaaccaatgtagcagttggtacggaaaggggtgaggcggggaaggcttcatgtgccacagggaggatattacaatgatgcaacctcctataataagaaaaaaacagaaaaatcacaaaggtttcgtgccttctataatctatttgtgtttcttgcagtatcaaatcagttgttattggataatttattttatctaagtttgaatatttttaatgcaatcttgtaagtatttatggttataattttatttcatgtaatttatagggttagataattattagtcaacgttttttattaaatattactcaacattttaggtaataaagatggtactttgtttaaataaatttcaagagtgatgagaatcattggattccatccaaggagagagaaaaatggcagaatttttttaaaagttcagtcacctaaaatctagacactacttaatacatactttctccatcaaaaaaaaacctaacctagtatgtatataggagtctgaccagattcattgtactagattatgtcccatttcatacatgttgggttttttttgggacggagggagtcgatcgatctgaggcaaatcgtttatccttatgctatttttgcttcttgacatcacgaaagccgacgaccctcagttgtgccgattttgcaaattttctttatagatacgtcatgtatatagcatattcatgccaacgtatacgattataactccaaatatatagttcatctttaaattagttaagaaattgatttcccttaaataagagatgaaaaagaagtactagcgtggccgtcatgcatgagatttccctgacgacgtctagcatatgcctattattgatcgtttatgtacatacacgcctgtgattcttatggacattcattgattatattgccgtctcacctctttttaattggttgactagttaaggaaaaaattgtagttatatgttacttttttagcatgctacagtacttaaaaattacgaaactcttacaactaacattgattttaaccaaaacgtattttgcggatgttagggtttcggcgacggccgggcgaccggccgccggcggcttcacccctagtgtggagttggttctggatggagttctactccgatctgttgttgggttatgcagggtctgcacctgcgtttggtaaggctgtgacgatcaggtctcacccaaaggtgggtgatccggtggattggttgcttcgggggaaaagtaaacctgtaagtttctggataaagcggatcggagaggtgctttcctatggtgtgggtaacaaacctttgattcaccatacagatcaagggccgattggctggggcagatatgatccatattggtcttccagagtgggatcgtatcggaatcgaactctgccggaaatcaatataaagtgacgaactggctctggtcgtggatttaagtcacaactagcttggcgaaaatacaaccaaactgccttcgcgtcttcgtttgtgccgatcacgtgatccaatctatggcgtctgaagtcggtgggggcgacaaagggatcgtcatggcgacggttacccgcccgaagccgatgacggatggcagggttggatcgtcgagtttggcgctggttctggcggaattgccggcgccgaatcaaggagaggtcttggctgtggcagggaaggaggcgggggagcccaaacagaacctgatccctggaagtacatcggttgtggctgggactccaagggtccggcgactcacatagaaggtgatatactggaggatgaagatgacgtggttgaagtcagtcttgatgcagatgaggcaaacctggtggggcagtggaccgtccttgctcgctactactctttgaagacgccaaatcagaatgctctctttgatgacatgcgtcgagcgtggagattgagggctgacatgaattacaagtctcttagggacaacctgttcattgtttccttcagctctgaaggggattataagtttgttaaggatggaggtccttggttacatcgaggtgatgctcttttggtggcagagtttgatggcctgacaagcccatcgcaagtcccactggaggtggttccaatttgggttagaatctatgatctcccgttggttttgatgacgaaggataggggaatcttatatggcagcaagctgggacatgttcgggaggtggatgtggaagcagatgggcggaacaagcatgatttctttcgtattcgagttgatctccccgttaatcgtgctttaaaaacacacatagctatcaagatcaatgtccaaggcaatgaggaggtttgagctgagatatgagagagtgccgcacttctgttttttctgcggttttatgggccactctgacagagaatgcgagaagaagctcactaatccagaccagccgttcagattctcggcggagctgagatgttctcccttgaaggcctttgagaggaagattaacacagtgaaggctgtgcaaagctctggggtggctaggaaactatcgtttagtggagcgggcagtgctagctccacttcatcgagacataagaaggttgagcaatgggatgaggcagttcctccaaggatggaggcttttgatggttttgaattaaatgagaaggaaggggatgctaatgttgacctgcagcttgccgatcagacccgcaatatgcaggtgtcagggggtggttctcaggatgccgaaggcctcacaaaaggaaggaaaactaaacaagctagaccggcaccttcaggtgatctggtttagtcaacggggaagctgtcgtcgggagagatgatacctgcaatgagggagttactccaacaagcgtcttttggtgaagtctccaccgaggacactactagccttaacaagaggaggtcgcctgattcgggaactaagtaggagggcagagtcaagcaagctgctttggagtacacacaggcaacaggggaaggaaagcagatcattgtgaagccggtctctgcaggaagagcactgaagcgtgtcaggaaggaggcaacgggggatacacagatggaggatatggaagcaaccagctcgggggctgctggtaaactgacgggtcccatggcggggtcctatcaggagcaatgaattgcttatcgtggaactgccgtggcatcgggaacgccacgacagttcaagagctttgtgccttggtcaaagaggccagttcccaatttgtatttttatgtgaaactaggcagccagtggataagattaagcgtttgcgtaatagattgggtttgagaggttttgcaggggttagcagtgatggaatgagtggtgggcttgctcttttctggcatgagtctgttcatgtggaaatcttaaataagaatgaaaggtttattgatgcttatattcgtctgtctcctaatgatcctttgtggcatgctacctttgtttatggggaacccagagtagagaatagacacaagatgtggtcgttgctcaactcaatcaaacaatcttcaaacttgtcgtggctagttataggggattttaatgaagctttgtggcagtttgaacatttctccaggaaacctagaagtgatgctcaaatgcaggcctttagggacgtgttggacacatgtgagcttcatgatttgggaatttctgggttaccacacacgtatgataatagaaggggcggctggaacaatgtaaaggttcgcttggatcgtgctttggcagatgacgagtggagggatttgttcagtcagtaccaagtccaacatttggtttctccctgttctaaccattgtcctattgttcttaaattacatggttctgtcccagatcaggtctgtcagaaatgtctgcactatgagattttttgggagagagatgcagggatcagcgaagtagtttcggatgcatggaacgaaacagggggaagtctgatctgggggatatctctctgtcactgaggaaagttatggcagcgctgcagtcttggagtaagaaaaaatacaagaatattggcagagaattggagaaaacaaggaagaaactctcaaaccttttagaagctggaactgataaagctgctatacggcaaacctcggattacatgaatgaattgttgtatcgggaagagatgttgtggcttcaacgatcccgcgttaactggctgaaagaaggagatcgtaatacaaaattctttcacaatagagtggcctggagagccaagaagaacaaaattaccaagctgcgagatgctgctggtacttttcataggtcgaaaatggtgatggaacaaatggcaacacagtattttaaagatatgtttactgctgacccaaacttggatcattccccggtgactagattaattcaaccaaaagttacggaagaaatgaacaacagattatgctctgaattctcagaagatgaaatagcaaatgccttgtttcagatagggcctttaaaggcaccgggtactgacggctttctggccagattctaccaacgtaattggggctgcatcaaaaatgatatcgtgagagcagtaaaagaattcttccattctgggattatgctggaaggggtgaatgatactgccatcgttcttattccaaaaattgaacaacctagagacttgcgagacttcaggccaattagcttatgtaatgtgatctacaaggttctgtccaagtgtctggttaataggctgaggccttttttggatgaattgatctctaaaaatcagagtgcttttgttcctaggagaatgatcaccgataatgcacttcttgcttttgaatgctttcatttcattcagagaaataagaatccgagatcggctgcctgcgcgtataagcttgatctctccaaggcttatgatcgcgtcgactggaggtttttggagcaatcaatgtataagtggggtttttctcattgttgggttagttgggtcatgacctgtatatccacggtgagatatgcagttaagtttaatgggaccctactgaacacattcgctccgacccgaggtctgcgacaaggggacccgttgtgacccctttctctttctgtttgtggccgatggtttatccttgctacttgaagagaaggtggaacagggagctatctccccaatccgggtttgccaccaagcaccagggatctctcatctactgtttgcagatgacacactgttattcttcaaggctgatctttcacagtcacaagctatcaaggaggtgttcggcagttatgctactagtacaggtcagctaatcaatccaacaaagtgctctatcttgtttggtaactccttgccgatagcttctcgagatgccatcacaaactgcttgcaaattgcaagcacggagtttgaagataaataccttggtctccccactccgggaggacgaatgcacaaaggtaggtttcagagcttgcgagaaagaatatggaaaaagattctacaatggggtgagaattacctatcgagcggcggaaaggaagttcttatcaaggctgtcatccaagcaattcctgtctatgttatggggatttttaaattgccggagtcggtttgcgaggacctaacaagcttgacccggaatttttggtggggagctgaaaaggggaagcggaaaactcactggaaggcatggaaatctctcaccaaatccaagtctttgggtggcctaggtttcaaagatatccgtctgtttaaccaggccttattagcaaggcaagcgtggagactcatcgataaccctgatagcttgtgtgcacgggttttgaaagcaaaatattatccaaatggatcaattgttgacactagttttggagggaatgcctccccggggtggcaggccattgaacatggcttagagttggtgaaaaagggcatcatctggaggattggtaatggcagatcggtgcgcgtgtggcaggatccttggctgccaagagatctgtcaagaagacctatcacaccgaagaataattgtagaattaaatgggtggctgacctcatgttagacaatgggatgtgggatgctaataagattaaccaaatcttcctgcctgttgatgttgagatcattctaaagctgcgcacctcatctcgtgatgaagaagattttattgcctggcatccggataaactcgggaatttttcagttcgcacagcttataggctggcagagaattgggctaaagaggaagcaagctcgagttcctctgatgtcaacatcaggaaagcttgggaattgttatggaaatgtaatgttccatccaaagttaaaatcttcacttggagagcaacctctaactgccttcctacttgggacaacaagaagaaacggaacctggagatttctgatacgtgcgtcatctgtggcatggagaaggaagatacaatgcatgccctatgccgctgtccgcaagctaaacacctctggttagccatgaaggaatcaaatgatctgtcactaaggatggatgatcacttattaggcccatcctggcttttcaatcggctggccttgttgccggatcatgaacagcccatgtttcttatggttctgtggcgaatttggttcgtccataatgagatcatacatgggaaaccgagcccttcgatagaggcttcacaacggttcttacagagctatatgaaatcacttttagagattaagcaacatccttaagctaatctggagaaaggcaaacatgtggttagtttcataccgaacagtcctgttggtcaaaatttcagacaacaggtgaacttgaagaaatgggagaagctggcgctagggtggatgaaggtgaatatcgacgggtcctttgacgcacaggttaataaggggggaactggtgctgttctcagagatagtgatgggaagattatctttacgtcctgttcctaccttgattagtgctatagtgcgctggaagcagagttgctagcttttaaaacagggattgtgctgtccctgcaatggactctgttgccgttgatagtagagactgattgcctggtggctatccacatgcttcaagcagatggggaggataaatcggacctagcttttcttgtccgagaggtgaaagatctgttagctggaataagggagattaaaattgtgaagggccatcgtgaccaaaatcgtgtgagccatctgttagcgaataaggctcgctgtgaatctatttcagatttttggcctaagaacacttgtaatttcatctcacattttgtctgtgagtagtaatatatctccctttccccgcaaaaaaaacattgattttaaccgtttgatttaaattactggaaacagaaaatctaaacatatgtatcaactttagtaatagtatagtacagaaaatgtaatacttgtaccatcttccattttttcgaaagaaatataaagagagtatgtgctgcgatcgatacaatcatgcatactccctccgtcccgtaaaaaatcaacctagtattgaatgtgacacatcttagtattacaaatctggacatatctctgtccagattcattgtactagaatgtgtcatatccaattttagatttgtttttggacggaaggaggacaatatttgaattgaaaccaattgcaagctagccgagactctagctaaccataggtcttgcccgtttgttctttatttattagatgataccaaatactgcagatagtaggggagtggattttgatccctcaaggggatgtccactccttatttgcatgtcatttaaatgattataaaaaaattaagaagatatataaacatgtgatatatcactctacaaacatgcaagttcaaattcaacttctacatcttacaacaaaaaaacaaatttgactatgaatatactttaattagctgtagtttaatttatttttttcattgcaagatgtagagttgaatttgaacttgcatgtttgtgaagtaatatatcacatgttaatatatcttcttaatttttttttcaaattgcttcataatcatttaagtgacatgcaaacaacgaggagatatcccccgtaggatcaaaaagtttccctagatagcaataaccaccaaattatgtccatgtggattactagtagttctaagagatgctcgcgagagctgtatatatcacatgacccctaatggattagtaggttgttctttcgtgtgcttgcatgcctagctagctagcttcaggggttgtttggttgcatgccacaagttgccacgtctaaagttagtcatgccacggttttttagctattgtttggttcatgacacaactgtggctagccacacattttctctatatggccccacatgtcatacactagtattttttgctaactttggctaagttgtggctagtattttgctaaccacacattttgtggcagccacaccttgcctaatatgggatttggcaaagttagtaagcaaccaaatatcccctggtgacacggcccattccataggcacatctttgaggcatcctttcaccttctcatggactacagataaagaaaacataagacatagtatcaaactgaacgtcgcaagagcagaccaaattgatcaattggaccaccactacgttggtacatagctggtagacggcgctgacaatctaccttgaggcacccaaaaaaggagtccgcactctactccttctaatgacatgggagatatggtaggagagaaaccagatagtgttttatcacaaaagctttcggcaattttcctcgcagggaaaatctagcatgaggcgaaaacttggccaacatgagcaaaacgactcacacagcttataccttagttttcccatttacctttgttagtttcttttatctatacagaatttctttctactatattcaataaaaattggcgcactctaattaagtgttgatttgtaaagaaaaaaaaagcaagaactgcaacacgtaccaatgcatgcatatactattttacatttagtccatatatttttttttcatataactaaattaaacttgatactgtggaaacactgttgttttcgctaattaattaattgcattgtcattttctttgtgagttttgaacgagctgagcagaggcagttgtacaatagtctgccaccttaattcttttttttttcgggaaaaaggacttcattaaatcacatgggacaaattacagtctttttcaatcaaccatgaaacagaattggactcaaacccagcccaaaagcctgagtaatcgtcccttctagctttgtttgctaattcatggctaatcaaattttgttcccgctggatcttcgtaatagaagtcgtcctttctcctgatcgaagccatcttgcttctctgactagaaacgccagggttaagcagtcctccttattagtgagtagatgcacaactgagatgcagtccgtttcaattgcaaccagcagcagtgtccattgcagtgctaaccgaaggccctccacacaggcggcaagttcagtctctaacgctgaagagcagtttgcaagtgacttgcacatcgtaaagatggtttcaccattgtagtcccgaagaattgcactgatcccagcactaccatcggactcaaggaaggagctatcgatgttcagttttgccaatcctgagggaggtcgtttacagcattcttttggcttatcatccttttgcgtttggcaaattgtgtcgccctggatcttcttccgatccccttcaccaggtcactcctttggccattctttatcatcagcaaggattggacatagctttccaagaaccttttcaatgcacttatgggtgttggtcttttatcgtgcactatctcattatgaatgtaccaaattcgccacaaaatcatcagtatacgcataccatcttctgccgaaactgtatctagcaaggctaacaaccattctgggcctgtctgccaccttaattctgcatatatagctgtcctgtgcaaatgtgcaattaattggtatagatgtccaagcatcagcaagtatatcttgcagtgcaacacggcgacaaaaatgtgcgtccaacgcaaccattgtacaatgaagaagaagtagaggccacagcatgcaagatatatccatttgcaatgccatgaagaagaagaaacagctagctaccgatgctagttaattagcttgcagataagggtttgaccagcactaattaatcaccacctacaggaagtcagaaattaaacaatgatacttacccccaaagcttagcagaaacaacatgttacagctgtttcaagcaccaagaggccaacgcccacctaccttacctagcttgtttttaatcaagaaactgacgatgtcccacgctttgttgcgggatatatattagataataaaaaaaaatgatgaaatgatttggattgaaacattataaaaatgatttaaaaatgatgatttagcatgtgtatatttagttatagaatgaaataaattatatatataattattatatacttacatgttaagcttttctttcttaatgggttagtgtagcatgtaggttttagaagctaataaatattatgcttgcatgctgagctttagatgtttagggtgtattagctttatagtagaaagaatggatacaagctgctcttgagccggccggccggcgcgcatgcatgcatcgatcatcttcgtcgtcaaggcgatcggaacagaccagtagccgtctcttggaattcctttcaacttaattatacagcttacttagaattatatcaaatattaatgcttaaagagtaaagatagtactcaagcaataaggtggtcatattgtgttgaaaaccattatactttcggaatttgttagaactaaatcttcagttatatactgattatatactgatacttgatcttttgctcgagacatcattttcaggtgtcattaatttttattttcatgtattagactgagatagaaattttttacctcaaattaagtattaagtatagtactctctccatcccaaaatataagcattttttgactttgatacggtctccgagatgctactttgaccaataatatatataaaagtaaaatattttaaataaaaagaggctgcatattatgatagtttgttcagtaataaatctagtaacatcaattttatatgattgattttatttttatttttttactattaatagttaaagtttaaaatatttgacttgtcactattctaaaaatgattatattttgtgccggagggagcagtagtcaggggttggagccatcgcccggctagctcgggtggctgctcgggcgtgccggcgaaaactccaataaattttaatattgataagtaaatcgatgatgatatttttatagcaaatactagcaaaatctttttggcttcaccactgatagtaattaacattacggcccctcttgtgaaaaaaagacgaagggcttgttcactttgctactattttcaaccttaacaagttttggtattgccaaattttagtaaagttgctaaaattttagcaaaattatcaaattttggcaagatttcatatgtacttattaaaatttggcaacaaattaaatgtagccatttttttagtaattttgcttaaaaaagataatgttgaaaatggtagcaaagtgaacaagcccgaaaccctggtttgagacgtgagaaaaatcttctcttcactcacagaaattgaaccgtttccaatggaatccgcacgaaaatctcgtgaatagcatgagtgagtagtcacacacacatgaacacatactgtgcgctgagcctcggcagggagcatcgcgcggcgcgagcaacccgggggggacgctctcgtactgtaagttgacattctgatgtctcatattaaagaattcttaagggctcaaagtcccattttttatttggttgacaatgaggatgtactagtactgatgcatagcagtggagcaaggtcagagatgatcagatggatgacaaactgggggctgaactgtctactgcctacatgccagcacgctcacatgaaacctgcaagatgaacaagattacggcttcttcatgcgtgtaccaatgaggattcgctgactagatggcggcatacatgtttatcagtttatgcgtgagaaaccttttaattcgttcagattattatgtggtgtgccatgttcaacgtgtaattattctactatatatagatgccaaggtttaatataactatgtatagtccattagttagctagatataatcataacaataagttgtagtttcttctccgaactgcaatctatgcgttagaatgtagaaatagttgcgtacacgttacaactaatgtagcagttggtacgaaaaggggtaaggcgggggaggcttcatgtgccatggggaggatattacaatgtgcaacctcctatgagaaaaaaaaagcgaaaaaataagaatttcttacatgcctaaataccataaaggtttcgtgccttctataatccatttgcgttcttcgtgcagtatcaaatcagtcgttattggatagtttattttatctaagtttgaatatttttaatgcaatcttgtaagtatttatgattataattttatttcatgtaatttataggattagataattattagtcaacattttttgattgaatattactccacattttaggtaataaagatggtactttgtttaaataaagttcaatcattggattccatccaaggagtgagaaaaatggcagaattttttttaaagtgcagtcacctaaaatctgacactctctagtacatgctccctccgtacttctaaaagaagtcgttttggacaacgacacggtctacaaaacacaactttgactttttgtttctataaaaatatttattgaaaagtggtatatgtatacttttatgaaagtatttttcaagacaaatctattcatataatttttatattttcaaactcaacaacttgagagttattcatggtttatattcctaaggtttgacttaaatactgtcgtaaacgactttctttacgagtagtacggaggaagtatatataggcatatatgttgttgattacagctaatgatcgatctgcggcaaatcgtttatctgctaattttgcttcttgacatcacgaaagtcgacgagccctcagttgttttttttttttactaaatcacggggcggagagcttgccaacctgaatttgccattgtatttgaggtagaatacaaggtccattagatgagattaagagtctggaggggggaagagaacgaccttcagttttgtgccgattttacaaaaagaggttttagagatacgtacgtcatgtatatagcatattcatgccaacgtatacgattataattccaaatatgtagttcaaaatccatctagttcatctttaaattaagaaattgatttcccttaaataagagatgaaaaagaagtactagcgtggccgtcatgcgtgagagttccctgacgacatctagcttatgcctattattgatcgtttatgtacatacacgcctgtgattcccatggacatatattcattgattatattgccgtctcacccctttttaattggttgactagttaaggaaaaagttgtagttatatgttatttttttagtattgctacagtacttaaaaaaaacgaaactcttacaactaacattattttaaccgtttgatttaaattgatagtaacagatatcagcgttagtaagagtatagtatagaaaatgtaatacttgtagaatcttccattttttttgaagaagaaagagatgatgtgtagcgatcgatacaatcttgtataccctctctgtcgcataaaaaaccaaactaatactgaatatgacacatcctagtactacaaattctagtcatacatttgtccagattcgttgtactagaatatgtcatatcccgttcttagattttttttaacgaagggagtacaatatttgaattgtaaccaatgacaagctagccccataggtcttacccgtttgttctttatttattagatagaactcactctatctacttttgatagtcatatttcatcttagcacagtgaccaggaataagtaattttacttatcatctatttaagctactagttattcctcgtaaataagcgattcattaatatttacatttcttgatgcccatgtagccaatcttgtactccctctagtttcattttaatcgacgttttggacaatgacacggtctacaagatatatctttgaccttatttttctattataatatatataataaataaatgcatgtttacttttattatagtaatttaaaagataaatctatatatgttgttctagttcttttaaactaaatacttttaaagttattgatggttaaagttataaaagtttgacctcaatcttgtccaaaacgtcaattaatatggaaccggagggagtatggaagaatggagagtcacacattaaatccgagaaagtcattaagaggatagttggttagattgaaatatgcctatcaaaagtatttttttttgatttggaaatatgcttataaaaaatagatggagggagtaccatatattcccttcgtcctaatatataaggtatttcagagggatgtaacacatcctaatactataaatctgagcagggagtctgtccagaacatggagtctgtccagaacatggagtctgttcaaattcgtagtactacgatatgtcacatccctccaaaatttcttataccatgggacagagggagtagatggtaggcaataaccaccaaattatttccatgtagattactagtagttagttccagtagatgctcgcgagagctgtacatgtactccctccatactcataaaggaagtcgttttggacagcgacacggtctccaaaacacaattttgacttcttgtttctataaaaatatttattgaaaagtgatatatgtataatttttggtggggagctgaaaaggggaagcggaaaactcactggaaggcatggaaatctctcaccaaatccaacaaagcttttaccttagttttcccatttacctttgttagtttcttttatctatacaaaatctctttctactatatattcaataaaaattggcgcactctaattaagtgttgatttgcaaaggaaaaaaaagaactgcaacacataccaatgcatgcatatactattttacatttagcccatatattttttcatataattaaattaaacttgatactgtggaaacactgttgttttccccacatcaattgcattgacattttttttgtgagttttgaactgagggagcagaggcagttgtacaatagtctgccagcttaattctgcatatatagctgtccagtgcaaatgtgcaattaattggtatagatgtccaagcatcacagcaagtaaatcttgcagtgcaacacggcgacaaaaatgtgcgtccaacgcaaccatattgtacaatgaggagaagacgtcaggcctttttttttagataatggaatagagcatcccggtctttgctcaaagagctacagccaattattataatctcacacttaaaatgagtgaagttcaaagaaacttaaaggatgaaaccaaccatcaagaagaaacaacctaaaaactgccaacccaagataaagagtacacaattattgaattctgtttgtgaacctccatccaaaattgacaaaaagttgcataaccgttgtctcaagaatacggcatgcagcctttaaaagctcactatcttcctcacacttttgtagttgtgcccaagaccggagccaatgtgttgccctgaaaactacctgcatatatgaaatagatggtgacttgtcaaaaataacataattcctactcaaccatagagcccaacatatagcaaatgctcctatgagaacaagttttcttctttttttgtccacccctagaagccaattatcaaaaatatgagatataccatgaggaaggtaaagactaaaagaaaactgaactgctctccataaaaactttgcataatgacactccacaaaaagatgttgaatagtttcatttttcatacagaaaaaatatctcaagctaccattccaattcctccttgccaaattatctttagttaatacaacccctttaagcaagtaccacatgaagatcttgatcttaagaggcatcctaagtttccaaataatcttgtttctctcaatataattattgtttattaaggctaaatacattgtccgaacagtaaattgcccattttgatgataattccatctaaaacaatcattcagttgactcaactgaatatgcacaatagaagcacacaagttatgccaatgtgctaaattcttaccaaccaaagctctcctaaaagaaacattcagcggaacaaatctcataacattagcaattgaagaattcttcattcgaacaatggcatatatagacggatacttatctttaaaagcaacgttacctatccatttatcttcccaaaatctagtttgttccccattattcacaatccaggaacccatattcaagaaagtattttttaactttcatgagacttgaccagaaatgagaatcccctggtttcctatcaacttgagttatataatggttagagagatacttccttttcaataagtcctgccaaaccccttgctcatttattaacttgaacaaccatttactcaaaagacatttattttggatctctaaattatgaacacctaaacccccttggtctttgggttgacaaattatatcccatcttgtcagtctatattttttcttatgatcatcaccttgccaaaagaaacgtgatctataataatcaattttttgaagaactccctttggaatctcaaaaaaagatatcataaacatagccaaacttgatagaacagaattaatcaaaaccaatcttccccccacagacatatgtttacctttccaactactaagtttcttctcaattctttgttcgataatcttccaatctttattgccaagctttctaaaatgcattggaataccgagatacttaacaggaaaagaacctagcttgcagccaaagatattagaatattgatcattatattcctttgcttgaccaaaacaaaataactcacttttgtgaaaatttattttcaagccagataacttttcaaacactgttaaaatcaatttcaaattcttggcttcttgtaaatcatgctccaaaaatatgatggtatcatcagcatattgcaaaatagataaaccatcatccattaaatgaggtattacctcacttaacataccatcatctttagccctcttaattagtaaagctagcatatcagccacgatattaaaaagaatcggagacagaggatctccttgcctaagccctttataggtttggaagttatttccaacttgatcatttactttaataccaacatgaccaccttgaatgaaagaagctatccattgacaccttttaggtgaaaagcctttcatcctcaatgtctgttgaacaaaagaccatttaaccttgtcgaacgctttcttaaaatcaatcttaaagattacaccacttttatttttacgatgcaattcatatatagtctcatgaagaataacaaccccttccataatatttctcccagggataaaagcagtttgagtagggctaattaccttttgagccactccaataattctattagtagcaactttggtaaaaattttaaagctaacattaagtaagcagatgggcctatattgctggattttcatggcctccatacacttaggcaaaagaatgataggaccaaaattaagagagaatagaggcaaagtaccattatgaaactctataaaaagatctaacaaatcagatttaataacattccaaaaaacttggtaaaactcagctggaaatccatcaggacccggagccttgttatgttccatttggaaaattgcctttttaatttcatcctcagtaaattcttgtgttaaagcttcattctccaattgagatacttgaggaatgtcatcaattttattttcatcaagttgtaaaccggaatcatcgggaggaccaaataaacctttataaaaggtggtaatatgcgatttaaggtttttgcatcaccatttattacttggtgatcaccgtcttgcaattgaaaaattcttgtttttctatgcttaccattcgcaaccaaatgaaaatacttagtattagagtctccctccaagatatctttagacttagccctctggtaccacttaatttcctcttctctcaaaagcaaagataatctatttctataaaaccatctaatatcaatttcatcctaagttaatagagtggattcagcttttttatcaagcaagtccaatttatctaataactcttttttatctttttttgtaaatcccacttgtatgtttagcccatcccctcaaatgttgtctcacagtatacaagatatatccatatgcaggccctgtttagattctaatttttcttctttaaacttttaactttaacttttttgtcacatcgaacttttctacacacaaactttcaatttttttatcatatcgttctaatttttttaaacttcccgttttgatatggaacttaaacacaggcgcacaggcgcaataccatgaaggagaagaaacagcgctagctacctacctatgctagttagcttgcagtcttgcagataagggtttgacctgcactaattaatcatcacctacaggaagtcagaaattaaacaatgatgcttacccccaaagcttagcacaaacaacaggttacagctgtttctagcaccaagaggccatcacccacctgccttagagcaaatttaatattacagcccactactaactcaaattcatttatagtcagtctaatagccaattcaacttactatattattaatatatggtcccacctgtcatgcgcatactgcgtcttaaaatccgtgctgtagttgactacatatctgtagcccgctgctcttctctctcatattttatctaattaaaatatgtttataactggctaatagttgctattgtacctgctcttagcttagcttgtttttaatcaagaaaagcgagctgttcttgtgccggccggcgcgcatgcatgcatcgatcatcttcttcgtcaaggcgatcggataaggctagctagccgtatgttggaattcgtttcaactagattatacagcttattttgaattatatcaaatattaatactaaaagagtaaagatagtactcaagcaataagctggtcatattatgttgaaaaccattatgcttttagaatggaaaaagtctgaattacccccctgaactacaaaaccagacattctttaccccaaactatgtaaaccggacgaattaccctccttatccaatccgcggtagttttggtctacaaggcagtccagtcagcaatatatttattaaaaaataggttggccctacctatcggtttctctctctctcttctatctctcactctctctctctcttctcctttagacggcggcggcagaggcaggagcgcggcgaggcgaggcgaggcggcggcggcggcagaggaggaggcgagggggtggagaggcgagcgcagcggcaagggaggcgaggtggcggcggcgaggcgaagcggcggcggaggaggcgagggggtggagaggcgagcacggcgg

SEQ ID NO: 56990 - DNA, 10662 bp, Oryza sativa
accccgccgccactggtctcccccgccatacctagccgccgctcatctccgccgccgcacaccgccgcccctcgcctcctccactgcaccccgccgccgcttgccgcctcatcccccgccgctcgcctcctcctcctccgccaccaccgccgcctcgcctcgcctcctccgctgcaccctgccgccgctcactgttgcccacatgcctccgtgcgcgtgaatgagagagaatgagataagagagagaggggaatagttggataggaatttgatatgtgggtcccacattttattaataaataaaatgctgattaaacagccacgcgtacgccacgtagaccaaaaccaccgcgggttgggtcgaggggggtaattcgtccggtttacatagttcgaggtgaagaatgtccggttttgtggttcaggggggtatttcagacgaccgcgatagttcgaggggtaattcataatttttccttttagaatttgttagaactaaatcttccaattatatactgatacttgatcttttgctcgagactttcaggtgttattaattttcatttttcatgtattagactaagatagaaactttttacctcaaattaagtagtcagggggcggagtcaccacccggcccgccagcgaaaactccaataaattttgatatggatgagtaaatcaataatgaataaatttctatagtaaatattagttatattaaaatttatccgagcttaaaaatctttttggctccgacactccagactggtactcctcttgtgcaaaaaagacgaaagccccggtttgaaacgtgagaaaaatcttctctttacgcatagaaattgaaccgtttcctatggaatccgcacgaaaatctcgtgaatagcatgagtagtcacacacataaggaagaagtacaccgaagatccctgaacttatcatggggataaaaaaaacgtcctcaaaccgcaaaaccagatatacgaggtcccttaactatataaaatcggtcaccgaagatccttcggtagttttgaccccggttttggtctatgtggcagctgagtcagcgtgggacccacgtgggccccacatgtcagcgtgccacgtcaacttcccctttcacctcttttctttctctgtttctctgcttcctccctccctctctctctctgctctcgcagggcatggggatgccggcgctagggcgcccaaggcggcgcgcgcggccggggtcggcggcggcgatggcgttagcagcggcggggaacgggttgtcatcgtcgtcattgtcgttgaggaggctgaggaggtcatcggccgtagagatgagaagggagcgggagcagcaaccgcagtgcgaggaggtggcgggcgggacggcggcggagccgcatccaccactggcgacacatccaccgcccccgacaacccctcctcccaaatcgcctatggcctcacggtacgcaacaccagggccggccctggccctatgcagccgaggtgaccgccgggggcccatgatggtggggggcccatgatagtggggggaccaacacctaatactagtagtctagtacctgtctatggcctacctagaagcaaaaacgccgaaacgagaggagttggagcgtcgtcacctcgtcgcccaatcttagacactattgatcttaataccgttattgatgattttgcatcagaaatgcccgaagaagtatcttttcatgagaagcaatggatatgattgggttcttttcttcattaagataatgatattagttccaaggtataaatatattgttgttttggttgactttatttctcgataattaacagatatgttaaatttaatatatggatatgtttgttttcattttgcaagtaaaattagcgtctatatatatcataaaattttatatatagcttataggggccatcgtgatgagttcgcatagggcccacgaaatcataagaccggccctgcgcaacaccacggtggagtcggagaaggcgatgggttccccggccgcgacggagccggagaagacgccgcctcctcctgcaactgatggccccagcggtgaccttatgtcggcgacgacgcgaactaggggcgccgcctcttcctcgcggacgtggtggagcgactagacgcggtgtgcgctgaagagctcgagcacgcagatccttctgagcagagattgggaaggctggactctgctcgaggttgccaatggcgtcaccgcccgccgacgcccccacccagcgatgagcagctcagtgaacgacggggcctgagcggaggaggacccgagcactagttgaacctggctgacagtattgtcatgggtagattaaagaggcccagttgcacttgcacgcgatgattagtctcagttcttcaagtatcggttaatttgttcttatcatctggctctggcatgctattatcttgcaaatggaatgtttgacacaggtagctgggagctagaaatgcatgcagtcacaaggtcagattgatcgatgcagataacatgggaagtgtaggcgagatcgattgcgagtaacgagccgtgggcggcgcagttcatgggcgccatgggggagcttgcctgcggcatcgacaccatcaaggtggagtcggtgtggcatcgcgtccccaccaatctggcgtcctcgcagatcccgccgtccccgctagttctggctgatggtggtgctcttcttaccgtttgcctgcaagtcaagaggctcgaagcgaggatccgctaggtgtgcgcggccgacgcggccgccggccgccgtcgcggcgccgccactcagccccgctcgccgcctgggcgtctgctccctacccttggcccggcctgcgagagagagagagcagagagggaggaagggagagagaagaggagaaagggaaagttgacgtggcacgctgacatgtgggtactacgctgactcagccgccacatagactaaaaccggagtcaaaaccaccgaaggacctcgggtgaccggttttatgtagttaagggaccccgcatatctggttttactgttcgagaatgttttttatcctatgataagctcagggaccttcggtgtactttttcccacacaaacatactgtacgctgccagcctcggcagggaggcagggaacagggacgcgaagcgcgagcaagcagctgggggacgccagaaaccgcagcgcgcggccttgtttgcccaatgttggaggccccgtggcgccaaccgctacgtcgcgtgggccggcccggccaccattcggcggtcggtgcgacgcgaggcaggcggcctctctcgcgctggctcgtgtcgcgaccgggggtggggtggggtgggttgggttgggttgggactggggagatgggccgaatcgggcgggcagttttccggtgcaatttcacgcggaaacgagcgtaatcagcgtgcgtgccgcgtcgcgcacgactacggccccgccgcatctggaccgtacacgacgcgaccagagctaccctaagatctttttcgccttggatcatttgctctctctggtctaaaccgacaccagcacagcatctataatgacaggtactgatgagaccccatcatgcatgccacgtacgatgaataagctagcttttggaacagagaaggaataagcatggtactagctagcaccatacggccatgtgccctgttgtcttgcttgttagctgaaaccgagtttagcaaattacttcccgtcgaggcaaaccaagcgatcctatatgcgtctatctctcccactcccagtatttgttcatggcgtaaaggccacccccgcgactacgacctaacaacccacgccgaatcaccggttgcatgtgagccactgatgtgctccgtccacgacttgatactccctccgtcccaaaataaatgcagttttacactatttacgttcaaacgttcgaccgttcgtcttatttgaatattttttatgactagtatttttattgctattatatgataaaacataaatagtactttatgtgtgactaaatattttcaattttttcacaaatttttcaaataagatggacgagtcaaacgttgggcacggatatccacggctacacttattttgggacggaggtagtatatcttatattacatcacacctttcttctccacatcgcatcgcaaccctgcatcaattaataatttatatgtgctccctagtcccaacacgattccttctagaacctctagctatagaggtttcactaatgccatttgcaacacattccttttcgcatgtgcgacacgctctttgcttcaggttttacttgaagtatgagcgccattgggatccggtgaaatttccctttccttctccactgccgtattcattatgttgcatgtaaatatattcctgaaaggtatggatcaaaaacatcaaatctagctaacttcaaagaaaattcagcggctggcagcctggcagcgacgtttcagttgttcatgatacgcgtgcaagatgcggcttacacactgcatgatcagttcaggtcccggattcctctccagctacatgggagagcaagcattgctcggaacaattcaaccgtgtggtcaccctctctatctctctctatctccctgcattattgtccaagatatggtacataattcagatcttgccaatttggcaggtgacaaagcaaggtctcttgcaatgggagttggaggtgggtaagtaaggttaaaatgacagcaaagaactgtgaccacaatgaccaagtacatactaccacccaagtaacccggttggtacgctgctcatcgtgactcccaaagtctccgggccacaggccatgtggagatgcatcgcacacgcacagcttccaccaatcaagccattctcaccagccacggcagagaagagaactccactgtttcagagctctgaatttcttataagctttcagcaaaaaaaaagaaagaacgggggagaaacgcaccgttttcgctggaattctgtgggtttgcagcgcgcgatgtgtccgtttccaccgccaaatgcggccaaaccgccgtacggttccatgtgccacacatgcgatgaaaattcgcacattttgatacgggatctgagcctttgctatcgctcgcttgtgcctttcatttcgttgcagcctgagtagaccggttttatttcggtcacatgtgagcatgaggttgcagttctctctcagtgttcttgtgactctcagttatcagggccctcgcttatcagtgatagttactactcctcagatctttttccctgctctgttgaatgagcctgagccactggaagagtgacaggggtagggcctcgatttgatttgattccccttgccaaaagaagctcgttgatgaaccagtaatttaactgttttaagtgtaactaaagcataatcagatggttggagctttccttctaatgctaaggttagagattctctgaaaattcacatgaaagattccgtgaccaccccgcacaaagctccacatggattcagattcccctgtcggctcttgattgaggacagatgccccccccaaaagaaaaggagcctgtaaaaatattgtcttccccggttatcatgtcagtatcagattttaaaatcagtcgtagatgcccagatcattttctaatattagcaaaagaattagtactatatatcatatcactaagcagagactcgtgcagctcgtgtgcgttaagtacccaagtagtgcatttcttgtggaggtaatcaactatatttaacagttggaatccacatgttttagtggtttacaaagtctcaaacttgataatacaaaatttacaaaataccagagctcaccttgtaagcagagtagtagatcaacaagtacacaacattaggtgtgtaaattacattgtcttctgtacaaaattcagtgtattacagttagtaacagtgacaaattcaggtgctccaagatcagatgaatcccaaggtctaatctttagatcaacagaacactgcatagtgtggtgggatgaatacagaggaagatctaggaccaaatggggattaaggaatactcactatcaatcaagatctagcacaccaaaattacatcaatcctgtgccatcttacactttccttcagctagaaggcatcaataccaggattaaaaacctatgcacatacctaagccagcagcagaaatggtaaagatttcttattgcatctgtacaaaaatcgcatagcaggcagcagcagcagcatcagcagcaagcaagcaaagtatagcatctgtagctcactgaagtgagtgctggaatggagagctctaatccaactgatcagtgatccaaatcttgcaagactagctgatttgatgtggatccgcagctgtgtgttcgatcgatggccgcctcattgcaggtcgtagacgttggaatcggcggcgtagcagccaagaacgcggacgaacaccgcgaatctctcgatctccttgatggcgtcgaggacgcgcgggtcgtgagaggcgccctcgcagtcgacgtagaggacgtgcgggaacgcgcggagcgtcggcgcgccgcgggcgctcgtgtcgaggatcatcacggggtggcccgccgcggcgccaccgccgccgccgccgccgtcgttgttgttgatgacctccagcttggtcaggttgatgttgcgggaggagaaggcggagaggaccttgaggaccaccatcatggagccgccccggtgggcgaccaccatgctggtcttggcgtcggcgtccatgggcagcgtcaccggcgagggcggcttggagaggagcaggaagcgggtgacgttccatgactcgtcctggaggccgtgcgcgagcacgtcgaggccgtagaggtcggcggcgcgcgggctggcgatggcggcggtgtcgagcatccggttggaccgcagcatctccacggcgccggcggtgtcctccacgggctccctgtccacgccgagccgcgccagcgcacggccgcagtgcgcgagcgccatggggtggctaatcacccggcgcacctcggcggcgcggacaccgggcatggcgaggaggcagtagtgcacgaacaggttgatctcctggaccacgacgaggtcatgcctcagcaggaggtcgtagttccgcagcgcggtgccctccatggtggactcgacgggcagtatcgcgcggtcgacggcgccgccgtcgaccgccgccagcgcgtcggcgaacgcgcggcagggcacggtgtcgcacccggggagcgccgtcttcgccgcgaactcgctgtacgcgcccggcgcgccctggaacgccaccctgagcccgaacccatcctggcccccggcgccgcccgtgctcaccgacagatggatccggtcattcccgttgatgtgctgcgccgccgccttcttcctcccgctcccgttgacccccttcttgccgtcgccgttgatctgcgccttgccgttgggggacttcttggaggagtgtccgttgacgccgttgatcttggccgccgcggcgacgaacgacggaggcggaggccgcgagtaggaggaggaggggttggtcttggggaggaggaggtgcttgtggaggtggagggaggaggaggtgtaggccatagaacggcgcgcggcggcggcggcggcggcggcgagaggagaggtggtgggttgggattgggtggggagagagagaggcaaggaaaatggagagttttcacagttttagctaacgagcgtggtgggggaaggttttgctgactttttataaacacacggcggcagcggctggtcggcagcggtttggctctggtttgctgcttacaattggctgtttactgtttatttcttgcttctgccttaaaggcttcggtaattggtgttgttcacagtgtaattgacggagactgcggatgagggtgaagggcttgaaggctcccccggttattggtgttgttcaccgtgtaattgacggagattgcggatgaaagtgaagggttataaatggtggttaaacacgcgaaccatattgatttagggtgtgtttggttgaatgaacgagtattgataggagatgaccgtctgattttctgtggtgtttggttagagggtaaggtggatggggcggctcgaaatagggaatattacctcaatatactggatgagtgcatctagccgatttggctagatgaagccatccagttttggtctggatgatgtgtcctattctgattggctgtggttggtttgattttctattaagtaagctccaaatgattttttttctcttaaaccgtttatctaatttatgatttgatcacacctttatatttgttacaactaaatcttttaaaacaagatttcggattattatattttgaaatatatatatatatatatatatatatatgaaaaatgggtcccactaacttttgccttttcccattcatgctatatccctccaaccaaacaagtaatttggtcatcatatctatacaaataaaacaaaaaattggatcgtcatccaataaaaaatggatcgccatatcacaccatgcatgaccgtgaaccaaacacacccttagtcattgggatttgggagcgattggttgtgagtcgatcctgccgtctgatcggaatctaacggtctaacctacagctttgatcgcttatctccgtgctagccagcctaaccgcactgtgttttaggccatgaggcttttctaacgaatgttagagagacacgagcatatgacgtgtgagtttatgagggtgggtcttacatgtgaaggactcatgtttctctgaatttatgatagaggagttgtttttgtgttttagggttttcttgcattggcaagactcgcttggggcgtgggtaatgataaacatagagatgttcgatgttgtcatgtagcagtgtatggtgctggcatacgatattctatgataggctgagtctaggtggcatcgaagttgctgcatcagttgatgaggttgataatgctgacatcaaagcaactacactttttagttgaagttagagctcaatcgtatccatgcgtgctgttgaggtgcgatgggcggtgaccttattagcagttttggcattctggtggtcgcgtgtgtgtctctagggtgaaagtgctagttacgtcactgccttcggacaccgttcaccttctagagatgatactatgggaattttgtgaataccacatttaggaagtcctttgggtgtgtgaacctatagatccattttggattggacaatgttgtcattctgtcggcatgcccttgttgaagttagggctcttattcaacgtgggagcaacgacaataactttctgtggagtgaacgtttcacctgacgttatcataggtttgtgtcacttgagtcatgtgttttcattcgtggtggttatattaagtttttcgattctgattttcctcataaactgaatcaactatattcttgtatagcaaattacaggaataccatacccttttcaaaggtttttcaaggaaaaaggaacaacctattcaatcatctagttggaacacgctcgttgtcggcttgtcgctcaatactcatgtgtcctctatttaactgcacgccgcctcctaatttagcggcattggtatgtacaggagttgtatgtgcatgattccatcctttaaacttcgattgcgtacaactatatgcacgcaagcaattgtatagatttatttaggtgtgtatttagggcttaaactctaggttgtgtgtgcatattaatgtatgatgatgtatattaatgcatgtctctgaacagaagcctaaatcatattcataccatatcaagaagttcctttgtttgtattaatttaacttttgatcaaaacctaccagaaatgtgtagtataaggattgatatatacggcaatgtacaagatagcaagtggaatgagatgattaattaggactattgaggcactttaggaaacattgcattagatgacatcttgttggcatcttagtcatagtcacatagatgcatatattgggtggctttgcttctagaaggttggttactctgtgatgcggtgttatcaccgtttgcttgttgatttatgccgcaactaaaatttgattgattttaagttcttttattataatattttttagcattgcttttatatcgctgagaacatgatttaaaagttttaccataaattatttttagttgtttcattcattttctgtagagcaaacgatgagcaaactagtgttgggttacagggtaacaatttcctcaagcagcttggacttgtgaatgtgaatatagttgatgcaaagatcaaaactatatactatatggtaaatcatcaaccccgttaattccgcaagattagtgcagtccaaaaaatatcttctcctaattcaaaacacttaaaacaactcctttacctgtactactatccaagcaattctcacaaccaaagcagagctggctttgattttgaacacatgattattctgtgaccctgaattgctggagtctaattaaccaatggctttcgctgttggacagcaatgccgcataactttccagtctttcct

SEQ ID NO: 56991 - DNA, 25492 bp, Oryza sativa
  unsure (1)..(25492): unsure at all n locations
aagcagctgtgagcttcctttcagcagttttcccaccattgatggctgaagcagaggcaggcgccagccaattgcgttgctgtttcggctctcaaccgatggacagaatcgccggtgctttccaaacctctcttgctgtaagtctgtaactattagtggtatgcaaatgggagatgtgataagctcgaagaatcattcttgatggttacttcatcagataagaacgtggcggttaatgttgatacgcagatctgactacagtatcattgacgttttgggaagaatgctagtactactagtggcttgtttaggcaaacgtgattggcctgactaattctacttctagagtaaagtaaaggtcgctttctactagtatagtactttgtataccttttttagtgaaacaactgcgaaggatggaaacggtatgaaaatttccgttcatataccgagattatttttatacaataaatatgaaaatggtatcgtttccaaccgttttttgtttctagccatctatagaacttagatttttctaatttcattcagcatcatactaatgtcaccactaaatagttaaattcatcaatatgaaaaattccccaccatattaagaccgtttccagaaaataatactctctctatattttaatatatgacgccgttgacttttcaaccaacgtttgaccattcgtcttatttaaatttttttgtttaaatataaaaatatttgtatcaagcttaaacaatatttgatgataaatcaagtaacaataaaataaatgataattacatacatttttgaataagacgaataatcaaatgttgattaaaatgttaacggcgtcatatattaaaatacggagagaggataagttaatattgtttccaactgcttttatggtactgcttgatctactagaacaagctaaaattaagcttgccacgaccacaagatgcaatttttttgtaatggtggctggcaagttaattggataagcacaatgcaggacttgtgtagtcaactgatgtcaatgctgaaaacaaaaaaaaaaaggtggatgcatgcacgcgagacggccaaagtcagtgatggcgggcgtcgttaacaagtggaaattcaacaccgcacgacacggctctcccaacgcgcgctgtcatatgggagagagaattttgaggctccgttattattcttccaataaacttctacttcttttgaaatttctccaaaatttccgtttcacctttcacccaaaggtatcaaatacagccaaaccgtttacatcaccctaaaacatcatcagtgctcattcacaatacttatttttttcataaacacgtaaaaaattgcacgtccacgtaacacttatatatcctgacatagtatacttattttgttacgtctaaccttagtcgtggtaaaccgtttattttataaccctccattatcctgggtccattgccggatgaagctgatgggccagccatcaacctgtcgttgcttgccgtgtagaaaaaaacggacaggaaggatacggccggcgcctgcccctgtcaaaatcttcgactacagatgtctccgcaacaattcaatattctggcggcgatggctgtctagaacgattgcgtttctgcaattggttattcatcgtttaattactcttctttttattattattagtactcgtttaacactagatatgttcggccaaagcctggacgcgatgtgtgcagtgtgcatgtgcagtgtcggatgaaaggcctaatccaggcacgctctttcgccatttcttgaggttcttatcgattgctcatattccctagcaagctataatattagagaataaaaataatttataggtgaaacttttatatatgtgttattaacattctaaaagtcgatgctgaaaaagaaagtacattaaaaatatcttaaaaccaatttcaaaataaaatttgaaaattcaaattttagcttttgctttgatttattagtacagccaatatggctataacttatctctcggtgtggtcacatactcacatcgcatcaccaaagtgggcgtatgggcctgactgatcatgatagggaagaggaccaatcgatttggcacggttccattttcatattacaagtggccaccaggtccatactacaccaatccttttcctcctgacttaaaggagactgcgtaactgagtgagtgagtgaccgtcctagagtatttatctttagcatttaaaatttgtctcacaaaaactttatttccacgggttacagctgaatagctgataagaccattaaagcctagaaataaaaacaagaataaaaatatcagttatttctcttcgccactagtttgtttcagaattgctcgaagtaaagtttccctgaaacgtgtagcttttgcgccttcgccccatagtaacaagtgtcattttgaacgtacaacggatggcttgggcgtgattcttttcatgggccgtgctggatgggccaggcagcccaaaagtcgttcatgctgctatgactatacacgggccatggcatgggccgcttgatacagattctactagaatgaggataacacacagatgcaagacatacacaaggccaatacacaaaacaaataacaatcaatttatacatgtttatactcataggcttcctcgaactacataagaaactaacatatgttttaacatacaaaagaaggtcgacgtaatgtatttaggtggacattttgcccccccccttccccggtcaaaaaaaaaatacaaaagaaggttcaattttcaatatatctattagctctgagcctccaaacatctcgtaagcaccaaaataaggtaacatatatgtttcattgatcttggttgagcacttgaccaattttaatgtggctgaaattgtaaacaagaaggaaaaccgcaaaattaagtattcattcagcagatgtttccattatcagatccagaggattagggtataggattaggagaattagagagcaagtggcaattggacaaggatttaggggtttcgccgtattggaggagaacttacctgctgctccagcttggggcatcgggccactcgacggatggcagcaagatacaacagctgacgcctagatgggatcgccgatgacttatcaacgtcagacattaagggagaaaatgtttgtgtgaggctacagtaggcatgtagcttcaccaatcaccaccgctcttgtagaaactatggagtattttgctggttgagtggaacacgcgcacgcaccacttatatgcataccacaccgatatgtacaatccttcagcacatgttcaatagattttggtatgggtaatccatgaacctaacaaattattttctaagcacgttcaagtgtgtaatatcttcatcagaatgctgcgcatcacttgacacatttttgggggtgaaaccacgtaaatttctaaccttgcaaattgtatctatgatttatgctatggatttatctccgacgagttccagcaaacatcagtgagtatttgagtcggggtggagaaagtagaaggtgtttccggcttagagggatgaccagagtgatgtacggtaggtccgtgttggagccgattgtggtggtggggcggtgaggcggcggggagaagggggcgaaatgacacgtagatacttcttatgattatcaggatctacgcactaactaatggcaaactcatgcatgtacaacttcacgaccacgccaaaagtgttcccatcgtccagatagctttcgactttcaaggaagcttgcagaatgtaagatgctgaacgctcataaaaggatgatctggcttttgacattctcgcagaatagtatactatttgggggataagttcaagaacgtccttttcccccaaattccaaaaggcaaacaaaatgcttggattgagctttactccaagctaaccacagatggatctgcagctagctagcatcgatcatcaatcaatcaagcagctggggctagcttagcttggtagtgcatgcattcatcaccatgtgggccttcagggagatatcgccaaaaaccccttcaggtcccatgcatactagtggccttgtgggggcatccacagcttcgtgtagtgcagcaattcgatcgtatcgtcgtggagcactgatgctaagttgctaacaagttacaggctaacagctgaattctcctgcagtgttggtaggacttgctgtttcttctctctgcaagctggccgtgcttaacaactagcacactcgtcaacgcacacaaaaatgtttttcatattttgatcgatcgtggtacagccggcgatcagttattcagactggtgatcagttatcactaattcaccatccaaagcatatgagcctctgaaaatggagtgttgcagcgattatattctcgtcgttgtctttcagaggaaacaaaaatctctcaccatgcatggctcctacaagctagctagcttcgtgatctagtaactggatatggtaggtggcaagaaaacaaaagaatctagcgattcatcatctactcatcatgccaagactgatccctttcaccttttccattaaacccttaattatggtgttcgagaccgggtcaaaaataaattaacatcctgcagatcacggcttgatcagccgccacttggacgcgaggatcgtactaacctcgtcgcgcactaacgcgaaagcggctttgcgacatgtgagatctcccccaatgtggcgagacgccattggcctgaccgtcctgtaagcctgaaacagccactcttttttgctccctgtgcttcacagctaatccctagcccagcgtcgatcgagcaagcaagaaacgcgtatcccgatttgtccccaatgttttcaccaactcccgcccgtttttataccctcgcaatcctccgtttcggtcgagtttagtacacatcttcctctaatataagccagtttgtttttttttacgatccgtactagacggtgcgaaattctattggtagagcaggccagtgtacgtataagtacgtgcatgttgatgagctgatcgagtgatcgatcagtgtggcagtgtggtgagcaatgtgagaggcacgtaggtgtggattggtgtgttgggttgtggcatggagcaacgggcggcggcggcggcgcagcagcggcaggggaggaggcagagcgcggcggcgtgcgggatcaggcgggcgagggcggagacgcggcacccggtgtaccgcggcgtgcggttcagggcggggaagtgggtgtcggagatccgggagctccggaagccgagcaggatatggctcggcacgtacgccacccccgagatggccgccgcggcgtacgacgccgccgcactggcgctgcgcgggcgcggcgcggcgctcaacttccccgacgccgcgcggtcgcgccccgccccggcgtccgcgtcccccgacgacgtgcgcgccgcggccaccgccgccgccgccgcgatggcacaccaggaggaggacgacgacagtcggcgtcagctcgaggacgggggcggcggcggcggcgtggtggacgaggacgacgtgctggaaaaaaaaaggctgatggtgagcatggcggaggggctgatgatcagcccaccgccggtgatgctcggcctgcaggcggacggcggtggaataatggacgagggcggcggcgtggtgaggttgtgggatcacagctgagtgttcgaccacgtactgtgggtaatggaggagggtatgtgcgcgagtgcaacgccatgatcgatcgatggatggatcgagcagatgcagctgcaggtggtgtggtgaggatcgatcgccctgagacgtggacgtacggaggaatgtgtgtcctaacgtactatacgtgcgtacgtggtgatgcgcctctacgtagacgtagcgtgggtgtgatccaagtggatgatggtgacacaatacacatacaatgtactatatggatactgggacatacagttacacggacacctttttcttgcaaaagatactcctactctcctagattagtcaacggtttgagtttgagacaagcaggtaatgtgattttttttcgattatatggcagaagtgcgcacacatcactatatccgcaacaccatactcacatctcacgaatgtgccctctaacatacgctttaaagacaatcccaccccccaattataccgcagacgcatatatgcacatcattatacacattaacagtgcactcacacccccatgaatacgtcagctaacacaggctctaacaaacgaaaaccaactgcacatcccttatctcactaaaattctgttaaaagcccacctgcatatgtgtaatattcgtgggcaccatgatttagatcctaatgggtaaagtcatacacccacaactccaccatcacaccactggtgttttctcataatgtgaaaaaatgtttccaatagcattgacaattttcacatcatggaaaaatgtcgcttgtaaaaacaaaattgtttatacagctgttggtgcgtaaaacaatggtttatattttgggatgaaaaattagtgaagaaatttgactatgatttttttttaaaaaaattggttcggagttttggtggatgttggcataagtgtatgccagattacaacatatgtgcctagaaatagttgtttggtctatttgtatgcaatgacttgaggactgttgacaaccaaaattggcatatcctaacaaaacaagatactccagatgatctggttttgggtgtccgaacgaacgatttgtattcttaatagattcattatggattcaatttgtacaaggggtaagatcaatgtaccatcctgaaaattttaacattttcaaaaatgcaccatgacgattctttgcttattacttcgattatttcttctattcggagaaatataaagtgtgtcttttaatctgaaaagttgatttcagatatttctatccttttatgtcttgattcaaatttttgaatcttaaacctttttattgaatgtttgatgtatcttgctttaaattcctagaattttgaaccatttcttatttccatccatttctagaaaagcccaaattagtatcatctcaactttataatttcgacctttttattgatttggagtttcttggttgagttttatatttaaatctcttccttctgaaatacttcctttgtttcaaatgtatgtacttcatatatatgtgctcatacttccttctgaaatacatccatgtatgtgcttcatatatttgtttggtttcatatggatgttagtaaatctagacgagagatagagggggtcaaaacatcttataatgtgaaacacgcngngggggggggggggggggggannnntntnnnanccaagatgtccatattacatgttacttctaagttccaaacctctaatttatattagtcccatttttaaaacaagaccttctccttgaaaccctttttcatcacatagtctctatatactcctacaccaaaaatttaattaaaccttaaattcaaaatcattcctataaacttaaagtttccttagatatgatgtagttatttttctaacacaagataagaggtgcacaagtctatatattttatcatatatgcgcacaagtcatagtaatatgaaaatagtgtatcgtaccgtcaacatatcaatctgtatcgttatatcttggaaaagctattttaaaattctgaatacctatcctataaattctagatccgcaactgttctatagagccaaaatttcgaaccgcaagtaatattttcaataaggaataaaaccgtcgacattacaagttttaagagtcggacaaccatagttacatgccctcattagcagcttccacgaagtggtaacaggcaacaataaagatgcagttttggttctgcttctaccaacgcggcgactcaacacgcacacagctgtaggttcatctctggaaacgccctcctgtatcggctgccgcaacgacgacgacgaccagaagccgcggcgaaactgtgagccggccggcacatttacgtgcagctcgcgctgcatgcagactgcaggttatgcaggctacagtacatcagtaccgcaggaaaaagaaaaaacccccaatttttcatcgtatcctactgctgcgggttgagcacatgaggcaactctggttacagctgtttgctgctgctgttgcaactcgaccgagtttactaatgcaaattgagcggcctaactcaaattcgtcgagacctgcgcttcgtacggatggttatatcaagtttagcctgcccaaacgaggctgcaatcgcgagaccggtgtcctgagccgtctcccatctgccaatggaggaggaggcagcagctagtggcgaccataccatcaaagcgtccgtcgtgcttctgttccgtcggcagttgctcgcccaggctgcattgattcgatgcatttgcttggtgccgccaatttggttcgagttcgagacctctgcattcatgttcgattaccttcgaaaaaaattgaagcctctgacgactctcctgaagattgattgacctcgttgaacagagtgaattaaaattgtgcacacggttaatttccattactgggtggaataatcaggcaggggacaaggagaacaggcaaggagaatcaaaaggcacagctggactggactagagctcggctgctcgagcctcgttttcgaagtaaaagaatggaggcaggcagacagtatctattcccctccaactctccacgtgtagcagtcaactgtacttgactcgtgcagaaggctacacgagcgaaatctgcaggccagatgcagaatcgaatcgcatcgcgtcgaatcgtcgccacggcggccgcggaagccgcgccgaaagctcgtcggagcagtagtttaatcgtctggaaacacgaacaacaaatcacattagtgaaggttattgtaaaaaagttgtgtggttcagttcgaagctgaagcaaagcgtgtaaaaatttgcccgcttcgattttgcagatccgatacacggtaaaatgtacagaaggatttaacaaaaccgtacggttatcacgtggttatcacaattaccatacacggtaatcttttcagttttttaaccacgatatgtctcacggttaccacgtagtttatcgcggaggttttgtaaccgtaccaaaagcaataagagaaacctgatgtgttaaatcccatatgggattggtttattttggaacgtggcgttgagattggcgttcgatctgcgcgtaggtagagaagaatagaacctagttttgccggcaggcgcggccgcgtttcacgcgatgggacgcgcgccacgtcgccggcgtaatggcgccgcggacgctggctgcacgcgcccctactggcccctgctccgaggctcgcctcgccgcgaatccggtactgcgtggtacgagtcgggaccgggtcaccggtccaaggcccccaaacaaattcaccgatccgatccgtcgtcgtttctgccgagttttaccgccgccgctgctgctgtaatttggcgaaggccacacgagttcacgccgcgatcacccagacacgggacaccaccctggttgcgacagaaacaggggagcctttcacatcttacgtggtcagtcctagagaaacagagtagcgtacagtacaaccactgcattgtaccgactacttcttttatactgtatccgccctctagagattttttttattttgttgtactgtttgactattcgttttattttaaaaaaaataaaattattatctattttatttgtaacttcctttattattcaaaatactttatacataactttttgttttttatatttataaaaaaaattttaataagatgagtggtcaaacaagtaaaatgttaaaaatctcttatattaagagatagaggaagtattcttttgactgagaaattgtaccgatcgagtatttacgttactactactactagtacgcatcaccaagtgatcgctttcgatctctctgtttttcttacggaattcaaccttgttcggtcgtcggatcgatcttattaacttcttaccagcatgtgttcgtgcacatcagttttcacccagcaaacactcgtgtacgagtagagacacggaacggtccttattattacacgcattgaccgcctatccagttccctcgagtactagtactacagacagtgccaacctactctattggattagtaattccaagctactgcccctgtcatttcgtattacaagttgttttattttttaaaaaaaatattgtttatgtttaactaaatttataaaaaaattagcaacatatataatattgaattagttaatataacactaagtatattttgataatatatttattttgtgtaaaaatgttattatatatttcaataaacttgatcaaaccaaaaaagtttaacaaaaaatcaaaacgatttaggaacctttgattcatataattggcaaacgatttttataggattcaaattcctatagatttgtttcctacatgttgctttgattcatagaaaagaaacaaaagttctataggattgtattcatatgcttcacatttcatagaaaaaatagcgtgaactttcctttgtttttctcatagcacgatcaaatagctcctattatctttcctgttgattcctgtaggatttgagaaacatactatttcacgtcttgtatttttcctatcctcgaatcaaaggggctcttattataatatgaaactgagggattactgctttaatttggtcacaaagctcactccggtttcgtcattccaagctactcctactcccgtttggtcacaaagctaggcagcgaccaaaccataaaaactcctatagctcgtactcctacatcgtagccaccgcgcctcccatggagtgagtactagtagcaggtagaaacgccacgataacctcggcctcggggcaaaccaaatccgccgcgctgagccgagcgtgtatttagcaggcgatctctctcctcctccttctcccactctccccagctcagccgctccgcccaccgccaccaccgtcgctgcccgctgctcgctgcatctcccaaccgacaacccgcagctcacctgtacgtgctctcgcgtcgatccaaacaagctccaaaaacatcaaaaaccccacgcacatttctttactcgcccggagaagctaccgcgcgcttgctacctctcgcgtctccgtctctgcgttgcattgcattgcattgctcgttctgtcatcggatccgagtctgggatggcggcaatggcgggagggagtaagccgctgaggctcaaggacctcctggagctggactgcgagtcctgcagcgccgctggcttccgctgctaccctcgccgcctctgcgtcgccggcggcgcggctgaggcggcggcgccgccaatgcggcaccgcctcgtcgccgaccggtcgtcgtccgcaatgcggcggcccaagctgtccagcctctcgaagagcctgtcccggcggctcaggggaggcttctggaggcggcgcgaggaagaagacgaggaagccgccgccgccgccgcggcgccgccggcgacggcgagctccaccgcccccgccgtggccagctgctgcagctccagctccgactccgagacgtccgagtccagcaattccacaggcgggaggaagtcgcgctcccactccgactactcagaaatctcgtcagccagctccgacgacagcctccacgccgccggcgagccctccaccaccggagccgaccacgaggtaatcaaccattccatcaacctcacttctctcctactcaatcactcactcactcactcactaaccttgatgaggaatcaataattgggcgttaattcagctgctggtagcttgggtttagttgcattagtgccccaaaatttgcgtaaactccagggcgaagtgggattagccaccaattaacgatcgaagcggagaccccacccacggcgattaaatgccacaaccgaagcacattcattcggtagcagcgatccattattcaccaacacatggattgctcgattgttcggataatctcctgacttgttcatgttacgagtatccaaaggggagccctagctactgactcctgcattgatgagcgtatacagccaaacatggacctatgtacacagggtgtagagtagtacagtagtaattcgtgtaccatgtgcgataatacgtagtactactactgccctgtgctagctgctgctccaattgtggtgattgatcgatcgagatcggtcgaaatgacctgtccatccatgcattgatcgatcaatcagtagggttgtacctggctactgattttacggccattgatcagcaaggatagaagtagcattgcagatgataccactaattaattattcgtagagattagaggcctctgtggtgtggttggctcgctggtgctgtgcatgcatgagcagtagctctgtggctcagtggaccagaaggggcagtggttgcaaagcgtaaatgcaaagcgggccgttgcacagttagtgcgggcttgtccggaagcatgatgcagcggggccagtgtcctgtgcatggcacgctctaccctcacctcgcgtagcttccgctctctgcatgtgcacacgacggccacatggtttaatgccccaactaaaattaaaccaactcgtcgtttcagcggtgatgctgatagtagcatcgttatcgctgaaacgacaagttagcttagcactatagccgacgtccgggaaagccggacgatgtgtcgtgccgtacgccgctacagacgcgtcgcttggactgacgctgccgtggcgaaaggtcgtggattagaaatggacgagatgacaaaatggggttgtgtggttgagacaaaattggtggatgattgctggtgtacggtgtgatgcaggtgatgaagaggggatccaaggaggaggatgaggaggaggaggctgacgacaaggagcagctcagtccggtgggcgtcatggacttccccttcgacgaagacgacgacgacgccgccgccgtcgacgaggacgagagggtcgccgccggcgcgtgctcgttctctttcagcgacagcctcgcccagctccagagtaagcaaactgattgaactgaacacgtacactcatcctttttctgaagaatctgtcacaaaccaaagtttatcctaaaaccaaaggacaattacgtactataaaatgcataacgtgtcgagttaactgtgtgatagtagtgttgtgtagtctacacaatggtgtcaaatcttcagatgagatgggtcgggacgggtccgaggtgttcgtcgcctagtgctagtgccgaaccggaatctgctctgtttctgtctcttgctcggacacgaaacggggcatggacaaaagaagatgttccgatttttgtactgttcatacgggcccccgggaaaggcggaaatcccggatcgtgtaaagatcctactgggcccacccgaccagtgactgtcggagatggccacaaaaggcacatactaggccagtggttttctcagcttttttttttatcttggttgattgagcatatttgactctcgaaatttactggatttgggattggttaattaagggcttgttaggattatagggtttccacattatttttgggaaatactattcactaagggctcattcgatttagaggtttttcataagatgattgtaggaattaaattccttggattttttttctatatgcatcattcatttcataagaatggatcccacaaaattcctaaggattgtaatcttacaagctaatttcataagattcttagtatgaggtgaggtgagatttcttgaaaaaattcctaataaatagagtgcatgtcacatcataatcttttactccgaacgattctatctcctgtatttctatgttttcgatcatctattttccatgtgagctgaattcctatcctacgatccgaacaagccctaaatgttttaaacactttctttctttttgaaatgaggttttaaatactttctaatagttctcaaaataaataatttctgctactaaactctatccctaagccatgtaaaagaactctatgcttaagtaaagttactagctactagtaactctatcccttttacctttttatatttgtatatacaaactctatattaaaaattgtatggggtcaacaagtacttgctgcttctagcctcctacgacttacttgaagtataactcattagtatatttttaccgtttaccgtggatcagggagaaagatgcaactgcagcccaagatccgacggctcgggagcatggcggagctcagcggcgtggatctcgaggcacgcttcgccgcctcggagtccgaccgccttgccggcatcgtcccagtacagcaccagtgcattaccgacgacgtagcggcggcgccgccacgacacgacgatcatcggaacgacggcgtctcccaaaaagatcccgacgacgacgaggacagcctcctagacctactggcggacaccgtgtcggtcggcgtggtggatgacgtcaccgagaggctcctcctcgacttcttcgtcgaggcgaagtgcagctccagaaatattgagttgcatgcaccgaccagtctgttacgagagaggagacggcgagagaacggcgaaacgatgagacttgccaaggcctggcttgagggcacgggaacaccgtggacgttgaacgacgtgctgtaccacggcgaggatgtcatggcggagatggagcggagccggcggtggatgcacgccggcgaggaggagcgcgaggccggcgtggtggtggcggccatggcgatggacgagctgttgcacgagctggtgagtgacctgattgcgttgccgaagtagttctttgtttggatgtcaaagttgtcaaatcgagtgtaatgtaaacgtgagatagaacagattcagtgaaggttgatataggggggtagtgagttaggggcagtggaataaagcagatgcatctgtatatagttttgtcagagtggcaatggaaacaagaagattactgttctgtttggatgtaaatgtacactctacaggtcatcaacctaaggccaattagactgcacttaacccgggtaacgaaattctcttttcagcagtcttcatcgtgtcgggtgtaaaggggaaaaggcattcatgaaatgttctcttgggtgacagagatatgaacaacatccccaaggaaaaagagaaaaaagcaaagtagggaccaacaaagcacaagcatcacatgctttcatgaaccagaattattattatgccacagatcacaatgatacattcagaaagcttcgaatctacgttcctctgttacattaccacagctacaagcataccgtgttacactgtcgggattacaagaaaatgaatataaagtgactagtcacaccctaagcattaaccctaaacctctgagctgaggcaaaaagggatggaaaaaaacataattcacaagctgcctagaaagaacatgaacgatcaaatttttacaaggtaagactgaatctcgagcataagatttcacataggctcaaatccttgtgctattcacttgtgctgaacactaccttgttttcttgatgattgttgaagtgcgcatctcagcgtcttccttggcaaatttccaccagagatatgtgaggggaatagaaatagcaacacaaaatacacggccatcaacatatccccaacgtggtggtatgtcataggtttccaagactattgagaatacgtttccaataatgacaaacaagatcttaaaacatgaaggatgttttgtcatgacagcccatactgcccataggaggaactgagcaaggctagcagcagtgcaaacctttgtgtttaggcctgcaaaagaaaagaaaaaaaaaaggaaccatcagcatacatagatgtaaactttctaaaaggttacgcaatatcattttaacacatacctactgaaatattgacacacaaatattttctaacagttaggtagatcctcaatagtttattacataatctgagtgtagaaatgtagagtgcaggttcgacattagtacagtaacaggtttaaatagagcaacatgatacctactcagaacttcactactgcttaagttttacaagcaatactagtcactactacaaaatatacagatcgattggcaagacagtatttcaattatctgcaggaagtcatgactcaggaatgatgcattcatcatgaaaaacctataataagtaaaatggtttcaaaagttcaatatcatgtccagctaaaatttacctttatcaagttcatagaaattgagatacaaaatatgagttgttgtgaatgccagaattggagctgccaccatcactctggaagcttcatccttcagatttagagttcgcaatattgccaagataagggagtacccaataaaagcagcaaatgatgaataatacaacttttctgtccaaactgtatcactgcaagcaatggaagaatcaagttcaactaattatgatcaaacacatatactggaatcatacttttcatcaatgtattgggcttaccaactgtgatagatggcacgccaaaaccatgcattcatggccagaagaccataaatgtgccataggccagtgtattcatagtatgtcatttgagtttcaggcctaagaggcagcttgtaagaaagcaggaggaaaaaagatagccacccattaaattgtacaaggagagagagcgcggaaagagcagcagaaataggctcctgcaagaagggaaaaaaaaaagcaattagtgataggtgaaggacacaaggtagaactgaaaaaggaatgcctagacagatcaagtttataaaaaagctaagcaattaattagtacatgattgattgattacctgaaacacagatgcacgcttcataggccatttgccatgatacttaactgaccctaatccaagttgctccctttcactttccctctccatcatacagtggtatctgcattcactcttgcagttccattctttccactgcaagtacaatggttcatgtgcgtaccatgatttatcagcaggatggtcatcagttggaacttggcagtgcctcacggaggtctctcggagggaacccgtcttttcgcattcgtcaacacaggctctgtacaagttggggacaaatcaggcagttagcttgtcattgctcatcagttcaaccttcaacatcccaacatgtttatagaacagagaactaaacagtttttttatgtacggattcaaatactaaggttgtatgtataaatcacaggacttcatcaggaggtcacatctcccagctttggtcatgaaataccctacaaagctttgtttctcacgcatgatcatggatataggttagataatcaaaagagcacacacacattgggagttacttctaaaaagtttagcttccttggtgcaatctcttcataagaaatcaatgaccaaaataccagtattcaggggggcgaatcatgctttgaggccaaaccaaatcttgcgctctacagccaacgagcaccaggtgttcgagcaaatgcctaagaacgactaccgccacacaccctcgctgattccattgcacacgcaatcagctcctcgaaccaaacgtaaaacacacacacacccccacaagcctcgccaaatcaccaaatctttgaagagatgtcgcaacactggacaaagaatccacggagtcacgagccctacatacctgtagagcggatcggcgtcgccctcggacgcacccaacgtcgccaccacggccgctgccgcgaggccgacaagcagcgccacccagcgcgcccggccaatccccatcacctccccctcccctccccccctccgccccccaaactcaggtagacctacacgggcagtggcgggaggagctcgacgaggaggaggagatccgagtccgggagcagaatccggaaggagcgatcgaatcgcgcgcggcgcgggggttcgtcgtgggcggccaccaccggggagcaaatcgacaggggaggggggaggaggggatcgcgagccaacgcggcgtgggattttttttttctcttcttctcttctttttttgctcctcttttttttggtttttgggggctatggggatgtgtgcgcctgtttgtgtgtctgggtttgtttttgtgcgccgcgaggaggctcgtgggaggtgaggagggtgagctgctaaaaggcctaaagataaacaaaacgatcaggggcattattttgtgtggagactggagagttggggggaaacaagcagaaaagcaccccaaatttgcttgaattggatcattcgcttgtacggttgtagtactacacttaattttttgttttgggtaaattatgtaaaagtacatgtattttagccaaactattgcgacaggcaaaactacatcttaagtggtgtatcgcagaactatatgtttagttttcaactttttttatagaactacatagtactgtaaaactacatatttaataaaaaaatttatcacaaacctatattgtttattaggttcagcaaaaccatagtgttaaagaatctaaactctaacttatgttgttttgtcataattggcaaatttgtcatattcctctataaaaatatgtaattgcatgataaatttatgttaaatctgtagttgcgtagtagttctgctagagaatatgtggttttatgaattttactattcttttttgacttgaaaattatgatttctatcgagtctgttcttgacccaagcctgttcttgtgaagaatccaatactgtagagagtggtttcatagggcagacaaccaggataggatggctagaaaatgtagagaatttaggcaagcctaactaggacagcgtatttgttgacgaaacactatattcaaccattctcaataattcaatgggttattggcaagctgagaaatcagccaggttcattattgattgatgatagtacgctgagttcatggtttgtactttatgatacaacattcaagccaatgaaggctcatagtacatttgtaagataaagaaaagttaatcctaaacatcagttcaaaaatacatgcttctagaactcaaaggaatagatgctaaacatccatttcccatctctatctcaatcgtgtagaatcccccctccccctcattgaattttagaactcacagaatagccgcgaaacatccatttcatctctctcttaaaaatatagaaggagccaagactaccaaagtacagaatcatcagattggttggcaattggccccattggccatgatctactactactgctactttagccaaaagttttgacactggttacctatatatcagatcggacggcgactgttgcgccctatgtgcaccaccaagttgtcgcccgccgtccgatcgatctagccggggtgtcattgccgttattgcgaaggtggtagtagtagtggtggtagatcggttgatgaaaatgattgggtcatgtgtcacttaattgctgacattgaactgagataattggataagtttatgttcatgtaacagatcaacgtcagcagacccatcaggtcaccttttattctagagttttatctaaatttttccagtaaagatgcatcattggtagttttagcattcgaacttgataacattaactatgttgagaaagaaagggaaagttgattaaaggaatgttttgtcgcgattgtctaatgcaccttagtaagtagttagtagtggaggagtacttgagggatcaattgaaaaaattacaagatactattgttatagaaatgaaatttaatgctcactagtgatcaatgggtcccgaaggcaaatttgtcagctctctgacttaagagtttggaagttttttggaagccgtatgcgtgtctccgtactgtatagtccctaattattgcacttgacatttccatttggttttagtacgtcgtcacagggaaacggttgagaaggcacaatatataattcacttttctgttcgagaagaagatattgtgctattcacttggaattcttgtttttagaggctgcaattctgatgaatgcctgatgcagcccacccaaaataaatggtgtgtctcgggccttcttctctgatacgccccctccgttgtgttcatgtgggcctccgggtcattgtagtttgccaacctggccctgaatgaaatgttaaacgctacaagcccagcacgatcacacactaggctgaccgctggcccaaaccatacccgttgccagtacagaaagttagagtaccacttgcttgtgtcacgcgcgttttgcctaccggccagcggaacggtgtacgtactccgcctcatagaaaccaacatagggcatatcctagtataaaaagtaaaaagatatatcttgtttaatcctaaattgatttttacgagactgatggagtatgttgctatctataaagtcaaacggattcgctataattctacccctatattattttacgagtaaattacatggttgatccataaatctattcatccatgttactcagatccttaactcttaaagtattttttttaatattcgaaaatattaaagtgtgtcattctaatctataattacaacaatatctcagggatcctacgtgacatgccacatgaacattacaataacaaattttcctttttattttttttcttctctaccttttcctttttttcatctttttcttttccaccatatatgaaacatgaatgaaagaacggaagaaagaggaagaaaaaggaaaaaaaggagaaagaggcaatggccatgtggcatgtcatgatcatgtcaccacataagatcccgcaggtgccgtggcaacttaggatctaatgtcacattttaattaccaagttcatgatgtagaaatgtatttgaagagtttaggacctatataatacgagtgagcaagtctagggcttggtcgtgcagtttactgtttttttattaaaaaaatgtcacaatgtgtttgagatccatatgctactgcctctaagaagaaaaagagtaaagtgtgtttcaaagagaaggcttaccaactgagcaaccagacgtgttgattgtttatcttgacttatattaaaggtacaatgtacctatattgtaattatattatagttactacattcatccttaaaaaaatgtaggcgtgggtatccatgtccaacatttgatcgtccgtcttattaaaaaaataaaaaaaattaatcacataaagtaccattcatgttttatcatctaacaacaacaaaaataatactaataaaaaattttaaataagattaatggtcaaatattacacatgaataatgtaaaactacacttattttgggacagagagagattatattctaattaacaccaatatggttttgtaattaactttcctagtgtactttttttactccatattccgtctaaatttttttactccatttttcgttgaaagatcttttttagataatgacctttcgttgaatgatatttagatatataatgacatttttatataagtcgaaattattgtaggccatgtactatggtgaataaattgcgttttaagctccgtgctgtaccataccgtcactatgtcaacggtgtcagcaaacattacacaccaaaccatacctcttcccttttctcatcagaaatttcccattcgcgaaaaggaagatataggaagacagagagggatacatacaccctgactaacaatcgaccatgcgttgtatgatatgatacaaaaggtgacaaatgacaaaagatatcatatatgacataattaaaagaatcatacataggcgttgtacgtgcctccggcctaacccactatctcccccctctcatcagtcatcaccctcccccatcctttcctttccattttcacgctgcatggagagcaaatggtgcacgacagcaacatctatcgatcacccgcgcgcggaacgttcatacactggcaaaaaagtgcaaaagcgattccgatttccgaattccgaaagccgcccaagcatatgcgttgcgtgcgtacgagtttaatagtatagccaactgctgactttaaatcatttataattaacttaatagtcaatttatataatatttacctataaacatattctacacaattaatatctaatctcacatgttatacgcacttgtatcttagaattcgtgctacagctgactataaatatatagcccgctgctcttctttttttttttatttactcgaaatcaaaatgtgtttatagttggtttatagtctgttatttatctgctctacgcacgcacgtactcctccatcgatcgtgcagatcaaaagcgcaaatatcgatcgatacattccatcatccgcatgcatggatgaaacgactttgccggccgccgccccggggtcgtcgtcgtcgttgtcgcgcacccgtgccatggcgtgccactccccgcccatgcgggcgcatgcgcgcgcgcgcgctcggtggatcggaggtcgccgacgcgagacgagatatggcatgcgcgaggggggcctcggtgcctcggtccaaatcaagcggaaagacgagacgtgatcgttgcactgccacgcgtacgtacgtggaagggcgcgcgcgggcgggcgcgcgacacctgcccgactgcaggtgggcgggtggccgtgtcgttgacgcaggtggcaggcgggcggatgtgcgaatcgagccgggaactcggtacgtggcgcggccgcgcgcatgtcggtacagtacagtacaactcgtgtagtacatgtgcgctgcacggcgtcacaggattttactggcgatctgacgggcgcaccgtgctgcttggagtttaggcctgggagcttcaggcagctgtaatttttttttcagaatcagaaactctttcaatgatttagtttttcattttaaatatagaaaattatagttatgaaatctataaaatgaatcaaaaagcaagcttttcagagaaaattgctaattaggtgtttttcagaattatctgggtttggagctgagacggaggcaacaacttactgccaattgtagtaattttttcgtccgatgggtacaaaagtggcagtaaactagttcgtcgtccagctcacggatgttcacatgatcccaaacgcgaagatttagaaggcgggctagtgaccgtgagcaataacaaaatcacaccactacgtcgcccttgtttccatggccacaaaggacagcaccagctcacaaaaaagaagctgctttgtaggactttttgggcatcgatcgtgccaattctgctcctgcctgttgagataaactaccatcttcaagggctttttctcctcgacgacaacgagtttaggttcacgaatgtttggatgacatggaatcacgttgcgtgattgcgttgctgttgcgtctgtgtgtgtgcgcgttgcggcgctttccgtcgacgcactcgcaaccaatcgggagcatgtgtgcgcttcgttgaatcggttgtcgttgtgaggtgtctgtactggtgcagtgtactgctgctgctctgtcttccgctgttacacgtttaaagatctttccaaaggtaaaggtaatcaccagatcacaaatgcggattattgcacgtgagccaggtaattcaattacctaatgccatgtttttatgcccttgtcctgtgtatgtcaaatgatgcatatgtttacttgtggaccatgatagatactttttctggataatttgaaccgatgaaagatactatcctgattcctgaatacacctgtacgtataaaaattaagatacttctagtagtatataacaagatggcagcaacagatacgctgaacccataactcaccaatcaattctctgcaccagaaatcatcaactattcatcaggttttaaaaatgtcaaagaagaaaaaaaatacaatttctgtcaggcctcagcactcatcagtgagcacttatagcacacagcaacacatcagcatccatttctccagttgatcctctcccccatgccaagtgctaacaccggagccatctctctgaatctcacctgcttccatgtctcaccctatataaaccacccctactctctacccggctactcaagcaccaaccaaaaccaaagcagagaagaggcaagaacaactagctgcatggcaatggcgggagagagtaggaggaggaggagggcggcggcggaggcggtggcgtggtgcttggcgctgggcgtggtggcgctgctgctggtggggtcggtggagaaggaggaggaggtggtggtggtgcgcggggcgcggctggcggcggcgcggccgtgcgaggagatatacgtggtggaggaaggggagacgctgcacagcatcagcgacaggtgcggcgacccgtacatcctggagcagaacccgcacgtccacgaccccgacgacgtcttccccggcctcgtcatcaagatcacgccgcgccccggccgccgcaactgaactgaacttgctgatcgatcaacgcgttgatctatctctgatcgatcgagagatcgatcaacctgtacagtggacaccgatcgacgcgaatgtatggcggaatgcagagatggttcttgtttgtttgtgttttttcttgctttgaagtttgaaagattctgaccaaagaagggcgccgtatccgggagtttgtttcgtcgtcgtttgcttcgtttgacgatgatgaaccagaaccacacgtactggaacagaggacgctgcgagtggctactggctagtaagtggctagtagtgtagtggtagtagttaggcaggcaaccttgcctggtgtgtgtgtgctttgttcattccgttatactagaggctagttgtcagttggttacctgaagtgaactgatgcagtggttggtaaaagaaaaaactgagactgatgtttgttagatgcgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56992 - DNA, 24570 bp, Oryza sativa
  unsure (1)..(24570): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttggtgttgattacctagtacaccggcaacaatcccagccaacaagtgaggggctccagatagcttaccgttaccaaatcctcaggtctggtgcaacagtcacatcccacttcagaacacaaccagccaaattgccaatcaaattgttctttaccacttgtcaaaggtagctacaggcgtatcaaaattgcaacttatggcatatatgcataatcaataattctgttcagtgcatcttatcatctcaatggccctcttgatagcaagcatgatgcaaagatgaaaatgaccaaaagtgctcaagtcccagaaaaaaaatcagcaaaaagagattaagatctaaccagttatttgagctatcttccagaatgtatatgcgtaaagcaagcacaagagttaacaatggagactaatcaaaatcagagcctcttatgttctaataacattagattaaatgggattgatggaacagtcccttaaccaaagaaaagttcacaggaggcaaaaacaagcagcaaaaagggtaaaaaccatggttcatgtttttcagaaacataaagactacactacacaatgatacaaaattaaagtagtattttcatggttcaatcagatcattaaagttttcatgatcttatcagaaaagtgcgccagaatgatataaagtttagccaggattacagccattggccacaaattgccagaattattgtattaatgagtcaggttaacttttcgaatgttggctagatgcatagactaacagtaatggtagatttcatggacagtcggcagaaggaataaaaactttgagtcggcacaaagagctagatagaaagttgagtcatgatccatcctgtctaacaaactttcagctactatgccttgtcgaatttctggcttttctcacaacaaaacatgccaaaaacagaatttatcgcagcaatctgcataagcataagagaacaaactttctaactagcatgatcaaaggaacaaaatactgtgtctgaataactaaagagcaacggaaatctcaagaaaagtcaatttttcagctgaaactaaatgcaatgggttgatagcatggattgcaactctgtttgatccaaaagaccaaaagaatgatccttctttcttttaagcaggctttcaaataggtactgaaaggttatacgatgggttttgttactatttgtagattgtgaaaccatagtatgacccaaccagctactgataatatatggctgtgtaatttcatgtggtacagggacatctgtcataaaaatataaattttccaacaaacaactactgccacacggtggcataactagttccaaagataaagatttataagtaagaacacattttacaacaaacaagtatcacaccaaattagataatttcataatattattcgaagacttgaattcccatgatggatgacaaacagttacaaaaataatttctggagaagagagtgcaatttagagacagtttacaagaaagttatcgcaaaaatacatctaagagaagagagcacggtactcattggcctcatgagccatttcttccatggttctatcttttctctctatgtccagatcaagtttctccttcaattccctctctttgacatcaatctattagaaagcaaacaagtaagaattttgtggtaaatattgggttgaagtattggataaaaggaggtcgattgagaaaaatgccacaaaccgcatcatatatctcatcatttttctcaaaatctcctttctttctagggatgacatggatgtggacatgtgaaacagtttgaccagcttctggaccatcctgtaagcactggaactaatgagtaaatagcttaatattattatataagaaaataattcaagacagacatgcaaagttatatctagggtaaatgataaaaaggaagttaagaatacttgtatggggaaacgaattcttttttattctacacacaataagatcatcatatttaggacgcaataagcaaaacccatatggtactcctcttgatggtatgattaaacattgaaataattaaaatacaaactcctgctaaccgcagtggcataaatacatagaccttacctgaatagcaaatgtaagtgaagacgctttgtggtactgctcaagccgtacaccaacttcctttgcggtaacccataagtcactagtctcattagaacttagatcagcaaatcgtttcacttcacgcttggggcacactagaacatttatatattgttaagggaaaacaacatataagatatatcatattctcaatataccacagtagaaatcaaaagaagatggttaaccaataaatttatggaagatttgctcgacacggcagtacaattgacagttactccatatcaatcacaaccaagtagcagataaatactacatatggacatcatctcatggtaaagatgacatcctctaagatgatcaatcaagtaagatgacatgtggcaaaataaacacctacatcacctcttcagccaatccacaaaattgtccttaagccagacttgatatttgtcaagtatagaagaagggtaaaccaacacaatcctttcatgaataaataaattccacaggtccatttatttactattaatttgaatgcattgatgaaactttacccaaacacaagccagcaaaagcaagctcattttatcgacgaccccaacagaactagctagcagtgcatgcacgtgaaagaaatcaactgtgattctgtaaatatctccaaaacagcgttttgcagaaaaagtagcagtctcttttggtgcaattgaaggatatgacctgcacaataaggaacggtatggttaagaaagaatagcagaatatgaaccaaccaatatatagcaataggaattaaatgcatgcagcaacagcaaggtcaaagttgacggaatcgcatatggtatagtggtgaaatggtactgtattaaggtgaatctgttaggtagaagaagagatcaattgcagaaaaacactactatatgtgaacagactactccctccgtttcacaatgtaagttattctagcatttctcacatttatattgatgttaatgaatttagccatatatacctatctagattcattaacatcaatatgaatgtgggaaatactaaaaatgacttacattgtgaaacggaggaagtagctagtatctgcgtgtacattgtgcttgttaagcgtgttcaagaaaacaaaaacgtgcttgttagcatttggcaggtaccgtatgattcgcgaactggtcatcaaacaaattagcaatggcaagctacaaaacccgtctctgtaatttccgctacaaattttgggactgtactatggtactactcctactgagcaaggggaacggaggcggctggagggaataaagcgatcaagtggtaaaactgggcaaggggaagtgaggaggttattaccagggaggagtgggcggaggttgaccatggcgtaggagagcggggtggagtggaacacctccctcgcgtcgatcttgtacggcccgaacttgtaagccgcctccatctcctggaccggcggcggcgaggaagaggaggagatggctcgcggcagaagcagtggacgacggcgaagaagggtaggaggcggaggcggagcgagagggagagggagaagggagaagggagtgggcgcgcggcggaggacggcggagagcgccggaagcatcagctgccgtctcgtcggcgaacgaatcgacggaggagaggaaagcaatgtagagttgttctgggcctaaaattaaggtgggcctgcatttttacggcccatctgagcccatgttgttgtctggaccggtccaaagctgagtggtgctaatactcctactttagccctctttgtttagacttagacttattggattagacttttaagtcagcttattggcttatatgatttataagccggtggatttaatgtcctaagtttagtggtagagtcatacatcaacctcacataagccaaaaaagcttctccaacctagcatttggcttaatagtgttagagtggcttatggcttcaaaaaaaccaaacaaataagctgcttgtttgtttaggcttacaccttttggcttataagttgacctataagcctaaacaaatagggccttcaaataggctcacccaaaaaaaaatgcaccgtgatgaaaatgtaatcatgtcaggttgacttgctgaaaaaagtgaagtggatagagtgatgagagtggatgaactaaataatcattttgacttttgctctgaccaaaatcattaaactaagagtatacatatatggagctagccagcatccactgcctgaacgaataggagttgtcatgcaaatccactgcaaatttaagtgaagtgatgatcgatcatgtgcgtactttctaaagtagtttgtgtcatggatatgaatatgatgcatgcacctgtgaccgaaaagctaccttcactttgcaggcatatattggcattgtttggtgacttgacattaaacaagttgctgcatgctcatcagctttgaaggagtaagagataagtcaatctacaaaggtgtttatacatatatttttgtttatcttcaattgttcatggtagtgcttgctgcgtaggttttgcaatgatcgcctgattattattaatctatctatgtactctctctctctctctctcactacctacttgcacggatcaatcgctgtttgacttcatttgatgagataatactaatgaactagtgcaagatagtgttcagtcaacagcaatggagataatactatttttatgaccttgttcaaaggtttgtaattttccattaagctagtgtttacaaagcaaaccactatatatgtgcacttgttacttagagcaatctagctagctagtgttatcatatcatattccaaaatccttaaatcaggttagatacaacagaaacaaaaacaaattcagaaagctgccagcacaacaaccacaattattttttactagctacgatcagttgtgttatccaaaccaaagtactagtataacatttcaggctttcagcatatatatgcttgctacacctgtatccccatttttgccctgaaacaaacaggaagtactaaacatgatagtatggcttctagcctaattgcactgtaatcggaatgataggggtgaactgtgcaagcacatgtacgtagcatgtagtagcaatataacctgaaagttgtggaaaagctatatattgggacattgcagcttcactgccactactgatcgatcatcacaaccgaaaaagaaaagattttgctggatatttaactatatacactcagctaagctggagtgaccacatgggccagtttggatggtgtgcttttgatgatgttatgtattccctcccaaacctgcaagctgcatgcatgcctattctgtgtcttaagcaccttggacaagcaactaattgaacagctcgcacagagcaatcggcaattgcaacattccaaattaggcctggtttagttccaactttttctttaaactttcaactttttcatcacatcaaaacttttctacatacacaaacttccaacttttccgtcacatcattccaattttaactaaacttctaattttgacgtgaactaaacacacccatatcaacaatgaatcaaagttgtccatatgcatgcatgacctagaaaatgccaagatctctgcaagagacagcccccgtgcagtccaaaatcaatctagctttaagctacagttagagtttgggttaatttgtttggtagcgaaatatcattcgaccatgacatgcatgtggcgaaccatgcatatgcagtttgcaaaaaagatagctacatagcgtggatggaatacttcaaaagcatatcaaaacgatacgatatgcatggtgtttcagtactacaatctttcaagaggaaaaacaaaaacttcatgtgggggcagggagctgcagatgcgtgcctcttcacttccagagaaaactaatggtatgtcagttttaggagctaatacacactgccattacatgtgttatgataaggattttaagccgtttgcgaagacaatttaggtactgctccctctaggttaatactaatacttattgttttgagagaaaaacacggtctaaaacacaacttcagtcactgttttatattataatctatatagaaaaattattaaatatatgattttatatatgatgttattataatatacctagtcttcatatttataagataaatattttaaaaattatttatagttaaaaaaatttataatttgataccaaactcattcaaaacaataaatatcactctctccgtcctaaaatataagaatctagtatcagatataatattttctagtactacgaatctatattagaaaatatcccatctagttttacgtttttttatattttgagataaagggagtatcaacgagagatgtatgcttagcaaagcacatgacttgagtgatcagacacacatgaacgaaattgttaggtaactgtctccatctttgccttcaacacaggcatgcagccagtgtatagaaggagaagaaccctgcttttgccccccttgcagaggaacaagctatccaggatatactattgtcgaactccattccaatgtctacccactagtatatgttaactggatcatatcgagaaggcaattagttaacatactgccaagagttgcacatgcatacttcatatatacaccttctggttacttcatgtgtctgagttctctgaatttgcttaacccatacatatcattggactccggttaattacctcgaactttgtagccaccccaccccttgcatcgatccgcatctggtatttataagatttagggtttattcggatcagagtaatttcacaggatttttggaggaatactgtacataggaattttttccttttttttattcggatcatgaaaactggttgtaagaaatccaaagtaaagtttcctttgatgctgatttcacaggaaaagtacaggaaaaatccatccaccttgagctcattttttgcttcctgcatgcaaatcctaggcaatcaatttcctgtgatccgaatgctatcaacttttgtattcctttgttattcattcctctgttttacacttagggcctctttgaatcgcatgattgagaaaacgtaggaataggaaaaacgtaggattttgataggaatgtaagtgtaaaacagaggattgtaaaacacaggaaaaacacaggaattggatgagagatatagactcaaaggaaaattagcaagaggttgaagctcttgttaaatttcctccaaaatctctataggattgtccattctataggaatttcaaaggattagataggattcaatcctttgattcaaagggcttcataggaaattttcctataggattgaaatcctctaaaattcgtatgtttttcctccaaatcaaaggggcccttagattcctttcatattcctatacttttcctatctatgtttttcctatcctataatccgaacaagcccttaatgtctatacatacaaaatgagtatatatgttgcaccgatcaagcatgtaaggcatatattgtaaaatcaaaggtgttttttattattattttgtgatgaacaattggcattggagattatcagtttagatatttggaatttatttgcgaagtggttttggagatgattggatttcataggtgatatacaggtactgtgctggattgggtacggtcacaccgggcacgggttgccggtcagaccggcgtgtatctcgcggtcagaccggcgtagcccacggtatgaccggccgactctgtgtcagtttcggtttcgggttgtttgtttggatatccgtgattgtttcatgattatgacttctagacggatattatgtgtatgaatattatcgtttgctactaatgagtcaagttggggatagcttggtctcggaatatggtttctttctttgttctatgtgtaggtgactcgagatgtcgggagagtatttgcggtgatggaccgggagtcggcttggggataagacgacgtccgtagtggtcagagatcatgcgggatactaaggctagagttcaatacacgtggttggtgaagattccatatggcatacgatggaggtattgtgtgtgaatgggatgcagagtcgaatttggaaggagtccaaatttggtatgattggttatgtaaagtttgtttcttgtactagagggtttcctagggtgattaggacttctagtatgagtttggttcgtggctttaggctgcctatctcgggtataaatagagggggagtgtgaggcttcccagtatcgcttttgagagcaattgagttgatagttgagttagggtttcgagtttagtcgaaatttttataaggagtgttgttggtgcactttgtaaacccagagagaatcgataaagtcgtcatccactttaagagttcttcgatttgtgtttcaccgggtttcggcgatctaaccggcggcgcaccggcggtcagaccagcggcattgcgccggttagaccggcgtctacgacaggcgacaggagctgatctcggcggtcaaaccggagatacaatctcggtcagactgacggcaaccaggcgatcagaccggcacatctacttcggtcatatcgcgatccgttgaatttgaggtaacttttatttccgagtttcggtttttgggtataccaaccattcaccactctctggttggcttagttgttctgattcgatatatatatatatatatatatatatatgctcatagcaacagcgacagatgctagtgaccatagtatatctcacacgaacaaattagtaaggtatatacgggcaaacatactcaaccgattaacgctagtggaaatataggcatcagcagtttataaagaagaataaataattgtacgcgttattttactatctatattctcaggaatagatgaatagtacatgatagaatagttctcatttgcccaccagtactgcaagtgactctgactacacaatatgtcaattgtcaatattcttccaaatgcatgtaatagtctttagaggttttctttcgtccttgagaggtatatacctctcattgtctgagagctaaaaaaaaataaaccattaaaaagcaagtttatgattggcaataccaataattttcttttatcgtcaccttatagtatatttgttcataggtcagagatatatgagtaattttacggtccttgagaagatacctagatggagtcatagagtatatagtgaaaagcaagtaggctatgttcgatttagatgttagagcaattatagccctatggcttaccggagaagacactccattactgcataattaatatatatagacatttaaaatatattgtttttacaaaaaaaataaagaataaaaagttttttaaaagaaaatcgtactcccttcatctcattttaagtacagccatgattttccgtgtacaattttacccgtccgtcttatttgaaatttttttaaaaaaaataagattcatgttttatcatctcataacagtaaaaatactaattataaaaaaattaaataagacgaataatcaaagttaaacacgaaaatttattattgcactttgaataggatggagagagtactatttagcatttaaaaacgtgcatgtctacgataatatggtagttcagaagcgaaaagaacatatatggctggttggctggctggctagcttattaaccatacgtacgtgtttcgtggacaatatccataaggctcacatggttattttagatgtagaatattctgatctagtagctacttgtgtgaactattcaattgttccaaagtataggatgtccccggcatatctccctgaatcatttcatctgaatcaaagtgaattattttgccagcatatgccggaccagctgctagctgatcatgaagcatttgttctagctagctccaccgtgcatcttccaagatttattttgtgcgcatcttagccaaagaattaggatgaatgtcgtttgttgcaaggacttggatacatccgaaagaatagttacaccttttccccacctacaaatcttgacgagctaatcatattttgggaaaaaaagaagcgttgatcacttgggaatatctgtttttagtttccagtactctagcttcatccatatcaattttcatgtgaaaatactacctcacacgtgtgatttaagagaataaatcacgttaatgtctaattaactttcaaatcaatccgtttcaagatttgtgcttcacaaccttttgcagcaccagcaaactctaacgagctaattggaggtgttcccttgcttagataaatatcctgtataatggcagctcactagtgtgggccagtttgggcccgctgacaatgagggaagctctcgccgtctttcgagtggttaggaggtgtggtgacggatccggcagcgggaacgacgaaggaggatgaagatacgatcaatgaagtccgagaatatggaagatgagggttaggagagagaatggaaggtgaaggcggattttgtggctccataagggtggttgcatgggaacaccagctgatgatgatggagaagatggcagaggggtgacttattatttttcttaagaagggagagggattacgcaatgtatagattgttcttttttttttatccatgttttactgtacatatatacatacaagtcttatcataagtctacgtcacataataaaacttgggtatagagcatagatcagtatatttattgaaagaaaaacattcgaaaatacaactatataatcagtgctaccaaaatttgtctagatgggtttaaatataaacatatcctatatatacaagtcgtcatatgtacataccatgcatatcaactaataaatatcataaaaaattatacatgcatgtaatttcaatataatatatagtattacatctacgtgtaaattcccatctttaaattcatcgtacatagagaacagcaaaataaacaaaactgacatatttagtcttaaaaatatcagaatttttaatcatggctaaaatataatgaatttaagattaagactttagatgtaacactattgaagtatttcttctttattttttgacatttgttagttagtttacacgtgaaactaatatacacatgatgtgtttccggtttaaatatggtcatttgtacaaataaaggtagatcttaatcggcaacgagaatgaagattagaaggtctaaatataaattagtacaaattatgtgcttagcgaatagcaattaattaagagaaatcaacatgttatcagaatatagcaatatatttgtaaaggcttaaaagattatatttaattagagatgtcgaattgagtacgtagtatgtgggagatgtagtttgacaagccggtgctttggtatttttggcagtaggtcattcaattattatagctttacatgctctttaacaccttagaagactgtgggggaataactttgagttgattgtagaagtaaaagtggattaagtcggtgtgtggctaagtcttagctaggcatgcaaagaatatgttcgtccaccgccgcctatgacgcatatatccatcctgatcttgccgctgccccatgcgtccaaccgagaaaaccggctccttaaaccttaaacaaaagattaaaaaccggtagagatatgcaaataaaatcatcagtcagagaaaaaaatttgtgctagtcaagtgtggtgatgaggttagtttgtcgtgaccgcaagacttctatcgtgacttcgatacattttgatcttgtttctgggagatagaatatacgtgtaaaactgctaaaaaattagtgtacgtttccgggtaaaaagttttaaatataaatataatatactgtaatgtaattacaatataactacattgtaatctctaatgaataaaattatatatttttcagtacttacatacaaacaagttacttcgtatattataagttaattatatactatagaattatcattccgatccctaattaccacgatccattcagatcctacgtggcgctcgcgcgttgcatgccacatggaaacaacagtttatatataaacttcaaacaatatgtttttatttgatattgttaaaaatagattattacaaattttaaaaatagattgattgatattttaaattaactttatatacaagctaaaatctgcatctgatgtacacgcagatgaagatgcgccggcacccaatcccaccacagcgaattaagcggatccaaagctaataatactcgatccgctgttagtgttagccgcgggcgcagcatttgtctgcatcgttcgatcggtttcggcttcattcattcatgtgctcccccctccccgcccacgcactagcggctgccgtccacgcacaaaccacgtaagcacgcaccacctcgcgcggtataaattccccgcgccctccactcattccattccccaaccccaaccattcctatttctaaacaacacacctcctctgcacttgctccttctcttcttctgtccatcgaatcgacaagaagaaatttacaagcaagaatggccgccaaggtgcatcctaacgtcgccgccgcgccacagccaccctgcattagcagcatcgtctcccaacaacaagaagaagaggagcccccggtggtgctcacggtgtggcgcaagtctctcctcttcaactgccacggcttcaccgtcttcgacgccaagggcaacctcgccttccgcctcgactgctacgactccaccagctcaaggcgcgccgacctcgtcctcatggacgccgccggcaagccgctcctcaccatccgccgcaagaggatgagcctctccgacagctggatcatctacgacggcgacggcgccgccacctccaccgccacgccgctcctctccgtgcgccgccgccgcgtcggcctccgcgcctccaagtccaaggccatcgcgcacgtcacgccgctctcctcctccctgccgctcccggaggcctacgtggtggagggctcgtacgggcgccggagctgcgcggtgcgcgacgcccgcggggacgccgtggcggaggtgaggcggaaggagtcggtcggggacgacgtgttccgcctcgtggcgcagccccgcctgggcgcgccgctcgccatggccatcgtcatcgccatcgacgagatgctccgcggcggcagctcatcgctgctgcggaggacatgctccgcgtaagtccaaaattcttccttctgtacagtagagacattgagctcgctgcaaggggatcagaagctcggggtcccacctgtcagcgactcagaagcagtgttcccgcagcagagtctagctagatgcagggcactaaacacccagaaaagaaaagcacaggaattatgacaaacttattagagttggtgctgtatgctacaatcaagttttagctagctgctgggttacttaagcatcatccatgttgataggaaattaagcaggactgatacagtcaggcttgtgaaagtaaagcacaagtaggacaatacatatagatacagcctagtacaggggagttctttttttttcttccccggatgtaatattacaaaagattattgtttattattatatggagaaatggaactgcttctccttttccttcctttttttttagtgatctgtgtacacggctagcccatacagcagcatgttcagtgtgtgcgtgcttgaccgtctatccgagcgacgagagaccatttctgtgttaatcagatgtgagtagtaaacagatcctatctccagcaatattttattttgtttagaagtgagaatccttattattaggcgattcttctgctagtatcatattgctacccactctttgatatgacacagatcgatgatggatggagcagagcttagcttggaagtgcacaacccttgacagagatgagtaacacacattataaacaacagaacattattcagctgaacatacaagatgttagcagctaacatgcacttgacctgctactgttagtcccagacttgtgccagctgatatttcttgaaattaatcccagtttgttaatttgtttcaggtctcattcactgtgttgtactgtagagccactcgatctgccttgttcatctcgcggtggagctagtactaccaaccgatctagagtatctatcacgttttaatcaccattcattcttgtttgagacgatgaaagagagaaaaggcagtagatgcctcaaggacgacggatcgaggacatccttgtcgatgctctgtcccaactagagtagcttatagctcgatgaagacacatgcatctttcttccggccgtgtggtgtggatgtggtccttgatttgtttgcgctagaaattcatcgcttccgcgtaatacagtagtactacagtatgagagctagatggaaaattagacgaaataattttgtctatagactgtgcatgcagctgagaaaatcaaactcaacatcgtcatcatctcatcgtacagagagaaaaacaaacgcatgcagtgtccccgcccccttgcaaaacacaaaacacatggacacgatgcagactggtttaacacagagttatccctggatatataaaaaaaaaaaggttggacccaaagaaggacttagagtcaatggttttagtaaggaagaggtaaatatttcctgtggtgagcgcgctcgacaagggtcgaacccgggccagcggggtgcatgccagcgaccctgcccttgcgctaatagcgcatctctatccctggatatatcagtctttcaagtgtaacttttgctgactgcagatcgagggtgcttaatttcttcatatcattaaagggtaatttcatgtgtaactttttctggacatgtgcacttcttttattcaagggaaagggaaggaactcagccattcaatataattacaggaggtgaaaagagcttagaacactagaggaaaacacattattacaagctgaacagccaagaagctgatggagcagctagcacaactaatttgacgagtgctccaaagtgattactctggggctggtgcttgtcgtgcttcttctctcgcttataacaaacttctttgccaaatttgctacatcttcaaccgtaccatagacactgttgaatatcctgccatttcgttgcaaccaaatgctccagatcgtttcttgtgcactttttcagacgataaacagagaactctgcactttctcagcgctttctacatgacgatgaacagaggatcgtgcactttttcagcgttcgactacttggtttagttctcgatccattcgtttgatacatatacgtatgttgtggagattatggataccacatgtccacacggcatgtatattcgactgggtatggtggtaccatatgtagatagaatatatttaaggggctcgagttatattcttaacctgtgtatcaaggaaatactcgagattctagtcggttatgattgtattttatctttacttgcctattttgctaggaatatgggctgtatgttataatacggactcctctcactatataaggaggggtccgggtgcctcttggggcataacttttcccccagatcatacgatcaataatacacttggtggatcaatccctgtacatgagtagggtattacttctcattgagagggcctaaacctgtataaaattcatcgtctccaaacccatccacttttcatgcttgatagccacccctttttgtattgccgaaatcttgtttcgacatatgttgacttgattgggatactgatctggactactaattcacaggtcaggcttcagagggagtgccattccaagtttccaacaagccaacaattaccactgatcatacataaacagaggcaggaaatgacggatttgagcgacggctagcccagctttttcatgctgaaaattttaggcggattcatcgaagtacttgctgtacagaaacataatggatgcatgaatggctgctagacttaaatttctgtctgctcattcaatccaatattgatcagagtgtcattttcagtcctgctcctgcatgcgccactgtacgtgcatctgacctttggcgaacttttgcgcttttagccgccgaaattgcccaactctttgagagaaaaagttcggttgcaatacgttttaaggaggggccaaagtcatcttcttgttatactcgatctgctcatttcatgtgcatgattagaacaaaagcacgcgaactgaacaatcaaggaagctgccatacaaatacgtactacggtactagtacgcgcccttctgtaactccattctgagtttcaagtcttcaaaaaattaaagtggcttataatatgaaacgaagggagagtactagttaccatattcatgtttacatcttcactgataatatatttacatgcttctcccttcgtttcacaatgtaagttattttagcattttccatatttatattgatgttaatgaatctagacatgtgagaaatgctaaaatgacttacattgtaaaatagaggaagtagatgctacgtacgaagtactcctaagtaaaaatcatcatgctagagaaatacgtgatgtcggtaatcctggtggtgatattctcaaaccagacatgtacagtaaactcaatagtcaatactatgggtaaggtatggattgagatccggtaaggtatgcatattctcgaacatgatcagtcactgcatattcgatcgatctcctaatcaagatgcattaacaagataggttcgaagaccatttgctgaaaacctaagctagattggtccttcttgcatgatgatatcttgagaaatactccctctgtttcgaaatgtttgacaccgttgactttttagcacatgtttgaccattcgtcttattcaaaaacttttgtgagatatgtaaaattatatgcctacataaaaatatatttaacaacgaatcaaatgataggaaaagaattaataattaattaaattttttaaataagacaaatggtaaaacatgtgataaaaagtcaacggcggtcaaacatttcaaaacggagggagtactaataatcgtaaccatccttttcccttgtgttttttgctgactggttgtgctctttaattatcactttatgcgcacttttctttgacgccttccacaattaacatgcgcgcgcgatgggtggttttgtttatatagtactccacactattgtacccgtatgatggcaatactagtctgactagtgtttgctcttcatctagaattgttgtgtttctgtacagtagtatgcatggaaagcaaagaagttgtggaaatgcggtcatatgcttggctaggaactgaagagatagcaattgggatggttggtttggcgtctaaataaaccacagcgtcctggaattgtgagtcatgcgtgatgcgtgattcctccagtacagaggagagagctgatcaaggaagataactcgagacaagccagtcagctaggatacctaatattccctcttggggctcctacaacgtatggaggaggagaaaaacgtgtcttgtgatcttaattgcgcagaggaagaacaaattcacctccgcctccgccgccgcgccgtgtcgagggatcccgatttatggatgcaaatcgctttttcggatcgtgattaatggtacggtggcccaaagcattccaggccctactagatagtggactcaacatgggccgaaatatcgggggggcctccgaaagcccatatacaattgccttacctgtccccacctgtcacatgcctcacgcagcagagctcaactcaagtcaaggcggcatttcgaaattcgaaaacaccaacggtttcaaatcctcctcacatcttctcttcccccaaatccctcctccccatcgcggctcctcctccggcagccagccatggccacggtcacgccgggggtgctgctcaagctgctccaggcgatgcacaccgacgaccgcgtcgccggcgaccaccgctcccccgtcctccaggtcaccgccgtcgtccccgccctcaccgcctccaccgccgactccctctggccctccaacggcttcctcctccagctctccgacggcctccactccacctacgtccagccctcctccgccgacgccgacgccctcgtcttcgcgcgcccgcaactagtcggccacctcgtccacctcgaccgcctccgcttcgcccgcccggtgccccgcgccgtcgggatccgccccgtcccgtcctctcgcagcgtctccttcgtcggcaacccggagccgctcgtcgcccgccccgccgcgtgctcccgcggctacgtcatccagcccgggtcccactccgacgccgcgccgccgctcatgccatccagttccggcaatgcggcgcagtccgatgcaacgaatgccatcaataggacggttctcgcgcacaagaacgtccccgaggccgcgccgccgcccgccgtttcagccgccaagaggcggttctcgtctccggcgccgtccaagcagcgagatccgtcgccttcggtcaagggcggcgcgtcacggccttcgtcgccctcggtgaagggcgcctcccgagcgtcctcacctgcggtcaggggcacgcccagggcgacgtcaccagcgccgtccaaatgcgtggtgcccagccttgttgcggccaaggaggagaatcgccgcacggcgagggagccggcgattatcgtgccatcaaggtacaggcagccgtcaccagtaggagggaggagaggggcggggtcgcccgcacccggtgggaggcgcgcgtcactgtcgcctagctcccggaggctgtccggggaaggtagcagcaagaagaaggtcggggtgttggtggctggtatctccaagatgacggatttgacgaatgggtcggctgttaagccggggaggaagagctgggacaatacctcaatcgcagcagcggctggctctgtgatgaaatcgaaggtcaaggtggataagagtactattctgaggacacaggtcaggatcatgtttcatttgtgttgcaattgcaatcttggaattgcacttgctatgctactattgctatatagttgtacatgcactgcacatttatcttgttgtagtgaacagacaaatagtacaactctactttgaacaggctaatcgtagtgaaaacagtggttacttcaaatgcttgattcagtacatatgtgaaaaatggcatggttttcttgcagttacttaaaatgtttataagtttattgaggaaagagagaattgaaaacactgttatttattttctttccagatacaatggcagctagtttgtaatctttgaatttgactcatggacatgcccttccctaccatcatcacattgttgtgttactgcaggaagcaatggcaagacgactgagtgatgttacaacagaactatccagtaacgatgatgattcatctgtagatgagaagccaaagccacggaagaagatagagtcacctgcagtaaagacgaaagcaatggctccaaaaattatgcttcatgatcctaaatggaccgatggaagcattccattggatggagtttctgatgtgctttcaaagatgggaaaggtaagcactcccaattcatctttgttagcaatgatcaagtcgcagttcattgatccttgaaacaccacatcttctctgaatttgcaggaagccactgaacgaagagacgcagcagcaattgctgcagctgatgctctgcaggaggcattaatcactgaatccgtaatcaggaacctaaggtaattaaaagccgacttgtgtccccggaatttcattcagcacaaaagtggtttttcctaacactcagcttgctattgtccacagtaaattttctgaactaacttcagcatcgaagacctccaatccccttccaacagttgatatcttccttgctgtctatgaggatactctcaaatggaagaaaattgctgagtctatatccaccaatagaactgaaactgcatcatgggagaattcagttactcattgggttgaagcagcattggcaactgatcttgaagtcctaaagttgatgaataaggcacctgaatcgctctctcggaaaaggggtgctgataagccaaaggctcccttggtggtagaagctccaagaacaaccatatccaagaggcaatcacatgggacttctgcaaaggtccagtcaaaggtcttaccgacctcttcagcgagctgcgcatggaacaaaactcagggcgtgaatgagacggctgagcttgccacgaccttgtgctgtgagatgcatacgtggttcctgaaatttgtggacgaggcaatggatttaggtttccacctttttgaagatcagaatgttgcaagtaggggaaagcagagcagccacataacaatggtactgtcccagttcaagaagatcagtgactggttggatggagtaggcaagattgcagaagaggctacaactaaggataaggttgagcagttgaagtgcaagatttatgggttcgtcatcaatcacatgggatctgcatttgatagctcggtctcgatttcatcaaggaattgaggaatgcttaaagtaagcctttaagtttcttctcttgtatttttgttcattggggatgggatcaaagctacataattctatgacgagaggtctgctacagtttgtagaagctactccttcagttattacctttggttttgccttgtgaataagttgtttgtgaaatggttcttgttttatcggttacaattatgtacacttgatagtttagcttgctgtagtctgagtgaatgactgacttgttaaagctacaagatatcattcttacatccttgcaaatattgtgctaggattaatggtatgttaatttgattggtgcccaatcttttcataacaaaggttaggcaaatgcctgacatgccacaaaaactgtagctagtacaatatgtgccaagtatatttggaatgccgacacattttgctagccgaagaaggaaaacaaatcttcagttgctagaggtccttccatgttgctaatttgctataaatgctggtgaaccatttggtcagaatacatgaagctgtagaattccctttcttgtcgaaacattgatgaaggataggtctagctcctgaacctttcagctgactggtcctaatgattagttgggtcactaatgtcaaagagatgctgcacctgattatggtagtatacaggaggtattggtgccaattcatcttttcaattgaaatttgaaagggacccatagaacttgacaaaaatattttatttgatgcgcttgacgcttgggaggctgtagggtgaagtaaaatcaaacacctacagagaactccctttgagatatgttattgtaaactgattgactgaggcagaaatgccaaattgtctaccggagttgaaaaggagttttatccaaactagtattactatgatactactagactagaattattgaactaacagtcctcaccaaattgaagtctgtagcagttgtttctgttcctttgttttccttgatgtggttggaacttggaaagctgatttgcttgaacatgaagagctgaacaaagacagccctgtttgtaacaaactagtaatcagataattcagccgattactacgacaattcagctgtttggttgtgcagaaggtatattgaccatgcagggtaattcggctgattgcatgaacttgtttggtaaaaactattgtgtataaatcgtgctccaaactcttgagcggatgctattagtgggtgtttttgattggacaatctgagcggcgagtagtgcagtactatgttgtgaagaaacactagtgctgggtgctgctgagttgctaaaaagtatgatatggaagggaagtatggatgtggttggggcagctactgtcccatgatggtttgtgctaatgaaggatggggagttgattgcgggagggatgagtgtggacgcaggcaggcgttcatagttagtgctggatggtgacaggaaacggaacaggaggacttgagagctgggcctaatgtgtggtttgggccgactaaaatgctaaagcactcccttctgatcgtacttgtgattgtagtaattatgtactagtaacgaaaattctgtttagccttttcgattaaaaaagaagaagaattaaactgatagcggacgcactggccgcatcttgtattcttaccaaaaaaaattccatgtcgttgttgtttaaccgccagcagtggactacttttaccaccggtgcacaagccaaattctgagacgcaatgcaacgacgtcatgctatgcttgcagagttgcaggctggtttgtgctgcgcattcgcgtcaacactcccatttattatgccaactaattccaaacaccagcaatactctcctcattaacttcttccgcgggacgagagagggagagagagccaaccgcgcactacttgtacttcctcatcttcctcttgctattaatcgaatcaaattactactagtctcccttccacgccacgcacacgcacccaatcccctatcgatcgagagacatggcctccaccaccgccaccgccgccggcaacggcagcggcagcatcctccccacccacaccaccacggcgccacccttcagagcccataaggacgccgacctggaatccacgacgcggcggcgccggcgacgctgcctgtgctgctgcctgctcgtcacccttgtggtgctcctcgtccttgccatcaccctcctggtcctcttcctcacggtgctccgcgtccgcgaccccaccacccacctcgtctccacccgcctcaccggcctctccccgcgcctctccttcccggccacgtcggtccagctcaacgtcacgctgctcatcaccgtggcggtgcacaaccccaacccggcctccttcacctacgccacggggggccacaccgacctcacctacaggggcgcacacgtcggcgacgccgagatcgacccgggccgaatcccgagccgtggggacgccaacgtcaccatggcgctcaccctgcaggccgaccgcttcgccggcgacctcacgcagctcgtctccgacgtgatgggcgggtcggtggcgctggacgcgagcactcggatccccgggagggtggccatcctgggcgtgttcaagcgccacgcggtggcgtactcggattgccatttcgtgttcggcgtcacggagatggccgtgcgtagccagcagtgcagcgaccgcaccaagctctgattgatcatgtgattccaacttaatttgcaagtttccaagcacgcaacgtaaggtgggcatgccgcatcgcgacgtgggacaagacgagaagccgtatgatatgctgctttgttacgcaggtgcactgcactagtagtacatagtagagtattatattctacacgggcggcacattagttcgttacagatagtatcagatcaggaattcaggattcagtgctacgattttcttcaatatttcttactgcgtgttgggattgatttgattcatgtatataacacggtgtcagtttggatatatatacagtaatttcactattctctatttcttcaacgtatgcgcccatgatgtttactagcgactgattcaaaaattcctaatccaagcgccaaacttcagttaaacagacctttctcgacagcatgcccacagcttcaagctgccaagtgccaacactcacagaaaactcggcccggtgcaaaaaaaaaaaaggagcatatcctgacttctttcactagcaaatactgagttactaggatttaggaccctcacatggtcaaacaacaaacatactaaacattgttacaggtttcaaaacatataatgaagccacatgtataaaccaaacggccatttccagcggttttctgtttaacctcaccactaacagtcacatcaagcaagcagcactttacattatcaatcatgattttcactactccgctgcattcatcacataaatgaaaacatttaagcacggcacaccatctcacagttcttgtgaaagaaaaatgaactactattgagcagcattcagacgatccacatcatgaacctgcaaca

SEQ ID NO: 56993 - DNA, 4200 bp, Oryza sativa
gataatcagatcaataaacatcatgcagatccgttcgagaaactgatcctcctcctcagcatcatcgaattcaaaacttaaccttttaacagggtaatcacctgaatcaaaacttagctgccttcgcgaaggaagttctggtgccttggtcaccttcttctttggtgcacaagctaactcctctggtcctggagcaaaaggatcaaagatgctttcgcgcggtgtctgacatccatatgaaggatcttcatctgcaacactttttgagatatatgattcaatcgcttcattctctggtggtgtaatcacctcagcaacaccactcttgttattttcatgatcacataccatgccaagggatcttgtgtccttattttcaaagggagattgcacagaagcttcttcatttacacacttgtccaacttttttacaacagggaagtcacagtttgaaactagcgaattatcaataacattcttatccaccccttgatccatttgggagtaatgtggagtcaacctctgctatgacttgcaaaatgaaaacctacaatgaaataagaaatagaaaaaattaaataccacaaactaaccaggacataacagaaaatgatcaccgaaacaaacaagggacacccaagaagattccaaaaggtttctaggggatactaaggcaaaaatggtcacaggagaaactaaagcaaaattaagtggttatcgacaaaacactagccccggatgtaacggcaactgctatgaatgtaaaattgttctaaaagagtaaaggactatgcaaggcgccaaggtagtcgtcagccactaataagcaaagagcttcaactcttgttagaagccgagtgaaatcactgacatcatctaatataaccaaagcccttttgtcgataaccgttatttcttaccgaatttcaaactgttcacccatcactctgagagtctgagtccaagtatatatacaacaattatatatgtttctttacttctgtaaaaagatatcaattaaccatcaacatctattttataaagcaccttccgactgtctaattggataatggggaaacctaaaaaataaaaagctttctatgcattagctccttggaagaccttcatccacactttttgcctactatatatgtatcaatggtttatatgcagctatgactcatacataaaagattaaaaatattctctatagccagcgtttttccagtatatctacacttgatctcacaagtttttccattatcacattttcctgaaacatagtaaaagtaaacaggataacctgtacctttgaaatagtacaggatctgagttgcagagatcaggttccaagagcatcaacacttaatagtagtatgatctttaccaaaagagcaagtgcagagtgtatcggtttcatataaaaacttgatcatgtcaaaatcaagtgtggttacctaaaaaaatgagtacatcagttgatatcaaaagatgaacaaggaacttgatagtatttgcctgacatcaataactcgaaaatgtagcaaatatgtgcagaaatttgacatcattgagcctcatttccagcaggtaaataaatgcagaacaatggcctcagatatatgaagaatgtgaagtagctactgtcattggtatctgttctttccagtatctatcaaatgtagcaaaagaaaaagtacaaggaaaaggaaaataagaccaagtgtaggaaaaaagaaaccgcaagaaaatgagaacaagtgtagagcaaaaatctattcacatgcatcacaaacagcagcatatatcatcattggccatctttcccagcctaacagcacgaaaaaaagaacaagtgtagaaaaatctgttcatgtactcttataaattctgctcagttcaagtgtagaggtggcctcagttctgctaagatcatttgaactataaaatactgagaaagatcacagaaagacagaaacttagaaagggcatgtttggttgcctgaccttatcgaataaggtcaagtgcgggcatatctgttcttatgcatcacaaataagcactattaatcaagtgtgtatctgtcagtatcaatttaaaagaaggcactattgtatccggccttatcagtaacttgtatttgtagccaaagatacaatggcataacacaaatcaacaggaaaaataggaataagtgtaggaaaaatgaaaagcaagccactagacatttcattccatcgaaatcaaccaagaaagatgtcagcttttagtagatctagcatatttatgaaggggacacggtcggtctaatccaaacaaatcggctaaaatcgaaggaagggaggagaagacaacctagcccttaccagagagctcaacggaaagagtcgacgaaagagaggggcatagcagagagacggagagagcgaaccagtggaagagagcgatggcggctagcgaaagagagggaggatgcagtgctgacggacgaccggccctcccgccactcgcgagtcggcggaaccctagctttccactggtttggaacaaatgaggagggatggtggtactggtgagtggtgaccccatccatggcttctgcaagagcaggcaaatctgctgggaaccaaacacgtacacgccctaactgaacaccacagtgaaatactcaaagttgctagtattataatggtactaatccagagatccaaatgtcaaatacgtgtggtctctacatcaagatctattgtagccctattgggtgtcttggcttgcgcatgccgccgctgaataacaccataaaccttacccgagcgctcgcttgacggcgacgtggtgcgctaagaagtttggatttgatccctcacaccacaaacaaaggggacaagactacaacagatatctaattaagcaaaacagggttccttaccaacaaaagaagaaatcaatccaagcccggatggatcttccagtccaacccaatacatgagatggggagcaaaccggataagagttccttgttggcgcacctagaaattagaatcacatggtaaaagaagtagatttagggctttaagaagtgagaaaagccgaaaaatcacatgaaaaaaagagataaagctcactagaaccctaacatgtgaaaaccataaaaaaatccatagaaagaagaggagcattttggatctgcgtgagagaaagattgagaagtagaaatggttaagaaaatggaagaaaggaaatacctcgcggcggctctggattggggcacgagattggtttgggtggcaccaaccgggattgggatgaggcctcccgccgccaaaacaatcccctctattaaaataaaacaaagatttcacaaaacaccccatagaatgtctcatttgctaattttattcctttgtacaacaactagcgaggagcaaggcagctctgctggaccactgaggaatatatgtgaaaaataaagaatcagtgggttggagagtaaaatgcaccaaaaggagggaaaactaatttgggcgggcaaccttggcgcgcgtgtagcaatttagcatatccttcccgcgaaataggcgtgcctatacatatcatcattttggtgaaaaatgaaagtttcccactgcctaaggagttttttcttaggaaaaaataataaaataataatggtcgtgattatttagaaatctataggtgcaaataatcattaaatgagtgggtttcatgtgtatactatgttgaggctagtttgcgggttatcgaagatcataatgattaagagacagttaattttatgttttcctggtttaatggaatttatctattgcaagcaaaatacctgtgtttcatgaccagtgaagaaaattataactttacataccttgttttgccattcatctctccatatgaaacacacctgtgatacctttgttccgtcatttatgtattcgtatgaaacacgccagtcaggttaaagaataagcctgtgagactttgatactcaattttaacagtacagagaagtttatgtgaaaatacatataaactcaaggcatgcattaaaaaataattgaatgaataacttttcataatattaacaaaatgaaagggttaaaatgaaagattgacaatgaatccaagatattttatcatctaatactcatagatagaatccgtttggtgatgcatggtagagg

SEQ ID NO: 56994 - DNA, 14909 bp, Oryza sativa
aacctctctaggcatcctccagtcttagcctatcttgttgggtctttgtctattttcattggtttatgcctatcttgctagggcaaaaacttttgaaaatgttttgcacataatttccttaataaaaaagtagagaatattcgtgagtagtacgtagttatggactagttaaaacataataagttattgtctataataatatcacgagtattccattcattacaaacttccaaatatcacgagcattccattcgtcacaaacttccaaaatacactcaagcgaatattcttcaaaacaaataaaaatatgcacatatcatcattagctagttcaaattggtgaagaaaagtgtgacagacgcttctcatcagtttagtttagataaatccggcaataaaaatcgctatcgactaccaaacaaggaagttgtcaaatgagacgttcacgacatctatgttttgaggtcccgatccttgcagcctttgctctaggctctgattggtagatttgggaattaggatgactaatggaaatttggaaagatttaatttcacctccttttctcctattagtgattcccagtttaattggggagaggggtggagcagacgcgaagtctccgttcttgtggaacaaagaagcatgcaaagaaaagaaataaggcataggagttggggcaaccacttggatggagtgagggcagatggccgtgcgtagccagcagtgcagcgaccgcaccaagctctgattgatcatgtgattccaacttaatttgcaagtttccaagcacgcaacgtaaggtgggcatgccgcatcgcgacgtgggacaagacgagaagccgtatgatatgctgctttgttacgcaggtgcactgcactagtagtacatagtagagtattatattctacacgggcggcacattagttcgttacagatagtatcagatcaggaattcaggattcagtgctacgattttcttcaatatttcttactgcgtgttgggattgatttgattcatgtatataacacggtgtcagtttggatatatatacagtaatttcactattctctatttcttcaacgtatgcgcccatgatgtttactactccctctgtcctataatataagggattttgggcttttacttgcactgtttgaccactcgtcttatttataaaatttgtgcaaatacaaaaaacaaaaagttgtgcttaaagtactttggataataaagtgtcacaaaaaaattaaataataattccaaatttttttgaataggacaagtggtcaaacagtgcaagtaaaaactcaaaatcccctataactagttgagtgcccgtgcgttgcaacgggtgattaaaaatacatctagtgttatatgttgataagccttaaaaaattctaatagacattataaaacccaaaccccaagtccatgatacacaatattttaaattcaaattgattacaaatgcagtgctacttttttatttcaaatccatcaagcaaaatcaatttcagatttaagtccataatataaaatcaatgttaggtctcagtttagaatctgttttaaattttcccttccactgaccgtaggctaatgattagaatttataggcagaatcagacctttactattgcctctaactgtacattgcctaggtgaagcacaaaggatgccagtaattgagatggcctcgatgggtttatcctcccctattgcagtaccacacgccgcaggcaaattcatctggcaaaagacaaaaataagggaacaatttctgaatatgtatcactaaactgcagcagcaaatgcaacaatgctggaactgtactaccgaagtgatcacagtaagagtctcaccatagatagtggccaagcaagtaggagcagaaagttggaggccatgtagagcaccatcccctgcgctgccaccaccagcaacaacgacggcatggccagtgcccaatgcttgaaagcaaccaccccggtgcgcacaacgccacccatgagactcaaatcactcatccaggcgaagcgaacaactgcatgcatgctaggagtggagacggcggccgtcgctgcatgtagtaccgacctggcggggtagtaggtgatgctgagggagcgcagccaggcggcggcaatactgcctctccctcaactgagttgatctgaaccttggtctgcatgtagtaccgacctggtgaggtagtaggtgacttcgagggagcgcagccaggcggcggcaatactgcctctccctcaactgagttgatctgaaccttggttactggaattgcgctgcatatcttcttctttagcaatcaggagacaagttaataggtgattgaatttaaaaccagttacaaacaagatccatcagggtgaaaagaatagaaagtacaaaggcactcacaattagagttcagttcttcaataatttatctccaagattcagtctcactgcacctaatggtgtggcagcccgaacacttcccattgctaagaaaaggaaaatattttagtaaatatttctattattagaagctttaatcagttgctatataggatatgtagtggtcattgatatattagcagctttttcatttgtctgaattaatattgagaacaaatgtggatataatcctggtgttgcagaaatcacaggacttatggcctttcagtttgtgttctacttgatagtgtgctacaaaattcaaataatacattaatgattgcaaatatttagaaatgcacaagctgtaaataaaccagcaatctcttttaaatcctgtcctgcatggactaaaaataaaagaaatacttcctccgtcccaaaataaagccattttttaggttggcacgggtattaagaaagtaggtgagaatgattggaggaagtgtgtgattggttgaaaagagaaagtaggtgaagaagaatggttgtgattggttgagaggaggaggtaggtgaagaaatagcttcattttgggacaagacactgtgctagaaatagctacattttaggacggagggagtacttaagttcagtacctactgaataagtttgtttgcagttacccataggtccatacaaaggaaacatggtctttataaaatcacagggtctttataaaacaatcatgccatttaaggacaccaaagctacatatcaaatttatttgactcagtacaaatgatcaaaaaagagtaggcatatgaagagtagaatctacgtagttcgaggtggacagtactatttggtcaatttgagcagaggaacaatgagggctccagcatttcttactaaatccctgactcgcatttttcactaaccatatgaaaagcataatcatatataaattcaatattttttcatgacaatactttttgggatatggagtttgcaaactaacattagaaattgtaaactaaccccagactaatgtgtttgatccactaaattttcatccacaacaaacaaataaacgtcgctttatagatgtactataaactccattataaacaaatgggggggaggggtatggaagaaatcataacatgaaaaaaattttacaacgttacttaccaccggctgaggaggaggttgccgcaatagagggcgccgtcgttggtggccggggctcgcagaagggggacgcggaggagatcgacgcgggattgatggttgcgcggaggagatagacgtgaggcgactcgtggaggcagcgacggaggataggcgggcaacatggtcatgggcgatgggatcggctgggaaataacggagagaaattggtacaactacaactccttcaactccctgctattgtatatgaaagccatacaagttatgttatcagcactcctgatgaatacaaaaaggtcaaatcaaatcacagcgaatttttggacacgaaatccacctaagaaacggccataaatttcatgaacacaaaggataaaacaatggatattagtataacttgcgccaatggatattagtatgttagtataacaaaagctaaatactcatggcatactcttttccccaatgttaccattatttacactgtgaaacatattcaagtcatctatttatatgtacgatcctgtttagataacttaaacagtaatgtaccacctcgataacttgcactgcaccattcatttcccactccgacaaatcgaagtatggaagacatcggcacgatactaaaaataagcatttatgcattgaaaaattccctttgggccaagtgagccaaccaaatgtatatgctgtttctatcaaaaagattattgtatcatgtttcgagcctcagatttcattcgagcgggacagtgggtgtaaagttttgacttttgtcttgctgaatagcagaattagtctttcctgatcaatttctgatctaatggcttcagccaactgcatcaacctgatgctgtggtcctagaagaaatgaactttttttttaactcagttcagacttcagaacccattttcttcagggaaaaaaaaaagttcagaacccattgtatttagttactgttgctgtgcttatgttcaatctgtccttgtgttaagcattatgttatgggcatgcagtcacaatcaaattacatcggttgatgacaatgtgtgtgcctgcctgtatctgccttcctatatgtgcccaaccaaggttaatatggattaactcaccaatagacgtcgaaccgaggagagggaatagattaacatgtgaatatgcagatttagagacctagtaccaagaggaaggggagtacaccaaccttgggaatagttggcgccggccttggggaggaggcaggatgcgacgacggcggaggggcggcggtcgagggcggtgcgggtctagggtttcggcgcgatgagggaggagggaggagtcggcggcgtcgggtcacggggtgagtgcgagagaaaggagggcgtccatggcgaatcctcgacggtgacgatgggggcgccgacgcgtcgatgtggggagtcccgagggtggattggggggcggccgatggtgtggaggaggcgggatgcctcgacagcagaggggcggcggtcgagggaggcgcgaggatggattgaggggcggtgatggtgtggaggaggcggcggtggagggaaagaagtcggaggaggggcggcggtcgagggagaggagtcggcgccgtttcctttttttttttttttttgttgcggacgaggagtgtgcgccgtttccttttctttcttttttttccgttgtagagtggcatgtaaattgttgatgtacctttctcatgtttgatcgtctgtccttggcttcactatcaccgtaacgaattttttaaatagtaaagatatgggacgaagggagtagctactgattcaaaaattccgaatccaagcaccaaacttcagataaacatacctttctcaacagcatgcccacagctttaagctgccaagtgccaacactcacagaaaactcggcctggcgcaaaaaaaaaaagaaagaaaagaaaacaccatatcctgagtcctgacttctttcactagcaaatactgagttactaggatttaggaccctcacatgatcaaacaacaaacatattaaacattgtcataatgaagccacatgtataaaccaaacagccatatccagcggttctatttaatctcaccactaactgtcgcatcaagcaagcagcactttacattatcaatcacgattttcactgctccgctgcattcatcacataaatgaaaatatttaagcatggcacaccatctcccagttcttgtgaaaagaaaaaggaataatcattgagcagcattcagacgatccacatcatgaacctgcaacagactcactagttcaaccagacacagctatccattttaagatttacaaaaggtacatggtcacagaccacaactcctaattgtatatgactaacccacccaaaaggaagactgattaaagcttacatgtataacttattaaactgcctcctactcctttagcatcactacctacaagttttagttagcaaagttaccatattggcacagggcaactgaaattggtagccaaaaactgccccaaaatactattcctaggcagatcaaaagggtgtcaagatatcacttattctctttaacgaataaacaccttggactgactgaatcaaagtcgagctttcgacaaatacttgggctgagctgtaccgctttaagaggtcgcctcagtggcgcatctgggcaggtgtctgcaatgcctataagtagaggctcacaacttccaggtgaattagaacctatcagatcctttccagtcgtctctagtgcttgatttgagataatcagatcaataaacatcttgcagatctgttcaagaaactgatcgtcctcctcagcttcatcgaattcaaaacttaaccttttaacagggtaatcatctgaatcaaatcttagctgccttcgtgaaggaagttctggtgccttgatcaccttcttctttggtgcacaagctaactcctctggtcctggagcaaaaggatcaaagatgctttcacgcggtgtctgacagccatacaaaggatcattgctagcatcagtagcaccgaatttagtattcagtgcatcccacaactccttagcgtcggtcatatacatatacacctcgaccagacgatcgccaagaacgctaagaatgcatcccacaaagagagtagtggcttcctcgaattgcttctgctgatcagtagtaagaattccttcaggtttaccagtactcacccagaagcatttcatagccgtcagccacagagtgaccctgatctgccatctcttaaagtgcacaccggtgaatttatccggcctcagtgcatcggcaaaaccagccatagtaaaatcacagtgcctataataaggtttttggattgttgaaattataagcacataatgatttaatttattccataaataaatcatggcattgcagatgtaaactagattgaacgcatcattcgatctacacatgtaaactaagcagtaaaacatgaacagatcaaatatgcgcaacacgtcgaacacgtaccgaggtggcggaaagactggttgctcggcaggaactactcgtggttgcgagcgtcgacaaaggcgcgagtggctaggagggcatcctcccttttaaggaggtctccctctcctagaataagtaaggtgataccaaaatccgcatgcatgccatcccatgaggtggacttttgtgattttccaaagaattaatcttcgaatgggccttagcccatctattaattccaacagaaccttggcaccggcaatgcgggctagagggcgcatgatgtgggtccaagagaagaccgacgagccaaacccatgtaatagcactatgggcaaaccaatttggttttggtcagcgtttgtgatgccagagtctggagattggtcactggaatcctcatgggtgcaaaccttgtggtggacccttacgccattgatctcgtagaagctgctgtctgggtcagcgagggcatcggggtcaaggagatcgtcctggtcaatgccagccacactccggcggcggcggcgtcgtggtggcatctgggcactgtctggaactgaacctgcattagttgtagggtttagtagtgccaaagctgttctgctagttttggggacattttagctgttggtgctagttctgctacccagatgaaaagaagggcgcaataataagccattttaaatgggggaaaacatgcattctacttgcaaagagcacatcaacttcaaaacctcccattttaagaacctcctatccaaatgctgcaagtcttccacaatgggaagatggttacctgggaactcggcagaggcaaaggctgggggagaaccattgggacggcgagggccggaggccgcgggagaaggcggtggaatgtcgagggtgtggagccgagggtggggattggaggtagcgtgggagaggcatctgaattgacctgatcaactgcagagcaggaaactcacgttcgctggactgaacaattgtgtggggtctcaacggaagaagcaaaccgaaaaatcaatctgcatccacacactgcaaatttgtatcgtcatcaaacaaaacggtgctccaaataactatcaatctatattagatgaatgcacactaccatgctcggcaatcgcatttcttggatttttctcatcattgattcattgggcaacaaaatatcaagtcttaatctccctaaaaaaatatatccaatcttgaagcaagtaaaacatctgtgagttaaaagcatgtgaacaacgcaagcagaggaaaaaaaaagatgatatcaaaatagaaaagtttggttatagtaagcttaagagcatgtataagatctgagacaactatagtctctcgtgcactatagacgataccgaaagacagttactacaacagtttgccatatataccatgaaacgaaataaatgtgaactacactcgtagctttggaaaagagaaaatccatcaaatgccatcgatagacaaacaccataatcctagaaatgccatcgacaaaggcaacttcccaaaaatgtcattgcacaagcctctttctcccaaaaatgccatcgccgtcaaattgctgttagcatctttccgttaagttgcatgaaaagacaatcttaccgctaggcaaccatttgctcacgcaacatcatttttgcattgtttgctcacaacaaattatatttatgttagcttacaaatttaccaacatcatttgatagtttccttctgttttcatccctagtcactccccaatggcaaataggcagctcccgagagagagagagagagagaacgcgccgtcgccgccgcggaactcctcgccgcgccctgcgacgccgccaccgccgccgtcgacctcctcgccgtgccctacgaggctgccgccgtggacctcctcgctgcaccctatgatactgccgcgccgtcgccactgccgtcgtggacctcctcgccgcgccctgcgaggccgccgccgtggaccactgccgcgccacccctgccgtggatcctcaccgcgccctgccgcgccgccgccctggtcctccttgccgcgtcctaccgcgtcgctgtgctggtcctcctcgccgcaccctgtcgtgccgcccccgtggaccgccagcatagcggcgccatggccaccgctagggaccgtcgctgagccaccattgtctagacgccgctggggagagcgctagatcgggatcggttgcggtagggttagggctagaaattttattttttttctttgacagtgaaaattgggtatattttgcattgagggcaaaatggttattattaaaaaaaataatggttgtaatggtgtggagttgatggtgatggcatttttgggagaagggcttgtgcaatggtattttttggaagttgcttttgtcgatgatatttctgagattatggtgtttgtcgatgtcatttcatggattttttttctttggaaaattatgtgttagtagtaccagacagtagaaacaggcagtacagactacagagcttggtcccctctatgtggaaatggtagctacagtgatggggtttgaccatttgggcaaattctacaaatactatagcgattggcatgaagtatgaaccacctactaccataatctttatgaaaacatacacagctatgaacaccatctattacttggtgttgagttgtgatccaaattaacttgcaaataaaggccaacttctatcggagcgcagcggagatccgtcgctggaggcttgagccgtagcgaaaaagataccgaaagaaaaaaagggaaggcagaaagaaaaacagagaaaaccaaaaaagaagcgaaattgaaaaaaaaacaaaaaaaaaaggaaaaaagggtcctccagtgctgtccgtcgctccttctccgcgcgcgacaggtgactggttgctaaatagctttctcgggagaccactacacttcggacgtctgatggataacagaaaatcggacgcttgttatgttatatttttgacacatacactaacatgtgcaaaaacactttaaactatttttttctcttaaattatttatccaaatcatgatccgattacaccattaaattcgttgcaattaaatcttcaaaacaagaccacacatgaatatattccgacgaatttttttagctaattattgaattatttttaaatattgcacgatgttccaccatgtatatcggaattgtttcactaaataaatcaaaaacgtttcaatcgtttaaatcaggcgttgtttcaccttatataaaaacaatgtttcagcaaatagcgaaagaatgttccagttcactgcaacatttgatccatacatagtgaaacactataagtacactaggtgaaacatttttggtagaacaaaaaaaataaagcgaattctcttgatagagggtttctaaaatatgtgggtaatttcttgcaaaagaatgttttaattcactgcaacattaagtctatacatagtgaaacattgtgagtacactaggtgaaacattttttgtggagtatgtagtgggaacacgtggcagtgttgcaggggagacgtggtggggcccaaggggagcatgtgcgcacgtggtggttgggggggagcgtccgattttctccccctcccccgggcgaccgaggcgagatcttattgtaaagatttaattgaaacgaatacaccgaaataaatggatcatagactgaatgagtagttttggagaaaaatgattttaaagattacaacttacatatgcatatatacttgcacaaaagttatgcgtatatgtatcctgagttcctgacatgacaaagagatgaggaggcattagcatgatgaggcgtccaaagtttcttccgtgatcggacgctagatgggaagtatttccggcattctcgaactatcgtaccagtttcaacccgtgggagagggttggccgccagctccgatgctagcgcgtatgcgccagatagcagcgcccgatattttctttccggggcgtgggcggaatcattcaatcatcgatttcttccccaaacctagcctcctccactgctcccaacctgccttccgtcgccgccgcctaccctcgactactgatctacctttctccgtcggcggccgcgggtgcccagcgcaaccgcaccctctcctctccagcagcggcgacccctcgcctcataccctttcctgggcaaggccgggaggggatcaatctagggtttccgccgccgccggttccccggacgttgctgcatgacgatggaagatggaagctgtccttcaccagtcacccccagcgaagccgaagctggagccgaagattacgaatcttggacactgaagcagaagattgaggatctcgtcaactgtgatcctatccatggtatcgtgccaaaaaatcctaaatataaagcatatttcgaggaaaagttccaggtacgtacgtacatattttcttcgatccatcatccatggatgcaaaactaattaattaattttgacctcaccagctagcatatattttttttattgtatgcaatcgatcgatgaatcaagtggtatcatatctattgctattgtaggagaagttaagtaagtacgtccgtgttgtattgccgaaacttcgtccagcaattcagaaggatagcgtcaagcaattctttcaagtctacaattgttggtcaggtttcatgggacggggaaacttccttttacctgatatcctcaccaacatggccaacgagaacgctctgcgttgtgccagggtcgcactccagggcacctctcctctgttgcgtcgccgccgcgctgaccccaacacccgccaccgctatggcttcgcccccctacacatggctgccgagaacttcagcgtcgacatggtcaaactcctcttccgttacggcgcatcggcgaacatctgcaccaagggcgagtatgtcattgagggcctcctccctctccatgttgctgtcgagaatgccagcatgcacaagtacattgaggatcattgggctcatggggaccatatcatcaacctcatcttcctcctttgtcttcctgagatggtttcttcattcaattcctatccctattatattactgccagagcatttagcctatttcaaatactagcttggaccaataattaatttcagccaccactgacatgcagaaaatgttcttggacacgactagattaattgccaaacagacagataacattgtcgacgaggtatggaattacattcgtgaagaaaagcatgtccaggcagcaattttgctgctggctgctcaaaagcagctccgtggccgccttaacaacagcagtggcaaagcctctctgaacgggtttgatattgttaaaagccacattgatgatgctcttaacaccatacatcttgaggggttaaatatggttaaggagggaaagaatggcagggcactaaagagattgaaagacaagaaggaagcccttcttacagcacttgtactagttggcattgttcacaaagccggtgaagctcttgagggatacattcaaactcattcacaggtaattgctgaaatttccccattgttaccattgctttctgatacctgtgggttttgatttttccagtttcgttttctttaaatttgtgtgatgcttacttcccatgactttgatctactagtgactcattttctttaaatttgtgtgatgcttacttccatgattttgatatactagtgaaacctcgaattacccttgttttagaaagctgtggtgggtgtggatcgcttttctttttctttttggtgatatgtaaacagttggaggagctcctgctgcattgtatcaactagtcacatccatattataaaaaggagttaaaaagaactggacccatgcagttaatggcatcttttagcctccattttcatgtaaatccaagaggctgaatagcaggcccagcatagtggtagtatactgctaggttcaggtctaatgcatgagtcaaaaatatatggaaacatgggagtagatgcagtgtgttcttaatgcgaagcaaggtggcccaccatcttttagatgcctacgagtttaatgcataagtcaaggtgacaccttacatctaaatctatacaatgttgccaacttctgtattacacacatgcttaccaattattgagcccatgtaccattcgtttcccctttctaaagaagatctaagaggaggggaagaggtcctcttcagtctcagcagcagaatgcaagaagggaaaaaaggacatgtatcctgtccaaagaggcagagcaaagcgcaagaaaaagaacatagatgagggaagaggtgccctttccaaactagcagagcaaagcatagaacaagaaacagagcagagaagagggaagaacaagtacctgtcctgtgcgacggttgacagctggggaagtggagagcatgaaggagaagcagacccgtcggagaaataggggcgttaggaaggcaggctggtcctctgcatctcccccttctccttttctatctctaggccactagcacccctcacacaccagcctttcgactgtgcacgccacacttgctctccccacatgtgcgtacccccatggcacttgcggaaggctaagcgagcaatatgctctcttccactggtgcttgggcgcgaaaggcgatgcctttacgacactttaaaaaccaagaattgatatttgcatgaactatagaagagcataggggtccattgaaggtaagtttatctttttgggatcaggaacatataaaatttgtagggaagatcaattgttcttaagtatggtttgagaataaaaatataatagcaccctcccttggattgggctaccttttaaagtgggaccccatgtaagtttagcaaagcaagttttttagcttggaaactgagtctttgagtttttgtaaatattttcaattttattcatgaatatatgcgtattcagcaattttaattatgactccatatatattcagcttctattcttttttttttttaagttgagggctaacataatgggtaagatgagcaagaaggtgcgtagttgttatgtgggagatcatgaggctaataaagggaatagcacttagattatgtcaaggtaacctgcaaaagggtagagatgaatagatgatagtgttaagggtgatggtggtttgtctttagccccattggagtggaaacctgatattggatatgctgcccttgttaataatatatgtttgagtggaagtttatatattctttctctaaccatgactatgactaggaatcatcatattgttctctcaacaagtctttcatattttaattgaattcaagctctaagaaatgaacgaaacaaaagctggactaccctgaagcaacttctcataatgacccaaattacatgaccagaaggcctgcattatggaagcttttgttggtgctgaccagttctttttcttcctcatttatttcttctattcctcacctggcatgttcatgtaaaacgcaaaacacatgtcggattgttattttctttcttatttatttgctttattctacgtgcatgttaaagtttagtgagaatgcatgtgtcaaaaattgtgaccctctttcaccccacgtctctatgcacacgaagagtgggttctaatattttctgttcaactttacttgggtctgtttcgaaggcccgccatttcacagcatccatatatgccatcatgccacaatgaatatatcaataaatttaaaaagtggatg

SEQ ID NO: 56995 - DNA, 14334 bp, Oryza sativa
agcatgccaaatcaatgacttactgattcaactcttgaccacttagtatttgtgtagatgtagtgcttaaaacaccattgttgactttcagatggtctgtactgtttgtctcgagagatgatgttattgaaggctgttatgtgtcttgcaaccaccaccacctgcaagtttagatatctgaattctcgttttggaataatatccttgaacattttgtaatgatacgttttaacaattttcttggtgaaatgtaggtgcgccatgacgaaattgttgaacatgtttcatcaattctaaaaagcaatggcattgctcattctggggaaagcattgacactggaaaacttgaatggtttgacatctactggctttatatatatattcagttcatgtttttgtgcatataatttatgcgttgatttatttgtgttttgaagctaccaacatggtggggggatgtcgattggcaagtcagattcacaaagaggtgtgtttcattttggttgatcctatttcttattaaaataaactagaaaggaaaatagctgtgaaactttattacgtgtccacccattacaaagtcatttgctgtggtgaatgcacaactttggaacattgcagaaagcttatgacttgcatccagcgcaaaagggggtgcaaccagactctgtacaccaacctcggaactatgctttccatttcataagctgtctcatgaccaatttcattgctgattacagtgggctatggggaaactattgaagcggacaagtcatcttctgatataggcgaagttagtaaaatggtaatgagatacgcaattaaatttatttgttgagtctaattcatgctgatgaaattagtatgaaaacaagattgttcctccaaatttgctcctactgacccctatcaattaacaagatatggaaatatttgataacgtaatgcataaccatcaattgttgccttattggttaacaacagaatgaatactcactacttaaatctgagtgtttttataattttgtttatgcgttcagttgctaattttctcatgtaaacagatcctgggaaagcaaccacctaaaggatcagccatacgcgaagtgagagatatgttcttcccatactggaaatcggtgttgtctcgacggttgcagctaaagatagttccatcctgtcaactaagcaggaaggacttgctaagtgctgaagcgagcacgaaggggaccaagagtatggaccacccgtgtaacccaatcaaatcaatgggaaatcttggttcgatgggctggcccccattgtcaagtgagtccagaaggatgctttatactgttgcttcaatgtcccggaaggtgtttaagcgcacttgactacagaaaatctttggcggtatgcttgttgaaacactttttttttctataataagcctctagaatgtattttggtcatagatgagaaggggagaaaacagcatatcctgacttctttcactagcaaatactgagttactagtaggatttaggaccctcacatgatcaaacaacaaacatactaaacattgttacaggtttcaaaacatataatgaagccacatgtataaaccaaacggccatttccagcagttttctgtttaacctcaccactaacagtcgcatcaagcaagcagcactttaccttatcaatcatgattttcactgctccgctgcattcgtcacataaatgaaaatatttaagcacggcacaacatctcccagttcttgtcaaagaaaaatgaactaatattgagcagcattcagatgatccacatcatgaacctgcaacagactcactagttcaaccagacacagttatccattttaagatttacaaaaggtacatggtcacagaccacaactcctaattgtatatgactaacccacctaaaaggaagactgattaaagcttacatatataacttattaaactgcctcctactcctttacatcactacctacaagtttcagttagcaaagttaccatattggcacagggcaactgaaattggtagccaaaaactgccccaaaatgttgttcctgggcagatcaaaagggtgtcaagatatcacttattctctttaacgaataaacaccttggactgactgaatcaaagtcgagctttcgacaaatgcttgggctgagctgtactgctttaagaggtcgcctcagtggcgcatctgggcaggtgtatgcaatgcttgtaagtagaggctctgaagaagaggtctcacagcttccaagtgaattagaacctatcagatcctttccagtcgtctctagtgcttgatttgagacaatcagatcaataaacatcttgcagatcctttcaagaaactgatcatcctcctcagcatcatcgaattcaaaacttaaccttttaacagggtaatcacctgaatcaaaacttagctgccttcgcggaggaagttctggtgccttgatcacattcttctttggtgcacaagctaactcctttggtcctggagcaaaaggatcaaagatgctttcacgcggtgtctgacagccatacaaaggatcttcatctgcaacatttattgagctagatgattcaattgcttccttctctagtgtaatcacctcagcaacaccactcttgttattttcatgatcacataccatgccaagggatcttgtgtccttattttcgaaggaagattgcacagaaacttcttcatccacacacttttccaacttttttacaacagggaaatcacagtttgaaactagcgaattatcagtaacattcttatccacgccttgatccatttgggagtaatgtggactcaacctctcctgtaacttgcaaaatgaaaacctacaatgaaataaggaatagaaaatttaaataccacaaactaaccaggacataacagaaaatgatcaccgaaacaaacaagggacacccaagaagagtccaaaaggtttctaggagaaaataaggcaaaaagggtcataggagaaactaaagcaaaattaagtggttatcgacaaaacactagccccaaatgtaactgcaactgctatgaatgtaaaatgtgttctaaaagactatgcaaggcgccaaggtagtcgtcagccactaataagcagaacccagcttcaactcttgttagaagccgagtgaaatcactggcatcatctgatctaatataaccgaagccgtttttgtcgataaccgtttttttggccacatttcaaactgttcaaccatcactctgagtccaagtatgtatacaacaattatatatatttctttacttctgcaaaaagaaatcaattaaccatcaacatctattttataaagcaccgtctaattgtaaaatgggaaaactaaaaggtaaaatgctttctatgcatagctccttggaagaccttcacccacactttttacctactatatatgtatcaagggtttatatgcagctatggcagatacataaaagattaaaaatattctctatagccagtgttaaactgaacaccatagcgaaatactcaaagttgctattagtggtaccaatctagagtaataggcgcccaaatgccaaatatgtgtggtctctacaccgagacctattgtagccctattgggtgtcttgcctgagacaaatcttgcgcgcgccgccgctgaacaaaaccataaaccttgtccgagcgctctctcgacggcagcgtggtgcggctaagaagtttggatttgatccctcacactacaatcaaaggagacaagtctacaacagatatctaatgaagcaaaatagagttacttaccaacaaaagaagaaatcaatccaatccaatccaagcccgggcggatcttccagtccaacccaatagatgagaaggggagcaaaccggatgcgtgttccttgttggcgcacctggaaatcagaatcacatggcaaaagaagcagatttagggctttaagaggtgagaaaagccgaaaaatcacaggaaaaagagataaagctcgctagaaccctaacatgtgaaaaaccataaaaaaatccatacaaagaagaggagctttttggatctgtgtgagagaaagattgagaagtagaaatggttaagaaaatgggaagaaagaaaatacctcgcagcagctctggattggggcgcgagattggtttgggcggcgccgaccgggattgggatgaggcatcccgccgccaaaacaatcccccctattaaaataaaacaaagttttcacaaaacaccccatagaatgtattatttgctaattctattcctttgtacaacatccagcgagctcagctggaccactgaggaatatatgtgaaaaataaagaatcagtgggttgaagagtaaaatgcaccaaaaggagggaaaactaatttgggcgggcaaccttggcgcacgtgtagcaatatagcatatccttcccgcggaataggtgtgcctatacatatcatcatttaggtgaaaaatgagttcttttttaggaaaaaaaataatggttgtgatcactcagaaatctataggtgcaaataatcataaactgagtgggtttgatgtgtatactacgttgagggcttgaggccagtttgcaggttatcgaagaccataatgattaagagacagttaattttctatttttcttgtttactggaatttatctattgcaagcaaaatacccaagtttcacgacgggtgaagatcacaattataactttacataccttgttccgccatttatctcttcgtatgaaacacgtcaatgaggccaaagaataaacatacgtttgttctgtcatttatctcttcatatgaaacacacaagtgaggttaaagaataatcctgtgagattttgatacctaattctaccagtataaagaagtttatgtgaaatacatataaactcgagggcaggcataaaaataattgaatgaataacttttcgtaatattaacaaaatgaaagggttaaaatgaaagattgacgatgaatccgagatattttatcatctaatacacatagatggaatccgtccggtgatggtggaggcattatccagcctctctcattgcaactcgcgagggacggtggcggtgctcccgtagccaaccaacccccttgggcacgatagacgtcctcccttagcgcgtggtagcagtgctcacctggccctaggcagcgagggcagcggtgctcccctgtccttagtagacgacaatggtgacgccagcagcctccataggcggtgaggacggcagtgctccccgtcctccctattcggcgatggcaagtgtatgaggtggcttgctaagatacaagtgtactatactttcttgtgtgttattgagttgttcgaatttttggtattttattatgaagttctcgtcttctactatggtgaaaagctcatataactggatagcgtttgcagcttcatctattcttgttgccgatttttggtcatgttcctccaattttgaaggttttggattggcaaccatgtggacatgtttgttttcctcgaactctgaaggttttaagctggccacgaacgaattggaagcatttgagccggccacgaatggattggaagcagtagcggacatattgcgcttgccgtgggaacattgcggactcttcgcgatccggacgtacacggggaagaagggaatctgacaaaaatacatgcacgggaacaaaagctagacgacgggcaaaaaaaattcctggaagctttaagtattttttatgcaggtataaatatcctcatcaggattttgatatatgtcatttccttatttctgttgtcaacatgtttttattagaatacacttaagccaaattacatgacgaatagatggaactgtatctatcataggctatgcctagtgcttcacctaggcgccttttgctcgctcaaaactattggtagtgtaactagttcaatttccaccttatcttcatccacctttgccagtcctcctatgaagtccccgtgagtcttcacacgtatctacaagtcttcctcccctctccttagcgttcacccatctccaccagtcttagcctatcttgttgggtctttgtcttttttcgttggtttatgcccatcttgctagtgcaaaaacttccgaaaatgtattgcacataatttccttaataaatagagaatattcgtgagtagtacgtagttatggactagttaaaacataataagttattgcctacaatattatcacgagtataccattcattagaaacttccaaatattccatttgtcacaaacttccaaaatacactcaagcaaatatccttcaaaacaaataaaaatatgcacatatcaccattagctagttcaaattggtgaagaaaagtgtgacaaacgctttttatcagttttgtttagataaattgacactaaaaatcgctatcgactactaaacgagaaagttatcaaatgagatccaagaaatatgggcaacatagcacgaagcgttcacggcatctatgtttcgaggtcttgatccttgcagcctttgctctcggctctgatcggtagatttggaattgggatgactagatgagatagggttaatggaaatttggaaagatttaatttcacctccttttcaataattacataatctttttaataaaataaatagttaaacgtatgtctaaaagtcaacaaataaaacaaatggccaaacgtaaataaccgtgcataatacataaatactatttcaatcgtaaacataaacgaagggcaatgcacgtaggtttatcagtccatgaatgaatattatattaaaaaaatatatataatgtcagaagtgggatttgaacccacgccctcgttagaggaccagaacttgagtctggcgccttagaccactcggccatcctgacctcacagttttttttcacctgatgttgtctaaaccattaattgacagacgagaagtaaaagtttcattccacaaataagtaacacttcaatcggtgtacagaattgcatactgtagaatatactactgtttacactcgagttgcagcattgttgcaaacacataccaaacaaatataacaaggggaaaagggaaacatttatataaccttcaagaatctcaagtcagagctctctaaaaattaatggaacacctttcccaggctcgatggtcagtctgaacgcagggcaatgcacatagtttggagaaagcttgaattcaaacttggacagcaggagtgacagaacaaccttgagctcaaccatggctagattctggccggcacatgtccggaccccaacgccgaagggcatgtacatatgagggggtttgcaggcccctgctatgccgttggcgaacctgtccggatcgaatttgtcggcactaggaccccatactgaaggatcccggtgagccatcgcgatcgggatccagatgttagttcctttcggtatgtcgatgccgccaagtttcatgtcattcagagcttcccgggcgacgaaggaggctggtgggtacaatcggagtgtctcctggatcaccattgtcagctgcacaagtatcaacagcacaccattgttagctgtaatctaatgaacggattgttttcatctcttctgttactggaagaggatgagaggacaaaacatacctttttcaacttccgtagaatgtcaaaatctagtggtctcccttgacaaatgtcaagggattccacccgggcacgggactgccattcatggtgtgaagctagaagcatcaaacaccaagcagccgtggtcgaagttgtctcatgccctgcgaagtagatgtttttgcagttgtcgacgatgaaatcctcgggcgtgcatgaagcaaagggaccatccttagaaccttgaataatggagtgcaggagatccttgtttactgaggtcgatgaatcatgttcatatttctttgatatgtttaaaatgagggtacggatgctactatccagattccagatccctctattgctccttgttggtaaatacctagtcggcccagcacaaaaataaaggaaaatccttaaatgattaaccaattacaataagatgataaaacatgagaagccacttattttcatataattattctcatgcaatggtatggattggaaaatacatgttatgatactcttggatctactgtagtatctcacggattctagataaaatattattttttaggccttatatccatttagaatgatatgtaggaattgcaggtagatcagaccaaaatgggacatgtaagttagcccagacaaaatagaagctgtatatttctccaaaaggttattctgatactgctgcaaaccaaaacagtaacacattatctgaattatagtgatttcagaagttgaatctgggcagctacttgggtattgaaatcattcaaactaagcattatctaaaaaaagagctcaacagaggattttgagcagttcaaagacagcattcttttgagttttaaattgtctcaaattgaaatatgtgccacagtagtacatgtgtagtttctgaaatatacctacttccaggaacaccaatgagcatactttgttttgccattgctttctgaagttgtcgtatttttatgaaaatctccttgccttcactaaagctgcttccaaaacaagcccttgatatgacatcagctgaaaaggttctcaagaactcatcaaccacaatctctgcactgcctcctctgtcctcaacttcatttttccatgagttcaacattgacattgcagcctccatcatcaaattcaccattccctatggatgtcattttaacaataaattgagttttagtatatgctacatgtagtgtactagaaagttgctccaagaaaaatattgttttttgacagagagatccatggcccaatacaagtgcctgcagataattaccttaaccctttccatgaatagttcaggtgcaatcacttttctctggtgtacccatagatcaccatttgatgtcagaattcccataccaagaagagctccacgctctttttgcaagtagcaaggttttccaagatccaaagatttgcagttggctagctccttcaccatgtttggatcagtaacatttaaaacttgtatgcttccagtggaatacaggtagatggaacctaacacaacatcaatgtttcaggaacttatcagctttaattttaaatatgaaatgcacaaggcatccgtcgatgttctaaaaataaatctattaggacatggttacagaacatacaacaaaagaatttacagtaatttaaatagcttatatgtaatgagggtaacaatgagactggtcgacaagatgagacagtatatggtacaccatcagaacgtatatgaaaccatgagctatccataaacaggccccaatcaaagaaattatgtttcgatggttgcagagcgaactaccatccaaaatacaaaggtacctaaaactctctgaattcaagtttgcatcaccccaaaataaaaacaatcctgttatgtgggacaataaaaagagaaattttagagaaaaaataagtcaatatcaaaacattcctcttaacaaaattccaatgaattacatttaacatcgaatataaagatgaattaataaactttattttactgaaactattatgcactacaagtttcttaacgtaccataaaccctgctccagtggaggaagtaagggaaaagagttgccacataatttgatgaaaacatgtcggtactccctgcttcttgttcatgtgctgacttggccaattgctggattctcctcatctctggtatgtttccaaagagaaaagaaggcttgggacccctcactccttggctcctcagtttctgcctcaaccgctctggtcttagccatagaatgatatacacataggagaacagaaggatacagaggatgatcggaggtagaagtgctagccattgctgtgatgagaatagctccatttttgtgtgtacgtatctgggtgtgtgtgtgagagaagagggagactacatgttcatagcatatccatatactgtatactgcatatttgctgggtgatccatctccatgtgaagcttggagctgaaaaggacataaagccgcaaagaagcgcctcactcactctgagcagttagcatgtaacgatcatacaacactgcaaatttacaacatagaaaagaaatccaaggttagtggtaggaaaacttaatttaacatgcatttttttaaggaaaccagggtctgttatgaccaaattattcacatggcataaaaaggaacaatttgggggtttcatatatcttcaacagattatgaggttgggcaataaccttgtagtaaagagctttcaacaaacaataaattaagacttttcggcatgatgttgtatgatagtttagccccattaatttggcaagaaattgcacaagatatagacatatagtagcctagaggctgctagaatatagagagataacatcaattggttgcttgaataaaaaactacgggcctctgctaagagtagaggactcaattcattccccacacaagttattaaaggaagtgttagcctgcactaagaaaataaatgagatgagatgagtgagggcacgcaccgtggcatttcgagctcaacaattgggctctgtgactctgcagctagcagctccatgcgaagaccatgctgatgagttgattgattacaagtatcagcgcgagggcgcggaggatgcaaagaggatgaggaaactgactgattaagaagaatctgcggtccagatagatgcagtctccagaaacagccctgtctgtctacttgctaagttttgtcactttgttagactcccatcaatcaacgcttggacccaaacgtcagtggcaaaccagacaaatgcctttttttttttcatacaaaagggagtgatggcctctcttactttttcaacccaaaagaatggatcgcaacaatgttctccatcataaaaccctttgattgggttcaacgagcttagagtgcttaacaacttcatctcaaaaaaggagctttattataacaagcattgctgtctgtggccagcaattataactggagctgtcatgaatcgactgggtgggtgtgagtaacagggctgctagctcatggcagctttgtcaccatgagtggcaagccgaacccgggttcaatggtcagcctgaacgccggcgagtgacggtacctcggcgacggcgagaaggcgaactttgtcagcagcctggccaacaccaccttcagctccgccattgccaggttctgcccgatgcacgtcctgggcccgtgcccgaacggcacgtacatgtgcgccgccctgcacgccgccgccacgccgttcgcgaaccggtccggccggaactcgtcggcgtcggcgccccaggcttccttgtccaggtgcagcatcagcctgggcacctgcacgatggtgccgcgaggcacctcgatgttgccaagcttcacgtccgtcagggcctcctgcatcatcaccgacgccggcgggtacagccgaagcgtctcctggatcaccatcgtcacctgcatcatttcgacatcgttgtcattcatcatcagtaaacagccattgttaatttctacgatgaacaatgcggtttaagatgttaatttctcacaatctttaaccggcgaagggcgtccacgtccaatgtcgaccttccccggcaaacctccattgcctcagagtgcgtggcgagtagcatcaggcaccagatggcggtgaccgccgtgctctcgtgacctccgaagtagatggtcttacagtttccgacgataaagtcctcagcctctgcagcgctgcgaccatcctgcgcaccatcaatgatggcgttgacaagactgttgtgtgagtcttggtagtggtgttgttcctttgcgacatccaggatcagtaagcggacttgttcatccagcatctgtatttcttggttgctcttggttggcaggtatttcctacaacagcaatatagcatgaaccatctaaattagcatacctgatcacttatagctgtgattgtgacatgtaagtctagtttatgccatgcttgaattataatactttaagcatgtgctgtttgaaaacagtttacggcgaggttttctacctatttgtctctactgaatgacaggacttgttacctactaatctcaaattaataaggagtatacaaaagactatttcttggttaatatcatgatacacacgtgaaggttctcatttcattgcaactaatttcattgacttaccacagtgcagacagaccaacaaacgaatcttgctgagcaattactttttggagctgcctaagcttgcaaaatatttcttctccttttgtgaagctactcccaaagcaagccctggcaattacatctgctgacaagttccgcaagtaatcatcgacaactatttccctacaccctcccacatcgtcaatcatatcctcccatgcttctaacactgtaacagttgcatcctcaatcagctggatcataccctgcatgcatatataaataacaactgcaatcacgcgtgatacgagttctagttttcagtccatgaaacctacaagcaatcacaatttaatggtaccttaatcttatccatgaagaactctggtgcaattatcttcctctgataggcccattcatcaccattctctgtaaataaacctcctccaaagagggccttgcgagatttctttagataattaggcttaccaagctctgatggtgtccaccggcctatatccttcaccatatctgggtgagaaacttgtagtatctccagagctccagttgagtatagaaacactgggcctggtcaaaatacacatgtaaattaacttcattaagaagaactcaacatggacattccctcaaatttgacatgaatatagggaaaatgagatgaaaagcataatctattctaagattgaaatcatttgtcaaacttgcatttttcggagcaaaggaaatgataaatatgattgttattgtattagaattctcactaccaaagtagatcagatcctgcttaatctacaagtagttgggaaatttttagttattcaacacaaaactcgagataacatataaaatgggtgtatgaaaattttaattgatggtcaactactgagtcctttatatgactgtcaagagttgaatggctattatattaagctgtaaaagggtcccacagtctaaataaactattcatcaataattatgatcctgacaaacttgtttaataatactcagtactagcatctgagcttgtttagagtctgaaacagaaacttcgtaggatggtaaatagcatccaaaatggacaaaataaaattacaaaacaaaggattagatatatatttaaaaatgtgtgatggcaccatttcgctgaaaagtgtctgatctgtttatataatttgatatcctactaaaagttgaaaaacagtaaaaagaggagagattaaaaaaattatgattgccctccaactccctactaaatgatcaattcaggcttataaactagattttaatagcaaggatactttgggatcctgcttctccatggtaattcattaattcacttcaacagttgtaggtgactaattttctccaagacatgtcattaataaacttcaggatcctatcatcaatctgatctactcatgagccatgaacatatgagtgcaagagccaatcatggacaaagtcacaacactagcatatgcataccataagtttcccgacagaggagaaagtgtgggaagagggtggagatgaagttgttggtgccttgcttctgtgaaaatttgagttcttgtcggattcttttgatctcctttgtgttgccgtacagaaaagtaggcttgggaccccttatgccttgcctcctcaacttcttccttatcttcacagccctcagccataggatgttgcacaagtagaacagagctaagctaagaagtatgacaagaacaacaatgagtgcaagcaattctccatgaagcatagggaaccagagaagcaaagtatttctgtcaaatcttcagtacattaggtctttcgtgcgctagctttatatatttgtttaacacctcaagcatgtgaattcttttgtttgaccttttcttcaacaactgattgttttgtaggttgctttcacatcttgggatcaacttacaatcagttagaccttccag

SEQ ID NO: 56996 - DNA, 5044 bp, Oryza sativa
ctttgcttgactgagcaaagtagcagaagaaagtaggcatgtgaattcttttaccacccggggcattgtgaatggcttttaccaccacttccgaccggtaactggcagcaactacaacgtttgaaaattttaaaataaaactattctaaagaaacaatcacacaccaccatatagtcattttgttatcagatgtaccaacggaacattctagaacatagaccaccaactctttttggtgtccacatgtacttcagtggcacttggggatctacagtacagttgccttctaccactcctagcgggatttgtaaagcataaaactagagcgaaaccgatgaggcttacaactggagcagcagcaataaaaagccatccactgcgcctgcgtgcactgtttggttgctcatcaacacgaacattgtgttcacttgtattagtctcttcgatcacaccagcagccatctgacgagttacctggacctcttgttcatcagaaatttcttccacaacctgaatgtctcttacattggttgtggcttgcttggacctttcatactctgcatcatctgtaggaagctcatatcggcagacaggacatgtatttctagaactaagccatggcaagatgcacgatgaatgataaagatgcatgcatggtagctgttttgctctagctctggtaggaattgggtctttgcagactggacaaataacatcaccatttgtctgatggcttgcagagataatcacggaggggagattttcaataaaggatgtcgctgctggtggagctcctcttctggaatcgttgtcctcagcaaattgctcaaggagcatctcaaactgccttgcatcaacatagtcatctggattcccgacaaaagttgtcctcatttctggctcttccatgtcatctagcaagttggtcacatttgctctttgacgtacactcacactccaattccatacaccatcttcagattcgtcctcactcaatccacttagctgaatatcatgtgattgctgctggtgctgggtcatggtgttgactatttcatcaaaaccagactcttccacatcttcctggtcatctgaatcccactgatccagtctagcattcatgggatcaatatcagtatctgtgttcatgtagctgtcattgtcaagttgaatggaaatcctcctccttgtcatcacgctatgttcctctatggaggtatctgaatctccaccatagtcaccaagactgatggcagattcaatttcaccaaacacagaatcaacataattaaggccatcgctctcatcatctgaagcatgccatctttgagattggcttggtgttgaattaaacgatgcatgttgcggcgcgaccgacgaagaatcaatatccgtttcacgaccttgtcttcttgctaagtcgatcagctgagaaaactcctgcaagaatgcgtcctccaggaaatcaatgcttgcagtcctggatatctgcctcctccgtgtgttctgccgataagtgctggttatttcatctctttcatcatcattgagtactgtcatcttgcagtccctgcatatggctaaagcttcaaaggtatcggtcacctgagcatccaaagtaaacggccttgtgcaaactaggcactgaacatctggttggctggcaactggatgacagtcgctcgcgtgtgttcgatggtcagacatggatatcctgatgaactgaacagggcacactgaatttggtcagcagttcgctattggacaaagtagacctgcggaacaaaacataaaaaaagaaagaaagaatgtgattagcgccagttctgcagtgaagtagtagcaaaatgcttataggatatatgctcaacaagacgaataccattaccagctagagattgcggagaagaagtgatgagagatcgcagcgcgaaacaacgggacccccgccttgtcaattaagcgctactgcagcagagcagaggaagcatccccctcatttgaatttgaatcaagagaaattgaagagttgaggtatactagtcggggatggcagtagatttgatgggggaggcctaaactagggctggtggtggtgggcaggaggaaccaactgccatatgcagagaccgattgacgacaatcttgagtggaatcaatcagtggagcaacaccaaatatggattttgaggggggtttgaagatggggattattggaggttgaggtaaaggaggtagggagacgaagaagacgacgagagggaaggggaaagggaaagccggctgcctctgccaagtgtggcccaccagtcagtgcacacggtgaatttagagccctcgtaagccaaagctaaatccaaaatttaaatattgccgttaaagttgctaaaacacacacacacacacacacacacacacacacacacacacacacacacacacagatatatatatatatatatatatatatatatatatatatatatatatatatatatatatataaataagttttacttggaggagattcacgaccacacatccgtcacaacgaccctcgacgacaaagcaactattgccccgctaagctccaactcccgccatggcaccttggtgtggcggatggcgagccagcgccagatcggtggttcaatgagttccctcatcacctgtcgtcgccacgcttctattagttcctctctaatcatgaaaacgagagtggccacgacaaggaagatagagcgaaagacgaccgcaacaaggaggatcgctccgacaatggccgtaggagccacgggatggatgtccgcgaaggcgaccgttgcggccgtgataatgagagctgcagcgacctgttgaagcagtacaacaaagaccatccttttatgggctagtgtcacgcccagaaatttagcctaaattttcagactattttgtgtattaaatctctgtccaggaccagccagggtacacaaaatgacaagtaataaacagttccaaacgtaaataaagcgtaaaatacttacaggagaggcacttagtcctcacaccgaaacaaaagcagcggcagcggaaaagacgatcctagcggggcttcagctccactccacaggcaaaactcaactggggtctgagccttggtcctctaacttcgtcttcagctcagaagcactacacttctgaaaagggggaataatagcaagactgagtacaaccaccatactcagcaagccacaccaacgatgcagacgtgcaatgggacacaaggacggtttgtggctatttgcataaaggctgttgtaaaacattttattgagcaaaacaataaaactgttgagtaattaaagtaacattaaatctccactgatcaatgctacaccacgttgaacaggcccaaccaacccacctgaactacagtgcattgagtcgatttattaaggtgggactaatcacggtgaataaccacgggcacggctattcgaatagttttactctgatcagaggtgtacaactgtacccacaagacacagccccacgacacgtttccgtgcgccgacatgccaccacgacataccggaaagaggccgtgacaggacccttcgcataactccctctagccaagcacaccacacctcaggtttcacccccactcctcgcaaggcagcgggcagtcccctctcgtgcctaggtgaatccggaagctgcataggccgtcgcagggcccatccaaactccatcacgcccacccttgcctggatgcgtcagctagaggaaagctacactacaagcccagccgttgcccacgctggcttgtggtaagcacgataaattcttccagggtttcccgcgaaccggtccttaattgccatgggcacgactagcaaaaccatgcacccacagcccaccatgaagtcacattttagttggataattacgacgatgaagcatggccagatgtctcgagcacgcagctcattctgatactaaaaaggtctaatattgtaattatcccatcaactaagctagtggtaattaagaatggctaagcatatagctctagctaggtcacataagtaacatgacctagtcgatttattacccaaggttgacaaaggacatatatcaagtaaatatggcacaagcaagcagataggtaatacccggatcccatgtaattagcaaaacatgcatatttatttgcaaacggtaaaaacatttataaattgggatcaacatgctaaaggggaatgcgtgacttgccttgcgcgaccgcggacttccgaaacgacggattctacacgctggcacgcaaaatgaggaaaaactctaataaaaaccaagaaaacagtacataaaaagtaaacaaacatgtagatctcaattttagatgaattttgcaagttaaatggctcaattcggagttctaatgaattagatatgaattttagaagttttgagccatttaaatgaatttctagaattattaacgaattattgcgcaattattaaatatttttccaaaggaaatgataagcgctgacgtcaacaaggggaagggcgccgacaggtgggccccacatggcagtgactctgggagggcggtccacggcggaccgggtccacagaccggggaggagcggcgcaccacgtggtgcacacgtggcgccgacgcggcgcacacgcagcgaccacgcggcggccacacggcagccgaaccgatggccccgatctacccggtagatcggacggcggcgggagctcgcggccggcgtgcgcgggcacggcgcaaaccggcccggcggccatggcgcacgacggcacggcgcgcatgcggcagcggcgcgagacggcggccggcgacggagagcggcggcgtcgcggcgaagcggcggctacgcggctaagcagcggcgcgacggctaaacggtgcgggagagagagaggaagaggaggagaggcatcaccgcgacgatcgatgacggcgagcgacggaggacgatggcgacggcgggacgagctccggaacctcctaacgaacaaaag

SEQ ID NO: 56997 - DNA, 3421 bp, Oryza sativa
ggaggggtggacgaggtggacctcgaccacacgaacccaacggcggtagcggtgcggtgctgcgacgaacctagcagcggttagaggcggccggagtagtgggagcagcagttagaggcggccgcgtgcacggtgcgggagcgatggagagctcgggagaggccggcggaaaaaggaaaagaggggaggaggatgcggggatggattttataggggcggggaggtcgggaacggccgggagtggcccgatttcgccggccaacgtggggaggtggaggtggagagagaggcgggattcgaatttcgaatcccggccgtctcgggcacaggtgcgggcgagcgggagggagagtgggtgcgggaggtgcggcgcatgcgcgggcgtggccgacgtggcccggaggaggcgggagcatgggcgcggcggcagagtggggcggtttcggtggccatggcggctggccgaaggaggaagaggaagatcacaggtggggtccacgggtcccacttgtcgggaagagagggagagagagacgggagagggaggcaaaatagacttgcgaagggggagcgagctgggccgacggcccgagagggggaaggaggggaaggggagaggggcaagcgggccgagaaggggaaaggagggattgggccgaaaggggcccaaagagaggaaggatgattttaatttgttttctttttatttaattgattcaatgaacttagtgctattaaaattacttcttgagctccgaaaattcgcggaaaaatccggagagtattttaggtaacaaagaatattacaaaatattcttggccaatgatttttaaaggaaaattttaattctcccattatttcacttgattaaattgctttaacttttatttaatttctaaaaaatgcattattaaatgatttttaatcccgaacgaaaatcggggcgttacagctagcagggccgaggctagtggcgacaggtctagctgctgggacgttgccgccgccgtcactacctgtagtgagattaagttggtcggtggcatcataggtgacgtcggcgtctctgtgcgacatccttctatgggggctagccatgggccatcctatggagaacagcaatttgagactggtatctaccctacaacggaagtgttagaattcatatataggctaaggtctatttggagattaattctttgaaaaatcacaaaatcccacctcatggggatatatgcatgaggatatttagtataaccttacctattatatgagatggtgacctccttcaaagggagagtgctctcctagccacttaggttgaggcatgtgtggtggagaggacaagagaaacacacacatgctcgctcgcctggctaggccaggtggcgcgtgtacgcgacgtgagcgtgaatggtccgccataattagtttctcatccttgcgtggatgtatcttttttttactgttttgttttgctgcgaaatttagtgtttgtttttggaaacatagtcttttgaaaacactctgaataatccggtgcatggagctaggcagctagcggcgtggagtccggatatgttacttgcgacttatccggttcggttatatgttatggagatcatgcaggtatcctgattacgtgtcttgttatctttatataaatcgagtcgccatctcctcgcaacacataggcaaaaacaaaatctagggtttttgccgcctcctctgtagtacgttgtcgcttgtagtctgctccgtcctacgagccgagggttatggtgaatatgcgaaacatggatggggataggcatatctattttgcattaaatccaattaattcatattatttgcagttttcacacatatgtgcgccattaagtaggatagcaacgatcatagcacttgctgccattttggtagcagtctaggttcattgtgaacgagaaataaaccgggaggatcgacatatcctgtgacttatcttgtctacttgagaattctcgggtcgtaaatggcaaatagaaagaagagatggaatccaaaacataaaagagagaaagtaaagtgttcattggaaccgcgtgctcgctaagagcaagtataatagtagactataagccggctaaatgctgagatggatgagagaatagaggagagagaggagaagcgagctgtaaacttacagtcggcttggacacaagaaccaagaaactctgtgagagaaaaaagtgggctctatattaattgtaaagagctaactattatatgagtaggataagagaaggctaaaaaaaccttagggcatccacaatatactacaaaagtagtccatagggaataaactattccattcagccatctagtaacattgtgcaactagtccatataaaggaaatagcaaaaggtatccatatgcatatggactacccatatgacataaataatattatatatctctacttctctctcttctcctaatattacattgtatccatatacattgtaaggattgctatagttaaagtttatttatatgggtcccatctatatagaccacttttgtcatatacattggtgatgccctaactagcaggtcggttgtattattagccttgctctaaagacagcaaccctgagaaatggggatagtgtatctttttggcattaaatataatcaatttgtattaattataattaatttgccttatttgtacatttgtacgtacgccattaatatgcgctttttgccatccttgcaggcagcagtcaggttcattgtctagcatatatgcacatcaatcaaattaaatatcgacattaaaaagtctataaaaaggctaggtgatgcacaatcacattcgcacgccctagagttagatagacattttgagatcgattttgctcgcaaaacaggagaaagagaggcatatggtgctcaaatcccgggcacctaggggtttgattttgctggtgttgatgatcacactgcaagcagagtcggaagcaagtcccagctgtgacgatctaatcggcacggccctattaaacacaattagcgatcgctgtttatatgctttcaatccaacaaatcctagttgagatcctgctgtcattgccgcgtgctgcggagcgacacgcaaaggccttgagctgtccaagggaaacagatgcctttgtagcttcgtcagtcaatctcctgctcagggtaaacctactatcggcgaatcgtgccagcttgtcgacatggccaaacagatctgcggaagctaattattaagacacagatgatatacttaatcattgacgcgtgatggccaaacaccagaagctagaggtagtgtttggtgaggggatgggatgggatgggatgggatggaacgaatctacttttatgggtgtttggttgaggagtgagtg

SEQ ID NO: 56998 - DNA, 3095 bp, Oryza sativa
aggtcgagggccggcgccggattcagcgatggggactgtggcggcttgcgaggaggagctcgcgggggaggagcgacggcggtgtgcgaggagaaggtctaggggcggcagcagatctggcgatggtgcgccggcggattcggcgatggggaggtgctgcagcggcttgtgatgaggagctcacgggggaggagcggcggcggcgtgcgaggaggaagtcgaggggcggcggcggatccagcgatggaaggagcggcggcggcttttcctcttgctcttgctcgccgccggcttttcctcttgctcttgctcgccgccggctcatcctcttgctcttcctctggcgatggggaggactgtggtggcagatccggcgatcggttgacggtgattgcaaacggcatccatcccttccctctctcatcccttcaaccaaacaaaaaattaggattgtcccatcttataaaccaaacatgtgagtggaatcatcccaacccaaaaatcagggatggttccatcacatcccacttagtcccgaaaccaaacactacctagaattacctatatactacctccgtttcaaaatatttaacaccgttgactttttagcacatgtttaaccgttcgtctcattaaaaaaattgtgaaatatgtaaaactatatgtgtatataaaagtataattaacaatgaataaaatgatatgaaaagaataaataattacttaaattttttaaataagacaaatggtcaaacatatattaaaaagtcaacgatgtcaaaccattttgaaacgtaggaagtaggaaatctctcttccatcgggtgggcactggtcatattaaatacactggattcttcatgtggctccccgcagactgggctccatgaataatttattctcttacatagcccaatatttacagctcgttgtgaataacggaagaaaggcatacttcttaactaagctcccccccccccccccctaaaaaaaaaacaaggggtgtttcatgtagctggccttacttttttttttttttgctgttttgaaaaccatggctggagtagtcgtgggggttggtggattgcactttaagtttggaagcatggttttgtgctaaaaagcaagttgatttgattagattattgtgatctactaatcttgtatacttccgtcccactaaataaggtgcggtcaaacttgataccttctccaaagctaaatttttactttaaatttcccatgtactaaaatcataaccatataaaagtaaattcaaatgttaacttaatgatattatttttagcaaataaaatttaacggcttacagagaactagtacagaacgcatctaaacatgtattggttatctagtactagatgcttatctacaggtactggtttcatatcatacagctgcttgcaacacttgctcttgctcgttgttgggtctcccaaaagctcttctcagaaacctttcgacaacagagacaaattcttcgggtcgttcctcctgtggcaagtgcccagagttcttgatcacctcaaatcctgcaccaggaatcgcacgtgctacgcgctcggtattccaacgaggaacaaggcgatcagtgtctccactcaccactagcactgcaatggtaaacacacacaaaccatccagaaagtaacatcatttatcagccacatgcaagataattccaaccatttgtccaaaataatgatagttcactggtaaacctgaatgcaaattcaaacatggataacaaatagtttttttttttgcttatttgtatatcattgaaggatcccaaaagtagagtgtatatgaaaacctgggcacgagatctcagaaagcctttctgagacaggcactttcgatgatgatatagaatccatgatcatggatatagtgtactccaaaagagccatctcccaacctctggatcttaatggctgaagaaaagacatagttttcagtctttgcataaggatccgatagttgcagaattttcagagacatataagtcaccttagtgtaaccttgaatgacatgatccgtcactttgcttgggtcataccatgcattgcggacagccaatataccaaacttatccatgatcaatcttacctatgtcaccaaagtccaatcaagaaaagaattcaacctgactattttcaattcataaagaaatgtttgtgaactggaaaagtctgctattcagttagtcagtgagagttgataattcaagtttagctaatttttacttacttttgttgacacatttactaaagtatccattgaagaggctatcagctaaaacactagagattaaaaaaaacttaccagcatcacgccaactgatgatcgaagaacagcaacaacagatttataatacaaagatcgaacaacaccacctattgccctaatcatattcataagaaaccctgcaatccacaagcatagctcgaggaattttccccaaatcctattgagtggatttgtaggcaaatttgaatcattggaatccttcttattctgccattcttgttcacctacaccattctccttcacacctttcctcctgaaaactggcacaaaaatggctggtgcaaccagcacaagtgcagctaccctttctggtgcctcaaagtatgcctccactgccacaaggcaaccagctgagtgcctgaatccaaaccatcacacacatgtaattcatcaagtaatgcacacagattaaagtatagaacaacacatgttgtgttacatccgtacccgacaaggacggccttcttggcaccgagttggtcaatgaatgccaaagttgccatgactgagaaggccatggagtaggggttgataggcttggtgtcatcaccagaccagatggttcgggatgtcagaccaaaggcaggccgatcaaaggctagaaccttggcaccagcaatgcgggctagagggcgcatgatgtgggtccaagagaagaccgacgagccaaacccatgtaatagcactatgggcaaaccaatttggttttggtccgcgtttgtgatggcagagtctggagattggtcactggaatcctcatgggt

SEQ ID NO: 56999 - DNA, 8115 bp, Oryza sativa
aactcggcagaggcgaaggctgggggaggaccattgggacggcgagggcggaggctgtgggagaaggcggtggaatgtagagggtgtggagtcgagggtgggtattggagggagcgtgggagatgcatcggcattgacctgatcaactgcaaggcaggaaactcacattttctggactgaacaattgtgtggggtcccaacggaagaagcaaactgaaaaatcaatctgcatccacacactgcaaatttgaatcgttatcaaacaaaaccatgcccagcttatactccatgaaagtaactagattaacgaagagaaggaggaaaagatgaccaaagcagaaacgaactactcaaaaacatgtcaagtactaaatgaatgagtggctgtgtaaatcctgctagtagcgtagaatgggaaatggaaataattttagtactttgcagaggaagcgtataactagaaagcattatgtatttctctatctttagcaaaacatgtttaaaataagttattcagtcattctatgtagaaacatggatttgatctaatgaactgcaaagacaagaaaactacaagtgtaaccaaatcactacagattaacagtatggttccttttattaaaaaaaaaatccttcagaaaaacagtctgcttcctaaattgtacgctgttgtaatcgttgggcaacaaaatatccagtcttaatctcccttgaaaatatccaatattgaagcaagtaaaacatctgtgagtaagtgagttaatagcatgtgaacaatgcaagagcacagagggaaaaaaaagatgatatcaaagtagaaaagtttggttctagtaaacctaagagagcttgtataagatgtgagacaaccattatctctcgtgcacatacaacagttttgccatatataccatcaaatgaaacaaatgccaactacactcatagctttgaaaaattatgtcttaacagtaccagaccatcactggccggtcccctctaatgagaaatgaatggaaatggtagccagagtgtttggagtttgaccatctgagcaaattccacacggtagtatttttactatagcgattggacctgctaccgtaaaggcgtaaacacataggagtacatagttacgaacaccagctatcagttgggaatgagttgaatcgagtgcagaggagattagtggcaggagtaccttgcagtggggttgcatccaccggaagagcaacggctgcgaggccatggtgggttgctttgcgcctaggctagccgatggaagtcagagcaaaaccacagtattgcagagggagggatagcacggggaacctcctgtcggagctggctaccgtcgaggacgacggcggcggcggcggattgggatttgggagcaaatcaacaatgtggcagcagaactgcagaagcaaacgccaaacacaatcacagcaaggagactgcgtggactggtgggtgggcacgttgcagataaggagacaagacatccaccgagtgggccgtattttcacaaaagcccatccaaggcctggaaaacaatgcatgctagttatgggccagatctgtcggcccggtccacgttattgggttggaaaaagtacatcgaagaaggtccctcaacttgtcatcgagggttggtttgcctaaaaatgcctgataaattttggtaagttttggcatgcctaattttggtgaggtaaagttgtgtttggattgaagccaaaatagcctaagttcaatattgaaatggcctattttcttaggcatgccaaaatttggcttcaaaccgcgggaggcggagatggaggctggcttagcgcgagaggcgcggccggcgggaattcacacaaaagggaaggacttattctcaacgcttggtttcatttctgaataaagaggaggctcgggagagtaactcgtgtcattcagctggattcctggtcggctttgtccaaaattcaaagagagatgtcaagcaagcgccgaatctgagtactcaacttgcccgtagcagccccctccgctaaaatttgtccttttttaatggatttagcggtggtggaagtgaccttggtgtgaggaggaactgtcgatgggtgtggcgcagtcttcggcgcacgaaggctagccggcgagggacgctggtgtaggagtctcacttgtcggcagagctagagtggtggtggagcatcggtgcgttagccatggattcacaggtcgtgagcggcgggtgaaaacctagcccggccttggccgggccgacaacgatggttcattcccccttctgagggtgttgtcgtgctgtctgactcctcaagggcggttgccgggcaaaagcccagtcttggctcctttgagccccgacggacggcggaggcggttttttccgtcgcttctcttcttgaagacgtcgttttggcatcccctagggggcgatctcgtctgtgttcctttgttggtctagtggcggtcggtcacgcttagtggcggtcggtcacgcttagcagcgggcggtccggtgctagccttatcccgggttgtgtgttgacgttgtcggtgtgtgggtggtggtatatttttcctttttcctggttacgaccctacagggttgtaaaccggccaaatgcagccgtctgccacgccctcggctagccgtccgaggccgccatgcctccggtaccaccgcggtcactgccaccgcaaccactactgccgaacgcaccaccgtgcctcctcccaccgtgccacagcagccgctgctgccgtcgtccagccgctgacaccaccgctgcgacgagctccgaggcctctgcctccgcaccgtcagccaccgccgctgccaccacgggtgttgccgttgctgcctcccatagccgcggctgccaccggcaccgccgccgtcgttcattactagccgcccggccggtcaccgccgtccgcaagcctcgcgccgccgtggccgccgtgctgccaccgtcgctcgccccgctgccgccaggcccgtcggcgcgagctagtggtatccaaatcgtccctaaccacaaaaccagatatatatcatccctcaacttacaaaaccgttcactttaggtcctccggtggttttgactccggttttatccgacgtgatggctgagtcggcatggaacccacgtgggccccatttgtcagcctcggcttcctctcccctctcctcttcctctcttccacgggcggtgccgctgtggcggcaaagagcagctgggcacaacaggccgatgtggcgggcgcgcgcggcggggagcgcgagcagcgcggggcgtggcagcggggatgtgggcaacgggtggagctccgtgaggagattcttcgccgcggcgacggagcggtggtgggcgacctcatcggcgccatgacgcgctctacgcgccataccacctcaccggccattccccgccgcccgcatccggcgcgcgaggtagggcttcctgcctccgggccggccgccgcgaggagccctaccccagctctccaagctcgccgccacttcagatgtagagatctgcaggcgcttcattctgcagtatgatatcctctctcggcgcaaagtactcggcattcatctctgaaaccttcactcaaattacaccacagaagatatcaactactcctcacgaacatccaacaagaattggaaagaaataaaaatcacatgatcacattgagatcatgtgattaaaaccaagaacacacgccaagaaaccatcatgtgatgtgacttgtgagtactagagtatactgaaccaagatagaacaccaaagaattgctgttgatcaagaaacagcaagggatcgatcaaagaaagtgactactaacgaatttcctggtgcggctggtgccatggacgacagggttggtcatgttgccgatgatgtaggcggtgaggctgaggttgaagagcatgtaggcggtggtgtagaccatctctccggtgttctcggcgtgcatgtcgccgtagccgacggtggagagggtggtgatgaaccagtacatggaggcgacgtagaactgccgacatcgacttggccacctcctgcgggcgacgaggcggcccaaagtggcgatgaagaggatctacctgcgcgctcgccgctggcttccttgtctcctccctctccatgcactctcgccgccggtcgccgcccttcccactccctccactcttccccttccctgcctccacctccccccaccttgccggcggcgacgacgaccgcatcgacgcgagcacctctttccacatcgcccgtcgccgggcgcctctctcgcctcgccctgccgacctcctccccacccggccacccgccggccgggggccagcccacacagagaggagatgatgagagagagaggaagggagataaagaggggaaagtgagaggaagggaaatgacgctgttagcctgacatgtggggcccacgctaactcagctgccacgctagataaaaccgatgtcaaaaacacggaaggatcaaaagtaagcggttatatctggttttgtggttggaggatgattttgtaactcgatgacaagttgagggacttcagtgtactttttgctattgggttcggtacgtggagtggagccccacctcccgctccagattactgtcatcgctgttgccagcttttaaagcaaaccagcagaagggaggagggcatttcttctctcttgtttttccctttcccctttttatgtttatgcatctgcacccactacttcctcgcatattgcattaccaacattgtggatatttcatatttgattattactatgtattactcctccgttctaaaaaaatattattttttagcttttagaatttattccaaaatataacaatttatgtaccaatattcttttcttaaccgatcataaccatttactattaaatttttttaactacctatacttcttatccaatcacaatatttttagaactcatgatatttatttatgtaataaaaggttttaaaacagaatctatagttacatctcccttaggagtaagaagaagtcctttttaacatgataatcagacctttcacatatattggaaatatcagaagagtcaaaagccatttgattttggcttggaaattgtcgattttgccaaactatccgccagctggttcatttctctggagatccactgaatttgaatgtctcttccccacaaaatgtaactgtacctaatttggtaaataatttaatttatccagaggcgagggtttcatatgcaaaagcatcgatgcagtttgcagggaggaaggtggcgaggcatcagggagattcagagttggttggttgctctcctactccgggtccgggccacgacccgccgccgcgccgccaccatggcctaccgccggaagcagggccccatcgccgccgatgatcgccggagctcctacccccagccgccgcaggcatgcgcccctctcccccctccttgtctctcactcttcagcttgcttctagtactgtagtagtatatcccagttttcaatccctgttgatcggatcaaattagattttttttttgtcgctgccttgattgatcgtgcatcttaatttatttgaggacaagcttgtttagcaaaaggacactgattccccttaaccagtacagtaatcctcctatgtttaactgcagattactactattttactctgggaaaaaaaataaccgcaagattacttgttttgttgtgagataattagaatcaatttcttaggcctatcgatcagatcatcacagttccttaagaaaccaccatgtgctgattcgaccaccttcggctcctcgctggttcgttgatcattttgttccttaatgtacaaactccttaaatcatcccatttgtttatcacctacagataaacaaaacattttgttccaaaaggataaaagaaatcactaactgatgttggtctctaatgatcactttgcaccgtcctttcagatgtctgtgtgtgtctcacaagtcacaaatgatgtatcctaagcatgtcaatttctctgaatagggctcttcttcatcgtacagttacacatcaatcaaaagtatgaacgagcccaagcttgggctatgggaaactttggcaagaaaagccaagggaattcttgatgaggatggcacagcacataagtctgacgagtacacaaaacaaaagacccctcgcaagtttgattcatccactggagctcaggtgaggtggcaagtattagaaaaacaaagcagaataagtaggatatcttgatgttccaagttgtatttatgttcacattgttctcaaaatttgtgatatttattaggaatctcgatctcgctggtcatttgaaaaccacagcaggacaggagatactggatcccggacaaggtcggaagctcttgctgcttctgtcaaccaacttggtggaagaatcagagatgcgttggaagtaatgtcctatttttagcttaattcagctctttatatttagtataactaatggcacaacccatctgattgatttctcaactctacatctctctttgctgttgttctggattttctgggatttccattttctctcgtttagtatcacattggtttcaataacctcttcttctcttctttctttaacaggaaggactcacaattgtggacaataagacatccaatatcattgaggagacaaagaagatacaaattagaaggaagcaagccaattcgaattcttatatgccgaacccagcatttgatacattaagacctcctaatctttcacatgatcaagctgaaactgcagcccaggaaacccaattaaaagcttctcgcgatgtaaggtgccacatgctgggtctagtagtggaagtttaacgtacagaaacttggacctttttaatatggcaaaacctttgctatgcttgtacttaaaaagtattaatacttattttccttttgctaagttcttggttatcagtttttatggttaatatggcttgaaataagacctttttttttcttcccatgtatttggacaaacattttcagattagtgatgcctttctcatatccccccaaaatgtttcaggttgctaatgcaatggctgctaaagcaaaacttgtgctccgtgaactaaaaacagtaaaagctgatctagcttttgcgaagcagcgatgtgctcagctagaagaggagaacaagttcttgcgagaagcaaagcagaaagggagcaaaactgaagaggatgatgacctggtatgttaatgttttccaagcaagcaaccctggaattattttattctcatgataaagttatcagaactacattcttcttgatggtgaatttgtgatgactcatcccaaaactctggctatgaccattgaaaagtgtgaaatttcttctttcccttgcatttctggacaattttgaaaaagatatgcaaattttgcagtacgttgcacaatgtggttggttgatatgaaagcctgatgtattggtgatgaaaatttgaaccactatatcatgtcggataaactattaagcattggtacttgtaaaaccatgtgtggttatagttcttttgtgatggaaaattgacaagtactggaagtgcaagaagtgtgtgcgtggactaacattggtcagattgcgacatctgtgccgagacaacggttgtttggttcatgtgtgtgcagatgatcggagtcgatcttggtcaacggtggatcgggactagactcagggaggggttgaggtccagaacgatcaaggatgccgggtgacaagattagacacaaggttgcacacggtgggcggacaccgtgtgaggaggtcttcgcaacgggcttcgcaaggtcaagtgtgcaagcgccaggattcgcgaaaaaatcggaaggagaaagaactgtgcaagtgcattgctgctacttactgtagctagcatacatgcatgtacacgtactgtacatgtgcaaggaggagcttgcactgtaccggttgctactagcatggctcggtggaaaagtcaagctagctagccatgcatgggctcagttggcaggga

SEQ ID NO: 57000 - DNA, 13900 bp, Oryza sativa
gtcaagacagggagcacgcagattgatttgcatgtgaagctttggatcaacgccgtggcaagcatccaggaggtttccttcggatgtaaggaagaacgaacagccaggattgcatctgagatagggtttgccttaagggcatttgtgacaatgtcttagggggtcttaggctataaatagagaaatggatgcaagggtggaggttgctcttttttaatccttttgagatgctcggtgagagtttcggtgtgagtttggagtgtgtttgcccgagaggcttttgtattaggattagtttggagtgtgtttgtccgagagattttaagtttgtattaatgttcctctgaaggtgtatgtttgctcctagttgagcggttattttgcatcacctatgaatgaaatgatttgaaagatttcgtttttgccttgttcatttaaattccgcaatttaaattccgcttgcaatttgaactttgcgatgatgagttttgctatctcctcctcatctctcttctagtttcgggaattccttttctcttcctcttctagtttcgggaattccttctttcttcttttctagatccggcttctctaatagccggggttctagtaaggattttgagaaatccggcttgatgagtattttcgggggcaagatttgaattactatattcaacccccctatagttgttcttggtctttcagtactttaagctgattattaacttcatagggcaattgcattcttacccctattttggattgtaattgtgattttaccccttctttttagggtttgtgattttgcccttacttttttcaaacgaagtttcaatttgcccttactctgttaagaccaactaacagtgtcaaatgagctgcaagaagacatatatacccttcacatttgctctcaaatttgaccaaacttgacaaattttgatagagcttggatatcacttttacagaagttgcacagggcgcaaaaaattcaccaaggattcatcgcattcacaagaaaaaaatatttaccaaacaaaattctcccaaatatatactatcaactatgagatgggaaaaaaaagaaaatcaggaggcagcatcccttgcattggcctcgtggatgagcttgcttgtcgtgtgtccttgctgctactcctactctgaacgatgttcgcagcaagctacagcattgctgagccaagctaaggcaccccttcccctgctacagcgtcgctgagccaccacctgctcgcgcattgaccgagcagcgccgcctgctccctctctaccgagcagccgctgctcacgctggtgagcgctgccacttgcgccgtcgcagcctgctcgtgagttgctccggtgccgccacctccgtctccgtcgcttgcatccacctgtttggaatgggagaggagaatgggttggatggcttaggtggtggtaactggtaagtgttttttacaggggtacactagtctttctatattttgtaaacattcttttctttaccttatctattttattatcttacaaaatctggacccacctaacgccatctaaagcaggggcaaactgaagcttcatttaaaaaataaaatcacaaaccctaaaaaagaggggcaaaatcacaattgcaacttaaagtaagggcaagaacacgattgtccctaacttcatacttagaagaggttcattgcttgtgtacaacagactttagttattttttacttatcactgttaagtaatgagtacaacatgtcttctgcatatttaaaatacatgcctgaagaacatgctattgaacagattcgtgtgcaactggagaccttattggccgagaaatcaagactggcgcaggaaaattccatgtacgcacgcgaaaatcgtttcttgcgtgagatagtagattttcatcaattcaccacccacgatgttgcccccttggatgatgacatggaagacagtataccaggagaagatagcaatcacacttactcggaagatatgtttccggtagttgaagcatatttagaccgtgaagaactatctcctgtcccctcaaggcctgaatctccaatcctcagctcatgtgagtcatcatcccccaaatccagcaattctaaaagcagtgctgccaatttaccaagctatgtctcaaagccaaatgcattggtacctgacacagattgacgaatgttattcgttgtcctctctgggcctggaattggtttggttgtgactgctgtgcatatattttttgtccattctttatccacatttgtttgcaaatgtaatttaattatagatttttggttttgtgtatggtttgggttctgtctaggtttggtgaaattgaccggtgtgaatacatagataaagtctgcaattctcagtatatggtttgagttctatgttgggttggtgaaacaactgactggtgtgaatagccgaaatgaggaaaattttcaagggtgagtttaccacttgtatatcgagattagtgtatcaagctaatgaaatgcagttttgtcaaattattttcgggaatacgcaaaatgcgtatcttttgtatgcagttttgtcacttcacattgtgcatgaatctagaccctttgaatctatattcttccattctggtgttcgatttcctgttggttatcatatcaagttgcatgatccattattctgtttacaagtacatacatacgcttgctcttgtaattgctgatggctcgaaccaacatttccaaatataaatattgggccaaaaacgagggagtaaaggccacatttacacctgtatgtgcagaagcccatcctgataagcaggagtgcatttgttaccagacagagctgttgataaattatttgccgacattcagcacatccaggggattgatcgatcgagatgagaccactgtagagtatatatgcttgcatttgttaggtgaggaatatcagatccgttgcgagatcaaaccactgtagaatactttccgttggttttccttcagactttcagtacgccatgctaactaaactagttaggcttgccaagaagaacatagtcacctgcttaattccagcttcactacgtacacaaaaggatttagcagtttgtgttagcaagttccttcgcaatgtcggccatcaaaaggatcatcgtgtgctgtgttgcatgggggcgaaaatggtattggaaatttctgaccgatcgaggctcgtctccgatgttctctcgaatgaactattttgaaacgataaccaataaaaataaaaatataagtggtaaacaatacggaaataattttgctattctaccttctgtttccttatttttatcatatttactagccacattagtcacgctttgcgcgactttttacataccgttataaaagctctgtacatataaactgttacataacatacgctgatggtatggagcaaagcagttagaagcttccccatggttaagcagcctaagatcatattagtctaaattttttttactgttcgatgcacgagatgtcatgcttactgaaatatttggtttgcaggagatgccatacttgggtagtgaaataacagggcgattacaaccggtaaagtctctgttcatctccagtttttgtccaatctggtattgttttgtgctgatgaaattcctgtccggttcttcagagtgctgaactgcagtaaaataattaagaaagctagacagataaaagaggaaaatgtctttactgtgacttgtattgatgtctactgctcttctatacaaaaatagcaataccaacattgtaaaagaagtaaatttcaaaaaaaaaacattgtaaaagaagtaccttctctattttgtcatcgtgaatagatatcatgtaggaattgtcaggaaaaataattgagcggcacctatttaatgcccaatgatctgaatgatcaattttgagttagtgaggaaattttggatgattcaatgaaatattattgttagaaatatcaagaaaggatggcatgtaattaatctgccctcgttgtctctgtcacatccgtgctaattcaatgttgagtagtgcagcaagcacgtccatggaggttcagaaaaggttgattaccctattatgtagtttgaaaattgctctactgctctgctgcaaccatcctgcaatttgtatggccaacaattacattggaaacactgacttttaacgtacaatacatggtgaaatggaacctctgcagcttgtagcgcctgaaataaaaaggtgaagtatttagtatttctatcacgaacaacttgaatgaggaattcataacctgcgtgatagctcaggatttccactaacatgcatgtctccgttcacaacatgagttagaaaagaaaattgacaattggactcactgtgatacacaccatgtctttgattttcttaaaagaatatcactttgcccatatccaccaaactccaggaacactttcacatggcttctctgcaaaaacatgcaatctgaggtggatatataagaagtgtaatcagctactccctccgtttcaaaatatttgacgccgttgactttttagcacatgtttgaccgctcgtcttattcaaaaaatttaagtaattattaattcttttcctatcatttgattcattgttaaatatatttttatgtaggcatataattttacatatttcataaaagtttttgaataagacgaacggtaaaacatgtgctaaaaagtcaacggtgtcaaacatttcgaaacggagggagtattaccttggaccaggaccaggtatatacgtacaactgctaccagtgtgttcatgcagtagattgccctgaaaaggattatgcatgagagagaaattatgtaaaccaaattaggtggttaacaccatgattttataagtaataaaccaattgcagaaatactaaaagacaatagcagaagatgcttagtagattcaaactaaaagaccatttatgctctggaagggaaggggcataggaaataaagaataatggcatatcaagcaaagtagcaagctctcctgttaagtataaataatgacatactctcaacatagaggcttcaactatccatgatccaccaaaaaaaaaacccttctcctaatgcactgtatccattggttaattctggatatggcttcagctttgttcaaaagatctacaaatgatagccattactggcaaccatgaattcgctgcttcctaatgaaattatttttaaggtagtgaggccccaatccttgataaaaaaattatatacatcaaatagattgcaatcattttgacccatgctcaagctttgcagagaaactcacgaattacataagtaggggttaacattgtgacactaactcactctgatgtaagaataatcctattaaaaatcaggatgactatatgaaaccaaaattaaaccgcacattttcctatttttcatcgaatttcccttctattgtctacacaaaggttcagacaccttcatccgaaaccgacactaatcaggacaaactcatagtgatattcagaagtagcaagttgcaattgttgatgcttcagctgaacataagcatccatattacaaatccaaatactactacttgatagttcctcaactgtactcaagttacttaatggtaatctacaatcgtctttgtccgctatcggatttgacgcattgttcgtcacaccggcgttttgggccttcttgagccggcttcatcactaccttcctccggtgttgccagctccaagccaccaggagacatcaccatggaggaggagctagagagcggccaggagggaatgaatcgacgtggtggcgttttggatgggaaggactgaaggacataaggaggtgtggctgccgcgcctgccgctggacagaaggaggttttggatgggaggatacgtactgtgcagcagtgcagatggagagggggccagcggtggcgatggagtcttggagaggagtcgatgaggcagcggcggcggcgggcggctccaaggtcgacgatgagtgcgagacggcgcggcgagtgcgagaagacagagcgttatggtgggtgtctcacggtgtgggagggggaagggtgaaaatgaatggctcagttcactttgatgtcattttcaaccatattaaatttagataaagttactaaaaaagtggctacatttagtttgctgccaaattttagtaactatataagaaatcctaccaaaattttggcaagttgcatgtgctaaaattttggcaatgccaaaatttggtaggttgaaaataatatcaaagtgaacaggcccgaaaaacaaaagaggtataaggatgtgtaaggactagaaatagataggagtttcatcaagggtctagaatatactatgccaattagaggatccaacgaccaccaacgtctagagcgagaatcgaacggtccttatttctttgatggcgtggcacattaattttgcaagaaagattagttctttcaatactttagatgtggaaattaccatttctataatacagtaaataccgtatttctaaaaataacatattatctttggtcaatgtctctatttggctcatagtttagaggtccattgactcctcaactaaatctctaatttgagtatatagctaaaggagaaggtttgtaaattacgtaggtgtgaacttgaatttacgtggtcatattatatagtcacaataaattacaaatgtgattttacggtttaatgtttttgacacggtttatgatcaataccagtatgattctgtcattctgcttatgattttctaatattcccatttttttattttgggctctacctttttaatttcatttccgagaaaaatgaaatgattacggaaatggttaaacctattttcctaccattttcacaccccgtatattcactgcttaaaacgtactctgtcttgatcaagttggggaagtaaaagcaattttgaagagcagaatggtttctgacttctcctccttaattttgtggcctaagctagcttgtgtacatcggtacatatttatgactctcagaaagaacaagaggacaatggtccttgccagcatgtatgcatgtgtgaggccggccaagaacatgacaaattttgattgatcaccctggtagctagtagtacccatagattgcacccataagtccacgcattggggatcaaatgtattgcacattgatgattgcaataacaccactatcaaaccttctcctgcatgttctggaccactatggttgtatttacgtacaaattaaggtgctggttgggatagtaatttactgtctaatgtctgaatttatacaggaacactgctatacgtgcgactgcgtcatccgatcggcgtacgacgaaacggctgagcggcacaatacttaacggcgtatgacagaacagcagcagcagcacagctcttgacgtcgtgtaatacacagtcgtacgccggtcggacactcaagtcgtacgtatagcattttcgtttatatagaagaacccatcattcacttgtgaatactgtttttgataaattcatattctccctattgcagatgattttgagctcgttgtcatcctcatatagacatcatttgttaaattaattgcataaataattcttcacgggcgcgaggcaaagtgggaccagctcctttactcaatctgtcattatcaagagcattgttaatgtttagaattagtactttcttgcaataattaggtttcatcaatggcattgacttgtgttttgtaatttaagttgacctcctctgatagtactgtactactccgttcgtccgtaaagtatgatcgatgcacaagacactgtagaggataaactagagtcagcaataaaagtcttcgctgcaaagtctccggaaaaccacctagctagagcggcccattcttgcaattacaatattgtagcactaactattgtttaagctattgcctataagtcttagccaattacttggatttagaattcaaagagtacaaattacctaaaattatttatcgtttgtatcggagctagtgtcttccgcttaattagaagctgtaatggccggacgcttcgattagttaatttgtgcattcgaccagattattggtgtgagcattttgtcacatatggtgtaagtgggttataaagtttttagtcagtgatgagtgcgtgattagtcattgtttctagccaactggattatgaatcatgttccaaaatgagcccaatcatcacttcacgtatataaatgcgcatatccatttggtagcgtctagtgctgtcttcttttgatcccttggatacgaagtgaacaatattattgtttattagtaactattggcggatccatcgtaggggcggtggggtctcgagcccttgctaccgacgttgtaaccatgggtggagagccccgattaaaagctcgcactaattttttttcatacatagagagggctataattttgtatagtttgttcaacacctccaattaaatattcctagatccacctcgcactagacaaagacaaagatgaaaccaaagacacgagcaagatggaaggaagagatgatgacaagttgattgcgtcacatataagacatcatctcatcgccatgataatgcactaatgctagcttcactcttgagcaaaaacaaatcctcaaagtgccaaagaaacaaagaagagcagtgccaatcacacaatcttttccgagtgctgatcaagaaccaaccgcacaagaagatgatgagcttctttgccacgtggaaccacttttattttttttgtttgttttggttttggaaaagcccctgagctcgacagttaacgttggaaaagagattattgttctggttcggtatcattctcactggtcgttggaaaagctcttgctttgctggacgccttgaagttgcaggtgggccctacaggtcagcctctgaggactttttacatcaagcaccctctcaccttgcagaatagggactagggagttgcacaaaagcccctcggaagaatcgaaacgttagaaaagaggacacgtcgccaaaagcgcacacagaccaactgacagcctggacccacaactcagccgtccaggccaggggcaaagcagtaaattctggtgggcggtgtgccaactgtaatcccgtgtcttttacccggaaacacaacataaacatttccatataaccccctcataaaaatgtgcaattcacatagaagccctcaccatcatctccatttctaaagcctctctctctctccattgcttcactctcgccatcaaatccccaaacccctcctccttctctccaagtcctcgtcttggttgtcgcaatcattcgtggggcgcgttaatccctccccaaattctgtggcagccagcttccccgcttgcttggattggatttctccaagattgattcgttccctcccaattcttcacttcctctatccatttccaatccaatcttggttttttgcattgtttcctcccgatttgtcttcctctcgctctccctctcccaccatatcttggactcggtcctatctgtccgtgcctcgcttccatcgccattgctcttttgctgctaaagtcttctctttggagggagagactgggactgggagctagctcgcccttgtgttgttcagggagtaaatgcgcgtccttggtggtgcttggtcccagcattttccgccccaaatctcgtccttgctgccccgacttaagtggtggagattccgtcaccggcggtcgtagatgaggaggaggagatcctcctcctgatctactcttcttcttcttcttcttcttcagctcctggctgctgctgctccactccccctgatccccctgcaggagcatggatttcttggcctgcgtctgcctcctccacctgctcttcttggccacttcccgggtggcggcgcaggcgtcgtcgccggccagggccctggacgcaatgctgcaggaccacgcgtaccgggccttcgtgcacccgcacactggcattgtctacaacgccaccgtcccggccaacctcaccggcgtcgccctgtccgcggtccgccttcgcagcggcagcctgcggaggaaaggtttctccgactacttcgacttcaccgtccccaccggcatcgtcgtgcagccgtacgtcgagagggtggtgctcgtctaccacaatctcggcaattggtctgaccactactacccgctgcccgggtacacatacctctcgccggtgctcgggctgcttctctacgacgcggccaacttgtcggcggtggggttgcaggagctgagctttgtcgcctccgggagcccaatttctataaatttcagtgatgttagatcggtgccggcaggcggtccagctcctcggtgcgtgtggtttgatttggatggtgtgccacaattccgggacttagaggcaagcaatgtgtgctcgacgtaccgccgagggcatttctcgatagtggtgaactctagcgcgattcctcctggtccagtgccttcaggcaacattacaccgccaataccgactcctacaggtcgttctaagggcagctccaaggggtggaagattgctgttggcgtggttgggggcgtcatagcattggtcctgttggcgtcgcttgtggtttgtttggcaaggtacaaaagagataagaaattggaactgatggaacagaatgcagagactggggagacattgcgtatggcacaggttgggaggtcacaagcgcctgtagcactggggacaagaacacaaccggtgattgagagcgagtatgttgcatagatgttttcttgacatttcagcggaattcaggcaacaagggtaaccagttatgctggcaagcatgggattgctcttcggtcggatgaggcaacaagtgttccatatcaatgagtgcggcacaaattgctagatgtagggcatagtcttggctcatgagacttaacacattcttttaacagttttgtttggagggttatttgttctacaatggctcatgttgatgttcataattgccatgttcatagtggggagctcttttcatctccaagcaagcaatggggaagaaatggttgttgtgtcagatttggaatcccttattttttggattgctgtattcaaaaggatataggcttggcaataaaggtgagggaattttattgtgcatttcattttgctacttcagtgaaattcgttcaagcttaagcgatttcgtttttgtgtattttggctcctcatgtttagagaccttgtaaggtacaattgtacatgtttagttgtttaattgatttgataactagtctgataaattagatttcatccttgcttgttttaaccaccagtctgtatgctgtgacaaatttccatcatcttcttcctagttatcttcttctaggtcagacattatggccaatctctaaagaaatattagaagtctaaacacgatacttaccagaattattcttcagaactaatatgatatccttttagttcctgttggcctgagtttctgttgatcatatttctcttttagcagcttgaatttaagcatttgaaacagaaaaataaggttattataagtataatctgatggcaggcgatgaattaaacagagggattgaagaaagctctgttagcaaaatgaataagtccgtatctttttccttggtttaatttcggttggtctacttttgtcaagcgtagaggtgtcattggggatttggatgatcaatgaggaagacaatatgcgttctatctgtataaattagtggcaatatgttacataattcatttgtttcttattgtcctcactgaactatgaaagaggaaaatatactgaactcgattgtagttttgtagctcaaaatgtgtcataaaagcgaagcacatcaaaagagcgcatgtataatctgtcaaatgagttctggataatgctctgaatttttagggggcgtgagctgctctttttgcatcttgaaatttatgttggacatcatgctagcatgaagaatttagctgttgcttgtagattgtcttgtattgatggaatccagttcccaattcaaattaggtgcccacattctctgaaagttcctttttagctgtactgtactgtggtgatattgtagtgtttggcagaagcaacctgtagtagtaaattagtaacacttgctgctttgacaagcatgtgtctagggtaattagctagccctgcacacatgtgagtggcatctttgatagccttacaactgaagggcaggtccagccagatatgccagccagccagctgaaatggatcaaacaaaatgcttagggacctagggaaaacaagtgtgccaagcctcttgtttggctggagaaaccagcagctggctagagagggagtgttttgtgtaatgggagataagaatgtatggctgaactgaactgaatgtataattacttgattgtgctggtagtttttgtgttttgtgtcaggtaatttttgaaggtggtgcgtctcagctaagcagaatcttttgctgtcacacaaactgatcacagctcatagatcatgtggccgcctatttcctcatgattatgcgtgttttctaatgtgactggttgcattcgctttgtaatgctgtactggagtgcttgtttagttaaatcaggtgttggagtatgagctgttgtttttgtgtgttaattaaccactgcagctggtttgacacgttttgttggagcgactgtaaaaccattgggtagcaggatagtggcacagcttcagagctactgtttccatcaagattcaaatagaaaaggcgttaacctgcttctgataatttttgaagagtaaggttaccatatgtactggttggtacttggtaggtagattatatgcatttgataaatcgttgactaacaatggtagtagtagtatgaactgaacctcggattgaagattatgaggttgttaggagattagtcgtgatcagcatgtgtgatgagacaattgttttgaaattagtctatctgaaactattaatgcccaggtattgtacggtttttaatacaaatggagagtgtaggtgaagtggtccacaactagtggcaacaagacagtgaggatcgtggactcggtgtagttgtgcatttaattaacttagttaatgataatgatggagccctagattatcatagttgccatgagcccaattcttttctgcgccgtaagacttgcttcccataatttcctagtgggccgaaactggagtacgtccttttcaattaggaataagttcacttaaggtccctcaatttatcgtcgagttcgaaattcgtctcttgagcataaaaccaggtacaacacatccctcaacttacaaaaccgtgcaaacgagatcctcggtagtattgtgcccagttttagctaacgtggcattgacgtggtgttgatgtggcaatttgatctcagaaaaataattaaaaccgtaggacccacatgtcattctcacacctacctcttctctctacccctgcactgcaactctgcaagaagaaggcggaacagtggcgggccgggcagagggcatcctgtgtgctaacgccgtatctaagaataattgacagtaaaaggaattatttgacggagtaagagagacacattcaatatgtgatttataattttaattttataggcatggcaatttgcgcaaacaagctagaacaaaagttttactagcattccaacagcaaatgggagtttcagaagtaaatgagtaaaaacaaaaatcacacaaccaaatgcagcaagtacagacga

SEQ ID NO: 57001 - DNA, 10383 bp, Oryza sativa
  unsure (1)..(10383): unsure at all n locations
acggggcagaggacgcgggcgacgatgccgctgcagcgacgaagcggagtacgcgaacgacgatgccgtcgcagccgccgccaccgcggcgcgaggcgagggcttcgcggaggcaagcgagagctccctaatgactcctttgctccgccggtgccggccacacgcctcgcggagctcgaggaggaccacgcccgggacgcgctcgaggccgaggcggcgaaggcggttttccagcggcgccgtgctgctggaagaagagagagagggatagagaagatggaggagtgaggatgatatgtggccccaccattttgtatttcttgtgtagatgatatgtcggtctcatagttttaattatttttttcaacatcaaataagtgtcacgtcaatgcacgtggaacgaagacctcgttaaatgagccacgtatacgccacgttagctaaaaccagacacaatactgccgagggacgttatttacacggttttataagttgagggataagttgtacctggttttatgctttcgaactcggcgataaattgagagacctcaagtgaacttattcctttcaattatttagctaggcttataccgttgctaacaggagtagttcaagtcctattttgttatatgtgatttataatatttcgaattttggtgttattaaattttggaggactgctacagtacggaatagcattataatgatacactttaatgaacccttctattttctctacctgcctaagcaactacgtgtaacacaatgaagcagcaacgctcccccttgcttcctcgcttagccacatcaactgcaactctgcaaggaatgagggagacatcgaggagaggaagagaagaagagccaatggcatgtcgatcgctggcagccaaaaggcaacgacatgcatcccttctctcctcaacttggtaccaaatacctgggataccagacctgatacctataggtaccaaatccgatacctagtacctggtagtaggtatcgggtacctaggtactaggtaccagaccttggtatcgagtgtatgatacctgggtagcaggtatcgggtacttaggtaccatgcctgataattgtataggtatcacctatgatattgttaggtatcatgtatgatacttaagtatcatgatatcatcaacgtgatatactagagtatcatgatactattagaatatcactagactatccaaaaggatatccatgtatcaagagagaactcaagaaaaatcaacaaagagctcaataaaaagtcatcataactgtagaaacacccatataacatgtagaaaaccccaaactaaaccttagaaacaagccaatgtaagagctcgagagtcacaagcctaaatctgggtgtacagatccacaccacaagaggccttgtccttgatgacggtgaccttgtcgacgatggccacatcctggaacatggtgagcagcttcaccttcatcatgtgctcaggcacctaccccataaatagcttcacgatcttctctactccgcccacacctacaccagcagcaacggcggcggcgatgacagcagcttcctcaacgcccgacgtgccaccccgcacggccggccgccatcgtcgcctccgtgctcatgagggtagtagtgtgagagagagagtgtgtgtgtgcgcgtgtggagaggaaattaagagaagagataatggagaggataagattgaatcggtggtgtgaaaagagagggctagatatttactaggagaagttatccgatgtctacaggactccgttcccaagtttttctgtaaattttgataagattataagctgtcacatagaatggatttctgaatgtacatctaggcaaaagtaaccaatttcactgtaatatacgtaaattctaggacatatgcacgccaatggatgcaccgattttctcctatacacgcgcggtactgcatgaacgactgcactacatacagaagaataatatataatctcagatcccgagctacacaaaagtacaattaatcacatactactatgcaagagtagatagtgaaagcaagcctttgatccaatttcgaggtcgttaaagcatgcagctcaaatctatactactaactttataccgtgcatgtaaagacgatacacatgaagcttccacgcttcgacctccttttcttgcatagtagagtaatatcaattttgaaggaggggaacaggctagaaatacatcgagatattttttttattttgtcattcttatgaaggtcgaagaatatccggtataaaaagttgagggtgaaaaatatttagttttgtaatttagaggagtaatccgtatcgtcgcaatagttcataaaataatttacacattttcttatcatatactactgaatatgctcttactttcatcgaattttgtgccaacatgtctcaacgtgtccagcccactaacattttactccccactgccatgatcaacttgtgcctgcatgccaaggagacagtcaaccacgcgcaggcatgttacagtagtatatgcagtttgtgatattacatggtgccatatatagaaaagacaacttaaagagccatgaccctcacagagcgctattagtatttgtagcaaatgtaaattgcttttcagaaaggaatttgaaagcatcgatcaatcagcagcaaaaacagctcaaagctttagcacatttgcattttactttgctgtactttccccatttgatctatctcatctctgaaaagaaatttttcacaaagaaagtttggagggagggaaataacacacacggacagagagactgatgatcaagtgaatcataatcactgcttggatcatatgtattctcgatgatcaaataacagggtaagttttgcacgagcgcaacagtagcctggatgcttgcttgatgtgcaaaatctgtaggcagacaagcatgaatgcaaagaatctgtgagaggaaatgatcaatggcacggttcgtgcttctgaccggcaatggagtatgaacaagcagtataggctgctgagtaatcgagtcgggttgtcttgtggctttctcatggtggacctgaccaaacaaagcccgatcaaagctagtagctcttctcctcgatatcctctctgcaaaagcaaaagtaaaagccaaaggaagaaaagttagagctgtccattctctctactctagtacgagtagatcagtggacaaggagccatggcagccaaagcatccgaatcatttccttcaccgacagccttcaaccccactcctctctccactctctagtgcatgctgctacatattgcagtagcatggattttctagagttacatggcacttgaaacattgtgaaatttcacctctaaaacagatacagagcataacatacttgggaaccagtaaaaaatataccataagttagttattaaggagaaaagaaagaataaatgttagaatgtaacacatctaaaatacaaaaaacaagaagcaaaggcactagtagtatggccacatgagatgaagactgaattcttgaagcatccacaagctgacagtagaccagcctttgtcccctagtcagccaactgttcctccatcagtgtcactttctcagctaatccaacacacagaccctctttgctaatttacaccttgaaagatgcaattcttcctatctgcagacatgcagtcatgcagctgagtggcctgtagaagaaagggaaagcagagacagccagacaggggggcctattggcaaatttggcaaatgtgcaatgtgcaagaagaaaagtagacgaaagaattaaagaatggatttttggaagaatgtctgtcattgaattgaattattagtatcttaatgatttgtttaaaatattactagtatcttaatgatggcaggccacacatccgttattcttttgtttcgtcctcactcatcgccgctccgccattgcccagagcttttcttttctacacaaagggaagggaaagaagaagcaggagggtttggtatctgaggctgagcaatggggctggccagcgacagccctgcgtcgttccccttctccgccgccaagctcgccgcctcgccgcgcttctgcaaccccatcagcaggaggtaacttgtaccaatgctgttcctttcccttccatttctgagctcgggtgtggttttgccgcggtttattcttttgcacaaaatgcaatggcgagtgcatgctggtgttcctatagtttgctagttttggcaaaaacttgtcctttgtcagttcagatcagttgcaactagtttttgttcattttgctgcgcaagtttggattgttcatgttacatttctctgggactctgaaagaagcagagaaaggcatagaccctgctggctgctgcagtgcaggtgcaggtgcaggtgcagccactccatgaggagaggagattggagagggtcacttgccttgtgtaatggtggtaggagaatctcagccccgccacgccggaggtgttcgagctcggccaagtggggtcggagtttaattctccgaatcccttgaaaaataacagggggttggagtcgaattctccgaacccctgaaatactggaatcgggaggtgggggtcggagttcatttctccgaacccgctgaaatactggtttctcgcaaatgctaccttcagagttcagattatcagatgacatctgaagttatcccctgtattactgaagaaagcagtggcaagccttaaaaatgttcatcggaatatcggatggtcccgggcatcacaaaacgtctgcacttttttttttatctcgtcccgtcacttgtctagattcaggtccctacctcagcattctcttttcttatgctgcatctggttctcaacctctgaacaagtcaatgaaggttttttcccccccttctctgtctctctttcctaaaagaaaatgcagtcaattttgggagaaaaaaattgcaaacgttagcaatttaactcaaaggatctacttcttatgtgatttgtttggacgaaatgtttgattgatttgtgaattgtgattggaacctacattggtagtatgtcttagtggactgaaataatctgcaccagctatttgatttctgtagcagttaccatggctttgttccattcctctgtaaaaagggatgtgatcaattcttatgtgttcccagaagagtgtagcaaaactaccatgagaagcatatcaaacttgatattcacatgctgcaaatgcaaatgcagttcttggtgtctaaaacttcaagaatgttccttgttgtgcaggatattttctgatgttgctggagatttaacagtatcggtggatggccaatcttttctactacataaggtgccttatctatttcaatagcttcatcttacccattctctgtagcctgtcatttttcctgttgcatttttttttatcattagtcatcaactactgcacaagcctgccaagtatattttggggggttattgctcagttgggcagttggattgtctttgcaggaagattaattacctgacaatgttataagtggagtaggacttccatattaatttgcttaacatgagaaccaatgtgattgaagtgaacaccttattacaatttggggacataaaaatcataatgtatatccttactgatgtgataattatacaagcatataattttttgtactgtaggttagtgttcaatattcacaatttcttaaatgtagcgctctgcaaaaggcatatatctttcttagtgggggtcgacagggatttctgatcatataggctgaaggtgttagtcaatataagagtgtgtaattggagacaaagcagtaattggttaacgggaaaatcagggttaaggttgtatatgttcttttgtacattagtaatgctttttgagctttcatatggagtttttttttttttggtgaaaaggagctttcataggaaggtattagcaaggaaaatgtatttcatatttatctctgcataactaatataagattatatagtctgaagtaaagttgcaaaatgggatcatagtatacttctgtaccaattttgcagttccctctagtctctaggtgtggaagaatacgaagaatggtagctgaatccaaggatccagatctctcaaagttggagctagtaaatgtaccagggggagctttagcatttgaacttgctgccaagttctgttatgggagtaattttgaaattaatactgtcaatgtggctcatctccggtgcattgcagagtatttggaaatgacagaagagtaccaagaggagaatctcattgttcggacggagacatacttgaatgagattgtagtcaagaaccttgataaatccctagaagtcctatgtgcttgtgatggattggatccaacagtggaagacgttggacttgtagacatgtgcgtcgatgcaattgcgatgaatgcaagcaaggagcagctggtttcaggcttggctcatttggaatgtgatgtcggatcaggaaagttgcgcatgcattgtcaagattggtgggttgaggatctttctgcactaagaattgactattatcagcgtgttatcgtcgcaatgagaagaactggggtgaggccagagagtattggcacatccattgtgcactatgctcaaacagctctgaagggtatcgaaaggcgccatgtatgggactcaggtcctcttgttggagacaaccaacgagtgattgtggagacgctcattgatctgttggcaacagaaaagatcacatcggttaccttgtcattcttgtttggcatgctgagaatggcaatagaagttgatgcaggactagattataggattgaagttgagaaaaggattggacttcagcttgagatggcatcacttgatgatcttctgatccctgcaacgcagacgagtgactcgatgtttgatgtcgacactgtccatcgcatattggtgaacttcttgcaaaggatagaggaagatgattcagggaacttatcaccttgcggatatgagtctgatgatggactaaagtctccgagccacagctcggttctgaaggttggaagactgatggatggttaccttgcagaaatagcaccagatccatatctgaaactgcagaagttcatggctctcatcgaactcttaccggactatgcgagaattgttgatgacggactctaccgtgccattgacatatacctgaaggtaagctaactgtactgcaaaccttgataactctttctgattatgtccaatggcaaattcagtaactgccactctgtcagcattacaacattattcaatgttgatgaaaatgtggcacgaatactttcaattctggatgtaatctttagaaccatttgcaatctgtatagtgtccgatgatgtatagcttgctgtgtgtggtgacaaaaaactgaattgtgataacaaacaggctcatccatctctgacggagtcggagtgcaagaagatgtgcaagctgatcgactgccagaagctgtcgcaggacgcgtcgagccacgcggcgcagaacgaccgcctccccatccagacggtggtgcgcgtcctctacttcgagcagctccgcctcaagtccacggtgtcgtcaactaccccccacaccacctccctcggcggcgacggctgcggcgggtcgctgtcgcagcggatgatgatgaccggcggcagcggggtggcgagctcgtgcgtgtcgccgcagcgggacaactacgcgtgtctgcggcgggagaaccgggagctgaagctggagatcgcgcggatgcgggtgcggctgacggagctggagcgggagcagggggtgatgaggcaggggatgcgggatggccgtggcggcggggagcacggccgggcgctgctggcgtcgatctcgcgagggatcgggaggatcgccatgctcggggtgggggcgcagggcggagcggagaggaggaggaagacgaagacgaagaagagctctcactcgcagtctcagtggtcgtcggatggtggcgggaagacgatgatgatgagcagcaggcggaggcacaaggcgtcatctgtcacctacgctgctgcctcctgaatcatcatcaaactgcatgcttgctcttgttactgcatgaatgcattttacaaggaaaagatgggcagggaaaatgtaaaattctacagctaggtgaagagattaaagtgttaacactcctttattagataagctaatctagttctattgtacaagtagtaacattttcattttgggtgtggctttttcttggtcattgcggcctcctgcgctaatggaaggaggcaaattttgcaaaagaacactacaaatccaaatcatgaatattttgcagagcacctctttagactaattttttaaattaaaattttaaacttaatcagagaagtagatttgaaaccgatttaaagacattatacattattgtcgttcaaatttaagattgatttggttggggtgcgccaggcccgggctgtagtgcaacgcctgggcgacacgcgagggccccagtggcaagccactgtggtggaccctcccccacaaaaaataaatttaatatcaaagtggacacatggcccacatatcagatattaaactgataagaacagatactacacttgatcttagccaaaaggccgagaaaggtatgagttgaaacggagccctccggctccttttatagctctcgcgaccgcctctcccagctgaatagccgaggtggtactaaactctctcccagcaaaaacaaagcagcaacatgcgctcctgcgatttccaatcgccgtggccgtgggcctaaatccttcccagagcccaagtagtagagcagccggcttgttatttgttgtttctctgacatgtggggtcatactatttgcaccataggccaacgtcggacacgattcgagttgcttcttctttatcttcgatctcgtacgtgcaggcaacgtacaccaggcaatggacgaattgaacgaaattgaattagatcttgttcgtaagctaggattaaaaaccaaatttcattgtgcaaagttgaatgaaaagcaaaacaagattctttgacatgaacatgatgcagcttagatcatcagtgcaagcaaacagcatctttcaactttcgtttaaaggagaaagctccagcatctcttcaactttctcattctctgtatacctgaattcgttcgtagatgtccgtatcttttggacttatcccgatggatcacaggatacccgtccccaccatttcctcacgtgtcctcgttcaactggtgtacggaattttgtgggacccaaaccatatcctccgacgtggcaagtcccaagccacgtccacttttcttattcccactaatttcttggaagagtactgcattgatcgtttgcgtggacggagatgagcctagcaccactatcaatgactattatcaacagtggatcagagttgcaatattgcaaactgtagctttgtgaatgtatttatccgtgcaagaactattcattccattccatggttcagaagttcagatcaccttgtcttgatcaacaccaagtctgatgctgatggcacgtactagtgaacatgatctgtttagtttgacggacaaagttgccatcatcaagatggaagctagcgaagagtagtgagcagaagttcagaatagttgcaggaaaatggaaactgaactgaagaagcgaccaacttataacggctacatgcaagtagcggacgatacacgacatcacattgctgaccagaaacgcctctgcagccatgcaattttggctgctatactattacttggaggcatacctgccattgtactccactcgttattattacaaaaagttaagagtttagtacaaacagtgtaatgagatggaatctctataaatccgatcaaggaggatcagatattcagatcgcaggaaatcgtatctgcctgcttttcgagagcttaacaagggagggagagctccttaattgccacgtcccggccttgctcttgatgcaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57002 - DNA, 6500 bp, Oryza sativa
catagagaaaagaacaaaaaaccaaaaaggaatcctaggggttaatccatttctgttaggtgaatgggaaaatacgaattaagagccttaggtcgatttagttcggggaaaggggaaggggaagaaaattctatgaacctttccgtttttccttaagttcaagtttgacgagagtaatattctacaactaacaactcatttattttgagaccgacccacttcctatccaggattttttttactagtcctttatattgcaatgtgtcaatcgtcaaatgctttggcaatttccccgggtcggatgaagcaatagaattttgaaccagacgttttgatctttggttatccttcgtagtaataatatctcggggtttgcaacgaaaacttggtatatcgactatacgaccattaactaaaatatgtctatggttaactaattgccgggcctcgggaatggttgaagccaaagattgcgatccttgggctctagattcatagtaagtgtaatacacaaacagccgacccagacagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaaaattcagatgttgatgaaattccatttttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagaaattccattctgggaaaaaagaacaatatcgtattcgtcttcaagaaaaacagaaattgcgttttcattatggtctgacagaacgacaattacttagatatgtacatatcgctggaaaagcaaaaagttcaacaggtcaggttttactacaattacttgaaatgcgtttggataatatcctttttcgattaggtatggcttcaaccattcccgaggcccggcaattagttaaccatagacatattttagttaatggtcgtatagtcgatataccaagttttcgttgcaaaccccgagatattattactacgaaggataaccaaagatcaaaacgtctggttcaaaattctattgcttcatccgacccggggaaattgccaaagcatttgacgattgacacattgcaatataaaggactagtaaaaaaaatcctggataggaagtgggtcggtctcaaaataaatgagttgttagttgtagaatattactctcgtcaaacttgaacttaaggaaaaacggaaaggttcatagaattttcttccccttcccctttccccgaactaaatcgacctaaggctcttaattcgtattttcccattcacctaacagaaatggattaaccctaggattcctttttgttttttgttctttcctctatgtgtattttacataccatagtaatttggtatagagaatttctattaaataaaggtattgtattattgctggaataaattgtcatttgatttgatacattgtaatcattaacgttgctgaattaagaaaaacggaaagagagggattcgaaccctcggtaaacaaaagtctacatagcagttccaatgctacgccttgaaccgctcggccatctctcctccataatcttattatggaaaaaaaactgagtgaatagcgagttttcctattcctgcagtacaggtacaaccacaaccgcgcgagagttccattgttctattagatagaaaaattccttttcatctaagtggacgggtccaggatttttttactaggaattccgctccctcgaaaagttttagtttgggttttccccaaaccaaagaaaaagagaatggaagaattcttcttattcgataaaaaaggaaccctagaattctgtttgcataaggtatcctaccccatacaatcaaatagaaaatagggtatgggacgattaatgactttgaaaatgcgaaatagttgatgagagaagttgttgttgagaaaagaaataggaaagtggaatgaaatccaatcttagtcaaatattttctatctcttcttgttcaaacagaaggaaaaagagagaatttgggctgagcagaaatacctctcttatccatttggagcatagggatcgatttataagaattgaatggatttgttttttttttatgttattttgtgaaggaatgaaaagaattctatatagaatgatagaatgggttgggaattatgcctagatcccgtataaatggaaatttcattgataagaccttctcaattgtagccaatattttattgcgaataattccgacaacctccggggaaaaaagggcatttacttattatagagatggtgcgatttgactcttttttttgtttttttagccctacctacaccccggttttacgagaaagagtgggggttcgcggagagaaaaccaaattagtaagggaaacccacgcttagggaaggtgaggtgaactaacaactccttctgtcgtgtatcctcgactgacgcggcctcggatgcttcaattgtagattttagtattgagcgaaaggttacacctacaggataggttctgtattacaggctaatcctactctactagtactaataggtagcataggggataaaagcactacacctagaaataggaatcaacaagagaaaaactttgttagaaattaaccctttcctgattggtatcagggctgggaagaatggttgggataacaaacaaccatcaagtttgtactttggatacccctataaccatcaaagatcgttgaagtggctaattcctctaaataggaggcgttgagaacaaagaaattcttggagctatcgttttcctctagcattaatagaattcattggtgttaagaaaaacctcttgtgggaaggttggctagagatttcttggaaaaataccagcccctttcggtccataatgagatggaactaattctatttttattctctagattttttcgcttagtactatgtacagaagggaggagccgtatgaggtgaaaacctcatgtacggttttggaacggagattttttgaatagaacgaacgaccgtaacggatgttggctcaatccgaaggaaattatgcggaagctttgcaaaattattatgaagctacgcgactagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacgtgcgactatctccactatagaaagaaaaataagaaaggatcaaattttctagtatttactagaaaagggggctttctacatagggatcgtcaaaacaacgattttgccctatcagctgtaggaagaaaggacacttcacgagaatcaaaataggaagaaagaaagtatggcctatactactctatggatagagttctcaaattgatagagaaagcaccgtaaagatcaattagtgaccgactgggtcgatacaactaaaaaaaactgcttacttatcccatgatatggggcaaaatttaggaatccgcttatgtaatagagccgatccactaagggattaagcagcggtgtagtatcagatcccaaagatagtaagttcttttttcttgcttatggggaaaaagtctttttcaaggattctatagaaatttcatatatgaaaccgagatagttacctttcagaaaattcggacgaaggatataggtctatctatgcttcatttttctgcaggtgggagaaaagatcaaactgattattgatcaaaatttagggtttgaaacttaggtaattaacttcttctgcgtaacccaagaagaaattggatcgatttttgagaaatcgaattcagttaagacaagggaaattaagatagcaatttctgagccgtatgaggtaggaaactctcaagtacggttctaggggaaggaactacctattccgaccggggagaacaggccattctacagggtgattcagaaattgcagaagcttggtttgatcaagctgctgagtattggaaacaagctatagcgcttactccgggaaattatattgaagcacagaactggttgaagattacgaagcgctttgaatttgaataagaccactctcctttttcagaaaatgggggtttggttgttgatccattaatcaaataaattaggtcggaagatcgaatcaagaatttcattatatctctttcctctgccttctattttatattatatttcataaggataaacgatagggtctagaatagaagtaataaagcgaataaaaaggggcaatataaatattgctaatatatcaggaccatcttattaataattctaatgagttatcttggaatttggaatcgaataaaaaaatctatattatgctcaaggaaagtagatatagatagggacttatactcttaaaaaaaatagactagctttttaaattaaaaaaaggtttttttgttacgtggagaaatccaagataaaaaaagtccgttaggcacccaatccttatgtcataatagatccgaacacttgcctcagattgacttcaatatataattgctccagtgaataactaaaaaaaaatagaaggacggtagatagtaaagaaaaggactaatcataatatctatctttcaaaggttcactaaaaagttggcgggtctctttgtatgtcttgtccggaaagaggaggacttaatgatgattcgttcgccggaaccagaagtaaaaattgttgtggatagggatcctgtaaaaacatcttttgaggaatgggccagacccggccatttctcaagaacaatagctaagggccctgatactaccacttggatctggaacctacatgctgatgctcacgatttcgatagtcatacaggtgatttggaggagatctctcgaaaagtctttagtgctcatttcggtcaactctccattatctttctttggttgagtggcatgtacttccatggtgcccgtttttccaattatgaagcatggctaagtgatcctactcacattggacccagtgctcaggtagtttggccaatcgtagggcaagaaatattgaatggtgatgtaggcgggggtttccgaggaatccaaataacctccgggttttttcagatttggcgagcatccggaataactagtgaattacaactctattgtaccgcaatcggtgcattgatttttgcatcgttaatgctttttgctgggtggttccattatcacaaagccgctcccaaattagcctggttccaagacgtagaatccatgttgaatcatcacttagcagggttattaggacttgggtctctttcttgggcggggcaccaaatccatgtatctttaccgattaaccaatttcttgacgctggggttgatcctaaggagataccacttcctcatgaatttatcttgaatcgcgaccttttggctcaactttatcctagttttgccgaaggagcaaccccttttttcaccttgaattggtccaaatacgcagaatttcttagttttcgcggagggctagatccaataaccggcggtctatggttgagcgatattgcgcaccatcatttagctattgctattcttttcctgatcgcaggtcatatgtataggaccaactggggtattggtcatggcctgaaagatattttggaggctcataaaggcccatttacaggacagggccataaaggtctctatgaaatcctaacaacgtcatggcatgctcaattatctcttaacctagctatgctaggctctacaaccattgttgtagctcatcatatgtactctatgcccccctatccatacctagctactgactatggtacacaactttccttgttcacacaccacatgtggattggcggatttctaatagttggtgctgctgcacatgcagccctttttgtgggaagagactatgatccaacgactcgatacaacgatcta

SEQ ID NO: 57003 - DNA, 3876 bp, Oryza sativa
atatttctaggttttcacagttttggtttatacattcataatgataccatgagtgctttaggtcgtccccaagatatgttttcggataccgccatacaattacaaccgatctttgctcaatgggtacaaaatctccatgctggcgcgcctagcgtaacagctcctggtgcaacaacaagtaccagcttaacgtggggaggtggcgagttagtagcagtaggcggcaaagttgctttgttacctattccattaggaaccgcagattttttagtccatcacattcacgcatttacaatccatgtgactgtattaatacttttgaaaggtgttttatttgctcgcagttcccgtttgatacccgataaagcaaatcttggttttcgcttcccttgcgatgggcctgggcgagggggaacatgtcaagtatccgcctgggatcatgttttcttaggtctattctggatgtacaattccatttcggtagtcattttccatttcagttggaaaatgcagtcggatgtttggggtactataagtgatcaaggggtggtaactcatatcacagggggaaactttgcacagagttccattacgattaatgggtggctccgagatttcttgtgggcacaggcatcccaagtaattcagtcttatggttcttcattatccgcatatggtctttttttcttaggtgctcattttgtctgggccttcagtttaatgtttttattcagcggccgtggttattggcaagaactgattgaatctatcgtttgggctcataacaaattaaaagttgctcctgctactcagcctagagccttgagcattatacaaggacgtgctgtaggagtaacccattaccttctgggtggaattgccacaacatgggcattcttcttagcgagaattattgcagtaggatagtggctaggaggatttgaaaggcattatggaattaagatttcccaggtttagccaaggcttagctcaggaccccactactcgtcgtatttggtttggtattgctaccgcacatgatttcgaaagtcatgatgatattactgaggaacgtctttatcagaacatttttgcttctcactttgggcaattagcaataatctttctatggacgtccggaaatctgtttcatgtcgcttggcaaggaaattttgaatcatggatacaggatcctttacacgtaagacctattgctcatgcgatttgggatcctcattttggtcaacccgctgtggaagcctttactcgaggaggcgccgccggtccagtgaatatcgcctattctggggtttatcagtggtggtatacaattggattacggaccaatgaagatctttatacaggagctctttttctattatttctttctaccctatccttaatagggggttggttacatctacaacccaaatggaaaccaagcctttcgtggttcaaaaacgcggaatctcgtctcaatcatcatttgtcaggacttttcggggtaagttctttggcttggacaggacatttagttcatgtcgctattccagcatccaggggagagtacgttcgatggaataatttcttagatgtattaccctatccacaggggttgggaccccttctgacgggtcagtggaatctttatgcccaaaaccccgattcgagtaatcatttatttggtaccactcaaggagcgggaactgctattctaactcttcttgggggattccatccacaaacacaaagtttgtggctgaccgatattgctcatcatcatttagctattgcatttatttttctcattgccggtcatatgtatcgaactaacttcggaattgggcacagtatcaaagatcttttagaagcacatactcctccggggggtcgattagggcgtgggcataagggcctttacgacacaatcaataattcgattcattttcaattaggtcttgctctagcttctttaggggttattacttccttagtagctcaacatatgtactctttaccttcttatgcattcatagcacaagactttactactcaagcagctttatatactcatcaccaatacattgcagggttcatcatgacaggggcttttgctcatggagctattttttttcattagagatttcaatccggaacagaatgaggataatgtattggcaagaatgttagaccataaagaagctatcatatctcatttaagttgggctagtctcttcctaggattccataccttgggcctttatgttcataatgacgtcatgcttgcttttggtactccagaaaagcaaatcttgatcgaacctatatttgctcaatggatacaatcggctcatggtaagacgacatatgggttcgatatactcttatcttcaacgagcggtcccgctttcaatgcgggtcgaaccctatggttacccggatggttgaatgctgttaacgagaatagtaattcgcttttcttaacaataggacctggagatttcttggttcatcatgctattgctttaggtttgcatacaactacattgattttagtaaagggtgctttagatgcacgcggttccaaattaatgccggataaaaaagattttggatatagttttccttgcgacggccctggtcgcggcggtacttgtgatatttctgcttgggacgcgttttatttggcagttttctggatgttaaataccattggatgggttactttttattggcattggaaacacatcacattatggcagggcaacgtttcacaatttaatgaatcctccacttatttgatgggatggttaagagattacctatggttaaactcttcacaacttatcaatggatataatccttttgggatgaatagtttatcggtatgggcgtggatgttcttatttggacatcttgtttgggcgactggatttatgttcttaatttcctggcgtggatattggcaggaattaattgagactttagcatgggctcatgaacggacacctttggctaatttaattcgctggagagataagcccgtggctctttccattgtgcaagcaagattggtgggattagctcacttttccgtgggttatatattcacttatgccgctttcttgattgcctcaacatcaggcaagtttggttaatttagttaattttgttgtactgtatcagcacctagttcattactcttgatggagggggaggatccgccttcttagatttctttttctatttatttttccatctaggattagaaccgtatacttggtagatagtaggaacggcacattatggcaaaaaaaagtttgattcagagagagaggaagcggcagaaattagaacagaaatatcatttgattcgtcgatcttcaaaaaaaaagataagaagcaaagtttaccctttgagtttgagtgaaaaaacgaaaatgcgagaaaaattgcaatccctgccacgtaatagtgcaccgacacgccttcatcgacgttgttttttgaccggaagacctagagctaactatcgagactttgggctatccggacacatacttcgagaaatggtttatgcatgtttgttaccgggtgcaacaagatccagttggtaaggataaaataccctttcgtatttgtatggatttctggaattgatgatcgtagaagagccctctttaccattctgtataaatggactattctatttgtatagatatggtagaggggcgtattcaaccccccttttatccactagttcccctctctttagtttaacaggatagaacagtttggtagctgacaaggctcataaccgtggggttgcgggttcgattcccactacccgctccatattccttctttatgatatat

SEQ ID NO: 57004 - DNA, 2095 bp, Oryza sativa
tccagattgagtctcaactattggtaaagcagtcatacttccttcccctaaaagagaatttaatttagcggctctttctaaaaggcgtgaatgcaaataaaaaacatcccctgggtaagcttcgcggccggggggtcttcttaatagaagggacatttggcgataagcttgtgcctgtttggagagatcatcataaattattaaagtatgccgttcgcggtacataaaatactcagccagggctgctcccgtataaggagcgaggtattgtaatgtagcaggggaatccgccatttcagctactacaatagtgtattccatggccccctcttcatggaaagtagttactacttgagctacggaggatgctctttgaccgatagctacataaacacatattacatcttgccctttttgattgagaattgtatctgtagctactgctgttttgccggtttgtctgtccccaataattaactctcgctgaccgcgcccaataggaatcatcgaatcgatagcaataagccccgtttgaaggggttcatatacagaacgcctggaaattatacccggagcaggagattcaattaagcgagattccgaagctacaatttcgcctctcccatcaataggtttagccagagcatttataacacgacccaagtaagcctcgctcacgggtatctgagcaattcttcctgttgcttttacaaaactgccctcttgtatcatcaacccatcgcccattaatacaatcccaacatttttggattccaaattcagagcaatacccctagtcccttctgcaaattcgactaattcgcctgacattatttcaccaagacctataatacgagcaatcccatcccccacttgaactacgcgaccgatattctcaatccctacttttctattatattgttcaatacgttcgcggagaattttatgaatttcgtcgactcgaagggttgccattagtgtttctttactatttttttttcggaagcaaggggaaaaataatgcctaaattctaaaggaaagtagaagttcaaggcctaattaatttaactcttccattccatggccccgagaatgctaatattagcacgaatcgtacggaaatgtaactcggtattcaaacaactattcagagttcctagagctccttgtacggcttgttggaaaacccgttgtcggacctgattcatcgccctttgtttttcaaaataaagggtttcgtttttagacttttctaattgttccaaactaatagaagtggcattaatcaaatttgctttttctcgttctatctcagagtatccattcattcgatactcatccgcttctagttcgactttctgtaatcgaattcgagctttttcgagctgctcaatggttcctctacgcaattcttccgaatttcgaatagtactcaagatcctctgttttcgattatctaataaatcttttaatgaaagtagattaccttgctattaagtttacaacttttatgatctcttcccgaaccaaacatgaatctttcgattcatttggctctcacgctcccttttttctttttttgctatggctacttccatattttttttaatgtaatgagcctatcctctaccctctcttttctgtttatatttcaatataccgaaacccatataagactagataaatattaagaggactcttccgcctagataaaaatctatcgtgggcagcaaagttgtttttttatttgtatttgccctttagttaaaattttcaatttcattaagaaaaactaaatagaaaaatggaaaatgaaaatggatagaattcctacttttttcttcaaatccaaaaactttctccttttttatacataggtcgtcgattcggcattggataaaaaagggcagggtgccccttctagtaaatagttcaaaccattttatcgatatgagtgttctatatcagataaattctacattagctatttcctgtttaaagcatttggtactaatactaatatagttgtagaaagagtacccccttttgcctagacttcaagcagtttagctttaaccgtgttaatggtctcat

SEQ ID NO: 57005 - DNA, 5140 bp, Oryza sativa
  unsure (1)..(5140): unsure at all n locations
atcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtnnnnnnnnnnnnnnnnnnnnnnnnnnnnnnnnnnnnnnnnnnnnnnnnnnnnnnnctgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattctttcttagctaaacgggtggaagatccatccaatttggttatatcatggactcaaaaaacggatctgaatgtgactgaaatgcacgatcttcacaggtatcacttttcacgatacctaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattggaaagttacggaaggagatccatcattttgcaatgaaaactacataaaaaactctggacaatttcgaaatcaggccaagcgtcttaatacatatgcaaaaaaattcattattggcccaccattgattagaagatttaacttgtatgaatcgctattggtttgatacgaataatggcagttgtttcagtatgttaaggatacagatgtatccacaattcatttagagttacttaatagcctatttcttataccatatctctatcccgtgaaattctcgagccgaaagatggatgcatatgctatgtttcattttgctaaatgatatcaattaaacggtgtatcaattccataaattggatatagcaataaataaatcagcaaaattcttttattttagatagaagaaacttttcttctatctaaaataaaagaatgtacccttctatctaaatccaatttgcatcgataaaataaatccaaattccagtagtagatgaataattgcaaatttttgtgtgtacgagattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaagatttttcatcggaaagaggtctccgaagacttttgggaaaacgtcaacgtttgctggcttatttggcaaagaaaaatagagtacgttataagaaattaatcagtcagttgatttgattgggatattcttgatcggtttggtcggatatgtagaaatctttttcattatcacagtggatcttcaaaaaagaagactttgtatcgactaaagtatatacttcgactttcatgcgctagaactttagctcgtaaacataaaagcacggtacgagcttttatgcaatggttgggttcggtatttttagaagaattttttacggaagaagagcaagttttttctttgatgttcgccaaaacaacttacttttctttccgtggatcgcacagtgagcgtatttggtatttggatattctccgtatcaatgatctggtgaatcctcttaattaatcattaaacaaaactaataaactagaaatgattgataaatgatcaagggaaaactttcacagtttccattctgaaatgttctctgtactataataaatagtaagtgaatcaacttactactaaaaaaattagtagacttcctcttcggaatagaaatagcctatttctacatagggaaagtcgtgtgcaatgaaaaatgcaagcacgatttggggagaggttttttctctattgtaacaaggaataattatctactccatccgactagttccgggttcgagtcccgggcaacccatatggaaactagaaaggagcaatctgagttttgatttttcactcacttcatttacaaaattttttggtttggtaaattttgttgtatggatatacaactgtcggggctggcttggttgacattggtatatagtctatattatactgttaaataacaagccttctattatctttctagttaatacgtgtgcttgggagtccttgcaatttgaataaaccaagatcttaccatgactgcaattttagagagacgcgaaagtacaagcctgtggggtcgcttctgcaactggataactagcaccgaaaaccgtctttacatcggatggttcggtgttttgatgatccctaccttattgaccgcaacttctgtatttattatcgccttcatcgctgcccctccagtagatattgatggtattcgtgagcctgtttctggttctttactttacggaaacaatattatctctggtgccattattcctacttctgcggcgatcggattgcacttttacccaatttgggaagctgcatctgttgatgagtggttatacaatggtggtccttatgagctaattgttctacacttcttacttggtgtagcttgttatatgggtcgtgagtgggaactgagtttccgtctgggtatgcgtccttggattgctgttgcatattcagctcctgttgcagctgctactgctgttttcttgatttaccctattggtcaaggaagtttctctgatggtatgcctttaggaatatctggtactttcaactttatgattgtattccaggcagagcataacatccttatgcatccatttcacatgttaggtgtagctggtgtattcggcggttccctattcagtgctatgcatggttccttggtaacctctagtttgatcagggaaaccactgaaaacgaatctgctaatgagggttacagatttggtcaagaggaagagacttataatattgtggccgctcatggttattttggccgattaatcttccaatatgctagttttaacaactctcgttctttacacttcttcttggctgcttggcctgtagtagggatttggttcactgctttaggtattagtactatggctttcaatctaaacggattcaatttcaaccaatctgtagttgatagccaaggtcgcgttattaatacttgggctgatatcatcaaccgtgctaatcttggtatggaagtaatgcacgaacgtaatgctcacaacttccctctagacctagctgctcttgaagttccatctcttaatggataaggcttttctgctaacatatagcaatttttgaagaaaggaaagctagaaatacccaatatcttgcttcagcaagatattgggtatttctttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcc

SEQ ID NO: 57006 - DNA, 1395 bp, Oryza sativa
  unsure (1)..(1395): unsure at all n locations
tccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggaagaggaggtaggatgggcagttggtcagatctagtatggatcgtacatggacgctagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagacnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaccgtgaaaacggggttgtgggagagcaatacaagcgttgtgctgctaggcgaagcggttgagtgccgcaccctagatggctaaagtccagttgccgaaagcatcactagcttacgctctgacccgagtagcat

SEQ ID NO: 57007 - DNA, 21762 bp, Oryza sativa
tcttagcatgatattggggaatctccttgctattactcaaacaagcatgaaacgtatgcttgcatattcgtccatagggcaaatcggatatgtaattattgaaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaatgggaatgggcgctagggtaatgaacttataatcatggaatcgactcgatcatcagattataagttcattccataccggaccagaccgtgcacattcttattatgagaaggggtcattcgagcctatggaaataggatactctgtttacatagaaatccccacgtccttacattctatttaggattaggaataggtgtaatcagacctgcttttgacatatctatcctatccttatttgggtaccatatgcacctctttcggcttctattgaatcgagaaattggattgtacatctttttgattttgatacatataaggtgtcctacggataatgcaaatcgaagctatttgatgtctgactcaggcctatatgaccgatcgatcgaaatactccaagactccacctttgtcatatattccatatatcacattagatagatatcatattcatggaatacgattcactttcaagatatcacattagatagatatcatattcatggaatatgattcactttcaagatgccttgatggtgaaatggtagacacgcgagactcaaaatctcgtgctaaagagcgtggaggttcgagtcctcttcaaggcataatacggagaatgcgcattcaatgagcattccccgtagaagtattccggaaatctgcgcctggcgctctcctctatcttctgaggtccttaaccacttccctgagaaaaggagacagtaaaagccaaaatagactaaatatagcctgaacgatcctaaaaatccctcgaaggagataatataataaagaacccaaagcagacggtatcctactgcaagggtggtcttaagaatccaaaagaggttgctcagaagagatagatgtatcccaacctctattgctctcgcgtaaagccttttttttacgcgacaggaaaaagtgactacgaattcccctttttgtttgcgaatccctgtttgtatcctttgagcgcacgcccataagtagcgatcaaggaaatcgatcaaacgatcccaataccgtgaaagagaaacttcccagatccagggaagcttatcataaagggcttcgacaaggggttttattcgttctttgagcaaaaagataaagatcggatagattcgaaccgcaattgcaaaggtaatcactactatgccagcccaaatcatgatcttcaccaacttggatttggttctctcgcgaaaatcgcgagttgcagagatgagaaccatgaaaagcaagatcccgaataagaaaacagaaaccgaggaaaccacaagagtgaagactagtagagtctcgtcttttgtcattctttgctcctttttcactcaatgattcattcgaatttcccgaccaaaaattctatatgtctattcatagggcctcgttgctaagtgctacaagatctagtgcactggaactcgtggttatggacccgaatcctttagtatggaacattgtcttttccaagtaaaaacccccagtttattgaaagaatgaaaaggtgctttcgttcttttcttgtggaataagaagccctcgtaccttaatgaaaggaaaataggaatttttcattaggtatttgaccaaataggatcgtccagttcctatagaacctatcactaaaatacccgatagggctaagcggaacgaaaaggattttccctgagatggtaaatgaaaacgattagccccatacgaggtttgggaataagtgatgagcaaggaatatacgtctttctgctaaagaggatctattaaactcataattcattagatccttgttatcaatgtcaactaggtatcataagtaaacggatcccggttgttcaatcctttgataaccaaggtcattctttgctaaagagaaatgatcactatgagtcagactcaatagaattggatccattccaaatagcgagaattaggattctggatccctctcaatctctctttcaattcgaggatccagagaggtgttttcatagtcatctccgaatatttgccatctccgaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacgcgaaccggaacgttccataagtctattggaactggctctctatccatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaaaagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggccctattctaggacatacaatgcattacagacgtatgatcattacccttcaaccgggttattctattccacttctagatagagaaaaaaactaaaggagaatacttaataatacggcgaaacatttatacaaaacacctatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcagtggtaattaagacccccgggggaaaatagggatgtctcctacgttacccataatatgtagaagtatcgacgtaatttcatagagtcattcgatctgaatgctacatgaagaacataagccagatgacggaacgcggagacctaggatgtagaagatcataacatgagcgattcggcagatttggattcctttcctatatatccactcatgtggtacttcatcatacgattcatataagatccatctgtctagagatcgtcatatacatctagaaagccgtatgctttggaagaagcttgtacagtttgggaaggggttttttgagagaaaagaagaatctacttcaaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgggatgggcgaacgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaaaaagaaataggtaagcggggaataaccttatttatgacaagtttcaaactggtaaagtatacccctaggataaagaagaagaagagtgggctaaggaaactcgcaagaaaagtaccaaccgatcgtctacttaagttcgaacgggttttcaaagcacaaaaacgcatccacatgtccgttttcaaagtacaaagagttctggatgagattcgttggcgttactacgaagaaactgttatgatattgaacctcatgccttatcgagcatcttatcccatcttaaagttggtttattcggcagcagcaaatgctactcattatagggatttcgacaaagcaaatttattcatcactaaagccgaagtcagtaggagtactattatgaataaattcagacctcgggctcgaggacgtagttctcccataaaaaaaaccatgtgtcatataacaattgtactaaatatagtaaagaaatcaaaataatctttagatccatctaagatttgattcccggtaaaaaaaatagaatagaaaaatatgggacaaaaaataaatccacttggtttcagacttggtacaacccaaaatcaccattccttttggttcgcacaaccaaaaaattattctgaaggtctacaggaagataaaaaaatacggaattgtatcaagaactatatacaaaagaataggaaaaagggctcgaatagaaaaatagaagcagactcaagtttcgaagtaattacacataataaaaaaatggactcaggctcaagttccgaagtaattacacatatagaaattcaaaaagaaatcgatacaatccacgtcataatccatattggattccccaatttattaaagaaaaaaggagcaatcgaagaattagagaaagatctacaaaaagaagttaattctgtaaaccagagacttaatattgggatcgaaaaagtgaaagaaccttatagacaacctaacattcttgcagaatatatagctttccaattaaaaaatagagtttcattccgaaaggcaatgaaaaaagccattgaattaactaaaaaaacagatataaagggagtaaaagtaaaaattgcaggccgtctcgcgggaaaagaaattgcgcgtgccgaatgcatcaaaaaaggtagacttcccctccaaacaattcgcgctaaaattgattattgctgctatccaattcgaactatctatggagtattaggagttaaaatttggatattcgtagacgaagaataaccaaccctgtcttcccattctgttcagtaatagaataaaaaatgacaagagccttattttccctaaaatccctgaaaaaaagaagaaattctacctctttctataagatttaatgaaaattgagaaatcttttaataaaattgctatgcttagtgtgtgactcgttagtttttttttagggttcaaaaaggggattaaaaaaaaatagaatgaaccctactatgtaattatagaaaatgaactaataaccaacctattgcttcgtattgtcgagatcctaactaagaaacagtcactatatgaataaatacatctatcataaatgagtaaatctatcatatacgtgtagcaactgcaattttttctttaaaaaaaaataggattctaagttgtgaagcaaaactaaaggggatgtagataaaaggaaggatgatagaaagaaggaagagaaataagaaagatataggattccaatatgtatggtctatgaattacatcataaaaagcaatgtgataaagcatcaatataataaaaataacagagaattcgaagtcgtaatttgattgaaacaagaaatacaaatttcaaggaataacaaagagcgtcccgagttaataaaactgagaaattgactcggaaagaaattttttggaagctccattgcgagattcaaacctaaccattaaaggagaagcagtgggaacgacagaacctatgactggataggattttcttgaaaagaatcccaatacttcattgggtgggatggcggaacaaaccaaaaaaattgtcttatttgatatggttatgaattaacaaataagacaggaaagagtaaatattcgcccgcgaaatttttattgaattagaatactttaccgcgattcaataagagtaaaataaaaaaaggagattaaaaaaaaaaaaaaagaattacattaaatatagaatatagataaataaacatacacatctagatatattctagatcctctttcttgactatatattttagtattttaataaattcaatattaaaaaccctaacctttcctattaatgtgtatctatccgtaatattttagaatattgtggaattagagaaatttgcacactttctcatttgattcgcgaggagctggatgagaagaaactctcatgtccagttttgcagtagagatggaactaagagagaaccatcgactataaccccaaaagaaccagatttcgtaaacaacatagaggaagaatgaagggaaaatcctaccgaggcaattgtatttgttttggtagatatgctcttcaagcacttgaacccacttggattacggcgaggcagatagaagcaggacgaagagcaatgacacgatatgcacgtcgtggtggaaaaatctgggtacgtatatttcccgacaaaccggttacaataagaccgaccgaaacacgtatgggttcgggaaagggatcccccgaatattgggtagccgttgttaaaccaggtcgaatactttatgaaatgggcggagtatccgaaactgtagctagagtagctatttccatagctgccagcaaaatgcccatacgaagtcaatttcttcggttagaaatataacccccccatacgaagtcaatttcttcggttagaaatataacccccccaaaaaaagtagtattgaaaataaaaaaccaggttcttctttctggaaagacaatatttctttcatccttttgcattgaaataacaaattgaaatcaaaataatatgattcaacctcagacccttttaaatgtagcagataacagtggagctcgaaaattgatgtgtattcgagtcataggagctgctagtaatcagcgatatgctcgtattggtgatgttattgttgctgtaatcaaagacgcagtgccccaaatgcctctagaaagatccgaagtaattcgagctgtaattgtacgtacatgtaaagagttcaaatgcgaagacggtataataatacgctatgacgacaatgcagcggttatcattgatcaaaaaggaaatccaaaaggaactcgcgtttttggcgcgatcgccgaggaattgagagaattgaattttactaaaatagtttcattagctcctgaagtattataaatactagtagacaagatatagatcaaataaaaaattagtagattgtgtttcacgtatatgctttagaatccaaaacgaaaagaaaaaagagaacatgttgattatagaaaaattaggaggaacctagaattagagtcttatgggcaaggacactattgctgatttactaacctctataagaaacgcggacatgaataaaaaaggaactgttcgggtagtatctacaaatattaccgaaaacattgttaaaatacttctacgagagggttttattgaaagtgttcggaaacatcaggaaagtaacagatatttcttggtttcaactttgcgacatcaaaagagaaagactagaaagggaatatatagaactagaacctttttaaagcgtatcagccgacctggcttacgaatttatgccaactatcaaggaattcctaaggttttgggcggaatgggaattgctattctttctacttctcgaggtataatgacagatcgagaagctcgactaaacagaattgggggagaagtcttatgttatatatggtaatcgccccgcctatagcggtaatcgccccacctatagtacccaaattctatcttgaacttcctatttttcaaacaaaaatacaacgtttttttattttcaaataaaaaaagaaaaataggagaaaaaaaatatgacagaaaagaaaaataggagagaaaaaaaaaacccgagagaagcaaaaattactttcgagggtttagttatggaagccctacccaacggaatgttccgcgttcgcctagagaatgacaccatcatcctgggctatatttcaggaaagatccggtctagttctatacgaatactgatgggggatagggtcaaaattgaagtaagtcgttatgattcaagcaaggggcgtataatttatagacttccccataaggattcgaagcgtaccgaagactcgaaggataccgaagatttgaaggataccaaagattcaaagggttaggtttttctttttttttctagggtaaaaaattcaaagttctaaaattcaaacaaagagacttattttttccaaaagagtaaattcatagtttaagaaaggaatacggaaatatgaaaataagagcttctgttcgtaaaatttgtacaaaatgtcgactgattcgtaggcgtggacgaattagagtcatttgttccaatccgaagcataaacaaagacaggggtaatctttcgaaaaaagaacttgactttctaaaaagtaaaaaaaaagtacccgcgaaaatgtccaaattccaaataaaaaaattcaagtaaaggatatattttaccctgaaacggatatctttgtatcttttttctttttgttatttctaactcatatttatgagataataaaatatgacaaaagctataccaaaaattggttcacgtaggaaagtacgtattggtttgcgtaggaatgcgcgttttagtttacggaagagtgcacgtagaataacaaaaggagttattcatgttcaagctagtttcaacaatactattataactgttacagatccgcaaggtcgggtggttttctggtcctccgcgggtacttgtggattcaaaagctcaagaaaagcatcaccctatgctggtcaaagaacagctgtagatgctattcgtacagtgggtttgcaacgagcagaagttatggtaaagggtgctggtagtggaagagatgccgcattacgagccattgctaaaagtggtgtacgattaagttgtatacgcgatgtaacacctatgccgcataatgggtgtcgacctcctaaaaaaagacgtctgtaaaagaattaaacccctttcaagagaaataaacgattcaatgatcaaataataatactagtctatatggttcgagaggaggtagcaggatccactcaaacactacagtggaagtgtgttgaatcaagagtagatagtaagcgtctttattatggtcgtttcattctgtccccgcttagaaaaggtcaagcggataccgttggtattgccttgcgaagagctttacttggagaaacagaaggaacatgtatcacacatgcaaaatttgggagcgtgccgcacgaatattctacaatagcaggtattgaagaatcggtacaagaaattttactaaatttgaaagaaattgtattgagaagtaatctctatggagttagaaccgcatcaatttgcgtcaaaggtcctagatacataactgcccaagatattatcttaccgccttccgtagaaatcgttgatacggcacaacctatagctaacttgacagaacccacggatttccgtattgagttacggatcaagagagatcgcggatatcacacggaagtcagaaagaacactcaagatggaagttatcctatagatgctgtatccatgcctgttcgaaatgtgaattatagtatttttgcttgtgggaatggaaatgcaaaatatgagatactttttctagaaatatggaccaatggaagtttaacccctaaggaagcgctttatgaggcttctcgtaatttgattgatttatttcttccttttcttcacacggaggaagagggtactcgtttccaagaaaataaaaacaggtttacttccccccttttaagctttcaaaaaagattaactaatctaaagaaaaacaaaaaaagaattccattgaattgtatttttattgatcaattagaactgccttctagaacgtataattgtctcaaaagggccaatatccatacactattggaccttttgagtaagacggaagaagatctgatgagaattgacagttttcgtatgcaagatggaaaacagatatgggacactctagagaagcatctcccaatggatttacctaagaataagttctagttttaaatccattgcaattttttcctcttcttctttttcgagttagaataaaaagaaaaaagaaaacaattttgcatctttgggacaatctatattttcgcgaaatggatcataataaaatagattataggtatctagggaagattcacttggaagtaactatttcctagatacctatgcacggtacttcacgattgaatgaatcaaactgaaaaatccctaaaaaagacctaaagttaaggatttttcaatgggtaatgttgctccaatacctaaccaaagagctactgcagtaccgattaaaaaaacggttgtagctactgggcgacgaaatggattttggaatttattgacattctctagaaaaggtactgtcaataagcccgtcggcacagaaaccattaagagaacgcccaataacttattaggtactgtacggagtatttgaaacacgggaaagaagtaccactcgggtaatatttccagaggagttgcaaacggatccgccggttcaccaatcattgacggctcgagaaccgctaaacctacattacatgcaatagtacctagaattactactggaaaaatatataaaagatcgttgggccacgcgggttccccgtaataattatgtcccatccctttagctaattttgctcttaatacaggatcgtttaagtcaggtttctttgttattgggataggtgaattctttaagatccagcccccaaaggaaccggacatgagaatttttcatcatccggctcgagcaagaatgaaagaaataaaaccgtagaagatccataatagaataaggtatataatggctcaatggctctaagtaagaaaagctttatcagattctattttccgaagttgcacctacaactattcattgaaaagaatcctactcttatgggtaaatgctcaatatccaagtgggcttacaaatttgatcatgatcaattgctttgtggattgtctcgcgtctcttgattagttggtatttatcccccccaatattgcaagtttcttacgtccaaacaaagtatttacttgttactaataaaaaatcaaaaagtttagcctacgttcttccttagatcccttcttttactccgatagtattgcagatcgcaatcgatgcaaagaaaatgaatgcatttccatactataataaaaagtaagtgtaataaatagagaattggatcatgtcacatgacttattccatttctactctatgggatcttacggagcctcttcatggatgacatggttgaggtatgatcatagaaaatattctcctcaagtgaaccagcctatccttactagacaggggacttacgtgttgattggatatggagacacctttggtcgtgaattctaatgtggcagatccaactctctatctgcatggccaaatcaataattcaagtcgcacactcccataatccgccttcttttctttcgtaaaattaacttcaactatttgtattatttgtatcacaatagttcggagttgaagagaagtatctaaatgacatgtcttattttagaataacccatgtttgtagcaatgaaataccacaacctacccgatatgatatatgagaattagaactctctatgagatgccttccttataaagggcccgaaataccttgcttacgtatcattagaaagtgcattaacataaatacggcagtaagcagaggaagtacaaaggtatgtaaactataaaaacgagtcaaagtggattgacccacactagcacttccacgtaataactccactaaaggtgatcctattaccggaatcgcgtcaggcacacctgtcacaattttgactgcccaataaccaatttgatcccaaggtaaagaataaccagttacaccaaacgatgcagttaatacagctaaaaccacaccagtgacccaagttaattcgcggggttttttaaacccacctgtgagatacacacgaaatacgtgcaggatcatcattagaaccatcatacttgctgaccatcgatgaactgatcggattaaccaaccaaagttggcctcggtcattatgtattgaaccgaggaaaaagcctctgtaacggttgggcgatagtaaaaagtcatagcaaaaccggtagcaacttgtactagaaaacaagtaagtgtaattccccctaaacaataaaatatgttgacatgaggaggaacatatttactagttatatcatctgcaattgcctgaatctcaagacgttcctcaaaccaatcatatactttattgagataggtaactaacccgaacccccctccgagaaccgtatatgagaatttcatctcgtacggctcaaacagaaacacacaaattttcaacggatattagaaaaaaggttcaaaacttcatcagccattgggttgggtcgatttgccttgaagatatgaaataagaaaaatccagaatttcttctttgtgatgataatgccaaaaaatctcaagttggctcgtctatctttctttcccaaatgttgatcattagaggcctcttgatttttctcttccctattttggatttcttttttttgtgcgtaatgcagatttactcttgttttactagataaataaataaagcaaaaattggagtagttttctggtagaaattatcttgttgcgatcctatgaatcagttcaattaaaaccttagatttatactagagccacgatgattgagtctcaagctaaacaaaaggcaagggttcttcgaataagaaccgcttgatgatcatttattgaatcggtgtaatgactcgacaaaatcgagagaaaaaaagttgttttttgggcaaacaaaattggaaggaagaaattttctttttttatttttattaagaactacttgaatttttttcagtctggttgcgaggtctgaatagttaatatgaatcatagtttcattttttttcttgatccactctatctatttcgtgttccagatactagaataaataatatccgacgaattagaatcatcttgatagagataacaggtgctttctatgtattatcaataggagcaaattctaacaagtcacacactcatattccagagataccgaaaccaaaaaattccacggtcgaactaccagaatgtctagaaatgtagagcttaaagtagaaaggctcttttggatggaaaaactatgacttcgtagttttcgttagtagaaacctaattcattaaaattccgtccagtaaaacggaagaattataaatttctaaaataatagataggaataccgcgaataaagccattgcgacccccataaaaggagtagtcccccaacccggagctactttcccatattccgaattcaagggtttcaataaattacctacgcgagtttgtcttggtccaggtctagaactatcttcaacggtttgtgtagccataaattccatttaatgatttgtgttgactttgtatactattccgttgtagttgtaaatacacgatcttttcgtagatccattgtaatcttgaaattctataaaaatggaaacagcaactttagtcgccatctccatatctggtttacttgtaagctttactgggtatgccttatataccgcgtttgggcaaccctctcaacaattaagagatccattcgaagaacacggggactaattgaagtaagaagtctcccagatggggagacttcttacttcaattaaattatttcacttttttagtcggaaccttaggtggttctcggaagaagatagcgaaaaaaattatccctaaagtcgaaactaaaaggaacgtataaaccaatgcttgaaatattataagggaaattcttcaactaattcggaaatagttgtaggtgggaacatgctatacatgtatcataaatttttacggaatgtgacattggatctataaattttccttttcaacataaaaattttctcatagcttagttagagcggtggaaatgattaggtcattgatagtggaaatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaagtcatcagttcgagcctgattatccctaaacccaatgtgagttttttctattttgacttactccccccgccacgatcgaacgggaatggataagaggcttgtgggattgacgtgatagggtagggttggctatactgctggtggcgaactccaggctaataatctgaagcgcatggatacaagttatccttggaaggaaagacaattccgaatccgctttgtctacgaataaggaagctataagtaatgcaactatgaatctcatgg

SEQ ID NO: 57008 - DNA, 1577 bp, Oryza sativa
  unsure (1)..(1577): unsure at all n locations
ttcagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccccgtgtggtgtggcggcatggggatgtcaaaaggaaagggatggagtttttctcgcttttggcgtagcaggcctccctttgggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaa

SEQ ID NO: 57009 - DNA, 12676 bp, Oryza sativa
  unsure (1)..(12676): unsure at all n locations
aaaagaactgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgtcggttattagaagcatcccaaaagcgtccgggtcgaaatatggctttcaaattaagttccgaattagtagatgctgccaaagggggtgggggttacgcaaagagccaatttatttaaacccatattctatcatatgaatgaaatatagttcgaaaaaagggaataaacaagtttgcttaagacttatttattatggaatttccatcctcaacagaggactcgagatgatcaatccaatcctgaaatgataagagaagaattgactcttctccaacaaataaactatcaacctcccgtttaattaatttaattaatatattagattagcaatctatttttccataccatttttccgtaacaaaactaattaactattaactagttaaactattgcaatgaaaagaaagttttttggtagttatagaattctcgtatttcttcgactcgaataccaaaagaaagaaaaaaatgaagtaaaaaaaacgcatttcctgtaaagtaaaattaaggtctttgcttttacttattttttcttttacctaaaagaagcaactccaaatcaaaattgaatccattctatctaacgagcagttcttatcttatctttaccgggatggatcatctggatatttaaaaaatcgcggatcgagatcgttttcgcttaaccaaagaaagaaaaagaagaaggaaccttttttactaataaaatactataaaaaaaatttatctctatcataaatctatctctaccataaaggaataggtctcgttttttatacaatgttctacgtcaagtttaaaattttttcatgaaaaaaagattttcaatttgactggacttgacactggattatgttttctgagacagaaaatgaacgcattaggactgcatcgaatctaagagtttataagagaaaaaaattctctttaataaactttatgtctcgtgcagaatacaatacgatttcatctttcgtttcatcataaaaaatctgggacggannnnnnnnnnnnnnnnnnnnnnnnnnnnnnnnnnnnnnnnnnnnnnnnnnnnncacgccccatttcgggttttatgcgacactaataaacagtattatgtttatttcttattcgtcaatcctacttcaattacataaaaatggggggtattctcttggtaggattctagacatgcgaataatatagaatccaaaaaatgcattgatcattacatggaattctattaagatattatatgaaagtcgaatttcttccactctcatttgagagtgcgaatacaaggaggtattttgtgtttgggaaagtccgaagaaaaaaggattttgaatcctccttttcctttttcccttagaaaaataactcaatcaaaatccaattatctactctacaagaacgaaacgcttgttatgcctaatatacttagtttaacctgtatttgttttaattctgttatttatccgactagttttttcttcgccaaattgcccgaagcttatgccattttcaacccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccttcgattctaaaattcaaattcttctacattgaatgtatagctgcagcaataaatttggatcagcctttctactccctgcatctacgttgagcaggtatctttaggtaaccgcacaatacctaacctaatttattgataagagtgcttattataaatcaattcttgcaatttttttcaaaaattgatttttgcatttttaggtgtcaaaataaacaaaacccatcctagtggatttgtgtggtaaggaaaaacgggtaatctattccttaaaaaaaaatcttggagattatgtaatgcttactctcaaactttttgtttatacagtagtgatattctttgtttccctctttatctttggattcttatctaatgatccaggacgtaatcctgggcgtgacgagtaaaaatccaaaattttttcttacaaattggatttgtttcatacatttatctacgagaaaatccgggggtcagaattccttccaattcgaaagtcccaaacgatccgagggggcggaaagagagggattcgaaccctcggtacaaaaaaattgtacaacggattagcaatccgccgctttagtccactcagccatctctccccgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaaatcgtccacagataatctatcgtatgccttggaagtgatataaggtgctcggaaatggttgaagtaattgaataggaggatcactatgactatagcccttggtagagttactaaagaagaaaatgatttatttgatattatggacgactggttacgaagggaccgttttgtttttgtaggatggtctggcctattgctttttccttgtgcttatttcgctttaggaggttggtttacagggacaacttttgtaacttcttggtatacccatggattggcgagttcctatttggaaggttgcaatttcttaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctgttcaattgcggccttataatgcaatttcattctctggcccaatcgctgtttttgtttccgtattcctgatttatccactggggcaatccggttggttctttgcgccgagttttggcgtagcagcgatatttcgattcatcctcttcttccaaggatttcataattggacgttgaacccatttcatatgatgggagttgccggagtattaggcgcggctctgctatgcgctattcatggggcaaccgtggaaaacactctatttgaggacggtgatggtgcaaataccttccgcgcttttaacccaactcaagctgaagaaacttattcaatggtcaccgctaatcgcttttggtcccaaatctttggtgttgctttttccaataaacgttggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactatannnnnnnnnnnnnnnnnnnnnnnnnnnnnnnnnnnnntctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgcgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgagaaaaaatttagtctacttttattaaagtaataggtgttagtctagtaccgtacccctttactatcttagccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggggccttgagagttcctcttgtggtagcaagttacttcgcaacctgctcaatttggccttatagggtcgggaactaatgaataaaaagggttggataccgcccaaccacccagccctctaccatatctagacaaatagaatagtccttttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaannnnnnnnnnnnnnnnnnnnnnnnnnnnnnnnnnnnnnnnnnnnnnnaggggttatagtcgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgaggaaaagaattgggtttccaccgagctgaaacaatatgctgatggttctagtaaaccaaaactaccgttttttagctatttggcttccatttccttttttaacaaaagaagatttagttacgattggaaataaatttttttgtatcttcatccatagatcctttactcatattttaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagcgattcgagaaagatgctaattccctcttagttaatgaaacagagaaggttcctcacagttagcggttggtacttcgatcgcaggcctttcctttactttcttttttgttcagaattgaacaaagaatttggggaagaaaacatcttcccccacttatcatgaaatctgggccatagagaaagagtgagatgtttttttttatttatcatagactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagagcatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcgcgaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaaaccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctgggtcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctctttcattcctctcttacaaacaaaaaaaagaccttttcttattggttattgaaaggtggattattatctatttttagcgataataaatcgcgacatactagttatgtcattctcactatacccccatacgatacgggggtatgtagtatatgattcgtctatttcttagagtaggacaggcgaatattcttattcttatggttccatttaagaataagtatgccatacgccccgcggggattgtagttcaattggtcagagcaccgccctgtcaaggcggaagctgcgggttcgagccccgtcagtcccgaactagggttcaatgaatggagaaattcatctttcctttttccatgaaaaaaggggggcaggaagcaagatcaaatacctatggggtacccctatttcactttttttagttcgcgtttctcagtaaagagaggagagtataggaatttttttatcactacttctggttgatagcgaaagacatacatatcatacgtggaagggatcctcctatgttatactattccactctcaaccatgaattgatttgatagatccgatattcataatattgaattgattcagtattatcagaatgcaagtcctccccttgaatttacaggatacccttttccctctccatgggattacatcccgagttattgcgaaaaaaaagaggttatggaagtcaatattctcgcatttattgctactgcattgttcattctagttcctactgcctttttacttattatttatgtaaaaacagtcagccaaaatgattaattggaagttcaattaatcattgaagaaatgaaaaagggattaaataaaataaaaatccaagtcttaaatgaaaggatccggttggaatcataaagtgtggtagaaaaaatacatatagttttttctaccacactttagagtctttctattatattatcttgaatctacatagaatagattactagattgaaatagtagtctaattcaatttcttttttcactgcatccacttaatttcaatcaagtcaaaatgaaaaaatccatggagggagagaaaaataatatgagaatagactatagtaaaagaaaaaaagtaaaaggaaaaaaccagcgaatctttcatgcttaaacatgtcgcgaaatgtttcaaaagagcataaaatttattttaagaactaagaataagaaaagagtataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctatatagtagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaaactatggatgaatcagttcaaagaatttactcttaacaaattcttagagtatttctggtagaatttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatc

SEQ ID NO: 57010 - DNA, 5814 bp, Oryza sativa
aaaacttccctttttttctattgaaatgaaaaagagaaaagtggatttctagtcacaagctacaaaattaagaacaaattggaaccattaactagaattctctttttattttgaatttcggtattctctcccgcctgccatttaatggcataataaaagacaatggatttatgcctaatccgtatataagtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtccattttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacatattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagacggattgttttgcgaaagaatctttggacccataaaaagcagaatttgtgcttgtggaaattctcgagcgagcggagctgaaaacgaagacgaaagattttgccaaaaatgcggagtagaatttgttaattctcggatacgaagatatcaaatgggatacatcaaactcgcatgtcccgtgactcatgtgtggtatttaaatggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataat

SEQ ID NO: 57011 - DNA, 6443 bp, Oryza sativa
aagttagattcggggatgcccctttcgaggggcattccaatttcgctagtatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatctggtatgctacaagtgaatatttgaaacacgaaatgaattcgaattttcggataacagatccttctaatccagtctatctaatgtctttttcaggagctagaggaaatgcatcgcaggtacaccaattagtaggtatgcgaggattaatggcggatcctcaaggacaaatgattgatttacctattcaaagcaatttacgcgagggactttctttgacagaatatataatttcctgctacggagcccgcaaaggggttgtagatactgctgtacgaacggcggatgctggatatcttacacgtagacttgttgaagtagttcaacatattattgtgcgtagaagagattgtggtactatccaagctatttctgtgagtcctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacatcttggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactgccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatttatggatattgtcagtaagtatgtgcagatctagtatagcttctttttcgctccacaaggatcaagatcaaatgaatacttattccttttctgttgacggaaggtatatctttggcctctcgatggctgatgatgaggtaagacatagactgttggatacttttggtaaaaaagatagggaaattcttgattattcaacgccggatcgaatcatgtccaatggtcattggaattttgtctatccttctattcttcaaaataattttgatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatataggaccctagaggacgaatataggacccgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggacgaacatgggactttagaggaagactcagaggaagactcagaggacgaatatgggaacccggaggaagattccgtcttaaaaaagggggttttgattgagcatcgaggaacaaaagaatttagtctaaaataccaaaaagaagtagatcggttttttttcattctccaagaactgcatatcttgccgagatcctcatccctaaaggtacttgacaatagtattattggagtggatacacaactcacaaaaaatacaagaagtcggctgggtggattggttcgagtgaagagaaaaaaaagccatacggaactaaaaatcttttctggagatattcattttcctgaagaggcggataagatattaggtggcagtttgataccactagaaagagaaaaaaaagattcgaaggaatcaaaaaaaagggaaaattgggtctatgttcagtggaaaaaaattctcaagagcaaggaaaagtattttgttttggttcgacctgcagtcgcgtatgaaatgaacgaagggagaaatttagcaacacttttcccacaggatctcttgcaggaagagggtaatctccaacttcgacttgtcaattttatttctcatgaaaatagcaagttaactcaaagaatttatcatacgaatagtcaattcgttcgaacttgcttagtattgaattgggaacaagaagaaaaagaggaggctcgtgcttcccttgttgagataagagcaaatggtctgattcgcgatttcctaagaattgggttaatcaaatccactatttcgtatacacgaaaaaggtatgatagcagaagtgcaggactgattctccataataggttagatcgcaccaataccaattccttttattccaaggcgaagattcaatcacttagccaacatcaagaagctattggtaccttgttgaatcgaaataaagaataccaatctttgatggttttgtcggcatccaactgttctcgaattggtttttttaagaattcaaaaaatcccaatggggtaaaagaatcgaatcctagaattcctattccaaaatttttggggctctttcgaaatttttcgggactcttaggtactattgcacctagtatatcgaatttttcttcatcttactatttactaacgtataatcagatcctgttaaaaaagcatttgctccttgacaatttgaaacaaaacttcaaagtacttcaaggacttaaacactctttaataaatgaaaatcaaaggacttcaaatttcgatagtaacatcatgttggatccattccagttaaattggcactttctccctcatgattcttgggaagagacatcagcaaaaattcaccttggacaatttatttgcgaaaatgtatgtctatttaaatcgcacataaaaaaatcaggtcaaattttcattgtaaatatagattcctttgttataagagcagctaagccttatttggccactacaggagcaactgttcatggtcattatggggaaatcctttacaaaggggataggttagttacgtttatatacgaaaaagcgagatctagtgacataacgcaaggtcttccaaaagtagaacaaatcttcgaagcgcgttcaattgattcactatcgccgaatctcgaaaggagaattgaggattggaatgagcgtataccaagaattcttgggggtccttggggattcttgattggagctgagttaaccatagcccaaagtcgtatctctctggttaataagatccaaaaggtttatcaatcccaaggggtacagatccataatagacatatagagattattatacgccaagtaacatcaaaagtgcgggtttccgaagatggaatgtctaatgttttttcacctggggaattaattggactattgcgagcagagcgagcagggcgggctttggatgaatcgatctattatcgggcaatcttattgggaataacaagggtttccctgaatacccaaagtttcatatctgaagcaagttttcaagaaactgctcgagttttagcaaaagctgccttacgaggtcgtattgattggttgaaaggcctgaaagaaaacgtagttctgggggggattatacctgttggtaccggattccaaaaatttgtgcaccgttacccacaagacaagaacctttatttcgaaattcaaaaaaaaaaactatttgcgtcggaaatgagagatattttgtttctccatacagaattagtttcttctgattctgacgtaacaaacaatttctatgagacatcagaatcaccatttaccccatttatatgatttaaggatacataaagcagattttttactttaaactagatttttgaccttagaacgctaagaggttagattttctatttttattttaatttaaaaagaagtttagttaattcattaaggttatgcttataccatgtagaaggttccatcggaacaattatatttatttcaagctatttcggctctttcttaatcttcgaaaagaaagaattttcgtaatggaaaggtaggatgaaaaaaaagaaaaaatcaaaaggaagtgtggaaaaaatgacaagaagatattggaacatcaatttgaaagagatgatagaagcgggagttcattttggtcatggtattaagaaatggaatcctaaaatggccccttacatctcggcaaagcgtaaaggtactcatattacaaatctcgctagaaccacccgttttttatcagaagcttgtgatttagtttttgatgcagcaagtcagggaaaaagcttcttaattgttggtaccaaaaaaagagcagcggatttagtagcatcagctgcaataagggctcgttgtcattatgttaataaaaagtggttcagtggtatgttaacgaattggtcgattactaaaactagactttctcaatttagagacttaagagcagaagaaaagatggaaaaattccaccatctcccaaaaagagatgtggcaatcttgaagagaaaattatctaccttgcaaagatatctcggcgggatcaaatatatgacgaggttgcctgacattgtgatcgtcctcgatcagcaaaaagagtatatagctcttcgggaatgtgccattttggggattcctactatttctttagccgatacaaattgtgacccagatctcgcgaatatatcgattccagccaacgatgacactatgacttcaattcgattgattcttaacaaattagtatttgcaatttgtgagggccgttctctctatataagaaatcattgattagtatccgcctttcccttgattcagccttaacatctataattttgtttgtgtattttctcattttctattgaatcggattcaaaaaaaattatattatgattagtccttttccacttaactgactggtagatagtcattttcattgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactct

SEQ ID NO: 57012 - DNA, 1036 bp, Oryza sativa
gatgaaattgaatcctgaaaagtgcaccttcggagtaccgtcagggaagctgcttggttttatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggctttcgaagatttcaagcaactcctcaccaagccaccggtcttagcttcaccacacccgcaggagccgttgttgctgtatgtatcagccacctcccaggtcgtgagcacagtcttggttgtcgagcgtgaggaagaaggccatgtccagaaagttcagcgaccaatctacttcgtcagcgaggtcctgaccgactccaaaacgaggtaccctcaggttcagaagctgttatatggtattttaattactaccaggaagctgtctcattactttcaaggtcactcggtaacggtggtcacatcatttccactcggcgatgtactgcacaaccgcgaagcaaatgggcggattgctaagtgggctttggagttgatgtctttggacatatcattcaagccccgcacttcaatcaagtctcaagcgttagctgattttgtcgccgagtggaccgagtgccaagaggatacccccgtggagaaaatagagcactggaccatgcattttgacgggtcaaaaagactttcaggcactggagctggagtggttttaatttccccgactggagaaagactaagttatgtactttggatacatttttcggcgtctcacaacgtcgccgagtatgaggcgctccttcatgggctacggattgcgatttccctagggataaagcgtctaattgttcgaggtgattcacagctggttgttaaccaagttatgaaagagtggtcctgcattgacgacaacatgatggcatatcga

SEQ ID NO: 57013 - DNA, 16973 bp, Oryza sativa
atttgaaaactttcaactcgaaattttgaattttttaagtcaaattttgaaaactttcaacttttcatctcaattttgaaaactttcaacccagatttgaaaactttcaactcgagatttgaaaactttcaactcagagttgaaaacttccaactcaagatttgaaaactttcatctcaaatttcaaaaactttcaacccagatttaaaaactttcaactcgagatttgaaaactttcaagtctaaatttgaaaactttcaagttaagatttaaaaattttcaagtcatgatttaaaaagttataacacaaaatatttaaaagcacttgtgctgaaatttttaaaaagaataataaaaaagagcaaaatgaaaagaaaaaaatcgccaaaaaaaaggaaaaacgcacagaaaaaatcgctaaaaaaaagagacccgtggcagcgggtggagggcgctcgcgctagatacggatctggcgcgcgcaccaattagcaaaagcccatgcatgtaaggttgcactaaggacggagatggtgacacaatcaaggtcattgttgacaaagatgttagacattgatggtgatgctgccaaagctgttgaggaatgacttgggagcgcaatgcgtggcatggaggggaaaatgctgctgtggtccactggctcttgtcttagaaggatgaatatagttggtgaagaaggtgatggtgctagcgatgaggtggggtggacgaacgaagcaatggctaaaaagtaaaaacagcatggagtagtttttgattaaaaaaatgatttccctggtttgtggaaactcagttttcattattcatgggtttatttatttaaaacatgattaaggtaaatcagttttataaaatatgagatgacaacacctaatagaagagactatggttcagaacatctgatccatgctatgtaattgaatgatgaaagttttgtaatatacatgcaacattagtgatggagggggaaacattacttaaaaaaattaattattggcatatcacactagatgtttgatgaaccatttgtaactgaaatgtgaaacatcatttaaaacaatgcacaatattagccaaacggaaagttatgcataatctctaaaaataattagtgaaaaataaaaacaagagagtttaatagtcgaatgcagtgagtgcaccaaataaagaaaaggaagcaacacaaagatgttgaggccgccatgcctgtgccacctcgttgcggggaggattgccgctgtgacgatcacctcgttttttatggcgaggggcgagagcgaggatgaagagaggaaaaaatggcctgggcggcggcaatcacggatattatggtggcggaattggtggaggtagcgcgtgcggggaagcaaaattggaagagatacgtgcatgaggattgagcggatctcgtccgttctcctgaccgttccatgaagtatgatgtctgtaggatgtagggtagatcacttggtagattatagggtagatcacttggtgaattatagggtagaaagatagatgtatatctcctatctctttcttattgaccttttttttacttatatgttaaattacactagtatatttttctaaaggatttaagtagacaatcaactgtttttaccaaattcttctatgcagtgagtactagaaaaaaaatacagtgcatatctgaaatttacagtgtaagttttaaaaggtgcgctataaatgtcccaattagccctgggtgttgtgtgtgggtcagtggggatgtcctgtgcagcattcatcagggtgtagaatcttggtcatatttttttgactgaaaacatacaccgtgcagtagaacatgcctcatgcttactcatggatacaacaacacatgtcatttattattatgctggtgtcaagagttgacaaacgaatgtccatgtgttgctgcaatctgttcccgtgtttctgtttcatgcaccgaaaagcgagaagtcaccaagaaagcctcatctgttgcttaaggattggcaatcaataccatctgccatgtgtgctaagcacgctgttagagaggtagagagggagggattatttcatttaggcatacttcaccattcataaaatccttctgtagggaatgcgtgctatatcgtcccaatttgatcccaagaaaaggaatttgcagccaatggatcggaagtacagcagagatttaggtagttttggaagggaccggatacttccacagaaatcaaaatataactccttaagtgcggtgaggttctccaagttgttgggtaagctgttccaatggcaggaagtaaacccaaggtaagctagtgaagtcaagtgctctaggatccactctcccctcagttccaccgagtgttcgagcgcaagccatttcagtgatggatatgcccctcttgacaaaagcttgggtacaagggacatgtcatcgacggttagccgaggaactgcgtgtgctttgccggctactttcaagtccataaggctgggacacttgatgatggtaaggtgctccaggctatcaagatggttcaggccttccaagcgaactaattgcttacagccaccgatgtagagatccctaagcctcactagagacctcattgtctcagaaggtatctctgtgaaagagtcaatttgacttagtttcaggctacccaggacagtgcatcctctcaatgaatcgcgcaggacagtgtcttcgacagtgcatcctgtcaagtggagacattctagggatgcaggaaacaacctttggtcatccatggatgtcacctccaaacgcctgcagccgctgatttccaggctcttcagcatgcctggaagtcttgggagccttgtcagattgggaagaacattgagcctaagcttgcgaaggtcagtgaagagcttggcgatctcagggagagtttccaggttgtaacactccctgagttcgaggaattgcaggttactgacgcccccatgttcccttgacagccaacttggtgttgtgcgacccaggtagtggcagatgttgaggcatgtaagttgctctggtggttggaggccgtcgagtatctccacttggaggctgtagatccttgtcagctttgacataggatgcgtgataagcatgccattcaagtgacaatgttgtgaggcacttcttctcggtcagattggcttctagagctttctccttgctctcaacactctcaaggccactgattttcaagctgccacgaaggttattttgcttcatcagctgctttaaccgatacgcttcctccttcctgaccttgaagtgacttagctcttgcagttgctttaaatcctccacgtaaggaattcccaaatcaacataaggagatgaaatagaccgcaagttaatcagctggctgctcatccttttgacattggaacagtttaaatctaaataatatgaaagagggaactctaggttctgcaaagggtagagtttgccaaattctgttggcaacttcacctgtcttatatgggatcccaaaaggctgagaaaacgtaaatgctttaagccacaggctactccgggacaatcactctatcttgatccagatatgtttgcaccacacgtaactcttcaatctttcagcattcgctcaagaacttgttctgttatccccctcgatccatcagcgctaatgattaatgtccggagtttcttcattttgtagatatcatgtttatacttcattgcattgctggaagtaataaacagatggcggacatcggaacggaacacttccacctcatcccccagaactcgtaagcaatcatttccggcaaccatctctgccaattcgtgcagcatatcaggtatagtaaaccactcatcgtcactgtcagcaagctttccttctgattttataaatgaccatgactttaggtcttcaaagtatttttcacctatatcttccattttctgtccattgctagtcttgataaacccttcagccatccacagcttaaccaatgcattgcgtttgaaccggtagttccgtggaaacatactacagtaagcaaagcatcgccggacctgttcgttaagtttctggtagctccgccactgttcttgtatgatgtcagtacacggtacttcattatctctaattttttgccaagagctggcatctaaatttttgcatagcctgtctcctactcgccttgctgcaaccggtaatcttcttagcttatttgcgatccctctgccaatcgaatgtagtttttgaagtttttggctatcaagtactctcacaccatcaagtgcataatgcatgaatagatcaaggaaatcattatcatccatctcagaaatttcaacggggctcttggcacctagggacatggctgtaacgccccgattttcgttcgggaataaaaatcaattaataatacattttctagaaattaaataaaagttaaatcaacttaatcaagtgaattattgagggaattaaaaatttcctttaaaaatcattagctgagaatattttgtaatattctttgtgccctaaaatactctccggatttttccgcaaattttcggagctcaagaaataattttaaagtcacaaagatcatttaaccaattaaataaaaagaaaacaaataaaattctccttccttcccttttgggcttggcccaagccttcccctcctctcccgcgggccgcgcgcctcctctctctctcggccggcccgcgccttgcgaaagtctgctttacgtcccccagtttccctcctctctctccatccggccgacaggtgggaccgtgggccccacctgtcagctcctcctcctacctctcgccggccaaccccaaccgccattgccgcccacgtcgccgcaaaatccggcgccctcccgcacccgagctcgcatccaacgacgtgggcacgatcccctccacgtcctccaccattttccccgctcgtcccacaaaaaccggcgccggccgagccaccaccaccccccgtcggcgccccacttccccgccggttgccgcccctctcggccctgtttccgccgctccgaccctataaaaacgaaccccgaagcatcctctctcttttcctctcctcacccgagccagccgcgctctctctccccctccccacgccgctcccgcgcaccgccgcttttcggcgagctccggccgcccgccaccgctgctccacccaccgccgcgccaatccgccaccaccgtcggcttcgcggcgccgtgccgcagcccggcctctactccacttcccctctccgcctccggaacaccgccgcctcgtgcaccaccgcctaccgcctccggccgcctctagccgccatcctcaaccacctcaagccgcgccactgcctcggttagatccaccaccgcaagggcaagcccagccgcccatccatttttcccctccactaccagaaccacctccccaccacgccaccctaccggccattttttttccgtctccggtcgccgttcgccatcaccccggctgccgccgcgacacgccggccgcattgcctccttcgccgcgtcccgctcttccccgtccgccgcccggtcgccgccttccgccgccgggagcccctcctcattgtcgacctgtggagcgccgccgcctccctccgccggctgctctcgccgtcgccgtgcccctcggtgagctccgccacctccctctccctcactgcccccgtttcctctcgccgcttcccgcgctgcgcgccgcagctccctgcgacgcccggcccgtgtgccgccgtcgctttggtcctggccgccgccgccgccagccttgtgtgcgcgctggccaggccgcgccgcccggccgtccccagccgtccgatcggccttggccgatctagatcgtcgggtgcgcggccgcgtggccgatcgccaccgtggactcggtccacggtgggccgtgccgctgacgtgtggggcctgccccctttgtggacgtggtccgcgcctcaccccttgctgacgtcagcgaggaccatttcctttgtaaaaataaataataattgcgcaataaatcgagtttaattctagaaattcatttaaatggcttagaacttctaaaattcatacctaattcattcgaactccgaattgagccattcaacttgcaaaattcatctaaaattaagctctacatgtttgtttagtttttatgtactgttttcttggtttttattagagtttttcctcgttttgcgtgccagcgtgtagttcccgtcgtttcggaagatcgtgttcgcaaggataagagttcagaagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagctggtgttactttgatgacctagctagaactatatgcttagccatgcttaattaccactagctcagtcgatgggataattgcagtattagacattttagtatcttggtgagctgcgtgctcgagacatctggccatgcttcatggtcgtaattattcaactaaaatgcgactgaatggtgggctgtgggtgcatggttttgctggtcgcatccatggcagttaaggaccggttcgcgggatgccttggaagaatttatcgtacttaccacaagccagcgtgggcaacggctgggcttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcagtcgaccagattcaccgtgattagtctcacacttaataaatcgacccaatacactgtagtttaggtgggttggttgggcctgttcaacgtggtgtagcgttgatcagtggagatttaatgttactttaattactcaacagttttactgttttgctcaataaaatgttttacaaccgcctttatgcaaatagacacaaaccatccttgtatccccttgcacgtctgcatcgttggtgtggcttgctgagtacggtggttgtactcagccttgctattattcccccttttcagaagtgtagtgcttctgagctgaagatggagttaaaggaccaaggctcagaccccagttgagttttgcctgtggagtggagctgaagccccgctaggatcgttttttttttccgctgctgcttttgtttcggtgtgaggactaagtgcctcttctgtaagtattttacgcttattttacgtttggaactgtatattacttgtcgttttgtgtaccctgactggtcctagacagggatttaatacgcaaaatagtctggaaatttgggttaaatttctgggcgtgacaatggctgcatctttggacaaagctgtaactaggatcttacttccccgcttcccaaaattcagtgtattacgtacttggtcccgttcttgctgagcaacatccgactggagaccatccagcgccagcaagaaccttttgtctctcaattccgcttttagcttattttctagggcatcaagattttggtacttataggatggtcgcccaatggctccttcgagcatctgtctgtaaattttatccacactgaaactttgagaaacatcaacccacatgacaggtgaaaaatggccatcctctttttcatactcacagacatattgtgcaaggattgtcttcccggatccagcaatgccatagatgccaattgttgttgaataacacgggttgttgctggagcctggttcaccgtcccctgctgcttcgcgcaacatatttactatctttgtacgatctacatctcttccaaatactcgccccgtagctgaggaagtagtgcccgacatcgtctcctcgatagttgtctccgtcattaataattctcgattcacaagcccgcccttagttagtttttgtagcttctctaggcttttcttcagcttactggttgtgtagcttcttctggcttttcttcagcagctcacgtaaccatgagtcggtattagagggagagctgacctgcattaagtttaggcatggcagagtcatgtaacatgaaacgtgcttattggcccaaaggaaaattttagtagcatataagttttttttttttggacttgtagttttatggctccttcagaacgcatggatgggcacatgaatcatttctttctatataagtacaatccactaagtacagttatggcaataaagttctataagtgagccatcggaagacgactcacgcgtcgcctcctctcgggcgacacgggaggcgcccagctcgccgtcgcccgccgctccctcccttctcctccttcgcctcaccgctgcccgagcggccggcagcaaagtcgcgcggccgcaaggacggcggcgacggggcttcgctcagtctcaccgcacaagggcaggggggactgccggcatcgggaggcggaaaccgcccagatccgtgccgaccggctggacctggcgcggcggttgctggtggcggggtacttcgttcgggcggtagcatttggcgggggtggcggcggagtttggaggcgctggtggtggaggacgaggctgccagatccgtgccggatctggcggatctggcggggaggcatccggcggcgcccgacgctggcgggaggatgtcggcgtctgctgggggacggtggagccggacgacgattggcgacgggggcagcttcttgtccgatgacagagggtgcggctagcggcgacgggcgcgacgacgaggaggccgcgacggtagcggaggggcacgaggccgcgcctgcagatctggccacccggcgaccagatcgggcgggcgagcttgcggcggtggaggcggagctcgcggcgaagggtcggcagcagcgggcgagcgacagctgcgacggggcttcgctccgtctcaccgcacaagggcagggggtactgccggcgtcgggaggaggaaaccgcccagatccgtgccgaccggccggacctggcggggcggttgccggcggtggggtactgcgttcgggtggcgacgtttggcgggggtggcggcggagtttggaggcgctggcggcggaggacgaggctgccagatccgtgccggatttggcggggaggcatccggcggtgcccggcgccggtgggaggatgtcggcgtttgctgggggacggtggagccggacgatgactggtgacagcggcagcttcttgtccagtgacggagggtgcggctggtagcgacgggcgcgacgacgcggaggccgcgacggtggcggaggggcacgaggccgcgcctgcggagttggccacccgacgaacagatcgggcgggcgagcttgcggcggtggcggcggagctcgcggcgatgggtcggcggcagcgggtgagcgacggcggctacggcggtgcgcggctggtgatgacgacgacagcggtggctgaggcagccgcgacagcgcccgtggtggccggcgcgaggctctcggtggcgacagcggcgcgcggctggtcacggcagcagcggtggttgacggcgcggtggctatggtatctattactctagcgggtgaatatcaattttcgcaagcgggactagatttatggtattatctgtagctattttttgcaaatggtgatttttcatagtccgactggaaaaataaatggtgacattgggaaaaatcgtttttctggtagtgaaaagtatttgcaagttactctagcgccatcaccattggtggaggttttgcacatctcaacatcatatgtcggagttttacttaagattttaattatttctatctagaagattattcttcgttatgaatttctaaataatatttattggctttgtggttacatgtaaagctacacacaatgaattcgaaaacctcatctcatcgtcccttatttaaaatttgggtttatccagaaggacatttgtctatctttttcttcggacgagtttacgggtcggacgtccgatcggtttagagaaaaatcgggcgccgatgttagtgcccgatttacgtgcaaaactattttaaactgatttttctcttaaattacttatccaaatcatgatccgattgcaccattaaatttgttacaattaaatcttcaaaacaaaaccacacatggatatattccgacgaaaaattttttaagcttattattgaattatttttaaatgttgcacgatgttccattagatatatcggaattgtttcactaagtagattgaaaatgtttcactcgtttgaatcgggtgtcgtttcaccttatataaaaacaatgtttcagcaaatagcgaaagaatgtttcaattcactgcaacatttgatccatacatagtgaaacattataagtacactaggtgaaacatttttcggtggaacaaaaaatgaaatgaattctcttaatagggggtttccaaaatatgtgggttttttttgttgcaatggaatatttcagtgcactgcaacattagatctatacatagtgaaatattgtgagtacactagatcggggggaacgcccgattggctccacccccgtcgggctcccgagccctgtcattctctttttcttttcatgctttagaatgcatcacatccaacaatttatttttatctattcgacaacaatgcgtaggttgtcttctagcaatagccaataaggcttttgatgggaatctatgagtaaaacagatgattggaaaatataggtaaaatacaaaattaaccacttggataaaccacgtgaattttaggggagaattctaaaaaatccccttgtcttgaaccattccaaataaatttcatatgatttttggaagttctaaatttcaatcttttgttccaaactgatcaaatactcggtagaatatttactgtatgattcaaacactaaatttcttccaaatgagccttaaaaattcctttctacgatgttttcaagcaactttgtactaaagcttcagcgtttaatcttgaaaattaaatgaaaaaacaactgtcacgtgtttgaactaaccatgtgcttaaaaaaatggcaaaatttgcaagctggatttcaccgtcatgtcacaattaattacttatatattattcccatgcatacccactctagtctccaggccattctgaatacctaagcaaaattgtaaaaatggtactccctccgtttctaaatatttgacgccgttgacttttttaaatatgtttgaccgtttgtcttattcaaaaattttaaataattattaattcttttcatatcatttgattcattgttaaatatacttatatgtatacatatacttttacttatttcacaaaagtttttgaataagacgaacggtcaaacatgtgataaaaagttaacggtgtcaaaaatatttagagacggaaggagtactacttttatctcccccagtcctgaaacttcttgtggtgaaggtggaggagggggctagaaggtgtaaagtatactaccattgtggactaacaagtttatctgagcaaggtccaaaatagagttgctaatgatggaacaatctccgaattcagttgatatatcttatcatcctcaagcttgccggtcttttgccatttgatttggccacgtgccatggttaatctatactttctgtaaagttataacccactaactctaaagtttcacatgcaaccataccacatcatcacccactaacaataattacatattcaacctcatgcaaacatgcaagagcatccacaatctatttaattctacaaattagcacgcaagcatattcaatcaccacatctcacatcatttccacaatagttttacaaatctctattatttttataatatttaatatatacttataaacatgttctacattaaagtgcgaatttcatttgtttcttgataaatatcgataagccctgagatttgattttttttctttttactcctacctgaattgtaacgaaaaataatattgaaaattacttagtaattcccacagcaaacacggggaatcccctagtttttaagataaatcatggccatgggaattatgggcttgtttggtttagtgctctacgaatactagtattggtagtgcaatgtatcaattcttttttattattatacggatagtaaatcagaatttttattatagtaccaaattagttttaatatatctaatattgaacgtattttgatattttatttttttataaatatggttagtaatttgaattagaagggggaaaaaaaggtcacttggtttggtttgcagccaaagcgacaaagctgcatgtggagggcgaggttaaggtaatcgtggatgtccacgatgtcctctgcgtcgtagaaggcagatctgaggctctgcacccacttgtccagatacggcatggatgtcatgtgttccatctgcctacgcagctgcggctcaagacatgccaccaggttgcgcagctgggcttcttggtcgcagttgagcaggtcgatgcctttgttcaccgccttggtggtcatgggcgacacgatccatccgatcgtcctgatcgcccacccaaccgccacaacctccaacgccatgacgatcgagactcaaagtaaatgctgcttgttggttaattgaacgatcgatcaatataatcgtctctcgtcgacggagttggagcacaatgcaagactatatatgcttggtgccggccggatttatggaacgaggacctagctatagcttaactcaagtcaagtcaaccccggccggtgcaccatcagtgaggctatctgtggaaattaatctaaaggaaaatcaacccacgtggggtttgggttgttcccccaccttatttttttgaaaagtactcattttattatatagaaaagacagagattagggaaagaatccccagtacaaattgatcatacaccaaaccatcctttctaaagatgagacagactgaactaagggaaacaaattcctgatgtagccatacagtgataatggatgagatcgacaggagtagcggcgttgccgtgacgactacatccatgggccttcattgacgtgcacaccgcttgacaaaccgataatcccctttggttgcctccacgggaacggcacaaattgaaggtttgttgttgagtcgtagattttggtgtgagcttcaccggactttaacagttgatttccacggagtttatcattgaatctgaggagcactgacttgcaatcctgcgaaacaagattgctcggacggtctgccctcaacccgaacgacgaacccagcatgggtaccactgcatagaaacatcaagaaagaggtccccaaactccggccaaccttagtcaagaactaggatggcattgattgatctgctgtctttctacttcagcttggagctcaacaaaggaggatgaggagaaattaacctggtggccagctgcaattccttgatgagcaactatcatccccagcccatctaccaacagatcatgcaagcaccaatccgaccagcaccaacgcagcattctcgagaagcacaggctgccaaatattttgttacctgctgtccttgaatccgagagctgtcgccaccccaacaaacaccgtcgccgccccaacatctggagggggagaggccggagacggagagggtgggtcatggtgtccggggacaaggcagccaacgccgcaactgtcgttgcgtgccggccagatgcagggagggggcagcgccaccaaacttgtgctggatctgacaggttgaagaagttcctttgaccgatctgccttcccctcattgcaactcctcctctgtttttccaaactaaaccctcggcgactaaaagcgactccttccgtcgccgggacgacggtgccgaactccggcgatccatcgacttgaacaaacgggaagaacccgacgacaggaagacccgactacgagagaagaccaacacctaagctaatagattactaaagggacgaaaatcccgccccctcccctcacgccggcgatcggagggtcgccggagatggaagggaaggggccgggagaaaaggggattttttttttctccggaaacgcctgtttcaggttgttcccccacctgacacccaatccctccctgtgaatccccctctcgtccacttgcgcgggtggttggtgggattattagcagatattatccctgggtttggatagagggggattagaagggatcactaccattcaaaataattcagaaatgataagaaaaaaaattgatcatgaaaacagaaaaaaaatcaatgtgcaaaataattgtaaaaagcccccaaaaatagaaaaacgtagatttaccacagacgaattctgaaaaatagtccagaattttttttaaaaaatcataattttggatagattaaattctacaagcagtaaaacatccaaaataatcatatgttttccatagatatgctagtcacagacaagagattgagttgtcatactagtatagcaatagattggaaattaagcgcatatatcgtcttccacattcggccctgcatatactgatctgttgaaacagtacaattacagactcctaaatctgcagttctgctaattgaattaccattctactacgaataacagttctgcaggcaaaccccaaaagaactgacgaaactaaaactagtttatcatcaagcccttgaaaacaaacttttccttgtctccgaatttttcccaaaaataaagagagttcggcaactaccaccatcagcttccaaatccatcaaaagtcatgtctcttaatcttaaaaacctgaaaaacaaacaggaaacattatggacacctgaatagtcatatgaaaatttgtttggaaagtgacaattattctgtgttaatttggaaaactaaaataagaagtgagttatcatctacaattctggaacaaaaatatttttaagacaaggaagaaggtcaggcacgattaagcccagtacatatactcacaattttcagcttttaagcactcaaccatacttgctatagaaaacaaggactatttggacagataaagtacttaccctgatatacatcatctctacttgtctttgtctgaacggaccagaaagccagcgtctcatttttcatattgttcttccctgaaaggttaatccttgaatataagcacagaacttgcaatgccaacagttgcaatatcaacacaaatgagttatatgtcgatttgtccgtactccgtagttctgcactacatatagtaataattgagctagtcaatgatattcatgtttttgtcatatctgtgagaccatgggcagtggcagcactgctgaatgtggtaaattcatcagatatatcatataattattaattatgttcgtgatagagcaggtagctccttggaaaaagaaaagtatgcataatacctgttatatttgtgtttcttggagtatcaaccaataatgtaggacctgtccagcaaagaggaaatcggtcaactttaaatatctataactacctgacaaattttcactcaagtttcatttgcaatttcctttggaatgtattacattacagagagtgcacttctaaagaattgttgaataggcatttcacacttttcacagctattatctcacaacatttcttcagctaaactgttaattttgttgatcgaatcatatcaggtgaaccttcaatgttggaacaaagccaacgaaaaaattgatctttgcaagcagcaggacaagaagctgtgctctgcacctctgcatgagagaagcaactggaacaatgacaggctaatactagcacctaacactgaaatggagctgtctaatttcacttgatcctgtcaactgtcagtatacaaagggagatcgtgcaaaatcagaaagactggtttggcttctactcgctcatcttaatgattggtgggagaaaggacagacaccgagcaccaactaggttagaaatatgactaatacttcaatccatacagccactcaatacatcaactagcaacaaattcatccactagaaaagtcacaaaatcttttcatagtaggaaaagaggagatcaagaatcagacctgcttcttgatgtccgggctgttgccctcgaccttgccctctcccgcaaccggtgaatccgaagcgaggaaggagagatggcgagcggcggcggctgtagcgggatggagaccggcggtgaccgagggcgggaaggagaccagtggtggctggagatatgctgctcccggacctcgcgccgcctccaaacctagcgccgtgaggagtcgaggaagatgagcgccgtgtatgctcgggaagaaaaaaatcgtctccgagacgatttttctgtaccgggggtttggcatggatcgggtggagaatttcccccaccccacctcgggccaggcgaacgcgtacatgcaccacggaagaaaattagatctggccgggatggcacacggggatttcggcccattccccccaaacctagcctataagaacgaggcctgagagatctattcttaaatcatttgtgttgatcagg

SEQ ID NO: 57014 - DNA, 3916 bp, Oryza sativa
ttttttatctcataacccatctactttcctacttgttcgctaccccttttagtattgctgaaatatagttttgacagttggcgcgctaggtaggggcagcgtcaagttttctcgccgactagtgcgatgggatctacatcaggcatcgacgacttcgccttcccccaagagcaggtgtatcgctttggcagccttgacttcatcaccgacaatttcggcaagatctcttttcttagctcggattcaaaccagtcggtaggagacaaccactccactccgtttggtttatcaaatacggcagagacctaccctaaagttttctcccttgagttggcgtcaaaccactcgggtgagatcatgaagacctcaccttcttcaccaagttccacttcagacgtgtcggcataccctcaaatcaccatgcgactaatgtggatgtggattttcattcctcaagaggacaccccttcgttttttttaaattacacagtacaacgcagatactcacaacgcacatccactcacccctatgaacacacgcaaaccctacccctacgagcatcttcgaaaactgagccggcaaatccatcttggagattgacgaaatcaccacaggcgcctcgctgtcgacgggtacatcgcctaccactgaaaacacaaagccgttaaatcctggaaaattcgctcccacgaggagtccaaccaggacctaaggtgctactgagactcttgtaaccactaaatagttatcaaaatattcgaaaaaaattgacaacatagatttatatgaaatatatcactccacaaacatgcaataccaaattcaacttttataatttgtaaaaaaaactgaaaatagttattgtacattctcagctttatttgttattgtacatgctgctgctgctgctgattcgactcggacaagaaatgcttttcttttcttttttcttttcattttccaaattcgagtttttttggaagtccaccaaagtcgagttctggcgggagccgtggtcaacgtgggccgaaccaacacgttacggcccaatattagtgggccgcacggagcacaatataagcccgttcaggcccaaccgtacggcaaccacctccgatcccctctcctcactccgtctcggcggcggcggcggcggcgaggcgtctccgacgaaaaccctagcatccctccccccacctcgcgtctgtctacgaagccatggtgagtagcaaccactcccacctctccgttccgatctgctccagatccatctgaccgatttctgttgttcaggagaggcgagatcgcggcggcggaagcagcagcaggaatcctcatggagctccggtggaagaggaggaggagctggaggatgattttgatgagttccggctgcccatgagccaccgccccacggagaacctcgagacggaggggctggagcaggcgtccgttgacacgcagctcacctcctccaacgtcggattcaggctgctccagaagatggggtggaagggcaaggggctcggcaagaacgagcaaggtataaaacttcatcttctctacctcgctcacttgctttctccatcttgtttacctccattgcagtacacccctaacttttcaaactacactgtcagcaacagcttaatgtttcaacacttggctctgccatcttaagcttaccagtttccacaatccttattgaattccttagttttgtagttgtggtttgtgagcgtagtaactgtcactacatttgcatgcatctctaataaaatcttgtcttaggctaagttcaggtttaatttcttcatgcataacatattatggtatgcatggctacgaatggagaataactgaattggcaagggataggagatttaaagggatgttggcggttcttgcttctgtcgtgttctagttctaggtattctagttctaggcttacgacccctcctagtacaacggatctggccaaagggctatccagattcgtggtactaggatgcgacccctcctaggttggcttcttttgggacagagggagtatagcattaggttaaggttagttgagcaattttatgagatgattgactgccaatctgttatgcttcattttccgtaattatcacgttgttgtttgtgaaggttgctctgttgggaggcactagattggaatatctggtctttcaacaggctagttttataggtgtaaactaggaaaatctatcaatgcaatgacttgctgtagttcctatcaatgcaaccttttgttcttggtgatgttactttactctgttttcctctattttgttttgttgatcaatccttgctccttcctcattcttctctgaaccttccccctttctctctgcaccttctgtttgagcagtacaagactagtcataactaatcaccatgtctgtggcataacgacttgactgaactatatgatttaacctcttttgttagttatccctttatgtctattcaaaatttttaactatcattatgttgagttctctctatttttctaactagttactatcattgattaaaaaaaaaacagtcatcgctttaatattttctgctaaaattctggcaccttcacgacaatgcccttttctctttaatgttatataggtataacagagccaataaaagctggtatcagagatgcaaaattgggtgtggggaagcaagagcaagatgacttcttcacatcagaagataatgtgcaaaggaggaaattaaacatagagcttgaggagactgaagaacatataaagaagcgcgaggtgtgcaatcgaacactgattccttaatattctatttcttcagggttgatgcttgcactttgaaatcttatatctagctgttggcattacatattgatatttgtatcttattcatgcaagagttgctagcatcagccctcatgatccttgagcattttgggcattttttatttggtggttctttttcctgcttggtgcaaatcatgacaatccaggtcatagcagaacgcgagcagaaaatacgtagtgaggtcaaggagatacagaaggtgttcttttgcagtctctgtaacaagcagtacaaattggcgcatgaatttgagtctcatttgagctcatacgaccacaatcataggaaggtaatgtgtttacttggtgcagcgaacttctcttctactgccttttcttttgtgaagtatgggtgcacatacatatattcccccttcactcttacatattaattgttcaggactatatttctgataagttcactgtggttacaacagaggttcaaggaaatgaaagaaatgcaaagcagcagcagcagcagccgtgatgacaggcagaaacgtgagcagcaacgagaagagaaggagctggcaaaatttgctcaactgtatccatcccatgttttagtcaataacaatgataactcaatgatgtgctaactatgaacaaatgtgctgaatgtttattgaacttgcaatttccttaatgggacttcagtgctgatgctcatagaaagcagcagcagcagaagcaagaaccatcagagagctcatcagagagaattacaatgaagaacttgcctaacccttcaaatcaggatcagcgtaaaaccttgaagtttggcttctccaaaatggctccttccaaggtaccccacatctgaacaacatattttgttaaactgatatgaccatttatggaagtaaagtagttgtgtgcttgcatggaactctgtgaatttgttttatcttttctatattctccattcttttttcattgctctagtttgccgttaagttgaaactttcttaggcttttttgttaaactgtaatttcctctcagcatatgtgctcttctagaagcttttgacacattaacttattt

SEQ ID NO: 57015 - DNA, 2085 bp, Oryza sativa
aaattcagtttctttcctgcgatctttcgcggtggatggtcgatttttcaaacacttttggtggtcaaattttgtggacctagatagctagctctcattgctgaagttaaccaatcaatgaaaataaaatggttgctgaattcattggtacttagtgacaatatactatgcactatatatgtaccccccccccctttttttttctcacatgttgttttcagagaaagtagtactgttttctcacctgttggtggctaagctaactatgatgttgggatgtctcatgcaagcctgtacctacaaggaaatgtcaataggggcgatctttgctggagaggacaatacagtttatcaatattctatatttcttctttgaaaagatgtgcgcaaaccatttttttttcatttctgtttgagaatatagagtaacaattctaaatgttgacaagttaactttacaattggtccggtacttatgatcatatttacttaatgactatgtgtttcaaagcaaaaaaaagaaaaagaaaaagaaacatttacttcattgatttagtaaacaacaatcgtggaatcacatttttgactcacctaccagggatccaatagttctatactttttatgtctactttacatggttttttatgtgctgtgaatatattatttgcattccaaacttgcagaaaattgaaattgcatgaattacaaatgcagataaaaaattgatttttcaatgggccgattaccatatactcgttagggttgaagagaagttacaatacagtttgggatcaggttcctctgacacaaaaagtcatatgaccttgtcattgacatatagacccgaggtaacatgtatccacatgtcagaaaccaattcataatcgtgacttcaatgatctacacctatttagagttgctatattttttacataactctattagagttggcaatggatgcaccatcatctatgatctacacgctatgttgtcccaggtagaatgagatggcaccccaagtacaatacaatgcgctgtatatcttcattatctctgttaatttaccacaacacgcatttcaacagtcattacactgtagtactttgctgaatgaaaggatcatgaactcaaacatttcacactatggtccaggggtattttaataaatgcatccaaccccactaccctggtcctgaggttgcattaatgcccacttctccattaatttttttcagatccaaatttctcacacaatatccactgccatattaattaactacatgggaacccacgtgttgctgctgcagaattgcgtgaaaatatagtagatacaagttctaaaattttctttcttatctactatacgatttttttcatgtatttatatattttttacctttataaattatccaaaggttataatgattggattgtatggtgtgtcttttgaagggatgaaatgcaatttacaccctcaacaaatcatccaaaggctaaaaacaattaaggagatgtgaggagatgcaatttacatccttgataaatcatccaaaggctaaaaacaattaaggtgatgtgaagagatgcaatttacatccttgataaatcatccaaaggctaaaaataattgaggtgatatgcattaactatacttgggggatgggatggactttatagatatatatgatttcttctctctctttttttcacaaaagaaatgtttaatagggtggagagctgagccttgatatatatcacaccttctcccatgttgcactaactaggagagaagaaaatttattagtaccacctcgcttaccaagctagtatcccctcccctcccatggcgctctccactctcctcctcccctcctcctcctcttcctcctccaagacggccactgccaccgacacctccgaccgccgccgccaccaccaccaccacaaccacaccaagcgcaagaagaagccgccgccgccgccgctctcaccgacgccgagaacgccgccgcctgcagggagtggaagccaccgcgccatggccgcgtcgtccaagaagagcaccaagcaggtcgtcgtcgcgg

SEQ ID NO: 57016 - DNA, 3619 bp, Oryza sativa
gcgcccaccgcgccgccacctcctcctccggcggcggcggcggccaccacgcctccctccgtggcctctccggttgctacgagtgccgcgccatcaacgtcgagcccatgtcaaggtctcctcctaatccgattaattacttaattaagctcataattaacttgattagcgaataataatctggtgttaattaggaggtatccgaggccacgggagctgtgcgcatgctcgcagtgtggggaggtgttcaacaaggccgacagcttggagcaccaccaagccattcgccatgctggtaattaactaaattttgatgaaaatttctacaaatttcatcaactttacataaaccgtaaacgatattgatatcaaccatctccattctaacgaaaaatgacaaactgaggttcatgttgtgtgaatagtagtcaatgcttttggggtgtagaacaagttaagatagtactcctagctaatccaagttagtaacactaatgaggaggcattgagatctgcgtgtgtgggtactatatattgcccagtcaatatgattggtttactcatgacaaaatgatgatggatatttccacatagacaccaatattgtgataattattattataatcttagtggagtgacagtgttattagtttactagtttcttggcacatcaaaccatgtgagatgagatgagatgagaggagaggagacaaacagaaaggagaaggaagatgctgctcatcaaagctattaaccccatctttcttttcctcttttcctttgtcttttgtgggttacaaggaagctactgtcttgtgcacattaatcatctttggttaattattttagttaagattggatggcaaaaatacatcaaaaggtatctgtgcctagccatcttttgcatgcttgcagtcgcatctgcatctccatttgttgaaggtagatgggtagaagctttctgactactgatggcatctcaatgcatgtaggatactgcatgcacatgattagttattataaagatcattaattaacagcaatgacagtacagtgcctgattaagacaatgcaccagaagcaatagaatcaatgtaggagtactagaaagaactgcagagtgagatcccagtgcttctacaactacagtagttgggcaaagtatccatccaatctgccaatttattatattagttggtagcacacaggatctgcatgcacttttgtgtaccctcacaaacacgaacacactcacaatttgtgaaattagtactctgaaaggaacacaaagtttcagattgttcaggtgtcgtttactccttcggttccattttaagtgtagttatgagtttcgatatccaatatttaactgtttgtcttattttaaaaaaaatataaaaaaattaaaaaaataagtcatgcataaagtaatattcatgttttatcatctaatatcaataaaagtactaataataaaaaaaaactttcaaataagaaggacaatcaaatgttggacgaaaaaactcaaaactgcacttaaaatgagacagagggagtacttgcttgtcctttgatgcctttattttttttatgaagtttctagggcagctatagctccttatagaatttctcagctttcgaaacacatcagattttcacccaagtttaagaatatatagttatagaattcagaaaataaattaaacaccagaagccaggaatcaaactttaaattctcaatagcttgctactcccctcgttcgatatttgtttagaaaatgatcttttttctggtacgaacaagctacttagcagaatctcaagcttccaaatagatgcagaacatgcatagctgattatacagctttaaactgccatgggccatggcagccactaaggttagttaagtgatcgatgtgcttgcatgaacatgtacatcatcctcttgaactgtttaggtcaattgaagtgtcctatcacatgacagtgctgcactatttgcaatgccattattgttgttgatgcggccgagatgaagtactgatctcctgaatttcagtgccttgattgcacactgtctgctatgataactgtgagcttagcttgcacatgctgatgcactcactgcatttaatgcacttagctagctagctgtgcgtggttaatctctccactaattacattacattacggtagatccaattaattagcttgctccctggaggattagcgagtgattaattttggagtgcatgcaatgcatatgcagtgtcggagctggggccggaggactcggggcgaaacatcgtggagataatcttcaagtcgagctggcagaagcgcgaccgtccgatctgccagatcgaccgcatcctcaaggtgcacaacgcggcgcgcaccgtggcgcgcttcgaggcctaccgcgacgccgtccgcacccgctgccgcgccaccgccgcccgcgccgccgccgacggcaacgagctcctccgcttccaccccgccgccctcgcctgcccgctcggcctcaacggcgccacctcgctctgcgacgacgacgacgcctgcggcgtgtgcgcggcgatccggcacgggttcgcgccgtgggcgggcgcgcacccgctcggcgtgcgcaccacggcgagcagcggcgcgcgcacgactgcggcgcggcggcggcggcggcgcagcaggcgggcgggtgccgggcaatgctggtgtgccgcgtaatcgccggccgtgtccgccggaacgacgacgatggcggtgcggaggaggaggagggagcgttcgactcggtggccggcgacgaggcggcgagcagcgtgtacggcaacctggaggagctgttcgtggcgaacccaagggccatactgccgtgcttcgtcgtcatctaccgtgttgtccccgagtgaagcagcaaacaacactcaaaatcaattaattgtatcaaccttttgtattagcataatcgtccagcaatttcaacatcatataaatgtataaattaaatgcattttgagggagagatgaacttaatttttgtctagttgctgttccagtgtagtatctgtttgtattgtagtgttgtatatatggacaaataattaagccacttgattagacaaatcttcgatctacacgcttcttcaactaatcattcattcaggttgatgcttcttcattcgatgtacgtttaatcatagattcatactatgtcgtcgtattattccaatttgcaactattatttgccaagatacgtatacgtaatccaataccatttgacgcatcaactaattggtgaaggtataactttgacatcatatgttcatatgtacatgaaatttcttttgtgattgcattagttgggcaatgcacatcaccatcttgtttgcttaactagtcacttaacagtattggtggacctagcttagcttcttctcaactgtgatgcatgatcagatcaatcagacatgtatccatggattcatgcagatcgagagacagatagaatctcacctttgcaagatgtgatgcatgcatgcatatatggatgtgggtacgtttgctgctaacttttgaccaaattttatcatctgtcatatgttaaaaaagtca

SEQ ID NO: 57017 - DNA, 16586 bp, Oryza sativa
  unsure (1)..(16586): unsure at all n locations
aattcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaacatgtaggctgcaccctgcattttctttcataagtgatggttgatgcaatgcaaatcctagtcttgctaggagattacaggaaagctaggtgatctgatctgagcaaattcgcacagttttgccagccatttgttgcattagttagagatccatctgatccatatacgcattacgattaattgtgttacagaacgtatttaaaaatactgatcgatgcatgtgtcctactagtatatatgtacggcaagacaaaagcatgcaggatcatgagttggacaaggagcaggtgaaccgacattatttacctttttctttgcgggtgggccccacgcagcagcctatgttgctcgctgagctgttaaatttacattgtgtgtccaatgccattgttaaacatctacttccttcgtcccaaaataaaacaacttttatatatatatatatatacacaaattcatgcataaatgttaatttgtttaagtttggaaaggaataccctcaaaaaagtttagaaaggattgagaagatcgctagagtaaaatgcaaacatgagagtgcagcgagattatacaaattatatatggtggtactattgaataaactttttgttgtaattgttaaacttccatgtggaactataaagattgctttgggaaaaaaatgcgaatattaggaaggaccaaatatcaaataaatagaagggatgagtcttcgaactcaggccggctagctcaccaccatgtggagctggccggagtacccctgggcttttctctaaagattgctttggttctaaagataaatgcagaaatgtatgaaataagctctttttatgttttctaaagaagagggaaataatatcatatcattggttaaaaaatgttaagagacacaaagaaaaataaataagattagctagaatcggaataattaacatatcataattgtagttctattttagaagagagaaggaacctcacactattgtgtaacaaaactgtataatataacaagcccccttgagtaatatttaacaaatacagcatgtataccaactcaaaagaggacatgtgtataattaatataacatgatatatatagttgaagacaccatcagaaatgctaagcctagatatatactactctagctaggctctagctagctcatatatatcaattaatataaaaatattatattaaagatatatagttaatttgcaagcatatgcatgacgcaaatggcacgtttaattaatactatttgtcaaaactgcatcaagtggaaacaatagtgcacatgattccatttgaaacttagccatgtcttcatgtttggcagtgctaaccgagaacacaacaatgcatcttctacatatttcacctaataattaacacactgacaacttcatgaagctttcaccgaaaatatttgagatagatcacgtgtcacaggccggctcaataacatggtacaacttagattgggagtataattaaaatgggcatagctaggaaggcaacagcatagaacattgacaacataatgatcatgcatgtattaagacattgacccactctggcaaaatctagtctaataaaaaactcacaaggttaattagaacattcagagatggatctcatcatgtcctgatggtatacttgtaaatgcaagtcgctttaatcatacaaggatggattttaaaaaaataaactcttccaaaacttatttctaaacatgaaccttttggcatggcgagacaacaataccatgtgcaacccatcatggcgtgacagtgttgtttcacctaagtggggtggtgtgaccaaaaggtttggattggaaataagttttggaatagtttacttttgaaatgaaaaaataaaaggttcaaaagaaataataaagaatcaaaaggatgtgataagaaaataactcaaatcaattaattagttgctctttatttatgctacattgaaagaaatgagttttttttaaaggaaaacaaataaaacagatgaaaatgtgttataaatttagggaagaatttaaaagcaaagatgacgacttattttcagttagcaactactccactatagctctaggtgaattggagagctactagctagggatctttgacttttgccttctgtttggttaatttcaactttcaagtatcatcattgcgggacgttgactttctaatcctagtgagcaatcaaactttgataatcgtgtcacattaactaaatgagacccatttaagtttaacaaacaagcgttttgacatagtaaagtaattgctgattatcaatggcaaccccttctcatgtaacatccacgattttcagagctcaaggatttgtctcagcaagggatggcaattgtggagattatgggtatcccatatctacacggcgatggtattcgaactgggtacaggatacctaatgtagatagaatatcttatctgtatctcgggtttgtttcttaacttgtgtatcaaggaaacaccctgagacttagtcggttacgactgtatcttacttatattttcgtattccgttagggatatagattatcttttgtaacccggactccttccccatatataaggggggtccgggcgcctctaggggcatatgctgatttttcccgaatcatacaatcaataatacactcggcggattcatccccggacaggagtagggtattacttcttttataagaaggcctgaacctgtataaatcttttgtctccaaacccatacactttcctagcttgatagccacccccttttattattgccgaaatctagtttcgacagttggcgcgccaggtaggggtagcgtcaagcttttcgccgatcagtgcaatgggttccgtctccggcatagacgacctcgtcttctcacccgggcagacgtttcggttcggtagcctcgacttcatcaccaacaacttcggcaagatttctctcctcgactcggaatcagaccagtcgggagagaaccggctttcggtcccgtttggattcccgaacgcggctgaaagctacttcaagaccatctcaaccgagtcggcttcagaccactcggccgagatcgcatcttctccaacgataccagatcaagatgatggggcttacccaccggtcctgatgaagctccccgacgatttagcggccgtcttcaccacgacagcgtcttcatcccgtaggcctaggcggaagtcggcttcaacaccgatttcgcctagcttcagggaagtcggcgtcatcctccaaccactcggcacggtttcgacagatcagctggatgactacaacagctctcccaccgtcgactcacgtcctactgacatcgtggagtacgacgaatttagttctcgatacaacgacttcaacgacttcgacgacttcgacggaagcctagatgacaactacacccctctctactttggcgttttcatggccaataatgagacggaggagcaacgccaagcccgggagaccgaggaacgacgccgactggaggaggagcatcaagcacaagaacaagaacggctacggcgcgagcagcaggaccgtgagcggactgcgaaggaggctgaagatcgacgtcagcgagctttggaagcagggcgccgagcgcgtgatctcatcggccagcaagatgtcgaagggacaccggttttccgcacccctcaacagaatgcggttgccgcgatcacccttctcgacaccctcctcaaccaaaacgagctcaatcaatccgaccacgtcgtcaacatcttgaatcagacgaagaccatgattgcggcgacggtcccagttaactccgaaagcgtccacacgccgactggcagccgggtcccccacttccgatctcatgactaccgtcatccaagcctcagcatcactggagcaggatccaatcgcaggagcaggggccacgacgagcggtctgttcactcgcctcccgaacttcatagggagcgccgagtggaacggcctcgctcaccacctcgtcgccgccccatcgatcttcgcgacacaatcatacagcgccgagcagctcgaggctaccatcactcgccggatcgccgcgacgacgaccttgacggagttgcagccttcaccgacgacctgcgtcgagtggattggccagccggcttcaaaccgactggaatagagaagtacgacggtaccactaatccagaatcgtggcttaccgtctacggtctcgcaatccgcgcagcaggaggagataacaaggccatggcgaactatttaccggtggctttagcagattccgcccgatcttggctccatggattgccccgtggtacaattggatcttgggccgaactacgcgaccacttcatcgccaacttccaaggcaccttcgagcgtcccggcacacaatatgatctctacaacgtcattcagaagtccggagaatcccttcgggattacatccggcgattttctgaacaacgtaacaagatctccgacatcaccgacgacgtcatcatcgccgcgttcaccaaagggattcgccacgaagaactagtcggcaagtttgggcgtaagcctcccaggacagtcaagctcatgtttgaaaaagccaacgagtacgccaaagccgaagatgccgtcaccgcatcgaagcagtcgggtcccagttggaggccgaaaaatacgccggctacgggaggaggtggaagtaacaatcataaggaccgcaagcgtaagcctgaggaacttgttgcaaccgccgctcactcttctcgacagcgttcgcgcgtcaacaccttcgacaagatcatgaactcccaatgcccgcatcatccaaactccaaccacgtggccaaagagtgcttcatctacaagcagttcgcggagcagtacaccaagactgcacggaagaactctgacgaagaacaaagcacgtcgaggaagaaggacgacggcgacaccccggcaggttttcaagatcaccgtaaggagctcaaccatatcttcggcggccccctggcttatgagtctaaacggaagcagaagttgactgaacgggagatcaatgctgttcagcccgacacaccccagtatcttcgatggtcagagattgcaatcaagtttgaccgctcggatcatcctgaccgagtggtccacccggggcggtaccccctggtactagacccagtggtccgtaatgtcaagcttcgcagaaccctcattgatggtggcagtgcactcaatatcctcttcgccaagactttggatgatatgcagatccctcgctccgagttaaaaccaagcaatgcgccttttcatggagtaattccaggattatccgcaactccactcggccagatcactctcccggtcacttttggcactcgggaaaacttccgcacagagaatatcagctttgaagttgccgatttcgagacagcataccatgccatactcggacgcccggcgttagccaagttcatggccgtcccgcactacacatacatgatgatgaagatgcctggtccccgaggagtcctaaccctacggagcgacatcaagcaagctgtcacatgcgacaaggagagttgcgacatggcccaaacccgcgagatggcgtctgcccgagaggaaatccgactggctgcaaccacggtgagcgaaggagaagtgcccgctgccaagatttcaaaaagtggggaaaccgaagccgagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggaattgaccaagctgttagcagcaggcttcatcaaagaagtccttcatcccgactggctggctaacccagtcctggttcggaaaaagacagggcaatggcgcatgtgtgtcgattacactgaccttaacaaatcttgcccaaaagatcctttcgggttgcctcgcattgaccaggtagttgactcaaccgccggctgcgagcttctcagttttctggattgctactcggggtatcatcagatccgactgaaggaatccgactgcttgaagacttcattcatcacgccctttggggcatactgctacgtcaccatgccgtttggattaaaaaacgcaggagcaacttatcaacgtatgatccaaagatgcttctcaacgcagatcggccgcaacgttgaagcctatgtggatgatgtagtcgtcaagaccaagcaaaaggatgatttgatctcggatctagaagaaacctttgcaagcatccgtgctttcaggatgaaattgaatcctgaaaagtgcaccttcggagtaccgtcagggaagctgcttggttttatggtgtctcataggggcatccaagccaacccggagaaagttactgctatcctcaacatgaaaccgccaagcacccagaaagatgttcagaagctgactggatgcatggcggcgctcagccgatttgtttcaagacttggcgagcgggggatgcccttctttaagctactgaagaaaacagataatttccagtggggacccgaagcacagaaggccttcgaagatttcaagaaactcctcaccgaaccaccagtcctagcttcaccacatccgcaggagccgttgttgctgtatgtatcagccacctcccaggttgtgagctcagtcttggtcgttgagcgcgaggaagaaggccatgtccagaaagtccagcgaccgatttactttgtcagcgaagtcctagccgactccaaaacgaggtaccctcaggttcagaagctgttatatggtattttaatcactaccaggaagctatctcactactttcaaggtcactcggtaacggtggtccatcatttccactcggtgatatactgcacaaccgcgaagcaaacggacggattgcaaagtgggctttggagttgatgtctttggacatatcattcaagccccgaatttcaatcaagtcccaagcgttagctgattttgtcgccgaatggaccgagtgccaggaggatacccccgcggagaagatggagcactggaccatgcattttgacgggtcaaaaagactttcgggcactggagcaggagtggttctaatttcaccaactggagaaagattaagctatgtactttggatacatttttcggcgtcccacaacgtcgccgagtatgaggccctccttcatgggctccggattgcaatttccctagggataaagcgtctaatagttcgaggcgattcacagttggttgtcaaccaagttatgaaagagtggtcctgccttgacgacaacatgatggcatatcgacaggaggtacgcaaattagaagacaagttcgatggactcgagctcagtcatgttcttcgacacaacaatgaagctgccgatagacttgcgaactttggatccaagcgcgaggcagcgccatctgatgttttcgtcgaacacctttattcgccgacagtacctcacaaagatgctactcaagttgcggacactcatgacatagctatggttgaagccgactggcgagagcccctcatacgatttttgacttctcaagaactccctcaagacaaagatgaggccgagcggatttcaaggcggagcaaactttatgttatgcatgaatccgagctatacaagagaagcccttcaggaattctgcaacgctgcgtatctttagaggaagggagacaattgctgaaagacatacattctgggatatgcggaaaccatgctgcagcgcgcaccattgttggcaaagcttaccggcagggttttttctggcctactgcagtgtccgacgccgacaaaattgtgcgcacatgtgaaggttgccaattttttgccagacaaattcatctaccagctcaagagttgcagactatcccgctgtcttggccgtttgcggtttgggggctcgacatggttggcccgtttaaaaaggcagtcggcggttacacgcacctcttcgtggccattgacaaattttccaagtggatcgaagctaagcctgttgtcacgattacagcagataatgctcgcgatttcttcatcaacattgtgcacagattcggagtacccaatcggatcatcaccgataatggcacacaattcaccggcggagttttcaaagacttttgtgaagactttggaatcaagatttgctatgcctcagttgcacacccaatgagcaatggacaggtggagcgagctaatggcatgatacttcaagggattaaagcgcgtgtctttgaccggctaaaaccctatgccggcaaatgggtgcaacaactgccatcggtactttggtccttacgaactactcccagtcgggccacaggccagtcaccttttttccttgtctacggggcagaggcaatgttgccgagtgaagtcgaatttgagtctttgcgctttcgtaatttccgtgaagaacgctacgaagaagatcgagtggatgacttgcaccgattggaagaggtccgcgaagcagctttaattcagtcagctcggtacttacaagggttgcgacgttatcataatcgcaatgttcgatctcgtgcctttctagtcggcgacctggttttacggaaaattcaaaccacgcgagatcggcacaagttatctcctctatgggaagggccatttattatctctgaagttacccggccaggttcatatcgactcaagcgcgaagacggcactctcgtcgacaactcttggaacattgaacatcttcgtcgtttctacgcttaactttatcattatattttcctattttgactgtcaaacatcaagttttctccttgaagttgtcagtcgggggctatcatcataataatggagtgtgattttttatcaattcagtttgcttacctggtttatcattgccttgtttggtttttctacttagtttgcgaggactgaaagtttttaatagcttctttgggttttaggctcaacaaagcttagcaaaaacttttaagaaatcaaaaaacttcgcaagaatcatcaagcacagcataaatacaccagtattgtacaaattgagcctccatgtattacattcaaactcagtcagaatcagtcctttcatcatcagagtcttcattactcggttggaggtcgttgttgcgaaattgctctacaacatcactcgcaattttgtcagctgcattttgcgcactgctgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatatacttccggagcaacactcagcttgtcaaatatttcggttgcgtcgagtgcactcggaccaccattattgaggaacatggcttggataattggtgcagcggcattggcgacgttatcccttgctccttcaagcctcttgatcttaccaaccaggacgtcaaactgagcttgagatttgatcttgcgatctgcaaaacacatttatgatgagcatctgttgcattataaggagagaagctcagattgttagctggcgttaccttcgacttccttcaaggatgagtccctttgcgcagccagttctgtcttgtctctctccagggcttcaatttgcttcgccatctgttccatcctggcggcttgcgctgtttgaaatccagatggttgaggatgcaattatgacagcataaatcaatggaacagatctggatgattaccttttgatgaaccacttagttcgaagtttgcgtcctggagctgggcgattcggtcccttaactctttctctgtttttttggcgcactccttggcctcatgcagctggtccctaactgcttctagagttcccaaatgaggaaccagcttttccaaagttgtagtcttggcctcattgcgaagatggattctctgcatgatggatcagggttcagttctgctaaaaagaaaacaaagttaccgaaggacgtcactcggaagacttacatttacaatacgagtggcttctccgagcgctttcttcagctggcacacttcttcatcttctttttgacggtttatgactatgccggcggcttgtgagttctcgtcccaccatttgatcaagataggaggacgagagtcgtcggtcgcctttatgcgagggatttcttctccgtcatcacctgatggtcctgatgtgtttccaagacattagacggatacactgaggttatttaaatcgccattgtttgagaagacaactaacctgaagatgtacctagctgagcgtgaggtgatctttgttctttacctgaagacccagctatcgagtcgttaccagcttctggtccttgcgaagtcgtcgtctgcgcttctacttcggggatctcttgatcagggcctgcgtccgactggtttccagtcgggggctcttgagttgttgccgtttcagttgttgccgactggtttccagtcggcggcaggtcactcggattggccctatcgcccgaagcatgggcgccagtcggctggctttcagcgatcggctggttttcagcagtcggctcggggtccttggatatattttgctctgtcatggcaggatcggggtcttttccagatggatctatatcagatggtttcctgcagagtgttctttcagtatttagcattatcttcatcggaaaacatgccgaagcggaaatcataccgagagatctaatacctggaagatgttctgatctttggcattgcacggccagccagttttttcctgggcatggtgcgctttgggggtttattaggcgagcccttatccccagatttatcatcgtcgccttcatcatcatcaagtaccagctttctcttgcgaggacctgtttgaccagtcaatttggaggtctgaggttgcggatctggtctgatcgttggccctccacctccctgagcggtgtgttggcgaggagaccggcgctgagtgactggtggatctgacttcatcaatgcatattcctgaacaagatgcttccatagttagtcaactcagcatgaagataaaattatgttctgatcacggtttgagggtttccgatgcatacctgtggaggcggattgaatgcattatatggcacaactggcagttgatgagagtagctgaccacaattgcatttgagaagattttatacatcctctccttcatgattttgaaatccagggaatccggttcttcacggttgggatcatgtttgccgtcgaactcgaatgctgtgcgggatctttccttgattggcgccagtcggcatttgatgaagtgccgagtgatctgctctccctgtaagccttgttctttaagatttaacatacgatccaacaactccaaggcttgtactgcttcatctccgattggaagagagttccaagtatcttggtacactggaggaagacaagagtacccgggaagagcaggctcgggattctgaacatagaaccagtttgcatgccatcctttgttcgaagtcttgaagggcatcgagaaatatttttggctcagagttccccttagttggaatcctgcccccccgactacacacggtttgttcttgtttggttggggcttgaggaagaagatccggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgctccaccatctccttaagattctcctccgttacgtcggatgacgcccattggccttcgaagctttctctctcttccgccatcggtttcactcaaatgtgctgatttgattcgagggatggcttgggagaggtgagggattgaggcggtggatcacgggaaggattttgatgcacttttcggaggtggatttggccggagttgtgaaccctagttcgccggcgcagctttgcactgtagcagggagtggggaaaatggcgagagttccggcggggaagacgaagcgccgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatcaaatcctttttatgcggtcatataattctttggaattattgcaatgcaaattaaaaaggtgcccgacagaaaggcgttatgctgtttttgcaagcttttttaggctacaaaagctgtttgggttaactaggaatgacttgtttttattatagttatttccttggcgtgttatatgcctgttttcatggtaaatagtcatggcctaggctatttgacttatttattaccataatctttataatacttgatgggtaatctttagagtttttatattcggatgcctgtcgagtgtgttcattcgtgaaccttttagagtgtaaaccactcggatttcttttattgtggttaaaaagcagtcggctagcatgcttatttaggcaccgcgtacgcttttgtcatataatgcacaattgtgttattattttgtctttcaactatatgtttagtttgttaactaatcacatagttgggggctacacctaattaggtgcatctattcgatgcaccatattctttatcttttcgccctttacagtccactcggcaggttttggcttgaagagtttgaagtactcggattatcatctttgagagggctacgatggtcgactgcaaaggactcgggggctactgtggagattatgggtatcccatatctacacggcgatggtattcgaactgggtacaggatacctaatgtagatagaatatcttatctgtatttcgggtttgtttcttaacttgtgtatcaaggaaacaccctgagacttagtcggttacgactgtatcttacttatattttcgtattccgttagggatatagattatcttttgtaacccggactccttccccatatataaggggggtccgggcgcctctaggggcatatgctgatttttcccgaatcatacaatcaataatacactcggcggattcatccccggataggagtagggtattacttcttttataagaaggcctgaacctgtataaatcttttgtctccaaacccatacactttcctagcttgatagccacccccttttattattgccgaaatctagtttcgacagcaatttcccccgtggggccgggtcccctacgggggcgggggcgggttcagtttttgacccgcgggggatgtggggccgggggcccgcatttttgtggggaggggacaggtgaggcatttcacccgtggggtgccgaagggtgtatattaaatctcaaaatgtaacccatagaagatctaaaagagccacaaaattttaagtaatagccttatcctctccactctccccatctcccctcccctcactctcactccatattaacttggagcgtcacaggctagttccggtcgggactagttcggggcgtgacattttttttatctattcgattgatttttctggtaggttgatttttcacatggaaacttttttttgggtgggtaattttttaaggcaacatggatttttcacgtgatggaagaagtgtgatggtgggagaagaggagaacgacgaccgcttttacagttgaaaagaaaagatgggaactgttttaatcacccggatggatgtccatccatttattacatgtcatttaaatggttatgaaaaaaatttaaaaacaattaacaagatagatcaatacgtaatatatcacttcacaaatattaaagttaaaattcaacttctacaaattgtaagaaaaataacaaacaaaactcaaattactatacgtatatttatagttaaatttgttatttttcttacaattggtagaagttgaaatttaaacttgcaagtttgtggaatgatatattacatattaatctatattattattatttttgaattttttaataaccatttagttgacatgcaataaacaggtggcgtctacagaatccatctcaaaaaagaggaatttatgttgttccatcaatattgggccacatttaggacaactctcttgaaaccggtgaagcaagcacagttaggctcttaattccgtggcccttgcctacgtttgtcgagcaaacggccggtttggcccattagcatgcccaggagacgaggaaaaaagagaacttatctgctaggctaacattatcaatttttggatatatatatatatatatatatattaaaatgcaacatacatgttatacatattgtgaaccaatctactcctaattatcttttctccctatagtaagcattcatttagttaaggttagatacattttgcagcacgaatcttgaaacacatcaacggtgtagattgtaggtacatatgaatccgagtgcaaatctgcattttcatatatatatatatatatatatatatatatatatatatatatatatatatatggaagggcaattgtattctttcccctattttaatttgtagatatgagttttgtaaaatatgttctttttgcttttttaaaccgaaactttgctcctagtctattggctatgtatatgagttcctaattcatctctctcgttttctgctctttcggcgcgcacgcttttcaaaccattaaatggtgtgtgttttgtaaaaagtttttataggaaagttgcttaaaaaaatcatattaatttatttttcaagttttttataacttaaacttaattaatcatgcgttaatctatcgctccgttttccgttttgagttaatcagcctagtcgtttcaatggcgttgcaatttccctctacttttgtataaaacagctgtgctgttgttcatttgtggcatatgtgtacttctgaatgcagcggtactaacatatgccatgacacaagggatcctctccaaactaaacaaatcaacttaaagctcatatgcacttcaatacccaatatttcatgagcatagaccttgtatacgtcaagaagggaaaaagaaccgaaaacataaccaaaaaatcatataatccccaaatcaacgcatgtaacacaatataaaaaaccattttagacaacacccactattacaggcggacttaaaaaaatatacttgtaaaaatatattaagtgtttttttacagctagctcgcatgcaaaaaaaatcaaatttttatataggtggccctcaggtcttaggttttcgtccgcaaaaatcatatctgtgtaggcaaactgttaggagcaccgcctgaaaaattgacaaccgaccacttgctaccgcactaaaaagctactatggctgtgttcgggaggtgaggttgagaattcaccttccgcgcacgcaaaatggagcgatgtattttcttacgattaattaggtatttactattttttttgaaaaatagattaatatgattctttaaagcaactttcgtatagaaactttttgcaaaatacatattgtttagcggtttgaaaagcgtacacgcggaacacgatggaggtgagttgggaaaaatgggggaagaacacaacctaagtcttaaactctcctccacggctcctctatcgagaaccactcattctctccctctcctatcttctctgtctcactagatccacacacgagctctccttatccttcacttgccaccgtttctcctcgtgtagaagcaaccacacggcttgccttggcttggcaacggcgacttcgaacacatggcattggatgagcagtgaaggggaaggggtgggtcggcattatcgaacgagggccagagcttgggaccagcgacaacaatggcgactgcggcaaggacagggtggtggtggcaaataatgggctgagctcaggatctgtggtgaacgaacatctatgtgggttgtttacaacaacgttgtggccctagatctg

SEQ ID NO: 57018 - DNA, 3244 bp, Oryza sativa
tgcaagaggacagtgagaaggctagatccagctgctgggaccccgtgaactccggtggtggtggaacctccctggcttattagggatagcgacaccaacttcaacgtcgaccacatgattttcgcatgccttataattgtaagcggggcggatgggcgcccatgaaaaatcatttttttctgcctgcgaatacccatcttgtactggtgctagattagcaaacctgttttttcctttttttttttggggggggggggggttgaactatggtggcttaggtagcctacatgccaatcaaagttttaaatttagtttaactccaagggagaatgtattctatcgaatttagaaaaaaatgtcaaaattcatggttatttaattgtttgtggaattatgtttgaaattttgtaatttaagttaccccgaaatgtttatgcattatgagatagttaaccctatactccctccggttctatattaattgacgttttgaataaggttgaggccaaacttttataactttgaccatcaataactttaaaaatatttaatttaaagaaaattgaataacatatataaatttttctttcaaagcactataataaaagtaaacacgcatttatttattgtatatattataatagaaaaataagatcaaagatatatcttgtagaccgtatcattgtccaaaacgtcaactaaaatgaaactgagggagtatagggtatcacattctaaccttggggttaacaagacacagttgcttttgtatcctggattgacgacgtacatcccttttgctttatcttttgctttttgcactttaatcaaggaggcgaagcaaagaatccgacgattagccaactactaactccaaattatctatagccaatttaatagtcgatttatacaacaattatttacaatactattaatatgtgatcccacctgtcatagaagcatatattatgtcttgaagtccgtgctacagcttctacagatctgtagcccactgcttctctctacttttttatctctttaaaatatatatgtttatagctggcttacagtctgctattgtacctcctctcagatctgagatgcattcatcctctcagatgatgcattcaggtacagcttaggacgtacatatagcatatcgatttgcggctttgcagcaaatgcaaagcaaagaaaaatactaaagcaaacatatcgatcgtacgcaaggaataatagatcgacgaaggcttctagacgacagtacgtttttacaaggcttctgctagctctagcccagaacatcgatctatcgatcatattgcatccagtttgatcgtttcaatttatgctcgccctcgcaccaacaatggcttagctaatccccatgtactcgatctctgtcggcaaacatcgtgattaaggtaaactagctacatcatatcgtgcagtttaattgcgctctctctctctccccctatgtgtgtgtgttgatgcatcaggagtgggctggagaaatcgatccatcaggcatctatatatcatgggttaattaattacagggcttgcttcaacatatatatgtattctctgctgtcgatccatttctaattaaggagcgtttaatcaactgaaagaagatcgattgagattatatgatcgatgaagctgcccgcaattcaacactaattgaagagagccgggctacgcagatcaactcaacatgccaccagcgaaggaggtaattaaatcagatcggtgatattgtttttatttttgaatgaaagttatttcacgaccacgcacgtgaattaaacaagacactttactgctattttagatttccaatttggacgcaattttttgaaacacgctttcattgtcatatttggctttagaagtgtttttttttctaacatctcatttgcaaacaatcctctcggagcaaacttcttctatttgtggaagaaataaattgcaaaaaggataattttaccaaccttagaacataacatgaggtaccatattttatactataaattttggcacatcaagtattatgtatctcaatgtataaaagaaataattttagtgtaaacttttgataataacaagtaattggtcaagaaccgtaaaatttctcacactccacctgttcaaaattcaatgctatgtttggctagttgcagagagaaaaaatattgtcgaaactagatttcggcaataataaaagggggtggctatcaagctaggaaagtgtatgggtttggagaccaaggatttatacaggttcaggccttcttataaaagaagtaataccctactcctgtccggggatgaatccgccgagtgtattattgattgtatgatttagggaaaatcaacctctgcccctagaggcgcccggaccccccttatatatgggaaggagtccgggttacaaaagataatcaatatccctaacggaatacacagatatagattaaatacagccgtgaccgactaagtctcaaggtgtttccttgttgtacaagttaagaaacaaacccgagatacaaataagatattccatacatattcggtatcctatatccagcccaaatagtatcgccgtgtagatatgggatatccataatctccacagtagcccccgagacctttgcagtcaaccatcgtagccttctcaaagatagcaatccgagtgcttcagattattcatgccaaggcccaccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcactaccacgcatcagatggcaaaagcatacgcggcgcctaaagagacattctagccgactgctttttagccataacaaaaagagtccgagtggtttacactctaaaaggttcacgaatgaacacactggacaggcatccgagtataaaactctaaagatcacccaccaagtattataaaaaattatggtaatgaataagtctaatagcctaggctatgactatttaccataatgaaaataggtatataacataccaaggaagtgactatgataaaaacaagtcattccagattaacccagacagcttttgtagcctaataaagctaacaaaaaagcggtataacacctttctgtcgggcaccttttaatttgca

SEQ ID NO: 57019 - DNA, 3631 bp, Oryza sativa
actgttcaggcctaggcccatttgcacctccgatacccttaacaagaaatccgagatccaagcgacgcttcgtcttccccgccggaactctcgccattttccccactccttgctacagtgcagaactgcgccggcgaactagggttcaccaatccacccaaatccaccttcaaaaagtgatcaaattccttcccgtgatccaccgcctcaattcctcacctctcccaagccatccctcgaatcaaatcagcgcatttgaggaaactcgatggcggaagagagagaaagcttcgaaagccaatgggcgccgtctgacgtaacggaagagaacctgaaggagatggtggcgcacggcgttctccctgctaaggagatcatcgggtggcggccagcgtacggtgagatttttccgacccccgatacacacgagattgtggtcttctcgcatttcttctacggcggcttcgctcttccgacctcgaaatttttccgcgggatcttgaacttctatggaatcagcttgcatcacctaaacccaaattccatagtgcacatcgccaatttcgtccatgtttgtgaagcctttttgggaatcaagcctcactttgccctgtttcgccggatcttcttcctcaaaccccaaccaaacaagagtaagccatgtgtagtcgggggggcaggattccagctgaggggaactctgagccaaaagtatttctctatgcccttcaagacttcaaacaaaggatggcatgcgaactggttttatgttcagaatcctaagcctgctcttcccgaatactcttgtcttcccccggtgtaccaagatacttggaactctcttccaatcggagatgaagctgcccaagccttggaattgttggatcgcatgttaaaactcaaagaacaaggcttgcaaggagagcagatcactcggcatttcattaaatgccgactggcgccaattaaagaaagatcccgtacagcttttgagtttgacggcaagcacgatcctaatcgcgaagaaccagactctctggatttcaaaatcatgaaggagagaatgtataaaatcttctcaaatgccattgtcgttagctactcacaccagctgccagttgtgccatataatgcattcaatccgcctccgcaggtatgtatctgaaatcatcaacttacgaccaaaatagtatcttgtcttcatgttgagttaactaaccatggaggcatctcattcaggattacgtattgatgaaatctgatcccccaattgctcagcgccgatctcctcgccagcacaccattcagggaagtggagggccgacaatcaggtcagacccacaacctcaaacctacaaaccggctggtcagacaggtcctcgcaagagaaaactggtgcttaatgacgatgagggcgatgacagcaacaaatctggggacaagggcacgcccaacaaactcccaaagcataccatgcccaggaaaaaactggctggccgtcaaatgccaaagattagaacatcttccaggtataaacttctcggtaccatcttgtttcggcatgcttcccttatagaaattatgctgagtatcgaaaggacgctttgcaggaaaccgtccgacatagatccaactggaaaagatcctgatccggctgtgacagagccaaatttatccaaagacactgagccgtctgccgaaaaccagccgactgccgaaagccagccggctggcgcccatgcttcggatgacaaagccgatccgagtgaccagccgccaactggagaccagtcggcaacagctgaaactgcaacaacacaagagcccccgactggaaaccagtcggatgtaggttccgatgaagaaatcccggaagttgaagcgcaaacgacaacttcccaagaaccagaggctggtaaggactcaatgattgggtctctaaataaagaacaaggaccacctcatgttcagccaggaacatcctcaggtaacacatcttctcaagtgatgccgatttaaataacttaagcttactcgtctaattgtcttggaaatacatcaggaacaataggcgatgacgaagaaataattcctcgcataaaggcggttgatgactcccgtcctcctatcttgctcaaatggtgggacgagaactcgcaagttgccggcatcgttataaatcgtcaaaaagaagatgaggaagtgtgccagctgaagaaagcacttggagaagccactcgcattgtgaatgtaaatcttccgggtgactgcctttaataactttgttctctctttagtagaactgaaccatgatccatcatgcagagaatccatcttcgcaatgaggctaagactacaactttggaaaagctggttcctcatttgggaactctagaagcagttagggaccagctgcatgaggccaaggagtgcgccaaaaagacagagaaggagttaagggaccgaattgcccagctccaggattcaaacttcgagctaagtggttcatcaaaaggtaatcatccagatctgttccattgatttatgctgtcataattgcatcctcaaacacttggatttcaaacagcgcaagccaccagaatggctcagatggagaaacagattgaagccttgaaaaaagacaaagcagagttggctgcagaaagggactcagccttgaaagaagttgaaggtactgccggctgatgatctgaactttcctctttttaatgcagtagattcttattataaatgtgttgtgtagaccgtaaaatcaagtctcaagctcaattggatgtcctggttggtaagatcaagaggcttgaaggagcaagagatgaagtcgccaatgtcgctgcaccactcatccaagctatgttcctcaataacagtggtccgagtgcactcgacgcaaccgaaatattcgacaagctgagtgttgctccggatgtatatttcaagaatatcaagaaagctggaagtatgggagctagcatggccttggcgatgacaaaatccttgtacccgagaattgaagttgacaccattgatggctttgcaaacgggacaagtgaagaagctgctcttgatcttatcagcagtgcacaaaatgcggctgacaaaattgcaagtgatgtcgtagagcaattccgcaacaacgacctccaaccgagtaacaatgactctgatgatgaaatgactgattctgactgatcatgaatgtaatgcatggaggctcaatttgtacaatactggtgtatttatgctgtgcttgatgattcttgccaagtttttgatttcttaaaagtttttgttaagctttgttgagcctaaaacccaaagaagctattaaaaaactttcagtcctcgcaaactgagtagaaaaaccaaacaaggcaatgataaaccaagtaagcaaactgaattgataaaaaatcacactccattattatgatgatagcccccgactgacagcggcaagaagaaaacttgatgttgacagtcaagatagggaaatacaatgataagcttaagcatagaaacgatgaagatgttcgatgttccaagagttgtcgacaagagtaccgtcttcgcgcttgagtcgataagaacctggccgggtgacttcaga

SEQ ID NO: 57020 - DNA, 21258 bp, Oryza sativa
accgatggcagctgttgtacccatttgccggcatagggttttagccggtcaaagacacgcgctttaatcccttgaagtatcatgccattagctcgctccacctgtccattgctcatggggtgtgccactgaggcgtagcaaatcttaattccaaagtcctcacaaaagtctttaaaaactccgccagtgaattgtgtgccattatcagtgattatccgattgggcactccaaatctatgcacaatgttgatgaagaagtctcgagcattatctgctgtgattgtgacaaccggtttagcttcaatccacttggagaatttgtcaatggccacaaagagatgcgtgtaaccgccgactgcctttttaaacgggccaaccatgtcaagcccccaaaccgcaaacggccaagacagcgggatagtctgcaactcttgagctggtagatgaatttgtctggcgaaaaattggcaaccttcgcacgtgcgcacaatcttgtcggcgtcggacactgcagtaggccagaaaaaaccctgccggtaagctttgccgacaatggtgcgtgcagcggcatggtttccgcaaatcccagaatgtatatctttcagcaattgtctcccttcctctaaagatacgcagcgttgcagaattcctgaagggcttttcttgtatagctcagattcatgcataacataaagtttgctccgccttgaaatccgctcggcttcatctttatcttgagggagttcttgagaaattaaaaatcgtatgaagggctctcgccagtcggcttcaaccatagccacgtcatgagtgtccgcatcttgaatagtatctttatgaggtacggtcggtgtgtaaaggtgttcgacgaaaacatctgagggcgccgtctcgcgctaggatccaaaattggcaagtctgtcggcggcttcattgttgtgtcgaagaacgtgactgagctcgagtccatcgaacttgtcttccaatttgcgcacctcttgtcgatatgccatcatattgtcgtcaaggcaggaccactctttcataacttggttgacaaccagctgtgaatcacctcgaactattagacgctttatccctagggaaattgcaatccgtagtccatgaaggagggcctcatactcggcgacattgtgggacgccgaaaaatgtatccaaagtacatagcttaatctttctccagttggggaaatcaaaaccactcctgctccggtgcccgaaagtcgtttggatccgtcaaaatgcatggtccaatgctccatgttctccgcgggggtatcctcctggcactcggtccattcggcgacaaaatcagctaacgcttgggacttgattgaaattcggggcttgaatgatatgtccaaagacatcaactccaaagcccacttagcaatacgtccgttcgcttcgcggttgtgcagtatatcaccgagtggaaatgatgtgaccaccgttaccgagtgaccttgaaagtagtgagatagcttcctggtagtaattagaataccatataacagcttttgaacctgagggtacctcgttttggagtcggctaggacctcgctgacaaagtaaatcggtcgctggactttctggacatggcctcttcctcgcgctcaacgaccaagactgtgctcacaacctgggaggtggctgatacgtacagtaacaacggctcctgcgggtgtggtgaggctaagactggcggctcggtgaggagttttttgaaatcttcgaaggccttctgtgcttcgggtccccaccggaaaccatctgttttcttcagtagcttaaagaagggcatcccccgctcgccaagtcttgaaacaaatcggatgagcgccgccatgcatccagtcagcttctgaacatctttctgggtacttggcggtttcatgttgaggatagcggtaactttctccgggttggcttggatgcccctatgagacaccataaaaccaagcagcttccctgacggtactccgaaggtgcacttttcagggttcaatttcatcctgaaagcacggatgctcgcaaaggtttcttctagatccgagatcaaatcatccttttgcttggtcttgacgactacatcatccacataggcttcaacgttgcggccgatctgcgttgagaagcatctttggatcatacgttgataagttgctcctgcgttttttagtccgaacggcatggtgacgtagcagtatgccccaaaaggcgtgatgaatgaagtcttcaagcagtcggattccttcagttggatctgatgataccccgagtagcagtccaaaaaactgagaagctcacagccggcggttgagtcaactacctggtcaatgcgaggcaacccaaaaggatctttggggcaagacttgttgaggtcggtataatcaacacacatgcgccattgccctgttttcttccgaactagaaccgggttcgccagccaatcgggatgaagaacttctttgatgaagcctgctgctaacagcttggttaattcctccttgattgcgtccttcctgtcttgtgcgaatcggcggagtcgttgtttgatcggcttggcatcttctttgacatgtaaggagtgctcaatcacctctctaggaataccgggcatatccgatggtttccacgcaaagatatctttattattctgaagaaaggtgatgagcgcgctttcctatttacaatctaactcggcccctattacagcagttttagtagagtcagagggatctaggggaatcttcttagtcttggcttcgctttctccactttttgaagtcttggtggcaggtatttctccttcgctcgccgtggccgcagccagtcggatgtcctctcgggcagacgccatctcgcgagtttgggccatgtcgcaactctccttgtcgcatgtgacggcttgcttgatgtcgctccgtagggatagcactcctcggggaccaggcatcttcatcatcatgtaagtgtagtgcgggacggccatgaacttggctaacgccgggcgtccgagtatggcatggtaagctgtctcgaaatcggcgacttcgaagctgatattctctgtgcgaaagttttcccgagtaccaaaagtgaccgggagggtgatctggccgagtggagttgcggataatcctggaattactccgtgaaaaggcgcattgcttggtttcagctcggagcgaggaatctgcatatcatccaaggtcttggcgaaaaggatgttgagtgcgctgccaccgtcaatgagggttctgcgaagcttgacattacggaccactgggtctagtaccagggggtaccgccccgggtggaccggtgatgctgaggcttggatgacggtagtcatgagatcggaagtgggggactcggctgccagtcggcgtgtggacgctttcggagttaactgggaccgaagccgcgatcatggtcttcgtctggttcaagatgttgacgacgtggtcggaacgatttagctcgctttggttgaggagggtgtcgagaagggtgatcgcggcaaccgcattctgttgaggggtgcggaaaaccggtgtcccttcgacgtcttgttgtccaatgagatcacgcgctcggcgccctgcttccaaagctcgctgacgtcgatcttcagcctccttggcgatccgctcacggtcctgctgctcacgccgtagccgttcttgttcttgtgcttgatgctcctcctccagtcggcgacgttcttcggtctcccgggcttggcgttgctcctccgtctcgttattggccatgaaaacgccaaagtagagaggggtgtagttgtcatctaggcttccgtcgaagtcgtcgagatccgggtcgtggtagcgagagctaaactcatcgtactccacgatgtcggtggggcgcgagtcgacggtgggagagctgtaatggtcatctagctgatccgtcgaaaccgtgccgagtggttggaggatgacgccgacttccctgaagctaggcgaaatcggtgttgaaaccgacttccgcctaggcctacgggatgaagacgctgtcgcggtggagacggccgctaaatcgtcggggagcttcatcaggactggtgggtaagccccatcatcttgatctggtgtcgttggagaagatgcgatctcagccgagtggtttgaagccgactcgattgagatggtcttgaagtaggtttcagccgcgtttgggaatccaaacgggactgagatccggttctctcccgactggtccgattccgagtcaaagagagaaatcttgccgaagttgtcggtgacgaagtcgaggctgccgaaccgaaacgtctgcccgggtgggaagacgaggtcgtcgatgccggagaaaggacccattgcactgatcggcgaaaagcttgacgcctcccctacctggcgcgctaactgtcgaaactagatttcggcaataataaaagggggtggctatcaagctaggaaagtgtatgggtttggagaccaaggatttatacaggttcaggccttcttataaaagaagtaataccctactcctgtccggggatgaatccgccgagtgtattattgattgtatgatttagggaaaatcaacctctgcccctagaggcgcccggaccccccttatatatgggaaggagtccgggttacaaaagataatcaatatccctaacggaatacacagatatagattaaatacagccgtgaccgactaagtctcaaggtgtttccttgttgtacaagttaagaaacaaacccgagatacaaataagatattccatacatattcggtatcctatatccagcccaaatagtatcgccgtgtagatatgggatatccataatctccacaaatatatatagtgtaattaataactttattcgtaacattatatatatgccggtttgcactctacctttttgtggtctattacactttattctattgtaattaataaatacaccaccgagaaaactgggcgtttctttagaattttatttgtgataaaagattttagtgtgtttgtttagctatgtgtcgaaactagatttcggcaataataaaagggggtggctatcaagctggaaaagtgtatgggtttgaagacaaaggatttatacaggttcaggccttcttattcaagaagtaataccctactcctgtccggggatgaatccgccgagtgtgttattgattgtatgatttagagaaaatcaacatatgcccctagaggcacccggaccccccttatatatgggaaggagtccgtgttacaaaagacaatctatatccctaacggaatatgtagatacagataaaatacagtcgtaaccgactaagtctcaaggtgtttccttgatgtacaagttgagaaacaaacccgagatacaaataagatattctatctatattcggtatcctatattcagtccaaatatcatcgccgtgtagatatgggatatccataatctccacagtagcccccgagacctttgcagtcaaccatcatagccttctcaaagataataatctgagtgcttcaaactttttatgccaaggcctgccgagtggcgaagacgaagactgtaaagggcgaaaagataaagaatatggtgcatcgaatagatgcacctaattaggtgtagcccccaactatgtgattagttaacaaactaaacatatagttgagaataaaataatagcacattcatgcatcatacgacaaaagcatacgcggcgcctaaagaggcattcttgccgactgctttttagccataataaaaggaatccgagtggttaacactcaaaaaggttcacgaatgaacacacttgacaggcatccgaataaaaactctaaagattacccaccaagtattatataaattatggtaacgaataagtctaatagcctaggctatgactattcaccataatgaaaacaggcatataacataccaaggaaaggactatggtaaaaacaagtcattccaagttaacccagacagcttttgtagcctaaaaaagcttacaaaaacagcataacgcctttctgtcgggcaccttttaatttgcatcgcaataattccaaagaattatatgaccgcgtaaaaggattctatcagcatcgggcaacactattgtgcgcataaattgccaaagcaaaaatgcctaagtccctaaggaacacaatgggccacgctgtcaaatgtattgggctgaggtactgttcaggcctaagcccatttgcacctccaatacccttaacaaaaaatcccgtgatccaagcgtcacttcgtcttccccgccggaactctcgccattttgcccactccctgctacagtacagagctgcgccggcaaactagggttcaccaatccactcgaatccaccttcgaaaagttcatcaaaatccttcccgtgctccaccgcctcaatccctcacctctccctagccatccctcgaatcaaatcagcgcattcgagtaaaatcgatggcggaagagaaagaaagctttgaaggccaatgggcgccatccgacgtgacggaggagaacctgaaggagatggtggcgcacggcgttctccctgccaaggagatcatcgggtggcggccagcgtgcggtgaggcttttccgtcccccgatacacacgaggttgtagttttctcccatttcttctatggcggctttgctcttccgacctcgaaatttttccgcgggatattaaacttctatgaaatcagcttgcatcacctaaacccaaattccatagtccacatcgccaatttcgtccatgtttgtgaagccttcttgggaattaaaccccacttcgctctgttccgccgaatcttttttcttaagccccagccgaacaagagtaagccgtgtgtagtcggaggggcaggatttcagctgagggggacgctgagccagaagtatttctccatgcccttcaagacctcaaacaaaggatggcatgcaaactggttttatgttcagaatcctgagcctgctcttcccgagtactcttgtcttcctccagtgtatcaagatacttggaactctcttccaatcggggatgaagctgcccaagccttgaagttgatggatcgcatgctaaaactcaaagaacaaggcttacagggagagcagattactcggcatttcatcaaatgccggttggcaccaattaaagaaagatcccgtacagcattcgagtttgacggcaagcatgaccccaatcgtgaagaaccagactctctggattttaaaatcatgaaggagagaatgtataaaatcttctcaaatgctattgtcgtcagctactcacatcagctgccagttgtgccatataacgcattcaatccgcctccgcaggtatgcatctgaaatcctcaacccatgatcaaaacataatcttatcttcatgttgagttaactaaccgtggaggcatcttattcaggaatatgtattgatgaaatctgatcccccaatcactcagcgccggtctcctcgccagcacaccgttcagggaagtggagggccaacaatcagaccagatccacaacctcaaacctccaatccgactggacagacaggttttcgcaagagaaaactggtgctcgacaacgatgaaggcgacgacaacaaatctggggacaagggctcgcctaataaactcccaaagcgtaccatgcccaagaaaaaactggctggccgtcaaatgccaaagattagaacatcttccaggtataaacctctcggtaccatctccctttgacatgcttctctcacagaaattacgctgaatatcgaaaggacactttgcaggaaaccatccgacatagatccaactggaaaagatcctgatccggctgcgacagagccaaatttatccaaagatgctgagccgactgccgaaagccagccgactgccgaaagccagccaactgccgaaagccagccgactggcgcccatgcttcggatgacaaggccaatccgagtgaccagccgccgactggaaaccagtcggcagcaactgaaactgcaacaacccaagagcccccgactggaaaccagtcggatgtaggtctaaatcaagagattcctgaagctgaagcgcaggcgacaacttctcaaggaccagaggctggtaatgactcggtgattgggtctccggataaagagcaaggatcacctcacgctcagctaggcacatcctcaggtaactcatcttttcaagtgatgccgttctgaataactccagcttgttcgtctaatgtcttgggaatacatcaggtccattaggcggcgacgaagaagaaattctccgcataaaggctgctaatgactctcgtcctcctatcttactcaaatggtgggacgagaactctcaagtttccggcatcgtcataaatcgccaaaaagaagatgaggaagtgtgccagctgaagaaagcacttggagaagctactcgcattgtgaatgtaagtcttccgggtgactgcctttgataactttgttctctcgttagcaaaactaatccatgaaccaccgtgcagagaatccatcttcgcaatgaggccaagaccacaaccttagaaaagttggttcctcatttgggaactcttgaagccgttaggggccagctacacgaggccaaggagcatgccaagaaaacggagaaagagttaagggaccgaatcgctcaactccaggattcaaactacgagctgagtggttcatcaaaaggtaatctctagatctgtcccattgattcaggccgtcataaccgtatcctcaaccatttggatttcaaacagcgcaagccgccaggatggctcaaatggagaagcaaattgaagccctggagagagacaaggtagaactggctgcgcaaagggactcggccttaaaggaagttgaaggtgctgccggctgacgatctgaacttatctctttttaatgcaacaaattcttatcataaatgtgttttgcagaccgcaaaatcaaatcccaagctcaattcgacgtcctggttggtaagatcaagaggcttgaaggagcaagagatgaagtcgccaatgtcgctacaccactcgtccaagccatgttcctcaataacagtggtccgagtgcactcgacgcaaccgaaatctttgacaagctgagagttgctccggatgtgtatttcaagaacatcaagaaagctgggagtatgggagctagtatggcattagcgatgaccaaatccttgtacccgaggattgaaattgactccattgatggctttgcagacgggacaagcgaagaagcagctcttgatcttatcagtaatgctcaaaatgcggctgacaagattgcaagtgacgttgtagatcaattccgcaacaacgaccttcagccgagcaacaataactctgacgatgaaagaactgattctgactgagtatgaatgtaacaaatggaggcttaatttgtacaatactggtgtatttatgctgtgcttgatagttctagccaagtctttgatttcttaaatgcttttatcgagctttgttgagcctaaaacccaaagaagctattaaaaactttcagtcctcgcagactaagtagaaaaaaccaaacaaggcaatgatagaccaagtaagcaaattaaattgataaaaaatcacactccattattatgatgatagcccccgactgacaacgtcaagaagaaaacttgatgttgatagtcaagatagggaagtacaatgataagcttaagcgtagaaacgacgaagatgttcaatgttccaagaattgtcgacgatagtaccgtcttcgcgcttgagtcgataagaacctggtcgggtgacttcagagatgataaatggcccttcccatagaggagataacttgtgccgatctcgtgtagtttgaattttcctcaaaaccaggtcaccgactaaaaaagcacgggatcgaacattgcgattatgataatgccgcaacccttgtaagtatcgagccgaccgaattaaagctgcctcgcggacttcttccaatcggtgcaaatcatccactcggtcttcttcgtagcgttcttcacggaaatttcgaaagcgcaaagactcgaattcaacttcactcggcaacattgcttctgccccatagacaaggaagaaaggtgactggcctgtggcccgactgggtgtagttcgcaaagaccaaagtactgatggcagctgtgtcacccatttgccggcatagggttttagccggtcaaaaacacgcgctttaatcccttgaagtatcatgccattggctcgctccacctgtccattgctcatggggtgtgccactgaggcatagcaaatcttaattccaaagtcctcacaaaagtctttaaaaactccgccagtgaattgtgtgccattatcagtgatgatccgattgggcactccaaatctatgtacaatgttgatgaagaagtctcgagcgttatttgctgttattgtggcaaccggtttagcttcaatccacttggaaaatttatcaatggccacaaagagatgcgtgtaaccgccgactgcctttttaaacgagcaaaccatgtcgagcccccaaaccgcaaacggccaagacagcgggatggtctgcaactcttgagctggtagatgaatttgtctggcgaaaaattggcaaccttcgcatgtgcgcacaattttgtcggcgtcggacactgcagtaggccagaaaaaaccctgccggtaagctttgccgacaatggtgcgtgcagcagcatggtttccgcatatcccagaatgtatgtctttcagcaattgtctcccttcctctaaagatacgcagcgttgcagaattcctgaagggcttttcttgtataactcagcttcatgcataacataaagtttgctccgccttgaaatccgctcggcttcatctttgtcttgggggagttcttgagaagtcaaaaatcgtatgaggggctctcgccagtcggcttcaaccatagctacgtcatgagtgcccgcgacttgagtagtatctttgggaggtactgtcggcgtgtaaaggtgttcgacgaaaacatcagagggcaccacctcgcgcttggatccaaagttggcaagtctgtcagcggcttcattgttgtgtcgaagaacatgactgagctcgagtccatcgaacttgtcttctaatttgcgtacctcctgtcgatatgccatcatgttgtcgtcaaggcaggaccactctttcataacttggttgacaaccaactgtgaatcgcctcgaactattagacgctttatccctagggaaattgcaatccggagtccatgaaggagggcctcatactcggcgacgttgtgggatgccgaaaaatgtatccaaagcacataacttaatctttctccagttggggaaatcaaaaccactcctgctccagtgcccgaaagtctttttgacctgtcaaaatgcatggtccagtgctccatcttctccgcgggggtatcctcctggcactcggtccattcggcgacaaaatcagctaacgcttgggacttgattgaaattcggggcttgaatgatatgtccaaagacatcaactccaaagcccactttgcaatccgtccgtttgcttcgcggttgtgcagtatatcaccgagtggaaatgatgtgaccaccgttaccgagtgaccttgaaagtagtgagatagcttcctggtagtgattaaaataccatataacagcttctgaacctgagggtacctcattttggagtcggctaggacctcgctgacaaagtaaatcggtcgctggactttctggacatggccttcttcctcgcgctcaacgaccaagactgtgctcacaacctgggaggtggctgctacatacagcaacaacggctcctgcgggtgtggtgaggctaagactagcggctcggtgaggagtttcttgaaatcttcgaaggccttctgtgcttcgggtccccactggaaatcatctgttttcttcagtagcttaaagaagggcatcccccgctcgccaagtcttgaaacaaatcggctgagcgccgccatgcatccagtcagcttctgaacatctttctgggtacttggcggtttcatgttgaggatagcggtaactttctccgggttggcttggatgcccctatgagacaccataaaaccaagcagcttccctgacggtactccaaaggtgcacttttcagggtttaatttcatcctgaaagcgcggatgctcgcgaaggtttcttctagatccgagatcaaatcatccttttgcttggtcttgacgactacgtcatccacataggcttcaacgttgcgaccgatctgcgttgagaagcatctctggatcatacgttgataagttgctcctgccttttttagtccgaacggcatggtgacgtagcagtatgctccaaagggcgtgatgaatgaagttttcaaacagtcggattccttcagtcggatctgatgataccccgaatagcagtccaaaaaactgagaagctcacagccggcggtcgagtcgactacctggtcaatgcgaggcaacccaaaaggatccttagggcaagatttgttgaggtcagtataatcaacacacatgcgccattgccccgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccaagcaaatatatctttattgttctgaagaaaggtgatgagcgcgctttcctatttacaatctaactcggcgcctattacagcagttttagtaggatcagaaggatctaggggaatcttcttagtcttggcctcgctttctgcactttttgaagtcttggtagctggcacttctccttcgctcgccgtggctgcagccagtcggatatcctctcgggcagacgccatctcgcgggtttgggccatgtcgcaactctccttgtcgcatgtgacggcttgcttgatgtcgctccgtagggatagaactcctcggggaccaggcatcttcatcatcatgtaagtgtagtgcgggacggccatgaacttggctaacgccgggcgtccgagtatggcatggtatgcagtctcgaaatcggcgacttcaaagctgatattctctgtgcggaagttttcccgagtgccaaaagtgaccgggagggtgatctggccgagtggagttgcggatagtcctgggattactccgtgaaaaggcgcattgcttggttttagctcggagcgaggaatctgcatatcatccaaggtcttggcgaagaggatattgagtgcactgccaccatcgatgagggttctgcgaagcttgacattacggaccactggatctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccaccgaagatatggttaagctccttgcggtggtcttgaaatcctgccggggtgtcgccgtcgtccttcttcctcgacgtgctttgttcttcgtcggggttcttccgcgtagtcttagtgtattgatccgcgaattgcttgtagacgaaacaatctttggccacgtggttggagttaggatggtgcgggcgttgggagttcatgatcttgtcgaacgtgttgacgcgcgaacgctgtcgagaagagtgactggcggttgcaacaagttccgcaggcttacgcttgcggtctttatgattgttacttccacctcctcccgaagccggcgtatccttttttggcttccaactgggacccgactgttttgatgcggtgacggcgtcttcagctttagcgtactcgttggctttttcaaacataagcttgactgtcctgggtggcttacgcccgaacttgccgaccaattcttcgtggcgaatccctttggtgaatgcggcgatgataacgtcgtcggtgatatcggagatcttgttacgtagttcagaaaatcgccggatgtaatctcgaagggattctccggacttctgaataacgttgtagaggtcgtattgtgtgccgggacgctcgaaggtgccttggaagttggcgatgaagtggtcgcgtaattcagcccaagatccaattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccgtcgtacttctctattccagtcggcttgaagccggctggccaatccactcgacgcaggtcgtcggtgaaggctgctactccgtcaaggtcgtcgtcgtggcggtccggcgagtgatgatagcctcgagctgctcggcgctgtatgattgtgtcgcgaagatcgatggggcggcgacgaggtggtgagcgaggtcgttccactcggcactctctatgatgatcgggaggcgagtgaacggaccgctcgtcgtgacccctgctcctgcgattggatcctgcgccggtgatgctgaggcttggatgacggtagtcatgagatcagaagtgggggactcggctgccagtcggcgtgtggacgctttcggagttaactgggaccgaagccgcaatcatggtcttcgtctggttcaagatgttgacaacgtgatcagattgattgagctcgttttccctgaggagggtgtcgaggagggtgatcgcggcaaccgcattctgttggggggtgcggaaaaccggtgtcccttcaacatcttgttggccgatgagatcacgcgctcggcgccctgcttctaaagctcgctgccgtcgatcctcagcctccttcgcggtccgctcacgctcctgctgctcacgccgtagccgttcttgttcttgtgcttgatgctcctcctccagtcggcgacgctcagtctcgtgacgcgcttcgttctcccgggcttggcgttgctcctccgtctcgttattggccatgaagacgccgaagtagagaggagtgtagttgtcatctaggcttccgtcgaagtcgtcgagatccgggtcgttgtagcgagaggtaaactcgtcgtactccacgatgtcggtggggcgcgagtggacggtgggagagctgtagtggccgtccagctgatccgtcgaaaccgtgccgagtggttggaggatgacgccgacttccctgaagctaggcgaaatcggtgttgaagccgacttccgcctaggcctacgggatggagatgctgtcgtgatggagacggccgccaaatcgtcggggagcttcatcaggatcggtgggtaagccccctcgtcttgatctggtgaggttggtgaagatgcgatctcgcccgagtggtttgaagccgactcgattgagatggtcttgaagtaactttcagccgcgtttgggagtccaaacggggccgaaatctggttctctcccgactggtccgactccgagtcaaggagagagatcttgccgaagttgttggtgacgaagtcgaggctgccgaaccgaaacgtctgcccgggtgggaagacgaggtcgtcgatgccggagacaggacccattgcactgatcggcgaaaagcttgacgcggcccctacctggcgcgccaactgtcgaaactagatttcggcaataataaaagggggtggctatcaagctggaaaagtgtatgggtttgaagacaaaggatttatacaggttcaggccttcttattcaagaagtaataccctactcctgtccggggatgaatccgccgagtgtgttattgattgtatgatttggagaaaatcaacatatgcccctagaggcacccggaccccccttatatatgggaaggagtccgtgttacaaaagacaatctatatccctaacggaatatgtagatacagataaaatacagtcgtaaccgactaagtctcaaggtgtttccttgatgcacaagttgagaaacaaacccgagatacaaataagatattctatctatattcggtatcctatattcagtccaaatatcatcgccgtgtagatatgggatatccataatctccacactgtgaacttgtttcattgtgacggagggaataaatatactaatgaaaataattaaaactagctaattcagctttgcctgtattgatcgcggaatcaccgaccgagaagctctctagttctagggcaggtttgaattaattagtggtattaatgaatgattaattattgcagtggaccaggatcatagcaggcagcatcgatgaagcagcaggcagggtaattgaattgctggaggatacaagcaaggggaatgtgatgtatttccatggctggggtggactgggggcttcagccgtccttagagcagtcgccaaaagactgacgatgaggccatcgccatcgccaggaagaagaaggtgggagaagatgatccacgttgattgctcggtgtggcagagcaagagggccctgcagaaggccatcgcccaggagctgcagcttcctcggtcgctgatggccttgttcgaccagcacgacgaggaggatgatttcagtggggtggatcagggcatgagaggggtggttccacttgtcacacagacaatcttgagcgacctggtaaaccacacattcctggtgatcttccacaatgggagcggcagctacattgatctacaggagtgtggtgtccctgtaataacaggaatcttgaacaaaacggtgttgtggacctcccgaagcagctttcggattaccgacttggacatggataacgtaagcaaggaggatcgggataagcttgctgggctgagtgatgtcgctatatatgcttatccaaccgcaggcgatgaatatagttttgtaatcttatttggaatgcttttgcatcaagaggcagaggaggttgccaggtacaccggtgtccctcaatctgctggcatgagcaccgagcttgtcaagaagtgcatcatgtatcagttgatgctaagacaacaacatgtggactacacccaacactgggatacccacgcagctaactattgggtatgcagtggaatcatacaaacctcagacaccactagtagtacaagttgtcatagctcatcgccatgggagatagcccaagctctttataataacttgatcttggagtttttgaccatagacgattacaacagcaacccaacttgtgcgaaaagaatacagagagccctacgactgccttctgattttgtgggcgagtcgtccttcttctggacatgtgatgctgctggcaataacaatgtcgacgcaactacagcttgttgtagacagaaatcactggaggccaaaatgttccaacatccatctgcaagctggctacgtgtgatacatctctttgaatgtaccttcagttttgcatctccacccttcctctcttgcagcagcctaagattcctcctacttgaccattgcaaagaccaaaacagcagcaggacggactcaacgctgacgatgacaacggataccggagatactagagcttgttttcggaagctgtgggtgctggacttgagtttcacagactggtattggctcttatcggttgaggccctagatttaatggttgagctcagggagttgaatgtgaagggaatcaagcattggagcataagccatctactccatcgccttgatgatgatgacgctagtaatagtacccgaagcagcagccgcaagccttggctgctcagccttgtcaagctccaagtcacaaccgaaccaataactgaagatcaacatcagtcacaagtatggaaggaagatcaggtagcagcaacattattcccgaacctatctagctgcaaaatcgtaaagacgatcattcttgatggttgttttgagttgaagcgaattgaccctcacgtcctgccaccatcactcgagtcatttagcttctccagcagcagcaatgacaatgatgttcatgtctcagccaagatagagagcatctcctttcggggatgcacccagttgaagagtttgttattgagaggactatttcaaaggctcaagcagctggacgtgtcagaaacttgtattaaaaccctcgacctacatgcaatgcgaggcaacgggtctctcaaggagctatttctgcttggatgcaaggagcttcgtgcaatactatggccaaaacaagatgtatcattggaggttctgcacatcgacactagtagcacagaacttgatcatgctacaggtgtagaagaatcatcatcattctcacctgttgaatttaaatggtatatttcagtgagggacagaaggctccttcgctcgctaaatgatacaaaatatcccttggatgcaccatgcatcgagatctcatcccctcctgctagtgttgctactgctactactgatggttctgaattaggcggaacaataagcaagagaaggcccattgccgttagcagggctgaacaacgttggttgatgtcgaccaaaagccgacgaccagctgctgacaacaagaagttatatgcggatgtcaactccacgatccagcacttgcaactacaagcaaccatgaatggcaactggatgtggccttataaacaggagggcagcacctctcactacattagcttacaagatgataagaggatgcagacgaaaccattatcgtcgccatctttgccaggttccatctgtgaaagagcttcaggcctgcacgtgcatgacagcttgtctatcgcaagtatcacaagccattcaaatggggcacggagatggaataatctagagtggtgcagagtggagagatgccctaacattgaaggtgttgttttcactccacctagtcctgttggtggcataactttcttgtacctgaagacattctgggcaacccaactagcaagggcacgccacatctgggactggggcaaaaggggcctgctgcacaaggggccagttccattcaacctgcaagtgctacacctagattgctgccccaggttgatatatgtgttttccataaatgacaacagagcttcctatgcataccgttggttggaaacccttgagatcgtgtgttgtggtgacctcaagtatgtcctccgagtgtatgataataatcaagagcttctggtggcaactatagaattctcagagctgaagcacatccacctgcacgagctgccctctctgcaacgcatctgcgggcataggattgtggcgcccaagctcgagaccatcaaaatccgaggctgctggagcctcaccagcctaccggctgttgggcttgacagtacccgcaagcccaaggtggattgcgagaaggaatggtgggatggcctgcagtgggatgggttggagaacggacaccatccttccctctatgtgcccacccactcacgctactacaagaagaaactgcccagaggttccatgctcaggtatgtacatatgtctgtgtgcatacatgattattacttgggtatcagtccttgcgcgcacatacatacatacgtagaaacttatatagctcagtactttagttactccatcatatatatatatatatatatatatatatatatatgatcgatcttttccctttttttttaattttgtctgacttggcgtgctttcttttcttcttaaattcaggtgatcgatatatacgtccatacactacatatatgatactgtaatcatctacgtatcattccctttccctcatccagtggctcatcaagttcttcagctctatctctattatatatgtccttatttggggctagtgttcaaagtgcttgctcatttcatcatatcatttgcaacggcatcaatatctaatgcatgatgagtaagtacatctctggccggcatccagacgctcgtcatctgcttgttactagcttggattctgttcatttatgcttcttttgttttgtgtgaaaattaataaatggatgctcagctgccagctggtgtgtgagctctgcatctatctgctaagttattttctccatacatgcttgctttccgtttggccggttagtcgatctgcttgttcgaccgatccatccatcggattactacgtatgcttcatctttctggatagatgatcatacatgtatatgtgaaaactttgatctctagcactgttctggtgtggtgtgcttcctagaggtcgacgaataaatcatcagcttcagcggcatgagaagatccattgggtgatcctcatgcagtcgagttgctgttgtgcacttgtttgtgggtgcgtgtgtgttcgtgtgatttgtcagcatttatggactgacctaagtttgtactcctaattacttcacttgtatgaacagaaacaatgatgctaaggattgtgagtgtgacattgtctatgcagcaaacatatatacctgttgctctgttatttggaaggggttgtatattttgctatgcagtctgcagtccacatagacgcctagtattttctttatgaaaaatacggtacaccttttgccttttatggttagcttttactcttttccttatgagtccttttacagtacaccatgctagtgatagagacgaaatccagccgtttatttgtgtggttatttttatactaattgatttggttacttaaaaagatttcccaccaatgccaccaagggaaatccaatcggcatttttttttctatctcgtttgttcttcgtcgctgcgaggattccagtcctgactcctgaatggaggacgcttcgtgctgaggcacagactctgatgaatttatctgtagctgcaagtactatgaatgatttggtgatgcgtagaacactcccagtatatttaggccctctttgttaagacttataagccaacttataagtcgaaaagtctaagccaaaacaacaagcagcttttt

SEQ ID NO: 57021 - DNA, 2852 bp, Oryza sativa
ttaatggtccttagtaatctgtctattatgtgctactactaataatttattagttgatcaactagcaccacacaatttctaatctattgtgaaaggcaaacgttcagtgtggtttcatcatgtatgcgagattaggaattgagtggtttggcattgctattgttgcattctgatctgttgattactaatgcttgcactaatataagcacggagatctgaatgtgcttttttgtcttcgatgaagcgtacatacttggccactctggtggatcagttttaattaaattttgtgggagggagcacggggcggcgacggcatcccgatcgggtcgattgggatttggggattcatcgaacgaatcggtaggggtaggggtagattacgttgagttagtgatccaaattaatttgcacttaataaaggtcatcttctaccggagcgaagcggaggcccagtagaagccagaggctgggccggaacgtaggcggaacgtcgtcattccttttagggttccaccttatatatatacctcttgtaagccgccgtgcgacgttgtaacctcaccccgatatagtgaagatattttgctggccgacgctcgtggttttttctctcctgttttgagaggattttccgcgttaaatctcgtgtcttctgtgattgatctattgtttttatatcgtttgcttgcttatcgtttcctaacggttcagtgcactaatcttaaagtgaaccaaacaaataacatataagccattgttttatttttcccataattccttcatactactgcgtactaatctgtactacttgtggaaatttcattagtataggatgaatcttttctttattttttgagggtaagtataggatggatccaaactgttggattagccctctaacccactaatataaggtagtatggtgtgctctaaagaaactcttttttacatgtgcaaagggagaagcacaatattttctcaatcctcaggtcgactgatctggtcaatgaattaagatgtatttcaacttgattagcagtcaccattagtaattgggttttgtacttgtgcagtgatataatactctgttttgtagtgaaaaccttctgccatgttgcagtataaggatatacagatgacatgcagtaagcattggggcatgctattctgtgtatccccaggtgttgtgctgggcctctatgatacacacattaggaccattttggtagacaatctgcaccttttaaaatacagtccttaaccagcaaaacacaagaacgccctgtccttttccaattcattgcttacacaaggaaacccctaagcagattttcagttctcattttttttccattttatccatgccgaagttcaattcttccttcgtgcgactgcaaagttccatcgttgcccttctccccgccaccgccgcctcctctctctcgccaccgtttcctcctctgctcccccgccttccttccaccgctgtcatctccgcctctcgtgcgttgccttcgtccccgcctcctccgttgctcgatctcacggcggagccacctctcttccttgttcttccaactcatgcacatggtttgaaattttggtaattttcggcccccaccggcaagcacaaatcttccccgaatttttggctttttgtcaaatatttgcaaaatttgtcaaaatttgttcaaattcagtcaaaatatgttaaaaatttaaataatttcggtccgaaaatcacgaaagtctcaaattctcggcaaccaccgaaatttctatggcaaccgaacttgcaaaccctgctcgtgcacaacaacagcacaacggatgagggtccatttcgtcatcgccatccccgaccaggttggaatctgagaagacggaggaggctatggacaaggcgacagatggggaaaggatccacaccaccggcctctcttcgccatggcggccgaacacacccaagaatcctcctctcgacattctaaatctcaaaaattcttcaacttaccatggtgatgggaggttgattatcctgttgctgtttcagataacccagtgatatggggctggtaagcatcatcttggcatcgacgaacctggcatcgttgtgcatcaccaaggttcactctcctgcattgtgaattttgttctcatgttttattttctctgaagttgatactcctgctggctctgaactctgaattttgttttacagtaccatcctctttgtacctgcaataaactgacatcgtgatgaatcagatggatgttggatctcgtgcttgtgaattttgttcaccgtaagttcaaatagagtacaaatagttttgatagctcacacataagggaaacagagtacacctttcttcggttaaatgacactgcaagctgtgaattttgatactccagctccagagatgtttcagatatgaggtcttcttaacatgaggtaaatttcttacaggaaatccattgatgattctctagttgtgaattgtagttctactccagcagaaattagcttattgtttcaagatgcatctttctcagcttagtcttgttcgtagattaagaaattcagaccaagtcaacctcctgataaccacactggattctgatgtcctggcgagccacatccaacgtgtggtgatccaaggcggtgacattatgtcgatgacactccaggcactctacagttaggaaaagtctttgttttggggtagaaatttgccatttgagcatgacaaatttgaattccatcaagaaattctagcgtagacgccggtagaatcattgtcaacatgacaaatttgtatcgtgtcagtaaaattggtattgtgtct

SEQ ID NO: 57022 - DNA, 11922 bp, Oryza sativa
gtcaacacacggtcaaccgacggaagtggcatgagagggtgtgcaaatttggaccaatggtgtagacccccgtttttatagcaggaatcactcgtgtgaatagtaccatttccctagatcaagtagtctggtactcacgattacattgctgaaatatcaagtgcgcatacatagattgtctagcgcgaattattacatcataggcccgcaggcatagtctagaacataggaccaaacggtccggaatacatcccaaaaggagaaatagataagcagcggaatcaaggcagcggcgacgccattgccacaggcgacgaccgtaactaagacctactaagcgccaccatcttcttcaccctcctggtagtaagcatatgggtcatcgagacttcatcaccggcttctgatggaatttgtaaatagcaagagtgagtaccaaccgtactcagcaagccaccacaacaacgatgcatatgatagaggatattcaatgaaaggctaatggtttatttgcataaagccaattttgcaattcttttcacaagcctaagacctagcataactgatcaaattttatctccgtagttcattatacagcgacggttctgtccaccatccattgtgttcccaaggatagcttcccgccactagttgtcatagttttctggggtctaccccttctcgcctctcgagaagttgatccaccagtctaaaaatcattatgcatatcccacccatcattttaagtgtttagagtctagccaagtgtaatacatgtcccggtgctcaataaccgcgagcacggctattcgaatagattggtttacttacactgtagtggatgtacactttacccgtactacgcgacttgcccaacacatgagcctacatcccaacgaatgagacttgccacggcaaagcctttcaacaacctcactttggcaatacccgctccatgaacttgagtcctcatgcactctaggcgtcataaatttctagcagtgagaggagttctggcgctccctagggggaaaactcacgaaagcctaacattgcatcctgtagttgaacccaatccatgctgtcctcttttgggtatctccttgtagtcttgtagtcttgacaagtcagtctctggccatccgtatcgggtatccgccagcagactgcttgttcgtccacacacctaagtgaaaccactatgcaggggtactgcctccgcttggctatctactccactaggtctatacccattcgagaagtacggctgtactaggatcgtttcatgcttaacttcatggctcggtacttaactgaccagggacggcactagcctttatcggacaccacccaagtcctccagccgccccagtcgaaaacatttgtttagtttaattttctttcacaaatcatctcatcattatcatggcaatgtggcgctcatgtctccacatgccgtatgtcaattaccttccctaattaaggtaattgcccaagcataaagcattttgataaatatgaatatgcatggatctaaattagcatgggctaagcatttgtcaaatattgactaaagacacacgatatcatggattacaaaggttatatggataatcaatatcaaaggtatggcatataacaaagtaggacattcacatataaatagcatgcaaactttatttaaatcaaaataagttcgcaataggtccaacatgctcaaagattagtgataacttgccttgctcacagatttgatgtccctgttctgcagttaactcaaccactccctcggaatctatatgtacgtgcgaaagattcgatttgaattcaactagaattcaaattaaatcaccaaaattcaacagtacaaaaataaatagcaaaagttattccatcagctagatcttgattttatatgaatttaggttcaagtttcattcaaatccgagctaaaatgagtgagttatacttgtttaaagattcaaatttgaattaattccaataattgtgaaatgatactgttcataattgatttatttttagtcatggcattatccataagatacattggctgacacgtgggaccagcccaggttgactagggccaaaccggctgttttaattaccagtgggtccagcttgtcatggagagtaaacttaatattggttttaattaaatttctaatcatccggacccacgcgtcatggacaggtataatcatcattggaagagaattactgtgcgctaagtagatgtgggtcccacatgtcataatctctctctcttgttcttttcctttttccccatcgtcttctacctcgcgccggccatcgagcagagcagaggcgcagcgcgtgcggcccagcccggacgagggcgacccggcggcggtcaggggaggcgcggaggagggtccggcgacctcccgccggcggccacagcacagggcggcgcggcatggccgccatggccgagctctagggtgcaaggggactcggcaaatggcgaggtctctaaccaattagtttggcgcaagagcttgtacagcttatggtgattccgttttgctagctaggtgggaaggagagtgctcgaggtgacctacccacggcgagcccgccgatggcgaagcggcggccgggacggcacgccgaagggcgctaatcgccaaaactggtgggggatttagcttctactccgtactagactaggaggagctataggagtgaggttttaccgagagacagcgggatggcgaagttcggcggcgcgcagctcagtgcggacgaaacaggggcggctagcggcgacgcttgcaggtgttcgatgcgtggttcccgacgttgatccaaggcagcagaggaagtagaggcggcccgagccacggttcccgcggtcagctacgccggcttcggctccaaccggtgatgatgaagcatgcacacaaggtgttcgatgaaatgtattcgaggaaaaggcagatagggatgaagtttttatgggggcttggcttggggataggccaggatggcgtggaggataggatcggcagctggtgcactcaatggctgtctagattccttctccattaaggttctgtctatactgtgtgttctagccggccctagctggagaggaaggctccgttcttacccgccggcatccgcatggtggcggacgtggccatggcgatgcgtgcacatgggagctaaggtagtagttggctagggctaggggtgacgcgcgatggcgacggcgcgttcgtggcggctcagcttttgcgcgtggattcggcggctcggtcgggctaggtctctggtcgaccacctggtggcccatgaacagtagcaaaagaaaaggaaggagaagataaaggaagagagtaagggggctaatctgtaaaagtgacttggataggaatttgaatgaaatgtagctctatatattttgtatttgagaattcaaatgtttgatttgaatatttattttgttattcattagttcccaaatgaatttgctttccattatattatccaaaaattatccaatataacttctaggctttgatattccttaaaaattaattaaatattccaatgtgacctttaataatacattagcacattggtcgagtttatttgtatggcaaagtattgcatatagataagtttaatctatttaattaattcttactccatgaaggcactgtgagacttggtgcaatatcggtctaaatattgaatcgagtactcatataagccctttttatatatagaactcaatttatttacatgactaattattttatgcgagtaaattttattccatgagagcctcaatgcaagttataaatatcaacttaattattccagtgaaacactccattatatgtagggttcataataaatatcataattttataactattacttagttgtatagctttagcttaattttcatttgcgacattttatagtttggcaagcaataatgaccgtaacatccatcatgatgcacaacaaaagaaccaacaacatcggcatgatgcaaatttatttaaaagtttttgaaagtactcaattttgagtttcgttttatttgtcgaattttcagggtgttacaaatggcatataagggaagagtcaattttcagtggcatataagggattagaccaattttcagtggcatataagggattatctcttatacttaatatttgaactagaaaaatgcccgtgcgctgcaataggaaaaaacatgagaaatttaagaaaaggttaagaaatatttatattatgtaattaattaaaatataaaatcgcaactatacatgtatacatgtatacgatgttgaagaaaaaaggctcgtaaaaatcaaggtaaatgtggaaaataaaattttccaaataaactatagctggatttaatttttattaaactctccacgattaattacactatgtgaaattttttcagtattttcagagcaccattgctaattttaataattaaaacattattttagcatttattttaatgaaaaccctcctttctccctgggccattttgagcccattctttctttagcccgtagccgagccggcccattaacctgacttctcctccctttcacctttgcctgcaagcgcgcatccagcccatcaagcaaccacaaagtttaatcagcgtcccttctcctctcactgtcgcatgggtcccagtgctacaggtcgtcccctacctccgttcgattccacagcttcccaacaccgccggaaactgtcccctccgtgaaatctgtccgcatccatagagctaatccaaaattgattgaggggttttgatgcttatctcctctttccgttttttctagaattagagcaaaatcgcatcgtatcaacctcggaattaagccatatagcaaaccctagagttgtccgtttcgcgtacggggaggaaattggaccgctcccaggacaatgtacgaaaaaagttggcaaaatcatcttaaagttttataataggtaaagatatactgaaactactggttatatatatgagaaatctgaaaataatgaagttatattcaaatatctgatgcttcatgagcatcatgtgcttttgaatatactgaagctaaactgaaaataccatgtacttttggactcctttcaaacatcaatcaaggtctctcaatagtcaatactccagtccaattactccaaggtttctgagtacttcaattcaggaaatcgaatcaagatttccatgtactccaattcagaaaaaatcaatcaaagcttctgactttctgagtactctaattccaaaaaagaaaaatcagtactcggcacatatactctttattctgtacgtacattcagaaagagtatcagagtactctaaatcagaaagatatttcttgtgctagttctttcattgtgtgtgtaaaatcgactacaattccagccaacgatcgagattcttgaggttatcggcgcaacctttctttattcttgagcttcttgattagatgcatcgctagaggttcgtcgtcgtcgcccgggagaggcacgccatttccgctgggcttcgtcgctgtggactgatgaggtttcgtcaccgtacgttgcctaggagagctaccgtcaatattagggttcgtcgctgtcgaggtccgttcatcgccatcaccagcgattgcgtaaaggcagttgagatcgagcccggccacgagccgcgcggcatcacggcgtagggttcgccgccattacgggttgggaaaggcgcggctgcgtcgtcagggcaaaccagacattttggaagatggggagagtatatcagttgctccgttatttggaaggggttgtatattttgctttgcagtttgcagtccacacagagcctactatcttctttattatcaaaaacacagtacaccttttgcctttgaatttcatgtttgacttgagaatgtgaatttaattgcccttaaattaactttcgaatagatttcagcactggccttttgagaagaagaaaaggaaaacccaataaaataccggtaagatgatattttagaaaagtttttttaattatttcaaattttgtttttctgttatagattcgaaaattttaaggtgttgcatagcagcatgcaatttgatgtcgcatggcatcgataggttcaagccttctttaggcaaagcattggtatcgatatcgttcatttttcatcaatcttaaatatatcttattcaagctcggttatattacattttgtcatgagcccctgcgcataatctaatgggatatcagtgggttatcggagggcgaggacatggaagcttggtcgaacatcgacccgtggcggcagcaacaggagatgagaaaacagagaatcggagatgagaattgtagattgaatttgcttgctttattcatccgaatgctacctcttaataggcttacaattggtaaccaaattactataagaaatagctaacaaactggtaattaaggaaaagagctaacaaactttatctaatttgcaagcggatagaactgttgccgtccggcgcggctgatcaggcgcgacgcgctgcgctccctgctgccgcgtcctgctgagccggcgtgcctctgcgacgatacgtacgtaatcctgaccatgacacatttatgtttggtttgcatttcaaatatcatcgtggcattaccactcatattactagtgatctaattagggagactaaccaacgggagactcggagagctacgaaccaatgattaagcacaacttctatacgtaatggatttgatgtgcttttatctgattaaatactatacttaatgcctataaatatatatatactatatacttaatgaatagtatatagaaatatatacttaatgaaattaatactatatacttaatttggaggcccaaaaattgtgggccctattcaatgggccacctcgacctgttaaatatgtgatccgaattttgggctcacaatatattcggattagtttataggattagtttcctattaggagtcctaaatttcttctatatatatcccttgtaagctgcacgaggagggtgcgacagcccaatgtatcccctgcgtttgtatccaatttctctacagtgatcattgtccgacgcggagtgggtgttttctgtgcgaggagaaaaaggcaatgcagcagccgtcgtccacgcctacgcagccgcacgcgtcgaggaagcagcagtcggtgtcatctgatgtccataccgagccatctaccagcacgtccattcagcagccttgcctcggttctgttcacgtgaatttatttcacggttggaaattgctgcgtgcacacgcccttcgtaccagggaatcaattcagtggcaatgctccggttctgttcaggtgaattcaaattcacattcaattgctatgttcacaaagccaagtctaccaggaggttctatacggagatcaaatacttcgttttatttaatgcacctagagcgtttcgcgtttttgctagggtttcacaatttataccagcagattcaggattttattcccaaggcgagtttgaagtttaatctaccgctcctggattgagatgcaatattctcgttatggcaagtgaagatgcaagttggcgtagccatcgaggaggagaagcaagtattgctgtacaccggagaggaaaaaaaaaggcaacacattcaagtcgtcgagagggagcctcgctcctgtctagatcacaaggtgatcaaattgtccggcgaattttgctaccatcatgcctaacacaccggaaggttaataaggagatctaagtactttgttttatgcacagcgttttgcgtttctgttaggattccagaaattaataccagcagattcaggatgttattcccatggcgagtttgaagtttgtgcatcagtttcgcgtctctgctgggttccacgatgtcataccagcagattcaggatttgttcccaatggcgagtttgaagtatggtctacctcttctggatcaagggtgttatggattatagtccaagtgactatttggcgcacattgattttatcatcatgaggttgtttagaggttgaagatttttatgctacaagggaaattcgtctcaaggtggagattgttaaatatgtgatctgaattttgggcccacaatatattcggattagttatgtaataggactctactttataggattagtttcctattaggactcctagatttctcctatatatatcacttgtaagccgcacggagagggtgcgacagcccaatgtatcccctgcgtttgtatccgattcctctataatgatcattgccggtcggtgcccgtggttttttcccgcaagggttttccatgtctccgttgtgcatctattttcataacacgaccgatagcccggccttaatttaccgtatcgatgattcgttctctaaaggaagttacagtgatgaggcggtttctactggtatttttatatataaaagggcattttatctttaggataaacagggatacaattgctttcgctcagaatagcttgggtcaccctggaggcctggactgacaggcatattagcttagatgaagcaaacaacactcctttcgctttatatctttttctttatgcatgctctttaattaaggagggcccagcagcgatcagtggcagtccaagcaacgaatctgatgattattgatggagcgcacagcttgggagatagtatatcgatttgggacacttttgccgaaaagcacattaccaaagcgaacgaccaagcatgtaatgcacgcattctatgtaggattctgctagctccatcagctctccccaaacatcgtgttgcattcagttcttcgatcgtttcattttgtatgctcccagggtgcgtgcaagcatggcttagtttgttcactcccggccgcccagtttttcaacatcgtgatcaaggtaagctacatgaatgcagcttgctttctcaacatccatagttttatatatgtacaaataatcaacacagtgatatataagagtcttatatatctctctggagttttggttttcaacgagctagcaagggacattcttgaatgcatgtttcaatatactccagctaatttgtatttagttttatatcatcaatttatattcatatagaatcattgattaattaaattaaaagaacatattctagattttgtaacgtacgtgcgattcaaagaacatcgactgatcaagatatgatggagctgctcgcctagactgtaattcaacaattgaagatccagctagctagcaagagatccaggcaacagatcgactcatcatgccagcggatgaggtatatatttcactccgtgccaatgtgccattatatttttttctcttttcattttgaatggaaattattcagcgaccatgcatgcaaaatttggcattccctctgtttcatattataagactttctagcattgctcacattcatatatataaatgctaatgaatatatgtctagatttattagcatatatatgaatattggcaatgttagaaagtcttataatatgaaacggagaaaagtatatattagctaggcaggcatgtatgcatccaatttggatgctattaatttgttcaaacacactttcattaattcattacatatatatggggtatattttaatttagacccaggagtgtcattaatttattcagtttggtggtcttctctataacttcactggttttcaaatagaagtccggcaaaatctttttgtattttcgattacatatatatgacttatagtacataactcaaaatatatttactagcttatatagccacacacccccacgcaggccatatataacaaacttgcccatatctaactccacgacccaaactaaactttcagctgcatggacacacatgcacacttgctaattactacctccgtattttaatttatgacgccgttgacttttttatccatcgtttgaccatttgtcttattcaaaaaaaattatgtaattatcatttattttattgtgacttgattcatcatcaaatgttctttaagtataatatctactgacacacttcacgccacgagactcactttacttgacacatctactgcatgcaggcacttacatacaactcatggctttcactgatatcacactaattaactcacacatgcacgcactgtcgtgctcctagcacacacgcacacgagacttagtatatataactcaaaccaaaagatcacttaaacaacaacgagattaaaccttaacactagctaattaactatactatagtacgtatcattaatttgaaagttttccacccaaaaactgtcaaaagttgtaaagacactccctgtatatgtagtaccgaatttaactagctagctcaacgctcagagaaaacgatatataattggtgtatctctacgtaccaaaaaacagcaagcatatatacagtagaaggcgaagcttagctaggtttgtctgattaattatattattaattagtacttattaattgcagtggacgaggatcgtagcaggcagcatcgatgaagcagcaaagaagataatcgatttcctggacgatacgagcaacaacagaagtacggtgatctattttgaggcctgcagaggattggggtcatcggccgtcctcaaagaggtggccaaacgactgagatcgtcgtcaccggagaagctgaagctgaagctgaggttggacaagatcatccacgtcgattgctctctgtggcagagcaagagggccctgcagaaggccatcgcccaggagctggagcttcctcggtcggtgatggccatgtttgatcagcgtgacaaggaggatgatctcgacggcgtggaccacggtgccagaggagtgataccgcacatagatgtgcaggagtgcggtgttcctataaatatgggactctcaggcaaaagggtactgtggacatcccaggtcaggtttgggccttggatgatcacaggcgatgtgcacatggttgccggaccgagcgatgtcgctatgtttgctgatcctatggatgatcaacccctgctgcatgaagaggctgaggaggttgctaggtccactggtgtcccaaaacctggcatgagccctgagattgtcaaggagtgcatcatgtactacaaggtggtgaggctgttagatggaaaccatggcattgactgggccacccacgcggctaactactgggtatgcagcgggatcatacgatccgttggtaatacgtcagcatgggagattgcccaagctttgcataccaacctgagattggattgggatgatagtctgaataataataaggaaaaactagatccactacaagtgccttgtgattctgtaaaggcatcattcttctgggctacatctcacagcaacaaggaagcaactacaagctgtaaagaatcactggaggccagaatgttccaacattcatctgtagacaggctgcgtgtgataaatctctcccagtgtacattcagttttacatctccacccttcctcggttgtagcagcctaagattcctcctacttgaccgttgcaaagacaaagacaagctctgctcaggctcatcaccaaatagtactagtgctggagacactgaaaaggagactagtattagcagtggagcatgtttccagaagctatgggtgcttgacctgagttacacagactggtattggctgctatcagtagaggcacaagatctaatggttgagcttagggagctaaatgtgaagggggtcaagcattggagcataagccatctactccgtgatgacaacaattctagtactggtgtcg

SEQ ID NO: 57023 - DNA, 14100 bp, Oryza sativa
  unsure (1)..(14100): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgagatcctattttgctaatgatgctatactgctaatgtgatctacttatatttatatatatttctatacaaatagttcccttctgacgtcgattgttcaaggaaatgctcttctactgatgtatatttcctccctgtaattctgctactttttatactatagttctattcatagcatggattaatgcctaatgcagagcactgacgataactcatttttcactcgcagcaggtaatggagctactgatagccttgcagtaatgccttctgctcttgcacttacggagaatttggatttttgggactcttactttctgtttgtatgaaatgaatgtaattagttttcagtggcttatcctagctgattgtggtgatgaatatgatgtttaaatgagtaaatcatgtattgtgaatgggtgactgattgtggtgactgaatggatatgatgcaagcaatttttagaacattctatgcggtattcagaattttcataatctttttaggcaatcttcagaatttcttattttctccagaaattttagttttttatttacaatatttcaaattttcggtaatgctatttttaaatttcaagactatctgtttagttttcttggtattttcagtgatatgaaatttaaatatcagtgttgaatgttgtttggcctgagttaatgtctgaagtgaacgttaaccttccccaccatttgcattccgaatgaccaagggaaccagatccctggggtggaggggattgggtgatgggaggggattcatccaatacccccctggtggcgtttctcccagggaaaatgcttaccacgtgccgaacaaacccaatggtgttttagcctcgaagctagaagttgtcaaatagtgtgtgcgaagctcacgacctagtcgctatgtgctatttgcaaaaattttgctacaggacactccgacttcgtggttttagctatgggacaccgcccgaactcacttttggggaaaacgcttcataaacgtggtaatttgccaatggacactgcgctgattaaaataataatttacgattggagaggagagaagaatcacgtgaaatgtcaaaaatgcccttgggcccacatgtcagctctcatatctctcttctcttctctctctctatcttctctcccagaggggcacgaggcggcgtcggtcaccggggctcgagctcattgtggcggaggagatggtgaggacggcgggagcggccgccgtggagttcgcggcggaggacgccgaggaggagagccgcatcgtcgccgccaactgcggccactaccacggcggaggacggcgacgatggcgggaatggccgccgcggcgctcgcggtgggagcggcagaggacggcgaggacgcggcgaagcggcacgggataatgattatttataggatattgtaataatgtattaattttatagcattaatatatttatttgcagggattaaactatttacttataatgtgccgacaaaattcttaaagtattcatgctgttccaaatgtttctagttttcacttaaaaaagtatagactaatttatcctaatatgttgctaggtccaccctgtcatatgcacacggatttttctttcgttccttgtatctcgctctttgacctgagtaggcaaacaaccagaacaaaattcccctgatctgccgcaccaccacagcccttacgccgccgtccaccaggcgctgtccgccagcaccgctgcaccggttccgaggccgcaccgtgcagagctgctccatcgagccgctcccaagaacggcgttccccatatcctgctgatgctctgcccaagggcggctggcatcttccctgttctctctactgcatcttcatcagctattttggttgtgcccaaagacctctcatctgcaagtgcaaactacgccaggttaggagcactctgttttttatgcacaccaggtgttcgatccttgacctgtatagacacacctctatctattacttgtttgtttcagtgcaaacgaaatatttcatcgtttttgttttatcttccatcctattatatctggcatttatttgttcagatcgtaggtaaaggctgtatatctagagtatcagagctccagttagctaatcacagggacatatttgtagtgcacaaatgttctaaaatttatatttgtaggtcctgttatctcctctgctcctaatcaagattgacatgcaaactgttcttgtggaactgtattttcagttttcaattgtcatgtaatgtccttatcatgtggctgttcatgttgcctcagattactttcatttatccagagtgcttttttcaggcccaacctcttcaccgatgcctgatctacccatctgctgctccgcaatatgtccaatatagccgccgtatgtactggatcacaacgtcaggagtccaggtgcggttaacctcacatcatatatatattctgtagacagactaattttgagttgaacttaaaattatatcaaaaaaatttagtgggtggttgtcaaattaggaacactgatgtactaaccatatttcttatcccatcacagaaaaccgatggatttaaatgctattaagaagttactgctttcccctagaccaagtgatgagtaccttgctggaatagagggttttcttgagtttgcatatagggaaaagaatcctaatgataagatccggtgtccgtgcaagaaatgtgttaataagtggttactaaggcgtgatgaagtgtatgatcatttagggagtgttcgttaggtggagataggagagattgtgtctcgttttccgcgcgcacgcttttcaaactactaaacggtgcgttttttgcaaaaaatttcaataggaaagttgctttaaaaaatcatattaatccatttttgaaatttaaaatagttaatactcaattaatcatgagctaatggctcacctcgttttgcgtatcttcccaatctcctcaatccccttctcttcaaacactcccttagtgtacaatggaatgttacttggttataatccttggggttgtcatggtgaaactgcatcattcatctctgctaacagtgaaataaaatcacaaaatagaattgataataatatgcaacagctagttcaagatgcttttggaaacacaggcagcagccctccagtgaatgattatgatgcaccaacttcttctaacagtgggccagactctgaaacaaaagcgttctatgatttactccgagatgctcatgaacctttatgggaagggtgtgaacttacaaggctttcgtttcttgtagtcttgttttacataaaatccattaacaagtggagtaataaatctttaaatgatttgctagcgatcctgcaacaagcaattccaaatggtaagagtttacctagaacatttgttgaggccaggaagataatgggaaagcttggacttaattatgtcaagattcatgtttgtccaaaaaaactgtcaactttacaggaaagacaaggcaaatgatgacttttgttcaaaatgtggaacttcaaggtggaaaaacaaagaagataaaactactttaacaaagaaggaaagaagaagggcaaccccaagaaaagttttacgatacttcccaattaagccaaggcttaagaggttatttatgcataaggaatcagctacagcagtgaggtggcatgatgagggtcgcacaaaggatgatgcattgcgtcatccagctgattcaaaggcttggaaagacattgattctagatatcctacctttgcatcagattctcgaaatatcaggtttgcaatggctagtgatgggtttaattcagttggaacgatgagttcgacctacagttgttggccggtcgtcttagttccctataaccttcctccatggttttgcatgacagcatccttacttatgcttgctctcataattccagggccatcttaccctggaaaggattttcatgtatttatggagccggtttatgaagagttgattgatttgtttaaggttggaacccccacatatgatgcatcccaagatgagatgtttcaactccgtgctatattattgttcgcaatcagtgactaccatggaattgggatctttgcaggttatagcgtaaatggtgaatttgcatgtattacatgtcatgatgaaacatgttctaaacgtttgatacatggtcgcaagtattctttcatgggacatcgtcgttttctacccctagaccatgagttccgttacaatcgaatttcttttgatggaattgaagaacatagaccagagcctattgcattttctgaaactgcaattcttagtaaaataaaggcaattaatgattttgagaagtcaaaaacatggaactgtgttagtgggctattttctttgccttattgggagtccaatttactacgccacaatcttgatgtaatgcatatagagaagaatgtttgtgataatatatatgggacacttctaagactggaaggcaaatcaaaggataatttacaggcacgactagacctgcaagaaatgaatataaggctaggattgcatcctaaaaaaaaagctaacaataagtattacttgcctcctgctacctatacaatgtctaaaaatgagaagcaacaattttgcaaagttctccatgatattaaagttccggatggctactcaggaaacatatcaagatgtgtaaatgttggtcaggcaaaaatttcaggacttaaaagtcatgactaccatattctaatccaacaacttcttcctgttgctttgcgaggtgtgcttccagacaatgttacatccgtattatttgaactatgtggttattttagagaattaagtgcaaaagtcctatacatagatgtgcttcggaagttggatgaacaaattaaaatgacattatgccgtatggagatgatatttcctcctagattttttactgttatggtgcatttagttgctcatttagcaacagaggctgaaataggaggtcctgtgtgttaccgatcgatgtactttgtggaaaggtatgtttatattacaaatacaattgaatttgttatccaatatatatttcttaacttttttttctcatttccatgtttatgtagatatttgagtgtgttgaagtcatatgtgcgtaataaagcgcatcctgagggatgtatagctgaagcatatttggcagatgagtgtatgacattttgttctaagatatattgaaggttttgagacaaagcacaacctactgtaacgccccgattttcgttcgggattaaaaatcatttaataatgtattttctagaaattaaataaaagttaaagcaaattaatcaagtgaattattgagggaattaaaaatttcctttaaaaatcactggccgagaatattttgtaatattctttgtgccctaaaataatctctgaaatttcccgcgaattttcgaagctcgagaaatagttttaatagcacaaagatcattgaatcaattaaaataaaaagaaaacaaataaaaccccccttcctttctttgggccattttcggcccaagtcttcattctctcccgcggcccgcgcgccccctttctctccctctcgggccggcgtcctccctcggcccgctcggctctctctctcactcaagtccgttccgcctccccagccggcctctccctccctctctctccgacaggtgggacccgtggaccccacctgtcatccccttcctccagctccaactgctgccatggccgcccgagccgccccacgacgccgccgtttccacccacctcctccaccccgcgcgcgcgcgctcgtccgtgggacctcgccgcccacgtcctcctcgttcccccacctctccccgcgaaaaccgccgccaccccgagcccactcaaccacgtcgccggcgcccctttctcccttcaaatccgccgccaaccggcctccccgtcgactcttgaggctataaaaagcatcctcggcctcccctcttccatttccccatttttcccgagctccccgcgcctccctaacgccctccccacgccgctcccgtgcaccaccgctttccggcgagctccgtccggccgattccgccgctccacccaccgccgcgccaatccgccaccactgtcggcttcgcggcgccgtgccgcagcccggcctctactccatttcccctctccgcctctggaacaccgccgcctcgtgcaccacctctctcccccgccgcgccgccttcagccggccgctgctgccgcgttagtcgtcgccgcacctcgccgtttgcgtcgtcggcaacgccgtgccaagctctaccccggcctctgctccgtttccccatttcatcgccgcaaccacctttccaccgtcgacccgagctctaccaccgccgttcactgcctccagccgtcccgtcccgctgctccggtcgttgccaacccgcgccgtcgcctccttcggctccgcagggacgaggggaacctcggccacctcttcccatcgccggagactcacgggacgtccgctattccgtgcgccggtgagcccttcctcccttcttttcctctccggccggccatgtcgttgccccgtcctccctaacagttccccttccatcctgtggcgcagctgccgctcgtccgcctgttcccgagctcagctcgtcaccggagcgtcgtcgtctccgtccgccccgagctccgccgtcgccgcctcccgttgccatctcgccgccggccgcatccttcggccgtgtgccgctcggtgagctcccctcccctttcccgctaccctccgccgctcacccgcgcgtgctgccgcgccggtggtcgtcgccagtgaccatcgggccgcgcgtcaccgctcctggccggtcggtcggcgagctggctcctgcccgcccgtggccgcccgattcaccccgggtgaatctgggccgtccacgtggccgctcggcgccgccccgcgtcggtgccctcgtgtcgccacgccggcgccaccgctgccgctcgtccgccgtggccgtccacgtggtgcgcccgcgcacgtgccgcgatggactgagtccaccgtgcgccctccccttgtgccgttgacgtgtgggacccgcctatcggcgtcggcccctctcttgctgacgtcagcgacagtccttttcctttaagaaattaattattaattgcgcaataaatcgttaaaaattctagaaattcatttaaatggctcaaaacttctaaaattcatatctaattgattcgaactccgaattgagccattcaacttgcaaaattcatataaaattgagctctacatgtttgtttagtttttatgtactatttccttggtttttattagagtttttcctcattttgcgtgcctgcgtgtagaatccgtcgtttcggaagtccgcggtcgcgaggaaaagtgttcggaagattgtttgaagaagcaaggcaagtcacacattccccttgagcattttgatcctaatttacaaatgttttaccgtttgcaaataaaattgcatgtcttgctaattacatgggattagggtttacctatctgctcgcttgtgccatgtttacttgatatctgtccttcgtcaacattgggtaataaatcgactagctcatgttacttatgtgacctagctagaactatatgcttagccatgcttaattaccactagctcagttgatgggataattacagtattagaccttttttagtatcagaatgagctgcgtgctcgagacatctggccatgcttcatggtcgtaattatccaactaaaatgcgattacatggtgggctgtgggtgcatggttttgctagtcgcacccatggcaattaaggaccggttcgcgggaaaccctggaagaatttatcgtgcttaccacaagccagcgtgggcaacggctgggcttgtagtgtagctttcctctagccgacgcatccaggcaagggtgggcgtgatggagtttggatgggccctgcgacggcctatgcgacttctggattcacctaggcacgagaggggactgcccgctgccttgcgaggagtgggggtgaaacctgaggtgtggtgtgcttggttagagggggttatgcgaagggtcctgtcacggcctctttccagtatgtcgtggtggcatgtcagcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgactcaatgcactgtagttcaggtgggttggttgggcctgttcaacgtggtgtagcgttgataagtggagatttaatgttactttaattactcatcagttttactgttttgctcaatgaaatattttacaatcgcctttatgcaaatagccacaagccttccttgtgtcaccttgcacgtctgcatcgttggtgtggcttgctgagtacggtggttgtactcagccttgctattattccccattttcagaagtgtagtgcttctgagctgaagacgaagttagaagaccaaggctcagaccccagttgagttttgcctgtggagtggagctgaagccccgctaggatcgcctttttccgctactgtcgttctcttttggtgtgaggcctaagtgcctcttctgtaagtattttacgctttatttacatttggatctgtttattacttgtcgttttgtgtaccctggctggtcctggacagggatttaatacacaaaatagtctggaaatttgggctaaatttctgggcgtgacacctaccttcacgaaatgatgataacgacgagtccattgcttctcttgatgatgaaaatcaaacaaatctttttcctcgtgctggaaaacctcttggcaagcctagaagttatgtgttataaggggtttggctaaaatccaggcacatagatatgtgcctttcgattgcccagatgtcaatccataccttctgtattatctcaaattcatatacactgttagcataactctttttgcaatgagcattcattacattattttctttttgtagaatgcatgctgaggagattacaaaaacatatcggcgcggccgtatcaccccaaatattatcgagcgtacacaaaatgagaaggaggctccctccagggccaaagggccaaaaggctccctccggtggaacagcagtcaggaagggagttacaatctgttttgttcaggaggcaagggtagctcttccacggcggtcgggcaggtagtctcggcggttctgatggcttctgtggaggcctttgtggggagcagcgaagcagccgttgggcttctcgttccggctggtgagtggccaagatttgtctcttggatctcagctagtccacacagtgagctgatgttgttgctctgatttatgtttacatgtggttcggtggtggaatatgtacatgtgtttcttttgcctgttggttcccatctaggcgtgctttttttttttgaaacgtgttgtttatgtgattaattaacatgagaaggatctgttagaaactagaggaaaaaactatggcagaagaacgaagtataggagctcgagaaaacatgcatagtagtagtcccgaaccacattttcgttgatctcatagttagtctgttcatgggttcaattttttatccttcgatctacgattgcgtattgcttagttttgaggatatcattattcttgtaggtgttttaagtcctatgcgtatgatagattttggcgctcaaattttgtagtaagactgaatttgaacattttcatgttggggcatagggtcagggctagaaggtttgcattataatgatgcatatttgtttgctccgtgttagctgtcattagaaaagtggagaacattggggagtcatttcatatataactgaaaattgagaacttaggtgctaaaaaaggtggcaggtgtattgtctttttgcttgttggtacctagttttgacgcttgccgacaagcttactgattctgtgcctttttaattttagcttttatgcagcttgtgatagtttgtagtaggtgattatttcaggaaggctctgtgatttatgttataatatgttttgacacttgacaagcttattgattctgtgctttttttaattttagcttttatgcagtttgtgatagcttgtagtaggtgcttttttcaagaaggctctatgatttacgttacaatacacatagttcaaagtagataggacttttgcttttgtcaccgatggactatgttttgagtgcaagctcctgagagaagtaatcttttagttctagtgcatgcttctacttgaagtttataacacatctatgaattttttgtttatacttaattagtttgttagccattaatttggtcatccaccaaagttaattttacaacctactaaactagttattttttaattgaattataccagaaagtagttttggaacatattaaatttgtttctactaatagtacttaggtcagtaagcacattttagtcaaacagtgattagttttgttagaaactttcagtcaagagagattagttttgtctactaatttcattcattaaagatgagctttattaattaccactgagcatgtgctaaccgtggggctgatgcattttttggaaagaaaacatcccacgtctagttaagcacacacacgtttaactagcacgcacatcccaacgaggctcactggagccacgtaatggtttcggaacacagctccctccagggccaaagggccaccgcgacggtcttcagtgcgatatccaatgtgtagacgcgcgtactagtacgcagatcttttgcctcattgctgctccacgttccaccctcctgcacggatatcatgagggcacaggacacgaccctccacttgatgaccagctcgtggagctcgccgacgtcggcgccggactcccaaccttccaggatgacgtcatggaacgggcgattgccagggctcgaccgacgtagccgacgtcggcggagtccctgggcacgaagctggcgacgagttcgacggcttcaaggatggtctgcttgctgacgcgaacccccgccagattcctcgacccgccgaccagaccagggtagtcgtcggcgagccggaagaccgtcgccaccgggatgagctcccgcggcctattgctgaagatgtaccacaggccgctaccgtcggtgaagccggtgatgtagaggttgtcccggcgaatcgcgagcatgattttgttgtcgccggcgccgacaagctcgaggatgaaccacttgaagggcttcctgttgacggcctgctggtgcaagacccaaacgacggtgttgtccgggccccacattttgttgctgctgtcttgtatcagaagggtgtaaatgtacgacatgagttctccgtagtcgtctgtggccacattgaagctgatcaggtcgtaaggtccctgcatgcagtacgtagatcgagcaattaatatctataattaattaattaattaaccagcagaaaagaaaattcatcacgcaacatatcgatccatccagtggattctctaattatttattttacacaggatgcatgaatcggacgatcgagctagtagtacgtacggaatttttttgagaattaatattatttttatggaaaatcgcaaaagtggtggccaaccggggaaaatcgcgaaagtaggtccctgtcgaacggatgcaattcgatagggcacctatcgaacgacgggcagccgacaaagccctgtcgaacggctggcgttcgacacgctcacctgtcgaacggagggagttcgacagggcccaccacccggcgccgcgaggcctgtcgaaccgggggcgttcgacggggccctccaccgaccctgtcgaacaatgggcgttcgacaggccggtttaaagccccgtccaccaaggccgcgagttcgatttgtttgaggaccacatcgccagccgccgccgagagtcgccacatcgtcgccgtgagcgccggagggagcgaggggaggggatagcaggccggagaggaggccgaggaggcgccggtcgggagaaaagggttggcgacgccctccagcagtaaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcaggatgtcaggtgatatgcccattcgtctgtattatggcgatgcttctatacaaatatgtgatagcggggtggatttaactgtatatgccttccatgatactagtctgaatgcaccggagcatatgggtttgaacgacgtgttagggtggttgtataatatgtttggggtagatctagtgcacgataaatttgtcataaatgccgtgtggccagtgaggggtcaacatggatggcagtggagagtagtggaggttgcgtcaactgggagttggaggaagtttgttagtaaagtaagggagaaaggctatagcttggcaatagtggtgcagaagacaacatgtgttgatcgatcgggggagtcaagtcatgccgtggtggaagaaactccgttggaaggtggacaagctgaaaatgtttggcagactgagcaaggtcgaggggaagaagtagtagagggtaatacataaggagaggtccttgttcgtggtactaatcgtgaggccaacgactcggacgatgaagaaccggattcgcctatgcgtgttgatgcagcggaggagaatgaggcggtagtggatcagatggaagtggaaaacgaggaataccttgcgcttgtagtggaaggagaagatacaacactgtgggacaacgaaactaacatacccgatgattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacttgaagtgcatacagggtggatgtccttggagagtgcatggttacaagccacaacatgacactttatgggtagcttcgagggttgagcaacatatgtgtttgttggagaatacccgtctggtgcacaaaaacctgacagcggcatttgtggcacaaatggtatattcaaaggtggttagaaaaacatctttgtcccctttcaccataatgcatgacgttgagaaagagtacggatatgagatatcgtacgacaaggcttggagggtgtagcgcccgttccgtcgtggcgcctagcgggaaaattatctcttaaaaacactaattgcgaaatttgcttcttcgcttgtcatctagtgtccgtgccatctcaagatctcaatccccgatccatcgttgagttcaaatccgaatccgaatccaaatccttccaaatcaaattcctccgcaaaagtctattttgcctcccccggggtcgatgggcc

SEQ ID NO: 57024 - DNA, 15277 bp, Oryza sativa
tccccctctcccccggccctctcccttccctcccggcgctctctctctccctttctctctctcgctctctctctccctcctctccctccgccccgctccgcccgcgcgctgcacgcgcgagcgcgtgagccgcccgcgccgagccgagccctcctttccgctccctcgctgccgctccccacgcgtcgttcgcgcgcgcgcgcccgcggggttgccgtccgtgccgcgccttctgcgccgtccgcgtcgcccggccccgctgccctgccacgccagcgcgcgtgcccgagccgcgccactccatccgccgcgcctcccgttgcaagccgcgcgcgcgtgccgtggtggccgaccgtctggtcgccgccgccgtcaccctctgccgcgccaacccgcgcctgtcgcccgtgtcgtcgcaccgcttcaaaccgccccgccgtcatcgccgtcgtcatcgcctcggccccgccactccgcgcgcaagccgccaagggacggaggccgagccctcctccctctgccgcgacgcccccgctcccctcctcctttttcccaaatcggcaagggggcaagcccctttctccccctctttttccccttttcctcccgccggcgtcatcctccctccctcctgtcgccgttttggccgctagccggagcgccagctcgcgccttgaccgccaaagtcggtttccaaaccgacattgccgccccctataaacccaggcgccctcccttccccttttcccctcccaatcttccctgtttctcgcccgcgccattgccgtccttctggccgaccgcagccgtcgcgtgtgtgccggaggagccggtgcgcactaggacgcggaaggggactccaggcgcgtcctctccttcctcttccccggcccgaggccggagagatcactcccgcgccgtcggcctctcgtcacagcgcccctcctcatctcggtgatgcctccctccgttcttcctcctctctctatctcccccccttagtttttggtagtagcacgagtagcctccccgtagctagccggcgccgccccgaccgttgtcgtcgctcgccgtggctcgccgcccgagctccgtagcacccgctcgtcaccggcctcgctcggtgtagctccgcccaatccgacgctagcaacggattcccgtggccgcgtagatgctctcaccgctgggaattggcccctcgtgacctcgtcgccgttttcccctttgctctccgccggttgccgccgccgaaatctgccgccgacggactccctccggcgaatccaagccgttggctcgctccctctccttcttcctcgtcgtctcggtgtacgccccgtcgcccctcatcgtcgcaaggcgccccggagaaaccaccgccgcccgccttccattcacggccgggccttcgtcttcctcccgccatcccacgtggcagccacgtaggcgccacgtcggcgccagctcagccgaggtcgggtcgggccgaccccggttagcccctcccgtgcgcgcgttccaccgcgagccgtgaggctgcgcgtgggcccgccgcatccgttcctccgcagaccgcgcgcgtgcaccgcgtccttcccccgcccgcgcgcgttcgccgcatactccctccgcacggtgagccgagccgctgacaagcgggtcccacccgggaccgcgcacggtgagcccggtccaccggctctctctcctccctcccgcgcgcgcgaccgtcttgggccgccttgtgccggccggcccatttagctcggccggaccgccctaattctcttgggccacgccctagccgcccgaggaaaagtctaatttccatccctcttttctttcttttcttttctttttcaaaaaggatttaattaaatccttttcctttagaccaaaaatccaataatcttagaaattcaatatcttcccaaccgtaaatccgtttgactccgttcgacttccaaaattcctcaaatctcgagatctatctaatggcacgcttagaggtcattaatagggctttattttcaccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatattgcttgcaaaatattatgcattgataggatcgcacttaatctgtttgtcccgtctgcaaggcagattggcggacttacctaatttgttgcatttgatccttcccttgttaattgttacatcatgtccccttgtaaccacctagttgcgtctcaatattcgtgcaccctgtgcgagtatcgacggacgccttcaaacttaaatctgaataacaacttgggtaaaacttgggtttacaaaagacttggaaaacccgacacctgggtcggtgcttgcgaactaaatgaatttccaaaaccgcggaccgggggacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgtcggggtggtgtcggggaggacccctgggcttcctggcacagtatggtctgggacctaacctgttgttggtctgggacccctctcgtcggcatatggtaaacctgtgtcggcttggaaatgccttgtcatgaaagcttggaggtctcccgacgtggctgatccccacgggctgggtgatccgggttagtaatgtcgtgtgggtaaagtgtaccccctctgcagaggttaacaaattgttcgaacagccgtgcccacggtcatgggcggatgtgaggtgattcctagcgtagttttgtttgactactgattgtgaaattgctgttgtgaaaaggggttcgatgtttgaaaaaaatctgcagctgatgggatcagctaggcccgggtggccgtttgaaaagctgttggccgggtgccaaccttgcttcaatcctaaagactgatacattgcacaaactccgaccggacgagacgcactgtctcatccgtgtcgtttgagaagcactcacttagttgtttttagaaaagagttcaaataaaatcaattgcaaaaacatcagcctttctttgaagcctgcattaaacacttaattcccatggcttgctgagtactcccgtactcacccttgctctatataaataattctccccccagttgctgaagaagatgaagcggatcctgctgatgcggagttctttcaggagcaagccggctacgatgagttttagggtttctgcctagttcccaagtcacgcctgtgttgtttggtccatgtcctgcttccgtttcccttttgtaatgcagttgtgagctcgggatctgtccgcagcccaacatgactgtacctctactctataataaagagacctctgttgctgtgatattctatctccctgtgataccagcactgtttcctgggactggtatcgattaacaggttaatttggagcgtcacgggctagttccggtcgggactagttcggggcgtgacagagggcaaaacagaaagcattggagatgaggtttggaacttatgaggattcttatcacaatcttcccccactattggaggtgatgcaggcaagaaacccgggcacacacatggctattctcgatgaggtgaatgaatatggggagaatgttcttcgtcgggctttctggtcatttgggtgcatgatagaggcctttagaaattgcattcctttgctctgtgttgatggcactttcatgacaggcaagtacagaggaacaattctaaccgcgatcggagtcgacgcggatagccatgtcgttcctgttgtttttgcatttgttgaaagcgagaacacatcaagctggctatggtttttgcggcacattaaaatgtgtgttgttgaaaacagaccaaatgtgtgtgttctgcatgaccgacacgccggtttgctatcagcgatacagaagcttcaagaagatgtcacacagtccgtgccatggccagatttatatagcagatggtgcatgcgacattttggggctaatttttatagacaattcaggagtaagagattgatggacctgttcaagaagttatgcaagcagaatcaacaaagaaagtttgatgccatatgggatcaactggatcgtttgaccactacacacatggaagaggttaggaaaaaacctatagttgccagacaggaggagccgaagggacttgaacccattcctaatgaagcaccaagtattactcggcgcaggaagcgtggaagggccacgaagtgcttcacggagtgggtagaatttgagccaagggagaaatggtcgttgttgtacgatacagatggatcgaggtatggtgtgatgacaacaaatcttgctgaagtgtataactggtttatgaagaatacacgacctctaccacttgttgctatcctggagggcatcacgaggggtacacagaagtatctctgtaaaaggtattccatggctagtctgaacctcagcaaacccagtgttaagtatagccccgctattacacagtacatggatgagaaaagtaagaagggaggaatccacagagtatggcctgctgggaatagagagttgttatttgagatacgacttcgtgacaagagtggtgtcggcattgggactactgacatcacattggaatgcacgttgtggccagagtatcacgcttgcaaatgcaattgcaacaagccttacctgttacatcggccatgttcccatgttcttgctgcttccgcaaaagggggtgttgatggaaacatttttgtttctccctactttagaaaggaatcgtgggaggcaacttggcgtggtgaattgcgtggttggcgtgccgtgtgcgatttcactcgtcctcctccagggcaagccaattgggttcctgactcaaatttattagttgatactaagggtcgtcgccagtcgcgcaggatcaaaaaccttatggatgaagctgaagtgaaagatcgttctcgtcgtaagaaagcttgcattctttgcggggagaaccattcccgtaaagattgcaacatgtacaatgtagggcaagatgccacaggcgctgatgttcgtcgcgttccaaaggggaagtcgaagaagaaaaataatccttagttcgctattatccttggtggactccctactttgaagatcgttatcgttcaatttatgtttagtgcatctgtaattttaatttgaactttcttgcacttttattacccgaatctatttgtaatggccttgtaattttcattttgaactgcactgcacttttaatatcgtcatgtatttgtattggaattgtaatttaaatttcgaactgcactgcacttgtaatatcataatatatgtgtcgtgggcttgtaattttaaattgaaatgtactgaactgttcttatctgtatctatgtgtgctggtactgtaattttaaattgaaatggcatgcaaatttgttacttgaattatgttgcatacatttactgtactgttaccatacgtgcattgtactaatatggttttcgatccgcaggtatggctgatcaatatgatgggcagctgatagacaaggagatcgataggaaccatcgatcgcgacgtcttagtacaggaactttctgcaatgtgctaaagatgagaggaccggatcaatattggcgtattgatcctcgttgggtttcaaggtgtgtgaaaatatattgtttttactaatacaaggtgtttatattttcatgtattaataacttgcgctctgtcatgttgtaggctgagagtagctgggtctttgacgtttgcacggttggtcgagccttcacgtgcaaggtccgaacgaatccacattgacgcggcgcttctgagtgctcttgtggatagatggaggcctgagacccatactttccacctcacagttggagagatggtgcccactctgcaggatgtgtcttatttgttggggctgccgatagctgggccaacagttggcccaacaatggtgaatgctggatgggcggatgaccttctggccagttttggtggtgtgctgcctgttgcactggaggatctcacagatgggcacgggcctacgaaaagttggttgaatcagtttcgataggatgtcttccctgatgaccaggaggagtggattgtgcagcggcacttagtcgcttacctgttgtggttgtttggatgggtgatgttcacgggaactcacgctgactccgtggacaagcacttcatccactttgcggagcagattgcagagttacctatcgcggagattccacagtacagttgggggtcggcggtacttgcggcgacatatgccggactgtgtgatgcttgcgtgaggaacagcaagcaaagttcactccctggatgcccgttgctaattatgttgtgggcgcacgagcgcttcgacattgggaggcctcagcttgactcgtacgcaaactacagtttgcgagagatgtataggtctggtgttgatgacatcgacgatcgtcccactatgggatccttgtggacacaccgtgaggtatttttcgttaaattcgttgatgttatcattatgaatactagttcacaaactttccttatatgactaatgaaaactactacttgttacagccgcagtgggttagcgggacgacacgtcgtgtgtacactcagtttgtagctgactttgatcagcttacgcctgaccgtgttcggtggactccctacactcagcacgatgtcaatgatcgtgcaccgcacggtctcgcggatctttgcacgcgagatatgcaactctggatgacgacttgtcacctcatggtgaacgtgcacgtcgagccacacaatgtccacagggttctcaaacagttgggcatgtatcaggacttccctccgagagatggtcgtcctttggctgatagtcttcataggttagttcacatcacagttgtttaatcctacattttttaaaataaatcactgcacaacattttttctgatgtgtgaatttgttgttgtgcaggtactccagaaaggggctcgggctttcctacgagctagttattgtgaccacagttcagctgacggtacaagagtgggagcacgcagctgataacttggcacttcagacacctccagacgatgggagttattatggagcttaccttcgttggtaccgcagtgttacacgatggaggtgttttcctccacaaagagatagcaccgtcccccaccaggcagcgattactgacacttttacccctcagcctagatcagcttacaactcaatggtatgtgtttatttgtggaatttgagcaactagttcaatatttttaaaaagttagcaagtagttcagtatgtctaataaatgtgcaattggttcaactagttccttttcttacataaatgtggaactagttcagtatttataaatgatgtgcaactggttcattatttctaacaaatgtgcatcttgttaaatactcttaataaatgtgcaactggttaaataattttaattgccttgattatttgtggaacaggcggaatttgttgagcacgttcacgtggagtccgacaccctgctgcaaagactagaggcaagacctccagtcgtcaggcctgacgacgtggcgagcatccttcgcaacttccgtgcacgtgctgccgcactactacgtcgtgtctcctgtcggagcgcggcagatgtggtgtagacgtcgggccgatggccatcaccaccactaccccgacgttccagcgtggatcggagtggtccatcctcttcacgtcgcgggtacgaagcggcccacacatctcacggtcgtccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatagggacttcatatcactccgcgtgcgccagagcagggccacacacagcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacagcattcattgaggacttcttttccactgatcctccccagggggaagtagggatggattactggcacgcaacacctcaggtcacacagccgacgcaggagacggaggccggtcaggggccagacgtgacaccacagcaggtagctagagataggcacccccctgataatttgacatatcccactgaacagattaggcgtaggaagaagggaggacctagcaagcgtgcgaaaggcactgatcgtccttgacttatctatttgtattaaacttttagtcatttaagttctgtccgtattatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcatatacatataacattacaaaaatattttcctttcttacacactaaaataaattacaaattattaaaaaaaataacttattacaaataaatggagaacgcgaccctgtcgaactgtgccagttcggcggatatcctgtcgaacaggggcagttcgacagccctgcctgtcgaacgggggctgttcgacaggtcctgtcgaacggcagccttccgatctcctcgccagtcgcgctctgaccgttcgataggcgccctatcgaactgcacccgttcgacagggacctactttcgcgattttccccggttgaccactacttttgcgattttccataaaaataatattaattctcaaaaaaattcgtgaatatggagcactctgccactggagagatcgataaggaattaaggatgcaatggttcgtgctgccatagacatggtctatggaccattgacgcatcgaagctcagagctgtcaaaccggagggcccattgcatgcaaccgtgaaaagctaagagaacacacatatgttcgtctctccctcactttgatttttttttttttactactacttgaccgtgatcagttcacgtacacgtaggtccatcggctatgctccatccaaggagctaagacagaattaggttacgagaccaccgatgttgtgtgcttgtgtgcgtgctatcggtttgcctattcctatctcagacacagataggatcgatattttggaaattgcagtaattttggtttgaattaatttaaaatcttaaacaaaatttggtcacatctattctttttctaaattcattttttttgtgaaatattctaaaagtaatcaggagaaatagtttcctatcggaagagggtgacaaaatccaaaacctcgatggtttaaatcatgttggctagtgggaatcaaccatacagtttaggaatacatgaaaatgccaaacaatttgaatttgtaagttgttatccaataagtgaagaatatgttttctcttttttaaaataaactataattattgttataacattagtttttcttgttgcatagacggatattttttctagtataaatcaagttcttgtcattaataaactcccaaaaaaaaaaaggagaaaaaccaattcttgtccgagtcggatcatcgatcgaccaatctaagcatgcaacactagcaccgatatataaatgctggtgatttcggccaagttcgcattggttgatcgatccatcggtcctcacgtaggtaatttcacggaacaatctcctcgcgatcgtttacggcttgattgtccatcatgattgtatgattgtgaacggacatccaatatacttataatttggttaaaaaatatatgtgaagtcatgctgatcacataagatgcacacctagtaaccgactcaagcatctctaagagtggtcgaggtacgactacacacctagtcctcgatcagcgtgatagtgatcccaccacttctacaaatggtcgagatatgattacatacctggttctttaccagcgtgattacgatcctccgactatctctacaagtggtcgagctacgacatacacacctaatcctcaatcagcgtggtagcgatcatcaccgcttctactagtggtcgtggtagcgatatctcccccccccagcaccgctaagatggagtgagagcgggagaggggatcggaggtggtggtcgtacgatctctcttgtctcaactagttgtgctgggcctgcacgggattatattaagctccatgtggcccacttatgttgtgccagaatgtgttggttcggcccaagctgctcagggctttagccatcatacagttacgctacgctgtagttacaattattatatagtgtagttgcattataattaatactataatacttcctccatcccattataagcgcggccatgaatttatgagtccaattttaattatccgtcttatttgaaatttttttcatgattagtatttttgttgttattagatgataaaacatgactactttatgcgtgacttattattttggttattttcaaaaagttttcaaataagacagacgatcaaaattggacacgtaaattcattactacgcttataatgtgacagagggagtactatatataaatttacatttgaaaatattttacttaaataagtttgtacaaattttgttttttttagcaaaactgaaaaagaaaaactcgaatttggaaaagaaaaggaaaacgaaaaggaaaagaaaacagttctggtccgaatctgatcatcgatcaagctaagaagtatagatggccatgtgggccgcccggcatggcacggcccaggcccggccgtgcctaggccgaggcttgtcgggccggcacggcccgaccgacgcaccgggccgtgccgtgccagcccacgtgccgcactcacagcccaggcacggcccaacacgcttcgggccgtgccgggccggcccgaagacacgatgggccatcgtgcttttcctcagaataagtctaaattttctccctcctattgggctgtgacattgtatagctaaaaaaagtctattttacctccctcttctttgtgctgtggtatataaatagctaaaataagtctatttaaggttcctattctttagacattgacatttatatgtctattttcagtccctatactttgtgtaccgggtctggcctgccagcccatcgtgccgggccggcccgaccgtgccaggccagcccagcgtgctggtagggaggcccaggcacggcccgacggtcgggccgggccggcatgggcccaacccaagtcgggccgtgccgtgcttgggccgggccaaaaaggcatgccgtgggccgggccttcgggcctcgggccttatggccaactataataagaagcagcactaccaccgatatataaacgctggtgattccggcgaagttctcattggtggatcgatccatcgatcacgtaggtacgtaggtaatttcttggcgtcatcgcaacaatggcgggcgggccggggagctgcgtgatgtgcgcgtcctgttgcaccctcctgctcttactggtcgccgcgctgctgatcctctcgtacggcgtcgtcttcaacgtcggcgtcacggtggaggacgcgtccctgacacgcctcgacctcgccggcgccaacggcaccgacctggcctacggcatctcgctcaccgtcgccgtgcacaaccccaacatggccgtccgcgccgagtacacccggccgctcgccgccgagctccgcctcgccaccagggaggagctcctccacgccgtccatctcgcggacgccgggcagagggtggaggcggccgagacggacaggttcggcgtgaccgacgagggcgtggcggctcatctcggcggcgcggcgttgacggagctggtgaaggagatgggcgcgcgcgggggaggaggtgtcgtcgctggagctgaagatcaccggcgaggtgaggttccggccggtgcacgccggccggacgaggagggtggacgcgacgtgcccgctgaggctgtaccgaccggggacgaacaccacgcaggtcaaccacagggtcatcaaatgccactagactagaagccgagctaattatataggactcgtgaaaaccttgtatctcgttagctccctcggttcgttgcagtttgtaggatcgaacgcgaataaccaagcctatcaggaggggggtgaatggcaaggaaaaccaaaaccccaaaagcttttaccgaaaataaaagttaccctcaaatcgatggaaatctcgacgtagttctattgccgccggtcgaaccactcgcacgcagccggtctaaccgccgccttgtcgccggttgaaccgtctccctgccgcgggtgtgaccgccagtggttagactgcagacttgcctccggtccaaccgtcaggatccagaaaaacacgtatcgacgaaacacttgaaagtatatcaactttattgcatcaatatatgtttacaaagtgtacctaaaacactcccctctcaactcacgaactaggattgaaacctcgaagtaaaccctaatttttctctctcaaaagtcgatatccttctagcctcaacccttcccattgcgaagatctcatccatacagtattcatccaccgtatgccatcttgtatccaacttcgtcacccggtatccttgaccgtctggatctcaactcctccctgagtctagtcccgatccccaccgttgaccgaagttgacctccaagaatcctgactttagtcatcttctcacatggtatcccgaccgcactagacctctgtttttccctgaacataatcccggtcctcaccattgaccaaggctgacctcaagtcacctgcacacaatcagataaagcaaacatttctgggcacaaatatcacaacctgacccacattagtcacacgcactcacactaacatccacacatcttttcaaactaattctttgattaaatcatttgcatagccaattgttcatcacaaatattaaccatgataatgatttcacgttctcccccttgatgaacacattggcaacatcttcaaaatgcaattttgtgtttttgaaaaatgaaaacaaaaatctcaaaagtgaaaaagaaaaactctccccctttttaaaagaaagaatttctcccatcaatttgcaatcaaagcacaaaatcgactatttttaaaattgaaacaattcaattctccctctttcaagaagcatgcattttgtatatttctcctcctttaacaatgatttcatcaagaatgcaaaagagaataataaccaatgaagcacatatgcaatgatgtcatgatcgccacttggaataaccattttatattttatattttatatttctttcgagagctttgaagtgtacctaaaacaattcatgatcatgtattgcaagacaagagagataaattcattaactagttaacaaacatgcactatattataaacatgaatcaaagatattataattaagctcgaattagcaataaggattcatgatttcaaatgatttataatgcaatatattcacaagcacataggttgaaaaataaacactatacatatatacctattgcatttatcactctttctcaaattagctttagcacaaaacaaacaagataattttttaaacttttatttgagccattttactcactttttttctctcaattattccatgtacgtcacatacctggtgtacagcgttggcaacctaccctaggatacctaggaaaggtgtttgcactatgctactactgacaatatgagagatatggatagagctcttgacaatatctctcattacgaaaataaaggaggagaccaaaacttgggccctagtagaagcaaaatgccttgcacatatcaatccttagtttttttagaaaatactttctagtttccttttctttttcttttgtaacgctcttcttcctatacagtttttccctcccagtatactcaatgaaattggcgcacctaaataccgatttattataaaaaaaaaagctcgattaggtggttcagccgttgcgtacgtgcatcgtagcgcagcagatactaccatccagcatatcacgtggcatgtggcacagaagttgcgagttcgtgaatgcatatacatgcagtaggccagtataggaagaagagaagagaaacggtacagatcgatcaagatatttctgtacagaaattaaccagagtacgaaaagttagtaattttgaattgatgaatcatatatatttcgaccaaaactcacaaatttggacttacagatcaatgtatactacaggagcaattttacggtccttaaagaggtgtcacgaggcactacttttttttagtaaactagtaaggtagcccgcgcagttgcgcgggcctcttatttaaaatatcattttttgttgttattacgattttttatattatgactttgtctctcggtgaaaaaatttatggttgaaaaacttcttatgcataacaattgtcaatacaaaaggtccacacacatagaaattgtgtcgtatatatgtacacgtgcattagattaggaataagttttttttttcttatacaccgttgtacgtacacgaagaagtttagcaattgaatggtttagttttaaaggatctaagataatgggctcacggatttaaatcatgtgataatgtagagtgtttgtagcgtgtcatctggtgatttattaggagcgtctgtaaaacaaaagattgaaaagagcatatatttagatgaagcacagaaaaacacaggaatgttaattacaatttattaagacatctagatgaaataatcatt

SEQ ID NO: 57025 - DNA, 2039 bp, Oryza sativa
gggataccagtgacgggttggaagcaaaactcgtcactggtatacctctgacgggttttcctttcggcccgtcacaggtgaggggatacctgtgacggtccgcggccggatggctcaccggtgacgttatcccgtctgacccgtcagaggtaatggtcactagtgaccaaatcgtttgcctgtcacaggtatcccgccgccaaggtaataatattcttggcggttcgaaatagccgccaaggtaattcctgccacccgccaaatcaccgatccgcgcctaatgccacgtcatcgatccacgcctcctcccgcgatctcaatcttaaccgtccattccctccccatccaacagtagattcactaatgagttaaaatactcctatgagttaaattttaactcatgacagttaaataatattttgaagtagtaaatgatttcaactgaaaaagtcatcaacaataaagttgtataactcatcaagatctataacttatattttggtcagttctttatctgacaatgtgatagtaacattttcataaaatttacatatatctcttatagtttatagaactatataagagatatgtacattttatgaacaatgttacaaatcactttgttagatgaagaagtgaccaaaataaaagttatagattttgatgagttataccactttgttattgatgactttttcagttgaaatcatttattagttgaaaatgttgtttgaagtagtcatcatttgaaattcaaattcaaactgttgaaacaaagtcatatagtaaaatgaccaaaccaaaagttgtagatcttgatgcgttttacaactttgttgttgatagttttttcatttgaaaacatttactacccaaaaaattatttgaatttcatatattttaaaattcaaattttttatagtttaatcaaactcggatggaaaaatgaccaaaataaaaatggtagatctcaatgagttctacaactttatttttgacaactttttcacatgagttcatttattatgataaaattcgatttgaattttttcattggtaaaatggcctcatgccacgtcatcgatccgcgcctcctcgcgcgatcccaatcccaaccatccatcttcatccaacggactgaagatcgctgccggttggtctccatgatcgatccgagtgcagtgagaacaaaaaacacctacttattcacctaacaagacaatgcaaggtacgtacactacactggtcaaggtcacctgtgacgggcccaaaccctcacctttgacggttttgggcttggtcaatgatcagtggtcactggtaagtccagtcacctttgacgggtggccggctgtcagtggtgacatccacctctgacgggcaagttaatagaaggccgtcagaggtgttggtctaagctagactagggcttgttaggacccgtcacaggtgtctcatctctgacgagcccctaaataaaggcccgtcagaggtgatgatctccggtatatagtagccgtcacagggtgacccacctgtgatgggcccgaaagtaaaggcccgtcacaggtgggtcacctgtgacggtccgacgtttgcgagtccgtcacaggtgaggttacctgtgacggatgtttcttccgaaccgtcactgatgagttaattccagaaaaaaataaatgctaaatattggctagcctcaggaattgctagccatgccctctgaaaaacagaaacatcacaggtgccagtcaccccccctccaaatggcacttaaatccacattcaagttgcacttaactaacagttgcaaccataggcagcagcatgggcaaacatagacagcaagggcaaacatagacagcagcagttgcacttaaatccacattcaagattcactgcaccaaaatcatgtatataaaatctagcccctacattcatccaaaacatcgacagacaacaaatcacatttaattcatctatacagcagcaccaataatcgaaacaacaaatcacatttcattcatctaaacaatgca

SEQ ID NO: 57026 - DNA, 4521 bp, Oryza sativa
tcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagatatgtccttcacgaaaaagacttgcgttacatcattggcaaggacaaaaggttcgtccgagtatccaaccttgttaaggtcaacagttgtcatcccactgtcattcgcaaacattctcttcatgcgctccgcaattgggagataccacaccacctttgctgggcctcccctctttgacttacttccttcaccttcactctttgctcgtttgtatcttgatgccccacagatagggcagacatccaagtcagcgtattccttgtaatacaaaatgcagtcgctcggacatgcataaattcttctgacctccatgcccaacggacataatacttgcttcgcttcatatgtcgtctgaggtaaattgttcccctctggcaacagatcctttaacagttcaaggagttctgtaaaactcttgtccgaccagccattactagccttaagcttcatgagttccaacacgcatgacaacctgctgtgcttcgacttgcatccatcatacaacggcatctggcaatcttccaccaacttactaaacttctcataatctctgtcattgtcctctgcgtcttcaatgtcatgcaacattgtagatagacattgagtgtccaaatctatggtctctccacctaaagcagaaggtacgaacatgccttctcgagctgcggcggtgttctctacatcctgatccaacacttcttcagctgcgacatcaggcgcctcttgctctccatgcttggtccaacaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtatatccatctacgatccatctgaaatcaacaacatacaaagaaaaataaatgatgatcgatatgttgagaatgaatggagaataatgtgttttttaccttgaattttagcaaaaaatcgcccccttgccctcccaaccgatttgtgaacagtaaaatggtcgggatggaaagcagttggcagtttggggggtattatagacccaacacacctcaaacgggttagataaaaaaagcccgtcaaaggtattggtcatacctttgacgggcttctattcagtggcccgtcactggtatacctttaactgttactgctttcagcccatcacaggtgaggggatacctgtgtcagctctgagacggatggctgaccggcgacgttatacgtgatgacctcctcagaggtaatggtcactcgtgaccaattcgtgtgccagtcacaagtgtcccttcttacgtgtcaggatctggaggggatgtcttagctagctcgctaactcatgctgtcgtttcttagcacaccccacttgctagctagctagttatgctcgatcagtgctctgtcgcgttcgatcgacttggatcatgtcatgaaggaggcgtgggacatgatcgagagtttcgtgcagtctagccgaagatgctcctccatccgatctgaccacgagcagcgtcggaatgtgggtggagctgatcgagcctgttgcctctgatccaaataaactcgagcaggaaacgcctcaggtccggccgttgcacaagatcgagacaggacactgccgcatgcacaagcttgcattggtgaacacaaaaaagaaacgcgcgaaagagagcgacggaggtgcatgcacagtagccgtggaccaccgtaccccaacgcgttgatgcaaaaaggacgcgctcttccatattgagcgatatagatgcaattaatgcagtgatcgacctgcacatacagatgagtatatatatcccgggaaagtttcaggtgcaacaaacccacccaatcagttagctagctagctggcttattgcaacccacccatcctatatatatcagctagctagctggcttattgcagcctcgatcaagacagtgatcggctcaaaaagctagcaacgacccaatgcaagctctgccgatgcaatccttctacatataagggatcggaggatgcatatatagccatctccatcacatctcttacagcttgatggagcagcagttggttatttttccttaatttgcctagtacgttaatttggaagagtaaatgtactatgaaactgaaaatgtttatgtggctacttatgatggatagattaaacactagagaaatgctacagagaagacatttcacagtacatggtgaaccagaatgtgtaatgtgcagtgatgcagcccttgaagacacgacccatctttttttctcctgctcctttgcaaagagttgctgggtttaccttggaatacattggagaatggacctcagtttcatgaatatgattatgtatgctaaagcatatttccagaaatctttctttattgaagcggtggcaattgcagcttaattggaacatttggacgacaagaaatgcacaattttttgatggtgttcaacttaatctaaactcttggaaacaaaggttcagggtggattttactctacatatgtttagagtaaaagaagtagaaaggcctatatggaaatcatggatagacagagtgatgtaataactttgtaaattctatctctctccctctttgtaaatattcttccctttatatatattctaaatggatcacatgcgtatggcttgcacgatgaagcaagccacccaccaggccaccactatataaaggggggcagagttgcacggtatatctattccagcacccacctacaagccgagcagagcacaactgcacgatggcaaccaccccacgcctgccggttgtgctgctggtgttggcagcggcagcactggccgcaccggcgatggccgactacgcacaccccccattggatcctaaccagtaagttttccaaccctctcctgcgctctcactctcacgtactgaggattcattctccttaagtctcctagctaatcgatcttaattaagccccactaattaactagtctccctatagcagctagatcggcccctatatataaatcaagggaatatacatgctttgctgccgatgttagcttttgcattgcattattagttggaaacttggaacaattaagcatgcccggccgtgcaggactgactcatccactgcactgcacgaccactactctgcagtctgcaccggcctgtgtagtgttactagtgtagaactcctcgatcactactctctcgatccaaatatgatactaccttatcaagcaagcatgctagtgatctcattaattgatactgatcgacagtcgtatgtatgtacatcgatcacactggctactaggaaggagatgcatgaggccatggtatgtatgtatatatatgatgctaccataaatgcagaatcagcaagcatatatcgatcgaatgcaataacttgatttggattcattagtttattattaagtctaattaaccgcgcaatatatataattgggagttagtacgtaataattgtgcagtagctcggtcagatcatccccgtatattacgaacgattctcgatcaagagggttgtgctgctatgctagattttgtaatgttccattgaatttttaatttgtgttccgatcgatatgagatatgatcatctcatgcatctagtatctcagaaatacacgtacgtatgaatttttttgagaattaatattatttt

SEQ ID NO: 57027 - DNA, 830 bp, Oryza sativa
ctataaaatttcaagagctgaagcacatccacctgcacgagctgccctctctgcaacgcatctgcgggcataggattgtggcccccaagctcgagaccatcaaaatccgaggctgctggagcctcacccgcctaccggctgttggtcttgacagtacccgcaagcccaagggggattgcgagaaggaatggtgggatggcctgcagtgggatgggttggagaacggacaccatccttccctctatgtgcccacccactcacgctactacaagaagaaactgcccagaggttccatgctcaggtatgtacatatgtctgtgtgcatacatgattgttacttgggtatcattccttgcgcgcacatacatacatacgtagaaacttatatagctcagtactttagttactccatcatatatatatatatatatatatgatcgagcttttcccttttttttttaattttgtctgacttggcgtgctttcttttcttcttaaattcaggtgatcgatatatacgtccatacactacatatttgatactgtaatcatctacgtatcattccctttccctcatccagtggctcatcaagttcttcagctctatctctattatatatgtccttatttggggctggtgttcaaagtgctcgctcatttcatcatatcatttgcaacggcaacaatatctaatgcatgatgagtaagtacatctccggccggcatccagacgctcgtcatctgcttgttactagcttggattctgttcatttctgcttcttttgttctgtgtgaaaattaataaatggacgctcaggggctgcaggaat

SEQ ID NO: 57028 - DNA, 1055 bp, Oryza sativa
ttggctttttcaaacataagcttgactgtcctgggtggcttacgcccgaacttgccgaccaattcttcgtggcgaatccctttggtgaatgcggcgatgataacgtcgtcggtgatatcggagatcttgttacgttgttcagaaaatcgccggatgtaatctcgaagggattctccggacttctgaataacgttgtagaggtcgtattgtgtgccgggacgctcgaaggtgccttggaagttggcgatgaagtggtcgcgtaattcagcccaagatccaattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccgtcgtacttctctattccagtcggcttgaagccggctggccaatccactcgacgcaggtcgtcggtgaaggctgctactccgtcaaggtcgtcgtcgtggcggtccggcgagtgatgatagcctcgagctgcattggctcgctccacctgtccattgctcatggggtgtgccactgaggcatagcaaatcttaattccaaagtcctcacaaaagtctttaaaaactccgccagtgaattgtgtgccattatccgtgatgatccgattgggcactccaaatctatgtacaatgttgatgaagaagtctcgagcgttatctgctgttattgtggcaaccggtttagcttcaatccacttggaaaatttatcaatggccacaaagagatgcgtgtaaccgccgactgcctttttaaacgggccaaccatgtcgagcccccaaccgcaaacggccaagacagcgggatggtctgcaactcttgagctggtagatgaatttgtctggcgaaaaattggcaaccttcgcatgtgcgcacaatcttgtcggcgtcggacactgcagtaggccagaaaaaacctgccggtaagctttgccgacaatggtgcgtgcagcaggggctgcaggaattc

SEQ ID NO: 57029 - DNA, 6448 bp, Oryza sativa
  unsure (1)..(6448): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaatgtgagtctctgcccttcctctggtcgatcgatgacgagcaaacacagcgcgtttcgccacgctttctcccaacccccaactccatcccatgtcggcccatcgtccattcgtcctccagaccgatcacatattcagacccgtcaacttcagcatttcacgcggccactacgacagctgcttcggctgcactttcactcgtatcagcgcgaggggaagaagaacaatccgtggttttccgtttcttcagaggcatggacagatcgtctcacgactcgtacgcgaagatgcttgatgcttcccggaggatcctgtctcgaattttgattggatcactgcgcactggacactcactactacgttaatgctgctgccagggctgcagccaaaggaccacactgtcattggctccgggacaataggaggccatatatttagccattttttagggagattttcaccaattgtacagttgcactattgctacgcagatcactgcatacgcaattaactctttcttacaagctcagaagctgtctgcacctatatagctactccctcctccgttctataaaaaaccaacctactatcggatgtgacacatcctaatactatgaatctggatatacatcatactaaaatatgttatatccggttctagattcgtttttatggaacggagggagtattctgtcatcagctatcactgctctgcctgaacttgtctgagctattactactgtagtatatgaatttatgaagtggagtctcgtaacaaaaatacgagtatactccgtactgtactacccttatcaggattcaaggatactaggagtatagcattaccagatcaggcacttagatgtggccatccaaagagtaatggtaatagcctaataggagtaccatctactattgatctttcaaaaaaaaaagtactagtatagaagtagtatccagctagagctgcttaacagggtcagaatttgtccaaacagagcttgtaatgcacactgacgaagtcgatccgatcgaatcagagtcaacatttaaagagtactatttcgaagtaaaactgttcagttcttacaagattacatgtgaatttgcaagacttggacatgagtgttcatctcgtagtttaatgatgggtacccaacctgcaacaacagtgctttaaattgtacaagcagagggtaccaacagagtaatttgcacatgcagtcctgaacctgatgccattgcgaaacacacaaccctatacggtgcagatgcaagggagcccaattcagtcccagccattatctgtattgccgtacttccgcagggaaagttaccctctcatctgatctaccattgcatacatctcaaaaggaagtgagtaaaaaagaaaacaggaccaatcttcagagataagtttttgaaacctatcttcagagataagttcactcggcgataggagaggacctgatttggactcaaatcaggtgttgacgaatagagtagcaagagttttttcgacgggtcaagacctcaagggtcttaacagttgaactaactcggttatgatttggacacttggtgattaactactgataatagtactacttattgttattggcttgttacatcattcggtgctcaaaaatcagatgcaaatttagatgggacagacagcagctactagcaacataagagaattatgttcagtgtatcatgcatgactaaactctgaacgtactcacctggatccagatgcgagcagtacagtacctgtgcacattgcttgtgtattactccacttaattacgaactctattattttcctccgataatgcccgcagaacaaggttgtcactgaaaaatggtcctctccagagtccaggagctataggaggagtatgatactccttagcaatcatatactcatatgacatatccaaattgacaccggggttaagccgttaaccgtcactacgagttgcacttgtataaacaaaaaacaagggagaaaaccttgtgtcccccccatgatgcagaaatctaataagagcagcccaacgcttccggttggtggcggtagaccggcctctttaaactaccccatccgccccagatttatcaattactcctcgtcatctcgtctcgtctccgccaccgtgcgcgcgtcccctatattagaccccccaaccgggcaccggacacaccatcaccaacacaccactgcaaacccatccgcctccgcaccgcatcgcacctacaaattgtgcacgctgcaccgctcaaaaaaaagaagaaactaaagtcgtacgtaggacgcggcgtgcgagcgttggtgcggtgcgcggcggcgcgcggggaagtagtgagagcatcgatcatgccgggggcggcggggtactccgggtcggtgaagctgaagtacgtgaagctggggtaccagtatctggtgaaccacttcctgacgctgctgctggtgccggtgatggcggcgacggcgctggagctggcgcggatggggcccggtgagctgctgtcgctgtggcggtcgctgcagctcgacctcgtccacatcctctgctcggtgttcctcgtcgtgttcgtcggcacggtgtacttcatgtcgcggccaaggccggtgtacctcgtcgactactcctgctacaagccgccgcccagctgccgggtgccgttcgccacgttcatggagcacacgcgcctcatcaccgacgacgagaagagcgtgcggttccagaccaggatcctcgagcggtcggggctcggggaggagacctgcctcccgccggccaaccactacatcccgcctaacccgtccatggaggcgtcgcgcgccgaggcccagctcgtaatcttctccgccatcgacgacctcgtccgccgcaccggactcaagcccaaggacatcgacatcctcgtcgtcaactgcagtctcttctccccgacaccgtcgctctccgccatgatcatcaacaagtacaagctccgcagcaacatccgcagcttcaacctgtccggcatgggctgcagcgccggcctcatctccctcgacctcgcccgcgacatgctccaggtaagtactagccagctctttgatgttactactgtttagctaactaactaatcaggtgagccattaacgagcgacatggacggacacgcgcaggtgcatcccaactcgaacgcgctggtggtgtcgacggagatcatcacaccaaacttctactggggaacccggcgggacatgatgctgcccaactgcctgttccggatgggcgcggcggcgatcctgctgtcgaacaggaggagggaggcgaggagggccaagtacaggctgatgcacgtggtccgcacgcacaagggcgccgacgaccgcgcgtaccggtgcgtgtacgaggaggaggacgagcaggggcactcggggatctcgctgtccaaggagctgatggccatcgccggcgacgcgctcaagtcgaacatcaccaccatcggcccgctggtgctgcccatgtcggagcagctgctcttcttcttccgcctcgtcggccgcaagctcatcaacaagaagtggaagccgtacatcccggacttcaagctggcgttcgagcacttctgcatccacgccgggggacgcgccgtgatcgacgagctgcagaagaacctggacctgtccgcgcagcacgtggaggcgtcccgcatgacgctgcaccggttcggcaacacgtcgagcagctcgctctggtacgagctcgcctacatcgaggccaaggggcgcatgcgccgcggcgaccgcgtctggcagatcggcttcggcagcggattcaagtgcaacagcgccgtctggaagtgcctccgcacagtcaagacgcccgccgacgggccgtgggacgactgcatccaccgctaccccgtcgacatcccggaggtcgtcaagctgtgatcgaatccatggtagcctcagcctcgccctcgccggcggccgtcgcgccgccgccgcattacctcccctacacctgtacgtcacccgcgaagcgtgcgtcctcaaactttggagcttcttaatttgtggtgttttcttctttcctcctttcccctccctcgcttcttaattttttttcttgtcttccttttatttttatttttttcgctataaacacggattaaatcgatatactttgtctgatgtgtcacataaggaatgatcattcacaggagattaattattatatatttttttaattttccaatttagcgtggccgtggttgttcgattgttcgtgtcaggatccatgaagagggagagggattggggaattgaggggcgtgatcgaatctcataggctccagttgcaatccgtatcgttactggcgaaagggatacacgcatagtctctggtagactggtaggcctacactgcacaccaattaatctcttttgatttgcgaaaaccctagtacagtattactacattactcttccaaatacagacatgcgtaatttattactgagatgactacctgattacaactgcgtactccctccgtctcaaaataaatgcagttttgcattattcacgttcaacgtttgaccgttcgtcttatttgaaaatttttatgattagtaattttattgctattagatgataaaacatgaatagtactttacgtgtgactaaatattttcaattttttcataaatttttcaaataaaacggacggtcaaatattgggtacggatatccatggctacacttattttaggacagaggtagtattatactgagatatttcagtccttctttgttcctgaaaaatcagtggttccggtcttaaaacttttggtgataagaaatggaatatgttaggagattgtacaaaaaaatctgaaggagagggcacgagctactcatgatccgtcgttgggagttttagctcgaaccgaactcatgatccatctaattactaactgaagttgagttcatcttactagattaaaatcgactcgcacttcatgcaaccggtcagacatgatccatctaattactggttgaagtgagttgtgctcattagctcacgttttattcctctcttaagctagaattccatttctgttataaattctgacaacgacgtgggtttacttacatgcccgatctgctatggttgacaattagaggactagctgagaataactccaacttttaaatttaactctaatagttaggtttgaaataaaattgtggagtagcctaaacccaatactaaacccaatacagtctcggtgggagcgcttaagcggtctagcccgcttcacttcggaggagctgaaagccaaacatgcccttgcccctagatgtacaataatccaaaattgtctgattatccctttcttaccctttgtcgaatttccaatatccctctgtttatacggctgtaacacgtaaataaatgcagtcgccgtgccgacatgttttccgggacaggctcttccttgaatagagaagacggctttcttcctcagtttccgttccgcctcaaaacatcaatcatgctccggtgtggaggacgttaatcgcttttacatttatggcgacggtcgactccccggtgaggatgaaagccggccgttcgatccaggtactcgacggctgcgtgcgttgcgtggctgggtcatcacggtcacgacctcacacgggcatcagaccgatcggatgctagtaaatgcggacgaggcgcagctcagcgccgggtgggtgggtgggtgggcgtgtggacgcgaggctggcgcgagctaagctgtggtggctagctggagggatcgcagttaatggccgaggaaggtgacaagatgggcttttttccccggttgcgtggtcgcggcgcggcgttgccggtggccgcagcgcggctgcgctgggttttgctcccccgcgcactcctcacctcgctgggtcgtggcaacttggcgtcgcgcgtcgcgtggcgttggacgcggggagaagcagcggggattgggtggtcgggcacccgcaggcgcgcgtggcgcggttgggaggcgttaa

SEQ ID NO: 57030 - DNA, 23043 bp, Oryza sativa
attgctggatcagttcgagaggcagaagcaacaagtcagatgtatgtgctacagtactagtgtcttcagttcccccgaaacaacatgaaaagcacatcgccctctaataacagcctgtcgccatttagcattctgctatgtccaaattcatccagaacagagttcttgaatgtattccaacttgatgctaacttcgcgccacaaatcttgcccgacatggcacagtggtgatcatagatcatctgtctactcacacgcataatccatgagcaagagatccgatcccttggcaggggagtcttcggatcagtagcacgaagcatacgtatacaccaatctaattccatggtgatatctctatttatgattaaatatgcaacaataaataaatgacttcatttttatctagcttactccttccgtcccaaatttattatactaggggcctgttcactttgatgccattttcaatcttaccaaattttggtaaagttgccaaaaaagtgactatatttagtttgctgccaaattttgataactatatatgccaaaattttggcaacttttgggcatcaaagtgaacaggccctaggatgtgtcgcattcagtccaagttcgctatattttgaaacgaagagtaccttggatcaatttggaaggaaatataagttttctaatgcttgcaatcgtagttaaggacaactacattgcaataataggctagtggcttgtctagattcattagcatccatatgaacatggacaatgctaaaaagtcttataatatgaaatattataaaacggaggtagtattaaattgctgatatgaacatgcaatgcaagcacaactagtcaagatcttggtacgcagttcatagcaaatctgcactgcacactgaaatgaagggtaaattttcttctatgccactggaaatttacccaaacccttatttgccagtcattctcccgatgctgcgtggacctagggcccgaatgagggcgatgatttgcgtgttaatctaaaatacaaataaattttatcatcaaaaggccataaataattgtttttgatcaaatgggaaacatctcaacaaattaacaccttcacagtcaaagatggaatagaatttacctaaatagtcaagacttcttttcctaaagaaatgtcgaaaaacaacaggaaaataacaagtatgaggtataattgagattatgtaaacgattgaaacaagaagcaaatcaaacaaaagaagcatcaacgtccacagggagcaagagggtgcaagaatgaatcaaagagagaggaaaaagaatttcaagctgcagtaaaaggtgagttatgtcaccctttgaactaactcctaaagaaacaagcagcagtaagtggcgatttaaatccctgaataaaaaatgagagaacatgaacatgaagttcaaaatgatgatataactgtagtcagtttgagcctttgaggagggatgtgctgtccttattgtattaagtcaaacaagaaactacttgtaatttatgtgacagtagatatagcagtgtccttatataacttcttcaaacaagcaatattcatggatgagttctgttgaaatttgtgttcaaaatcaattgttaagcacacatagaatgacttgcaaccctatataacatttgcccattcttgtcactagatgaacagtgcagcaattaagtgtgcatgcccccatgtgtgtccagctgtccactttcccaggaaatcacgaaatgtatacatggacaattaagaagcccacaagttcacattatcacatatgggcatcaattaagacactgaaatgataactaccttcttttgaaaaaggcaggatcaaataagcgaaacagagtttagctcctagatgaaccatcattgtttttgtttagaaagactgtcaccaaactataacacaacatggacaacaatactataggcaacttgaagtataagtgcaagatcacaagagggtgagggtgtgtgttggggggtatgcatactgacatttgacatacatcacatttaaaagagagaaaattccttccatacccctgaaattttagccgatcccttctatgcccatgaatttccttcactcccttgtatacctctgaattttgatttggatctcttccatacccttgccgttaattgaccgtttaataggtatataaaagtcagttttacccttcaatatgtgaggaatatgtagaaatttgtaaactatattgttggaagtataaaatttgttgtgtgattatcatattcataagttttatgtacataaaaaatttaatatatatttaaaaagtacatgtagcatttttttaaatgataaacatagttttggaaagcattcctatataatatatacaacaggagaaaatatgttgaactaccataaacaaatgctacatatactcttttagtaggtaaataaatattagtttttatgtcattaggtaaaaataaactttgccatgaataataccttgtacaataaagtcatgaatatgatagtcttatataacaaaattatacacttccaacaatatagctagtctacaatttttagatttccttcatgtctaagggcaaaaaggtccttttcattagaattaaacattcaactaacggtatgggtatgaaagggatcaaaaccaaaattcaggggcatacaaaggagtggacaaaactcggaggcgtagaagggattggctaaactttcaggggtatagaaggaattttctccatttaaacaggaaacacacaaaaaaaaatgcttgcatatcgcacggattcaaaattcgttgaacgtggaacttttggaacaaggtaagagaaataagtatatgttaaagaaaagggtaaaggagaagtacagtgtatatgaattctatgcagatgcttcatcagattcaccagcaccaccatttttcttgctaaagtattcttctgcacgagcttggttcttcagataagattgtggtagccatttcttccgctttggtaccagacttaaagtacaaccagctgcctcgagcttctccttggctgaagcagagaatgccccagccttgatattcaacttgactgatacatcaccatctcctaaaatctacagataggttttcaaaagttagcatactaatactacccgcatgataaaagatacaataacaacagcaacattgcagtatcattgtactcaaacaaagatgaaaggaacgccatctgctgaacatcagaatcagatgtcaagaaggaaaaagcctatcataaggataaagttgatagctccccacattatgacttaggtcttgatacctgttttagccctgtgggttttaccttatatgtaccacatagctaggagcctagagtatagaaaaaatcaatcaaatgaaataggaccagaaagaacaataaaagttgaacaattatgctattcaaggtgcattaagttccacccttggagaagtctttgtcacatcagtgatcaagcgccacaccactacccactataaggggcaacccagtagcacactaatgcatctactccagcaatccgccaactaagagtggagacaaacagtaaatattttgggtatgttgggagtgatgcagacatgcagtggtacatgtaagagcacatggttttgttgggatcttgataccacttcatgtttatgcctgacagatatgctcatatgcaggcctacaccatgtgtgggttcatcataactcatacgttctagatccttgagtagccaatagaaacactcgtcaaatcataccgtgtttgtccaacacgagctaagaaaattgatcccgacacacaactttgagacttcgaatactcaacttggtaattgctgctaaggacagaccaacacagcaacatttgagaactacaagaaaaaaaaaggccagccattcaatccacaacatcaacaactaaaggattacccaagactgctggtgaacttgatgaattcactggcaaagatcaaatgcaaggcattcatatttcagttttcagtaaaacatggtcatctacagaaccgacttaaaaaaaagaaggataatcgtcgtatagtgtaccttcagaggaagctttctctccctgccagacggattaatcaaacccctcgatttcaaggattccaatgatatctcgtcaccatccttgaacccgccacgcgccaagtctctcaaattgaacggcacatacttcggcaagccaatatgcattcctgcaatcgcaaggtagaacttgcaacgggtcacttctcaatcccagcatttctgcattccaaatggaaggtgctagcgtgttcccactcaatttccagtgcatttgaatgtgtgaggcttcgattgagggcgaggaggggaagcgggaagctcgaagagactcacctccagcaatgccgcgcagcttggggatgcggcggtagagcggcatctgccctccctcgaacccgcgccggacgcctggccccgagcgcgacttctgtccacgcatgccgaacccgcagctcgcgccctgccccgccgcgataccgcgccccttccgcttcggccgccgccgcgaccccttctgcgggcccaggttgtcgagccggaacttctccgcgggctccgcctccgcggcctcggccgccgcggcgctgcacacgaccgtgacgcagcggcgcgggcgggcgcggaggacgacggaccggcggccggagatggggcctggagcggcgacgaaggaggtggagagcgaagtggaggccgggaggtggagcaatgtggccgcgggagcgagggagaggagggtgatggacgccatggcggtggagcggagagcgcgcctgagcggcttgctggtgtgggtggatagaaggggataattggggaaggacacgagggagataagacggttggataaatgggccatgaatccaattaacccttgggaatttgggcctcttttccctctattttgtgaatggtttcgtattactcactttgcttcttgtttattaaaggattttagaaggtttacaaaagtttatgaatagaatagaactgaatttatcttcttaagaaatgaacatatttggattgatcttccacacacaatcaaccaaagagaaaacctgatctttgctgttcttcaagagactagtacggagagaaactgatgggtcacacaacctgacagagttaagtatactgaactgatctatgctaagaaaagaaaaggtgaaatgagaaaggaagaaacgaagacatgtacaagacacatgcttcacaggatcgtcccgttgcatgtctagcagtagacaggtgcaaggaattaaaagtaagtgttacaactgtagtctggataattgtacgtccaggcctcagctgaaagaaactaatggaactctggccatcaaccatctgaaatgtcaacaacgatacctctagttggtgagttcaatggtgacgatgcagcttggccagcttgatcctctgctgctacatgactacttacaggatgatctggcaatgaacttacatcaactcgattagcttgcacattttcagatttgtcattgtccccctggcttagggggtaagagccagcactgctagaatttctgccattttctacaaaagatgtagaactagcaccttcactgccactattggattccctagcaagaacaagtttcagtaacttctgccgctttcttctttcggttcttttatttatcaaaggcacctcatcttcatctgactcatccacagaatagtaattcaaccattcaatgattacagagtaggaaccatcccacttgcttatttttcttttcttctgtctgctgcactcttgattcttctttagtgaggttgttcttggacgcttcggtgcttcctgaacagttgtggcggttagacggtccaaaccaatatcctttgacaatttgattttcttattagctgtgtctcttgaagaggactccattccagaaataccaatagagtcatcaggaggaaacccagcagaggtttcttccagttcatgcttattgccttttccacccttaattgatgcatgcgcattgtgccaacttccaggggctgattcttcaactttgcaatcaggtgcttctacagataaagctaccaacaaaaattagcagtatcatcaatttgtatgagtaggcatactaagagtttaaaatgtatatctgcagtaaagagtcatctcaaggcatttcaacaaaatagactgttttatggtcttaaaatgttatcataactggaacctcctttttaagccaaatgttaccttttgaaccctctacacaacctgatgatgatccttgaactctgtgatagctaccagtgcaccgcttcttgtgcctatatatatattaatacagaaagccaaatcatgactccatccatgaactcaatgacactaaatttagagtaagttgcatcccaggaccccaaggaggagaaagagcatgatagttgttcaggtattactaatcttgtttggctgctggacatgtcgatttcacctccaataaagaaaaatttatgtcagatcatttaccactttttagattatgcaattgccaaagtgacaggacaacacaaagaaaatgttagatattgaagcagacacccatcattaccttcttagtttaacatctctctttgtcaaatttaacaataataatagttgatttatttgttcatcacaaactgaggtttacatcctacctcccacattgcaaggatacactaacaaggcagagagtaataaattacacattttggaaattacacagttagctttaaaatgtacatctagcttatatttctatgaatatttatgtgcactcttaggctgtgttcagtaatggaggatgggaacctatcccctccgcacggaaaacggagcggttcattagcgcatgattaattaagtattagctaatctttttttaaaaaatggatcaatatgattttttaaagcaactttcgtatagaaactttttgtaaaaaacgcactgtttacagtttgaaaagcgtgcgcacggaaaacgagatggatgagttgggaactggggattccgaacacacctttagagatataccaataaggcatgcatggaacaaaaaaaatgcaaagaaatatatagctaataccaatgccagtgacaaattaaactgtcacacaagtcattagcacccattgcctcaatgcagtcatcctgtgatggtcctttgattttggttgacttgatcaaatctccacagctttcacactacagagattgttagctgccaatctgaaattagaaaataagatttacttttaaagatcaggttcttactttgtgtatataaaatttctttctgatctcatggaacacagttatgctgtagccaccaagaggacgctggatataattaaaaatatcgttacgataataagaaatatttaagcacatgctgattgaaaattgacacctgaattcaacttacatgaggatcggctacagagtttaaattgattgtattcatcagtttctggaattttggcccatggtcactgcttgatcacagtttttaaattagtcaaaacgagaaaaaaaaaagtagacagaaattcaggtgtaatacaagaagaggccagtcatggtactaaaaagtacctatggttatcattactatctttgatgcacatataagcatgaatcatttcatgaagcagcgcattctttaaatccaaatctgtgtggtgttcatacaaggatctggaaagaagtataatacagccaccaccaccaggataatattcacagccacctacttcactgcatcaaaatgattaaaaatggaaagtttcaaaacaatcatactggtaatagcaggtactatggtctttgatgaaagtttcttatttcagagaataactatagaagaaaacaattataggcaataactcacaaagttatccaatagtacagagtttatgtgaaaaagatagtgttaagatgaaaatatggaagggtcggatggtcagcatcatttccagtcaattatagttgacgattatgagctaaatgacactatgacagacaactcacgaatcttgttgaacatgcttgctagaaaaatatgcacatgacagtgccataaatgtggctgacatacttcataattgtgcatagcaatacatcagtcactgtgttccattcaaaatgctatgcacattcaccaatagatttgcaaatcaaacatatttgggaagtatatagggcttgttcactttggtgccaaaaacaaccttaccaaaatttggcagggtaggaagtggcaagttttggtagcgttggatacttggatgtgttttgttagatttctttccaaattttggttgtgtcattatgagtgggaatgggaaactttcagaactaccaattttggtagaatagcaatggtagaacgtggcaacaaaatgaacagaatgaataggcccatagatatgataccagtgtcttcgaagttcaaaacaactggagcagagatgtctatgtaatcagtctaagagttcaagcgactttttcattctactgtctagataaatttgttcactccttcccaaaagtaaatgtttttacactattttcccatttctttctagaaagcatgccaaaagcatacattaaatctttccactttttcatggtttagacctaggcattgatccatactctcaaagagtgtagtttttacggtcaatgaacaagagaacgacgcaaagatttagaggttaacagatagaactgcagataatgacaaggcataatcgtgtagaataatatggatcacctatgttctggctgaacgtttagatcaaaatacccgaatatggataatcccctttgatgccctaattcatttttaggggattgatgttctagttctaacgaacaagggatatatgggttaagcacttccttttggcattgatccactggtggatgaatgagtggatttgatgcggggtgaaccaacatataccgaatgtccgaatcagaacccctacagaacaggattgttctcgtgtgctgttccccctataaagccatcatactgcactgaatctactaagatacgcatgcttagtggcaggacatgaacggagcaatcttgcaaccaccgcacacaactcaacatccacacaagacctaaatccgcagtattcagtaaaccggacccccccccccccccatataacaccgagaacggcgagaattcggagtggcgacgctttaccgattggggagtggatcctcgtcggtggcccaggagacggcgcaggtgccgagggagtcgtggaagtagagggcgttgtagtggcagaagagcttggagatgtccggctcgcctccgccccggtccggatccgagcccctcatggccggaggagtagcctgcgagtagttcgcgatggggacggcggcggagcccggcgactcggcgagggttttggggaagaccccggtcagggttctgtaggcggaggtggaggaggacgaggatggactcgttggccattttggctgggttgggtggtggtgctcattaagcccttgctggctgcacctatgtactctctccgtttcgaattacttgtcgtcgtcgttgttttattacattgtatacgaaaaaatattaatgaactataattttattaccattattaattatatcttgttttttcaaaataagtagtacaattaattgtaacagataatagcattaatataactatatttaaaaatagtagggaagaaaacacatctctataaattgtaaaaagatgattattatggaaaaatagataaatacaagaacggcaagtaaattgaaatggaatgagtattttcatatagaatgtggggatttttttgtcatatgagttaacaaggaaagatgaaaaatatatggattacatctaaaccttgtgagaaataaattacattaaattagcccattaaattattgatgtgtattgagagagttatgtctaatataaatcataggtgatgtagaggatataaacactatgaatagtatatagcactggcagtttaggaatcgtccttacgatcgatcaaagtgatgaagaagactattatagtaataacttagcgatgttagtgtaggtgtgtggtggtctgcatggcaccacatgacacatggatctagtaagctaactataatgactttggtgtgatggcaaagaaaatagaaggttaggaggccatgatcaagtttgacatgataaaggacaaagactagtctcaaatgcagcgactcgatgatagtgaatagtgtcgtggtttggaggcatgaagattgcaatggctcgatgttaatatggataaaaaaatgtggattagcgatgacgaccaggtaaaatacgttgagatcttttcagcgttattggtttcattaaaaccgctggattataacagagtaaggtgataagtctatccactggctaacttttcccataacctagagactctcgtcattggcaaatgttgatgttagtgtagagtgactagagtccatagaaacattggctcttgctgttgtagtagcctaaatagcctaagaatggattggtgcttgaagataaccgatgcctcactgagaagtttgttgtctaactgcaaattggtgtggcgtactatgaccaaattataggtgtaacatatcagggcatggatgtaaatggatttcaatccgagctaagatatttctaaagatcactagttatattaggctcatggttgcaggagtccaatatgtgactggatattgtaaggctattaagcacctggattccattcatatcctcacgtcttaagagcaaatttaatattagagctcactatcagctattatcatactttaaagacaacatatataatagattagctataaggttccttcaatttttgttgtcctctctcttttatctcacttatgcatttattgtatttgtcttggagcacgtattgagctagttcttgcacaagagtaacacccttcattttttttcttgctacctctctcatccacgtaagtttataattaatttatagctcactattatctatgctataaggcagagtgtgagcaagttgggttgcagtttcctagtaactgtaaggtaaaatttggaggcagctcatccaagactgatccatctattggtatactccctccgtactcgtaaaataagttgtttaggacaatgtttaagtcaaactttaggaatataaatcatgaataactctcaagttattgagtttgaaaatgtaaaaattatatgaatagatttgtcttgaaaaatactttcataaaagtgtacatatatcacttttcaataaatatttttatagaaataacaagtcaaagttgtgttttgaagaccgtatcattgttcaaaacgacttcctttacgagtacagagggagtattcttttgttttaatatcaataacatctcaaaagtattttctatattttgtcacttttcatgtacaaaacatgttgatattgtggttggttgtgggcatgttacattttcggatttgaggtagaaaatggatgatgccatggatgtaagaaaatgcgcagttgtaatttagtcttaattatatttgataatcaactttatccttggtttgtcttcatttaaacagtcttctcccccatgtccggcggcgccgtggcccgtgtggcccgcttccacaacctgcggccggcgccacagttgatgggccggcccatcactcctacctcgtgtctctgacaccctgaccacacgagccccctccccactcaaccggatagacgaacgccagccagtcgccggcttcaggctaactaagccctaaacccgcgtgtctcctccctcctcgcgagttcgccggccgcctcgcctgcgtcgatctccagtgggcagcggcgccggcgtctgctgcttccgccgcatcctcgcccgctggtgagcaccccacccgttacgcgcatcctctttctcatctctcactaacccacactttttttcccctccgatttgcgttggccctagcttctcttctagatctgtaggttgcctttctctttacctttttgccttaaccttagcacgaataacaatttagtttgttcccaagaaaatttgggggttcaaccgagtttaacacgattgatgccaccgatactccacagacttcttgcgtctaactttgttttactattgcaagttgtgaatgctgcagtttacatgattcaattgtttggttctttgcacagccaagagcacccccggtgaatttgcgagatcagttgggagtaaggacatttcggctgctgtaaaattggttttcataagcagagcagcagatgaggctaactgttggccaagtgcatcgacatgtgcttgcattggcatcttcgcgatcatgcttcgtcctcggtgacaacctcccattgagaatgctttcattaccacgagcggttagatttcaccagaccgcttggcttggtactgaaacagtacaagataagagtgcttcactaactctagctagtcttgaagggcaaaacaaagttgaatatggtaagaaagaaaaagcaacacgcattggaggtccaaagccgtcttcaagggcttctgctcttaaggtgaaaccaaaagtttcttcatttaattccaaaccagcaaagagcaccttaccgaaatcagcagtagtgaagaagactctgaagatagatgaatctcttttctctgcaaaatcatttgaagagcttggtttgccgcctttgcttatagatcggttgaacaaggaaggtctaagtactccaactgaggtccagtctgctgctattcctatcatttcacaaaagcatgatgcagttatccagtcatatacgggctcagggaagacactcgcttaccttctccctattctttctgaaataggccccctaaagaggcctacagaacaagatggttctgataagagatcaggtgtagaggcagttattgttgctccttccagagaattaggaatgcagatagtgcgagaagtggagaagattttgggccctaatgataagaggcttgtccaacaacttgttggtggggctaatcgttcgaggcaggaagaagcattgaaaaagaacaagccacttattgttgtgggaacacctggtcgtatttctgaaatttcagcagggggcaagctacacacccatggttgccgctttcttgtactggatgaggttgaccagcttttgtctttcaattatcgtgaagatatgcatagaatacttgaacatgtaggaaggaaatctggtacttcatctagagatattcttggccctcttgcaaggcggtctgagcgccagactatcttggtttctgcaacaataccgttttcagttatacgagcagccaggagttggggtcacgatccagtccttgttagagctatgagtgttgttccacttgattcaattactgttccaagacctgtgctgtcccagacagatgccaaccccaactctccatcaaattcagtgaatcaagctgcagttaacagcttaccaccatctttggaacattactattgtatatccaaggctcaacacaaagttgacactttgaggagatgtatccatgctctggaagctcagacagttattgcatttatgaacaacaccaagccattgaaagatgttgtatttaagttggaggcccgtgggatgaaagctactgagctacatggagatcttggaaagcttgcaagatcaactgtgctgaaaaagttcaaggatggtgaattcagagttctagttacaaatgagttgtctgccagaggactggacgtgccagaatgtgatcttgtgattaatctggatcttccaacagactctacacactatgcccacagagctggccgaacgggccgtctagggcggaaaggaactgtggtcacaatatgcgaagaaactgaaacatttgttgtaagaaaaatgcgcaagcaattagctgtacccatcaagccatgcgaattcacggaaggcaagttgcttgttcataatgaggaagatgtagaataagctctgcattgtcgaaatgacatttaatgtcttgaagtgttatttgtgtatgggcatttctcatagattgtattatcttaaaatgttatcaaccgatgtttttttgctcgatacaaatattcagataaatgggaatagttgtctttcctgggaacttgttcttcaacggggagttggtgctccgctccatttttttttctattgtcaccctcttatggatatgcactgtaatgcgtgagatgactccaagaaattctgtgtcagcatttcacagaaccgacctctttcttgttcttcatgatactttttggaattgaaaaaccaaaggtgaatgcatatttgtaaagtttagctagatgcacctgaaaaagtcaatggaacactgaacaggttcccttaaccatagttggaatcatggacggtggactttctggattctacattctgtcattcaagtgttccattgcaagtttgcaactgaaggtttgggtatagccagtgttctgggttactggatctttagtgtatatatttcagttaaacttatgacagtaaactgaagctttttacttgtagcagtggcccctatagctcagtggtagagcgtcagtcttgtaaactgaaggtctgtagttcgatcctgcatgggggcatttttacctttttccaactcgtttttttaattattttttactccaataaagatgatgttcgttttttctactcatttttttactccaacatagaggatgtttgaatgcaccggaatccaatttcttttactccaataaaaaggatgttctggagtcctgttccaattgttagggcaactcatcttcaccaaaatctttttactcgaacaaagaggatgttatgaatacactggaatcctgttctaactataaggtcaactcatctccaccaagtctccaaggtactcataactttgaactttacgtcacaaaatacatattgtgagacatccttttatctctcaaaggagttgttacaatactgtggcttagtcaccatcataccctctacacctccaaacctggacatcgacagaatattcaaagggtgaattatgtaactgagtttcaccaaacatagataaacaaaaaatgttgctcagtataattttgaaccacacacacacacacacacacacaaagagaagaagacgacccatacaactttaagaattcttgtccaaccaggtaaattgctgttttacatgacacgcttctacacatcagattggccagaaagctgcatctctactcctgctcatggattctccagcaaacagtaaccgacacattgtttgcaatagtctcagctttcgcaggagcctcgctaatataaactctttagatttttgtctagctgaatagcccaaataaactctttttgggatggagggtgtatgttccaagtgaggcctgatattttgaattcctccatatccacatggttcttggaattgaacagaatgataatattgatgataaatagatcgctactttgaaccaaaaggagattatatgaagcagaaacatgtatccgcacaaaatgtcacaaagataatgaactgggctgggcatgctttttattcacagacaaatcatttacttaataatcttagcaacaaacacagactgataaatattattcagccatgctagttttcatcacagaagatcagagcaaaaacaactgccagaactaggaatgttattgtttatcagcgatgtcatgatggataatataccaattggcgtaaataagaaatatatgtaacagactagcaccaagacaaaaggttcatatatgcttacaaaatataccagatagaaaaatctcatctgatcgaatagtaaacagatatatcaattcgatactcactatgttttccacaaattttcatgagcacagatgttcactgacaacagaagttgtgcactgcattttagtgaaaacataagcgtccataacattgttttgaaaaaattgacttatggttacacaatattgctgcaatcaacttatttcaagacaagtaatcaagcatataagtccttacatttttgacatttaggatcctgactccttgggagtttttgcaacaattgagatagcatgaagtcctgagttcaactcatcagtcaagaggtcatacaccatcctgtgacgcttcacaaggctctggccctcaaacttaggcgaaattaccctgatgttaaaatgtgtctcatttgcattgtccttgacagctgcatgcccagcatgttggtaagaaacatcttcaatatctagcgcactggcctccaaagcagactgtagcttttgcctcatccgagcagctcttgaaagcatagcactagtgcctcgtgagctcatcattgatacagttcgtctcacagcagctatacctgccaacaaagtttactggttatgaagataatcactatcacaaaatgaaactagatcagtgggaatgcacacatattcaagatcaatagtgcatggacctttacagaatttgcatgctgcaaaagattgatctgagaagctcaggtcatctcagaaagctgggtcctgagcatgattgcataaatgaaaacaatgacttagcctaaactatatctaaaaccgttgtggtccataaaacatgatgtgacagtgcaagtactgatttctgaactaatatgaattcaagatatgttgaaaatgcggtgcaattcaatcaggcgtcatctttcctaccccttcatatgcaggcacaacagagttcagacgtaacaaatccgatttcggctaagcatatccctccggtgggtgcaaaccatcaatctgcttttgttgtaaacattcaatatgtttttatttgtgatcatacacgatttcagggttacactgttcctctaaaatgctcctacctactctaccttgtaaagaccatactgaactccaagcgtcagtcacaaaatcgattttgatgataaaagatggtgaaattagatagttttacaggtgacagaaggcgcaagtaaagctggaaaacggctcgattcaaacatcttaaccaagaggatctgaccatgagctaggggtaaaggaagggggaagttcagcggctgccatgaactagctccgctcacgcgcaacgaaacgaatacgataataaacagggaaagcatgtagcttacgttttccggcgccggcgtactctcgcccggatcggggtagcagcaggcggagcgacggcggctagggtggaggagatacctgacagtggaagaaatcatggaacatgggccgcctttacgggccttgagtagtacatgggccgtcttgctccacgtgttgcggataacgccgagtcgccaccaacctcgctcgatcacgaacgatatgaggggagaaaagtcaaagcaactgaatccctcagtgcctcactgctgcactcgcggaggcgaccaggattgctcgtcgtcctccacggagatggcggcattgccggcctatctcctcctcctcctcctcatcctggtgatcctccgaccagcggctgcgcccggcgccgcttcgcagccgcctacctcggagcctcacctcccgccgccgctgcttgctcagaaggtgcaggtgtggcccaagccgacgtccatctcgtggccgtccgcggtgtacgcgccgctctcgccgtcgttcagcgtccgcgcggtgctgtcccacccgtcgctccgccaggcggtagccttctacacccgcctcatccgcgccgagcgccacgcgccgctggttccccccgccaactacaccctctcccgcgtccccgtccgcaccctcacgctctccgtctccgaccccgacgtcccgctcggccccgccgtcgacgagtcctacacgctctccgtgctcccggactccggatcggccgatatctccgccgccacgccatggggcgccatccgcgggctcgagaccttctcccagctcgcctgggccggcggcggcgccgcctccggtggccagccgatcgtccccagcggcatcgagatctccgaccgcccacacttcacccaccgcggcatcctcctcgacaccgccaggaatttctacccggtccgcgacatcctccacaccctccgcgccatggccttcaacaagctcaatgtcttccactggcacatcaccgacgcccagtccttccccatcgtcctccctaccgtccccaacctcgccaactccggctcctactcccccaccatgcgctacaccgagaacgacgtccggcacatcgtcagcttcgccgcctccttcggcatccgcgtcatccccgagatcgacatgcccggtgagtgagaaatcccagactccctctgctgctcctgcatttcaattccattgctctccgaataaacagtatactcaaggctaagtgtcgcgcgcttcggatcagggcacacgggttcgtgggcgggagcgtacccggagatcgtcacctgcgcgaacaggttctgggcgccgcacgcggagccggcgctggcggcggagcccggcacggggcagctgaacccgctcaaccccaagacgtaccgcgtggcgcaggacgtgctgcgcgacatggtggccctgttcccggacccgtacctccacggcggcgccgacgaggtgaacacggcgtgctgggaggacgacccggtggtgcgccggttcctcgccgagggcggcacgcacgaccacctcctggagctgttcatcaacgcgacgcgcccgttcgtggcgcaggagctgaaccgcacggtggtctactgggaggacgtcctcctcgggcccaaggtcaccgtcggccccacgattctgcccagggagaccaccatactgcagacgtggaacgacgggccggagaacacgaagcgcgtcgtcgccgcgggctaccgcgccatcgtgtcgtcggcgtcgtactactacctggactgcggccacggcgggtgggtgggcaacgacagccggtacgacaagcaggagaaggagcgcgagggcacgccgctgttcaacgaccccggcggcacgggcgggtcatggtgcgcgccgttcaagacgtggcagcgcgtctacgactacgacatcctgcacgggctgaccgacgacgaggcgcagctggtgctgggcggggaggtggcgctgtggtcggagcagtcggacgagacggtgctggacgccaggctgtggccgagggccgccgccgccgcggagacgctctggtccggcaacaagggctccaacgggaagaagcgctacgcgaacgccaccgaccgcctcaacgactggaggcaccggatggtcgagcgcggcatccgcgccgagcccatccagccgctctggtgctcgctccaccccggcatgtgcaacctgtcgcagtagcagtgtcagtttgctccatcgcttcgcctcgctgtcgcctgcacagtgcgaaggaatgttcagaaatccaagtgacagaagaagaatccgcatcgatcttgggggcgtgacgtcgtacactgattgctgaagaaaccaagaacagaataaacgaatgcctactaaacaaatgttctgttctgatgccctcttccggagggaacccgccgattgcgaattgttcaagaaagtcgcggacttatgccgtgcagaaaagaaagttttctttgtgagtagtttctgcacttgatgctgaacagatttttgcactgtttattccttcattttcacaataacacgggtagatagagtagtagtagtatttggctagtgcaatagatgaacaaggttgtagtagaagtgcagaaccatctggttgtagttttgtacgaagggtatcttaatagaaaaaagttgggaaaaaatcactgatagatatgtgattttcgttttgagggtcttcgatgtgagatcattcagattacaggtgcagagtctatgcaactattttgtggtgtcagcaatttatggtgctctgttcagtccagaaaaaaataatcaatcagtgtatggtgctctgttcagttcatcatcagcatcaagacaatcaacttccgggccgactccccattgaactcgtcggcatgcgccgtagatgtgctcattttagcgttgtggtcatggatggcgtccttgatcacagcatatgttatgatggacgtgtccttgtcaagtcacggcggcattcgatttggaatcgatgacaaacttggtcctcttttatcagcagatgataaacttggtcctgcttgaaaactaccgtaggtacattgacatttttgtcagacatcttgcaaacaatctgtacctgtacatctgtagctgtctgaatggccgacttgatgtcagaaaacaagtttaccagttcgatttttttaataagcatgccctaaaaatcatatatagacaaaaatttcatgtaattgcgatataattttacaccaggcatactcacagtcagaggcaggcagaatggagaagaccaccatcatctccagtcgcctagtcacctttcttgtagtagctgctcgttatttggtccaccaaatagtggagtcactttccctgcaacgtgttcccggggctgaagtgttccggttcacgccattgtgcctgccctccttttatccctagctttttctatgtgctgcactgctcaggtcccttctgtcttcctctgaaccctgaaccaatcccgaactctgaactctgaaggctgcagagacaggcagagagatatgagggagataataagcatccacatagggcaggcgggcatccaggtggggaattcttgctgggaactatactgcctcgagcatggcatccagccggacggcctcatgcccaggttcttctcgatcccaattcttgctcgtctgcatctcttgctgtcttttcctacttaattttgtgaaattctgatattcggatgatggttttgtcctgtttggttggttcttgctgtagcctaaaaaagaattgatcttgaggagaattttggggcagagtctccagctccagtcatgtatgacaatcagaagtgaaattagcgatttttattcgatgtttgatttgcaccatgcatgctagcactgttcttgtagagatgctatctgtgaatctgtgatccccaagccggttgctttgagagtagaaagcctgtgccttttttgtgaagcgaatttcatttcaagaagaatactagtctgtgacttgctgcggtgcctagtggctcctagtttacgatatcctaatccttggtcatatctgacgcttgcttgcagcgacacaactcctggaattgcaagggatgcattcaacacgttcttcagcgagacgagttcaggcaagcacgtcccaagggcgttgttcgtcgacctggagcccacggtgattgatgaggtgaagaccgggccataccgccagctcttccacccagagcagctcatctcctacaaggaagacgctgctaacaactttgctcgtgggcactacacaggtgtgatgcttaccctgaaactgagccattttgcagaaataaaatgtgtctatgaaaatgtctaaaccaacatattgatatactccaactagaatagtattcacaagaaacattctacaggtatgattgatccacaaagatatggtttgggtggatttagaggagtctgaatccatgatattgcttacatatccttgggatccataaggattattgctcacataaggaataacattaattgtttataacttatatccttggggtgacttgtaataataatttaggaacttacgacatgccgactattttttagtgaaaaatatgacgccataaatttagcttcctccataaataaattgtcatactagagaaactgtcatattcctttataatgaaaatatttttttagtaatgattcaaatccttttttttttctgctgcagttggaagagaggtggtagatctttgccttgatcgactaagaaaactggcagataactgcactggtctccaaggttttctggttttcaatgctgttggtggaggaaccggctctggacttggttcattacttttggagcgcctatcagtagattacggtaggaagtcgaagctcgggttcacaatatatccttcaccacaggtaatcaagaaaagtattcatgatttgttaccatgtttgtgttcattacagcgtattgtagtgccatggaaaaaaatagaatactccagcaaaagaatgtcttctgtgatgttgaatcatttatttgacaagtgcatggataaaattctcagggaaaaccgaagtaaattatgttcatcagcaaatgcaatttcttataaaactgattctcccatgatcctaaacacatgtccaattttcagcatatttttcattccatcattatctcttttttttcgaaaggccattccataagtatctgaaaatgaccacagtaactactgtaaacatctgattcttatgattaaaaaaaatctacatatgtctgccggaccctattttgaatagaaagacccttccaaacaatctaatctttatggaagacttaatctaaaaaaatctttatggaagagctgtgcaaaattacgtaatcaccaactgttcatatgtccttatccaaaggcgtagaatgtaggcaggtgtaccttcacactttttgtgggagcaacatcaacctgttattgatggaaacaactgtttttctttttatactacttcctccgttttacaatgtaagtcattctagca

SEQ ID NO: 57031 - DNA, 2664 bp, Oryza sativa
aatgctagaatgacttacattgtgaaacggagggagtatgaactatttccttgataatttttacagaggtcagtataggtctataagagtcagatataggacaatacatcatctacataatcgagagcgagtgaaaaaaaaagttatttttagttttcttttttcagaaggctgtgaaccatactttaatttaactatgtaagactattaataatcgtactagtatttttttatgtcatcatcatgcatgcacatcatgtcagatactcagatatctcatgcaaggtaaacatgtaccctccgaatggactagagaagctaaatttgtcgatgttaacatacaagctctgtactgaaaaccactccctgtgtgttgcagatctcaacggccgtggtggagccttacaacagcgtgctctcgacccactccctgatcgagcacaccgacgtcgtcgtcctcctggacaacgaggccatctacgacatctgcaagaggtcgctggacatcgagcggccgacgtacaccaacctgaacaggctcatctcccaggtgatctcgtcgctgaccacgtcgctgcggttcgacggcgccatcaacgtcgacatcaccgagttccagaccaacctggtgccgtacccgaggatccacttcatgctgtcctcctacgcccccatcatctccgtcgagaaggcgttccacgagcagcactccgtcccggagatcaccaactccgtcttcgagcccgccagcgtcatggccaagtgcgaccccaggcacggcaagtacatggcctgctgcctgatgtaccgcggcgacgtcgtccccaaggacgtcaacgccgccgtccactccatcaagaccaggaggactgtgcagttcgtcgactggtacgttaactccatcatctcgctgaattccagagattttagccggagatgatgacgatgatgatgacgaagacggtgatcttgtgtttcaggtgtccgacagggttcaagtgcgggataaactaccagccgccgacggcggtgccgggaggggacctggcgaaggtgaggagggcggtgtgcatgatcagcaacaacacggcggtggcggaggtgttctcgcggatcgaccgcaagttcgacctcatgtacgccaagcgcgcgttcgtgcactggtacgtgggcgaagggatggaggaaggggagttctccgaggccagggaggacctcgccgcgctggagaaggactacgaggaggtcggcgccgaagtcgaggacgacgacgaggaacagggcgagtactgatcgggctagcctgctaggtgaatctagcacggtagataaaccgcaagtttgtaaggtcggtggaagggggtctctcggtttacatggactcttgtgactttgtggtgtgagagtgggttttgttgtacttgcatcacaaaaaataaaagaattcgtcagaaatcaaaatgtgaatcaaaagcaaatcacagtgagtatgtatgtcgataaattattcgcggcacaattatttgtgccccatttggaacatagaaatccacatgaaataatccaaaaagaaaagacaaatgtcatagaagacacaaaaacggtttcacagaaaccaaaatgtgaaagcaaatgaaaaaccgcatatcgataactttctcccaacaaaaattgtcatatcgatcgtttcaaaaaaaaaaaatcatatatcgataatttattcgcggcccaattatttaagccccatttgaaacatagaaatccacatgaagcaattcaattctaggcccacaagacaaattccgtccctggcccaaaagcgggctgctgtttcccgtgggcgccggacgggcagacgacgaaccagtggttttgggcgaaccgaaaaaaataaataaaaaaaagagccgaaaaaagtgaaaggcctgggagcgaagcggcagagaatggcagggaaagccggcggcctcaagggcgtcgccctcatcggcggcgccggcggcaacagcgcggtcgccggcgccctccacttcttccaggacccctccaccggtacgcgtctcctccctgtagctccgtgctgttcgcctgcgcgcacagcagctcgtctcgtaagtgaattgacctcttctcgctgatgtgattttggtggactactcgatctctgcgtggttttttagggtataccgaggtgagggggagggtcaccggcctcgctccgggcctccatggcttccacatccactcctttggcgacaccaccaacggctgcaactctaccggttcgttgccttccgtttcccttgcttggttttgtgacttaggttgtgaaattgatgggggatttggccatttggagcactgctcgataagatcgtgtattgcaattgtgaactcgcatactcctatattatgtataagtagaacttacaacgctaactaccataagagaagataggcatctaatttgagttgactgctgatcaaaacatggataggacgaaaacgtcactgaggtaggaacttcgtttaccaattgagttgtgctgtgaagaattatcaaatgaccgatttatttgttaaaaagtgcactggacaaaacttttttttttgtcgggacggccaaagataggccggccatttcattaagattgggggaaataa

SEQ ID NO: 57032 - DNA, 3408 bp, Oryza sativa
aactgcataagctcaatgtatgctgcaaaaaatgtttccaatacagaatcatctgctcacccttccattctaattgtcctgttcaaatcttgctactgcatttttaagtgaatggttttcatttcttttatttagggtttgtttttcatgaaaatttgacttttttcttcttcacgtgtacggggtctatatttgaaatgttatggagagatggataacatcaaactctatgttactagatttatttgagaattttcataacccaagttgggggtgctccatggagcagctgaagtgttctctcatgccatcttgcaattgttatttttcatttgttctgattaaattacttgtcccagggccccattttaatcctcacaataagtcccatggggcaccatctgatgatgaaagacatgtgggcgacctgggaaacatagtagccaacaaagatggttagcactctgtcaggccgtctacattaagacctttgaggcaactaacgcaaagaaactttgtaaattaattcatgtgtgtctaccaataatacatcacctttttgttccaggtgttgcagatatcttcataaaggacctacaggttccattgtcttgaaatatgtaaaatatcagtttgttcatcttattgtttatgctaatgcattggtaattcatattcattgctttgtgaagatttcactaagcgggcctcattccatattgggaagggcagttgttgttcatgctgattctgatgacctaggaaggggtaagcattatgtcattactcttgcaagattgttattggtcattcagaattgaagagaagtctcccttcctacattatatatgtcctcttattttagaaaatattgaattcactatttagagggtaatttagagcttattacctgccgaatggcgtgctatcatgcatttgaatattcatataactatttaacgtagaagttcccttgttagctatggttgatatgggattattcggtgttccaaagctgcctgagatttggctcttcaaccttgagtgtaactactagtaaaaatcatattcataagacaggtaatccctcccaagcccaactaacctgggatatgctgaattgctgatagctgtcatgaaattattgtggactgtggtactatgttaacatacagtagggtataaatcataatccagtaggcaagggcccaaaacaggtccagataacaggatttgcatgggctgtaccatgctgcagttcaaaatctaactgcccatgggctgtacaatgctacaggtcaaaaatctaattgccagtctctgttcctctgctgcatttatgctaggtttgtggtagcagacaaatgttactgtggtgccttaagaaatacatttctagcaatctagatctaggattctggcactatctatgctgcattgttttgccaattattttcagtgcctccagaggcctttttatacattatttgtgcaagacatgtcctaggagttgggatgataaagctcttgccattaccatcaataactgcgtcatactcaattctgaacaacatctgtttgtgtccaattatttaagtatgaaatattttggtataatatttttctctcctgttcaaactctatgttccatttgttaacaattggctaactttgactagtggtaggttccaaaatacatgctcaagtatccatcagttgagtcaaattacggattgcgagcctaatgttagaataggtttcatgcacaattatgttttgccatttagtatcacatggtgaagcattcactttttatgctgctgctcattgtactactttgatattttgaaggtggtcatgaactcagtaaaacaacaggaaatgcaggagcaagaattggatgcggtaagtgagaatctttttgtagtttctgaaactgagaggaggaaagaaccattcggacatactagtactcaggaacacataggacaaatattgtacaaaataaaaagaaactttttttttctctgcaagaccgatccttccagtggaatgacaagctaatatgtctgctaataacttgtaggtatcattggacttcgatctgcagtttaacaatctatagtcatgaagcttgaggtggtggtggtatgctgttcagagatatggaaatcattggcgctcctcattccagactgtttcaagaatggcttttgacgtgttatcactgccttcagttatctatacgtactttgttacggagtatattctttttttgaacgaacatacggagtatattctataaataaaggaaaagtttcctcatacttatactgtaccttggactgaagctgtgcaaactcacaataatgtgttactatttctcaatcttcagcttacaagcgatgctgctttgaatttggccataagccaatgtcctttatggtactattaaatgaatacatagcagctttttgtgaatatatatgctcgtaatactgttatactacgaccttaaggcactcctgttgcctggcaaccaagcaaacgctgacaaatctggaaacgggtttgtcatggtgtgtgttttatctttgcttcaaacatactgaaacacaatttgtcaacttcaaacctgtgtcagattctactccctattggatcgaagaactggaagtgctcgcctaccctctgtttaaccaaccattccaatttgtcaacttcaaacttgtgtcagattctactccctaccgtattgaaaaaactggaaatgctcaaggatcaaagtatcctgacagcgtatgacgtcgtgagcaccagccggccatgatccgtgagtgaccatcaaaggctgtgacagtcccaagacactccgtccaaacactacaatcttccgtctccaagatgcaaacaagagcaagagttcatgctacattaataggacttgcagtttgcaggttaagtaaatcacgcttagcctccggttgatgctgataccaaggtcagccctgggccctgggggggtaagaatgcctcgacgggaaccggacacaccggaacgcgccaaaagggcgagcgagccgtgcgcgcccgattcggtctcgcggcgcgcgcgaccctggagcttcccccttggctccgggcggtagcctagccgggcgggcggagcagagcggataccggcggccgcgagccgcgacggctgctacggacaccaccgtccaccacaccccgcgcgcgcgcgcgcctccccgcgcgatgccgccacggagaagcggttcgtggactttccggaggcgtccggtctcggcggcctagacataacggcgtcacgcacgcacgtagcgcgtacgtaccctgggtcggtttggggcgagtaaaataaacgagcacgcacgtagtacgtgg

SEQ ID NO: 57033 - DNA, 5937 bp, Oryza sativa
gtagatgatccatcgtggcgcgtgcgggccgtgtcgtctcgtccctgcgcctcggctccgctcgcctcgcctgcgtgtgcgtgcgcgtgtgccgtggcgacaccgtcgtttcgccttgacacagcgtgattcctccgatgcaccaccgagcgaccgttcctgctgctgccattaagtccgttgtttttctgtacgatcggtcgtaatagtgaagtagcgtcgtctgtgattagatccgtggtttgtgacaataaccacttggtcggtccaactgagtgtgacaaaactacagaagtacatgtgcagttaataacctcaaacgagacagaaaacacaaactgcaaatgaacgcataggctgaaaatgtggctcagtttgaatccatccccttctttaagagtatttctgtagttaccgagtttggattcaagatgaatccaatcataatttagttcagttatctttttcttcttttgatagccttagtaggcaatcaagtaacgtatcgatgagtaatcatgaacacgttcacagatcacagagcctattcaaacagacggaatgcacgtaagagctccctgtatggaaagatgggttctacacactggtccatgtggatattgcacgtcacactctcagctacactacaaacctctcgatacacaacaacatcccagcaggctgggctcaaaaggggaagtgattaatgtggaaagatgggattagtcgctgcgctaagcacatcgagttaattaacgcctaagcaaaatggagctccagctttggtcccttctgggacaaaaccaaagcgatctaggtccacacgaagcagatcacgctgcatctggatcaatgaaagcgaactggatcattgttgttgcaggagatcatttcaatttgttttagcagtagctcgccaggaaagatttgcatgtccactgtgctagcttggctttacccagaactcgagaaaaaaaagaggctgttcacactagtggtctcatagtagtatagactttaaacttcgatttggtccacaagaaattgatgttcaattcagtcatcagctttgctttttgtaagcacttgtgacaaagcttaaaagcgtcaaacctgatcatcatctcaaagtaaaaccaacttacacagaagagagagagagggagagcgacaaaaaattagcagaaaatcagaaggtgtacatgcgtacatgtagacttctgtttatactagtactagtatactggactctgcttaatcggtgacgctagcttttgtgtgttttacgaagtggccgacagggttactgtaaaagatcgaaaaggaaaaaaccgtcgggactctccatgtcatctctctttttcgtctcaacgtttcaaaattttcaacgggccgtgtctggcctgttgtgttctccctccaactgtgttggctcgatatgtcgcatgaccaacgtgacactgtcgcgtgcaagattttttaatattattttaagtaaattgcattggcagtacaagaacttaaaagttaggtgcgattaggtgcaaaaaattgaaaaaaccgtgcatagcggtacaagaacttgacaggtagatgcgattaggtgcaaaaacttaaaaaccgagtatagcggtacaataacttggctaggtgggtgcgctcatggtgcaaaagttgccacgctattgttccacctcagcgaaagtgccacatgagcatgcattgaccatctcattttacagaaaagtccctaataacttttatattccaattacttcttcagatatatctgttttcctcctgtatcacaatgatcaaaccagtccatcttctcatccaaataaattctgctactgccaactccaaaaaaaaaaaaaatccaccacgatacagtgcaattgtgaattcttcttcctcatgacctgcaatacaaaataattggttgatgtgttataccgcataaggaaaataatacactaagattatttgcaaattattcaactaattatatctgctgacaagggtacaacacatctagcaagaatttctcattgccaatgtttctcttatatcatatacaattacaggaaacaccaataatttcagtaaaaccaatctagtggctagtaccattagatcacttcattgaattgtaataacaaataacatgatattcaagtgaaaacccaaaaaaatgtagccattgtacagatcaatgaaaccttaacttcgaaatcatccatcaaatgaacgaaaaatagaaatctacaaccatcagcaagtgatttaccataataagctaggagcagatgctccaaaaactcgtcgattcagagccatcccaaagcttacggtgatcatgtcgacggtagcaaattgtcggcttgaattggtttggttactggtttagggcttgaactaatgtggcacacgaagccctcgccgccgcggcgatgtaacggtttccctcgttgccgtcgtcactgccgccgccaccgtcgctacgccgccatcgccacaaccgcagccgcctctcaattaggaacacgtcaagaaagatggaaggagatatgcatacgtttgttctgtttgtcgagttaaaaaggaaatgtgattggaaaaaaaaagctatttggggttttttataaaatgagataggtctttcatataaagctgatgtggcaattttgctaaggtggaatagcaacgtggcaattttttttacatggctacttttgcaccatgagcgcactcacctagccaagttattgtaccgctatgcttgattttcaaatttttacatctaatcgcacacacctgccaagttcttgtaccgccaacgcaatttactctattatttttatgtttgaaatgaagaaatagcatgtgtccactgtaggcgtacaatatgaaaatattttgaaaatcatggcattttgcagggcattttttaaagccatgaacaatcagagatgaacatgcatgcagtcagtcacggcgagaggctgcaaaaggggtcgattttactcacattttagggctgttattttacacgggttgaagaatatcctaggaggtaaatactggggggaaaatgtcgacaaaagatcaacttagcataattatagcattggattatgctgtaaaatgtatggagaagaacgctagcttcatcggttggattcatgcttcagcaacgggagatcatctggagttcagatcagatcctctggtggtggtggagctggaacagctgctggtggtggagcccggcgtgccgtcgcagcggcggctgcaccgtcttgtgctgcttcgacttctcgtcgacgatggcgatgagcccgcccagcggcggccgcatcttggcgcgatacgatatctcgtcgtaggggcggcggtagaagcggaggaacggcaggaaggactcgcgctcccgctcgccgcggctggcctggccgtccttcttgaacgcgaacagcatcgacggcgactgcaggaacgacggccgcggcgtccgcgggaactgctgcgctggcgccggcgccttctgcccgcccttggtcgagaacggcgtcagcggtgcgccgcggtggacgggcggcgtcgtggtggagcgcgcggcgggggaggcgaaggagaaggagcgcgccgagagcggcgacgcgccgatgagggacgggctggaggtcggcaccacggagcgaggccccaccgacgacggcgtggtggtggacaggtaccacggcttgagggtgttgtcgtgcgacacggtgacggagaaccgcgacgaggcggagccgacgccgatgcccttcgtcccggtcgccagcagggccgccgccggctcgaaccgcagcgacgccgtccgcgggtacgccgtgaacgacgcgtcctccagcgagtcctcgaagtccagcgagcacaccaccgccgtcgccggcgccagctccacgaacggcctcactccctggacaacaccgcacccgttttttcagttcatctcccactcgccatcgccatcgcgatgaacacgaaatcaaacgtgacgtataccttccagaggacggagaagagggacggcgggtcgatgacgaaggcgcggtggaggcggccggggtagtagtcggcgacgatcttgagcgtgcccatgagcaggttgaggaaagccgacgccgaccggaaaaagcctgcacatgaaaaaaaaattaaaaaaaagattcgattcgtctcgtcaacccctctcactttcctgcagattctacggctctcgctttccacgcatcatcaccgatccaatcattctcgccacgattcaaaccgcaccggcgggaagccggggtctccgcccccaaaagcggcagccgtgcctgccactgtagcggtaactgtgcgcgatgccgcgggaccgccgcgaagccgtcgccggcaaccgcacacgacgacacgacacgacacggccatgcggccccgttcgtccgtgcgagcgaggtgggcgcgccgcgccgcgcgcgacgaaggtctcgccgagccatccccacgaatgtgcagtgcgcacagctctgacctacacatgccactactgcccattctgccttgcccgtgcgaggcaatgagaaacgcgaccgctattttctcactgtcgctgtctttcttctttggagaaagaaaggacacgcacagatgtaactagtaccactactacagctacgggaatagttggaaatggtgaagaaatggctgcttacttgcatcgaagaggaggacgaactggtcgacgaagcgggacatgcatgacacggccacctccagcgtgaacaccagtaaccgcacgaacctaattaaatccagcaagaagcaagagtcaatcaattgttaagaccgggttaatgattaaattaggcaagtgttcatctgttcgttcttacgatttctgggagtggaactttgggtagtcctgcttgattcgaaagacctgtaaaaaaagacctccctgtcaaatcagaacatattctccatctagcgtgtgagtgtcaatttgcacccggcacggaggccatggaaacgtaccacgacaggtcgggcctcgtcgtcgtggccggcgacgtaggcgacgccgtcagccagctcggcggagaactcgtcggcgatgatgtgatctgctcaacacaaaacaaagggcacaaaatcaaccaatttagcccccaacccgacgaagaacagaataccaacaagagtgtacactgttgcagactgtactttgcttgcataatattgcaaggaaacaaatcacacggcacaataaattcaggcgcacagtagcttgactaaaatacactgtgccgtaggtatcgcgaagagaacagaagcgaaacagagcaggggcatgcaccaccattaatgtggcaaaccccccacggatttcaaaaaaaatcagggcccccggctgctgccggaaaatcgcagggatgcagacacacacgcttgatgaaactcagatttgttggcagaaacatggaaaagaggggagtggagtaaatgaggagcgatgtggggatggatggaaataatggagaaaaatggaagctgggattgttgaacgtaccggctccgatggtgtccctccaggacaggacggttctcaggtgtttcgccgccttcttcacgctctcccctctcgcccggaggaaccgctccacgcacgcgtcgttgcagtacatcgcctgctcgcccacgccatccacgcacgcacgcaccaccaaggttaaccaaaaccgattgaaaacgcagcaccgcgagcgagcgagcgccatgcatgaaaacgagccatggagggcgaacctgcttggcggtgagcggagcctgcttgcggagggtcttgcggacggcctcgatcttctccctctccttggcgtccaccttctccatggccatcgatcg

SEQ ID NO: 57034 - DNA, 26109 bp, Oryza sativa
tattcttccgcctcgcctcggcgactagcgattcgttccctagcgaataacggcccgtgttggtgcgttcggttttatttaaagaaccacaacccttttgtgcttttatttgatcatcatcatcatcatcatatatagttattcccttgtttgggttcatgttttcagggctctcatatgattcgtatccttattttcaccaattcatgggtcctacatacatgtatacagtcccagggagctagaaaatgacctgggttgctgcggcggcctatggtgtccattgaatagtggagtataacacttccagtattgtaagtcgttgaaaaatttatgaaaaaaaaacgttggtatttatgtcatataaggatagttgagactatatttatgtttgtaaggtagtagctaataatacatattaccgttgtgttttgaacaaagcgtataaatactactatacgacggcatggttaaaacctaacttgtaacgctagcttttaaaaagttaagtgtgccaaatatgattgacgcgcctttacaattgaaaattttatagccgttagctattgtatatttattatttatggcatatctgacgtcttagttaagtggggtccacataatgcattgtgtaagtgttgacttatttagccgttcaaattggttgtgaccaatataattgaattgcttaaatcatgaatagcaaaaatagtggtctatatcaatctttttgcatggctttctcttagagttgatcgcgcatatatgtaagttgtttcctgcaatgctagagtggcttccttatttccttgtatggatcgatgcctctattagaaatacttttagattatatatgaatggttgtggaaatattattattctatatgtcgatatattgcacgttcatatggcttgttaaagaaatttgcagtcaaagaacaatggtttcttttatttctctctctctctctctcttttatttgaagtaggggtatcccacttatattagcatatgagggtcaatagatggttttcatgccaaacgatcaaccttagttttatcctctggtcaaagtagagtgctccaggatatattctgaaaagtagaaattttaaaagatttagaatcatctcaattattgctatcttattacaaatctatctaactgaacaagacagggaaacaaaatagggaagaaatcataccaatatatataaaccgtcaagtgacaggagaagaaaagtataatccatatctcttcagtccaactttctttctgttttagaagtaaaaaccaccctccattggcttgctggaaaccaagcgaaagccggtaaaaacaatgacatttgatctaactccttacgttaatccaacggttttcgttaaaaccaattggttttgttaacactagaggtagtctatttcctacgaaggtaaatcttttcatggtacatttgccaaaggaaaacttaatttccacggggactctgaacccccacacaatttccatattctgagattcaccaaccctctatatgctatatcaaatggtggagtgacctcactgaatagcgaatacagataagatttttcaatggcccattgcaccttatcatgaccatcagacatctggtaactatatcaagagaccatcagacatcagtgctctgtcttctgaatcaccaaacagccgtctgaagtctgaaccatttatatatttgttgttctttgatggcgaaatcatgtccagggatggagtacaatttatgggtacaaagtgccaaagatccggaggtttggttggcatgtcgcactgcaattaagagtgtcacatgctgcatcttcgaactacattttcatggatccccaaaaaaatcgaaagtatactgtttttacgcgaatttgcgtgaagatatcagttttgaaaaaaaaatacaatgcaaagaatccctgcttctacctggtctaaatgaaggctatgagtgaaatgacaagttgacaacatgtgtatagttagcgtgtcaccgtgtacgtgtgctaatcgcctttgtagtactctcttcacttcatattataagacattttagcattgcccacatttatatactccctccgtactcgtaaaggaagtcgtttagaacagcgacacgatctttaaaacacaattttgatttcttgtttctattaaaatatttattgaaaagtgatatatgtatactttatgaaagtatttttcaagacaaatctattcatataatttttacattttcaaactcaacaacttgagagttattcatgatttatattcctaaggtttgacttaaacattgtcctaaacaacttcttttacgagtatggagagagtatatgttaatgaatctagacattaagagtaggtataacctgaaacggagggagtagtagttaattaaattcttatattagtaagatgcgacattaagagtaggtataagccaactataaacatattttgaagagataaaagagaagagagaggagcagcggaccacatatctctatagctagcgctgcagcacggactctaagatacaatatgcgtatgacgggtggaaccagatattaatagtgtagaatatgtttataggttatgaattaactattaaactaatttacatgatttaaaactaatagttgactatactattaaatttgctctaatatccacgacatgaacagagatagtaccgttttgacacctccgggctctgacccaagcatgcacatcctatctatgcacaaattttctgaaagagaacagtcgtctaatggcacgcaggttcaggcggcttcagaggctgtctgatgagtagctacagccaggagcacttactacagttatctttttcttaaccatctcacaaccagatgcatgttctctgatactccagtgctgttaccggggtgcattcagcaatatcgcctgcatctatctatatatcagcactgcgccatgagcgcatatatgtggcagcagcagcctagctagtaattctgcggttcggctgtcgcattcgtcgcttaacttgagctcatcacggggcagcggcggcagcaggggagagacgacgatgcatgcggcttctgttcgcacgtgtgggagagggggatgcaggatgcgtcaccgcactctcgcctagctagtgcgctaaccaccacgccatggaacaggtaacctgtgatcagggtgtgtccattagcgctttgtcgtgccggattagtagctctcgctgcagagcttgcgcatatgaagctagctagcgcttagacgtacgtgaggcagcgcatgcatgcgatcgtatatgcatgccttcgcgctcatgcatgccattgccaacaacacggccggtcggccgtcgtctcgcgatcgatcagctggcttcagttcacagcttgtgaattgtgatcgctcgagaggggggggggggggggcatatgcatgacatcgagagcattgacaaagacgggagacgctctgttggggatggcaatcattcctgtgatctcggtcattatcagagtgatgcgctgcctttcccattacgatcccacacatcgtgtcctgcggttttggcagcttggcctgcaggctgcgccagcagcgccacacacagcgacatgtatagccacctaatatgcctttttctcttcgtgttggtctcatccggacgtcgtagagtcgagctgtagcttgtaggtcaccaccttccaccagctaataagctcaacctgcatgctcccggttgagtggaaccgaactaggagtactagccaactaggaatataacctacttggtctctcggtagattcctagtgttttttacctagagaaaacgggtaggtcttactccctccatatttttttaatgtatgacaccgttgactttttttttaatgtttaaccattcgttttattcaaaaaatttatgtaattaacatttattttattatgatttgattcatcatcaaatgttctttaagcatgacataaatattttcatatttgcacaaatgtatagaaatactatatatagaaaatatttgaattcaaattcaaatttgaatcgaatataatttaaattcaaatttgaatcaggtatataaactttaggtctataaaatttaggtgtataaactttagatgtatagaaatactatatatgaaaaatatttgaattcaaattcaaatttgaatcggatatataaactttaggtctataaactttaggtgtataaactttagatgtatagaaatactatatataaaaaaaatatttgaattcaaattcaaatttgaatcggatatataaacttttgacttataaacttttggtctctaaactttagatgtgtaaacttgagatatataaactttaggtgcataaatttactaaaataagaaagtaatgcggtgtcaaaataggaaaccaggtggagagagaggaatggggaggcagggtggggcgaattgatcgctacccccatctccagacgagcgatcgccctttagcatttccgctgaagaattatgataccaatgcagtccgtaaaaaacagaaacagtgaccattatggttttcacacctactctgaatttgcaatgattgatcacactgtcttaatttatcagagttcaccttcagctcgatcgtctgagtttagtctgtaactagtgggtgcccgtgtgcgcgttctggccatgaaattgacgtgacaatgtgtcccacagtttttctgttttggtgcctacgtgaatggaatcgcttctacgtttcagattgcatacagaaaaatatcttatcggaagtttggacaaggtttgtttgtttgtttgttttttgaaaacaggccgggcaatttggacaagacttgatcccgtcagtttgatggagttccctatcggagtatttgtaaataaattactacctacagataggtatgttcgaacctaaaactaattaattaatgttgcccaatcattgttgctgattgttgctttggtcgaaacttaggtcatggttagttacttaaacaaaaaaaatttcacgctgttacgtcaaatgtttatgcacatacatgaagtattaaatataagaaaaaaacaaattacacagattgcgtgtaaattgtgagataaatcttttaaacctaattgcgccatggtttgacaatgtggtgctacagtaaacatttgctaatgacaaattaattaggcttaataaatttgtctcgcagtttcctagcggaatatgtaatttgttttgttattagactacatttaatacttcaaatatgtgtctatatatttgatgtgacaaccaaaccaaaaaacttttcccaactaaacaaggccttagcatgccaatagaatcttgaacacggcaatgatcacatgtactccctccatcccacaaaaagtccattcctagcatctaaggagagattagtgaagagtaaaaatgaccaaaatgcctctcattattgaaaagagagctgctatacaacgaaatcctgttgggacgggatcctgatacctaaccggtatcaggccatacttatgaggtatctagtgatacctataaggtatcaggcgattcctaccacgtatcaggtgatacttgcaaagtatcatgtgatacttattaggtatcagatgattcctaccacgtattaggtgatacttccgaggtatcaggagtcgggcaccaaagcattgtcgctggtggtcccatcgtccacgtctcacgctggagcttgtcggcggcggctgcatcctccaccgtccacgccacgtcggagctcggcggcgacgactgttgcatcctccatagtccacgtcacgtcggagctcgtcaccggcggttgcgtcctccgtcgtccacgtctcacgttggagctagttgccgatggccgcatcctccgccgtacatgccacgtcagaactcgtcgccggcggccgcgtcctccgtcatctacgccccacgccggagctcatcagcgacggccgcatcctccattgtccacaccacatcggagctcgtcgccggtggccgtgtcctcctttctctgcgtctatcaactccgacgatagctccatccccggccatcgcgacaacccacgtccatcagctccgactccaagctcgcactgctcctcaacgtggcacctctcttcgattcagcaatgacggccaagccccgcgcgccgccgctgtcatcagctggtgcgagtagctgcgtagcgcgacggtgacggatgccacggcgcaacctcgcacgaaataggttatctcagctgcaacgccgtcgtgaaacttggttgtctccgcgccattcttatccgtagccacgtgaggctaggagaggataaggatctcgtattgaaggctagcaacggtatcccggtatttagcatttccgtattggaaaacgtagaaatgttgataggtaggtaaaaagtatttaagaaataaaacttctcgttttatgtgcagggattaggtaggatggtagaagttggtttttttagataaaatttaaactttataagttaagttttttttttttggacggagcgagtactacgattaattcatgactgtgaatttgtgatcgaacttatattgtctcgttgtactcctagtatatgattgctgtttgtatttggcaatggaaagctccaagatatactttgcggtgttttgtacgctagtactagtagaacgtctttctcctagtattttattttggaaaataaaaacgaagtgactgtttttcagatggtggcgctagctactccctccgttccaaaaaaaaaagcaaaccctggattttcgtgccaacgtttgactgtccgtcttatatgaattttttttataattagtattttcatttgttattagatgataaaacatgattaatactttatgcgtaaatcggggtttctctttttttttttgacggagggagttagttggtaatatactgatataaaatgtcagttccatcgatgtcattagcaagagtccacggccttgtgagtctcctttgcatggcttacaggggccccggcgtacgtggtgatggccaccccagcattttgtttgtcgtgtggatcttaacgcttcacatttaaaatcccttcctccccctaaacacactttacaattaagtaccctatccgtttgtattataaattgtttgatttttttctagtcgaacttgttcaagtttaaatgtgtttattaaaaaaatatattagtattttcaatacaaaataaaaatattatcaaaatatattaaactttaatttaattaaactagtttggtattttagatgttactaaattttactataaatttggtcgatcttaattagattttactaaaaaaacaaatgacttaccgtatgaaacgcaggtggaatagcaatcatctaagcacttcggtatgctggctgcctccaacaaaacaaaagtagcagttctttttcggtgaaaaaagtactcctagccgttaatccagactccgtccgtcattagtttagtgcaaagtaaccggagaattgccatacatctagcgtgctaaactactactccggcggtccggcccatgcaacaaaacgaccgtatcgatccggctatgagccccctgcaaggctgcaattttacctactactacgtactactatgctaccacctcgctgacgaccacgtacgtacgtaaaagcggccgcacggaaagccaacaagctcgccggccgcgcaatcgacgcgaagcccggccatgagccatccccaggaaaacatcgaaaacttgaggaagaaacaaaatcggcaactctcgtccccttcttcctaccacccacaaaccacactcgccgtgccagagccccgcaacatgggtagcaccgtacgtagcacgagatgagtgcgcacgacctccatgccatgcatgcgacccctgcccacggccggtcggccacgtacggtgcgtgtctgagcgagcaaggcaggcttggcttacacacaccccggccgcggcagcgtgtactccgccatgcacccgttgttatttccggttcccgagggccgaggcagccgtggtggggaagggggagagaaaaagctagcgagccagccagtcagccagcgccaccgtgcgtgcgtgcatgcatgcatgggcgggtggtgggttgggttgactaaatggggaagcaaggcgcgggttggaggcgagcgcggcgtcgcgttgcgctcggtggaatcccggagagggacagcgagagagaggccgcgtcactcaccgcgcgaatgcgcgatgagactggctggcgagtgccgcctgccccgtacgtagtacgtctcgcgcgctcgagcgtttcgggaagccgatcgatcgagtagtagtgggccggctagctagctgccgtccacgtacgtcgccgtcggtcatgtcgcgcgcggcggtggaagcgcgcgcgaggccctgtacgtagattgatcgacggtgacggatggaatcgatgtgtgttcgccttgttctctcttgtttcccgactggctgggttgattggtttccactgtttcggacttccggttcaaagagaatagagacgtgtacacatgatatggagtaggacttcttctccagctggcaaagtaagaaaagagcagcttatgcttaactttgtgccatttctgtgaatcaagattcaagacctaaaaaagaaactgtgaaatcgtgaggtgtagttcgatctcatgattactacttgtagtacattcttttctaagcctgtgattagtttgttttttagtgtagtactacatgatgctgcacgactagcttgctctgctgagtttgtttcaattcaattgcgctacaaaaggtcaggtaggataaaagtccttttgacatttccgctctgtttctgccggtttgcacagcagaggcaaccattcttctactacctcgttgagtgtcctagaaataaacaagatatatataattacggcaccgtattttcgcttatacttataaaatttaaatttttaactttaaatttagattgattttagagtttttttcctcaaaatttatttttcagcctttacttttatatcgttataagaacatgtatataaaaattttatttataaattatttttcatttagaaatataccgtttggcttatttcctgaataaacgaaatgatgcggaccttaaaagcatagtgatggacgcaatagtgatgtttatttaagggagatacgaggaatgcatgtcatagtgctgctttgttcccatcggaccgtcatggggatgagaaaactgacggcactagtcaatcctactctgcactctgcagccctgcaccaagatgggttcagatcgatatttgtacggttagttcccatctcgagattattcaacaatgtcgatcaccagctagtacggtgtatcagttttcggagtgtggattctaatccctcgaggggatatcccctcgtataactttttctttcaaattcgatgcaaatagttgtaaaaaattctgaaaaaaattgacaatgtagagtataatgatacctaccagtccaccaaaatttatgttcaaattcgatctacacatcgagaaacaaaaaagacaaatttagatacgctactattcatacgctgaatttgtcttttttatatctcgacgtgtgagttgagtttggacttaagattttgtagagttgtatatatgtgttgtatgaatgttgtcaaatttttccagaatttttcataaccgtttagatggtttttaagcaaacgagagaatatctctcgagggattagaatagttccccagttttcgtactgctagtcacatgggcgtcatgtagattgaccgcaatttccagcttacgtaccggtccaaatgagcgtgcatgcatgcataaaactgaagcacttctctttgtctaaagatgatggaagaataattagccattttcagtctgtccaaaatggcactctgcgctagctagctccactagttaaccaggggagaaaaggggtaaatcggagatgagcatgcatgcatgtgaggtgtgacttcaggttaggtaagcctggaaggctggaactaccgcagtcaaaagctaccgaccaagtagcgaacagcagcatccactgcctattcagccaccattcaagcaagacgcaagtttaatttgaaatacgatgtacagtcgatgcatcatcctccttctttgtcgaatgcattttaggtaagatcaaacaatggttagtatagaagagatcgagtacctactgctcgttactaggagtatctgtatctcatccaattctttggtgttttctcaaaggctagcgatcgatcgaaaagggttcccgctgaagtttctttcgataaacctgctgttgctactgcttatcagaggtgtgcccacgaccttcggagacagtggtcccctcgagtcagtgagaaaaataggtgcctgatcaatgggtgctatgtcaaagagagaggtaaaaggttagctacattgccacaaggggacagaagcttacgggtggaccatccggagatcacgcggaatgtcggatgtgggtccacatgtctgcgttttgcttcacctactactgcttccacaccaatccacctcctctaagctggcagcagcggcactgtagtagtgtagtgaactactcctacgtacaaagtactccagtactcgtggggcacttacctgagcagctcaggtacactccacaccaagattgttagtatctcgattcgtattctagtatcttatgatactacgatcctaccaagccgaaatgataccgatcctacctagtatcctaattttcatagtatctcgatcctactattcattactacacgatcctacgaaatcttaggtggtatcccgattctacgatctctacgatactacaaaatattatttaaaataacatggtttgaaaataatgtaaataaatatgctcaaatttatataaaaattagttaaatatatcaaaccaacgtggtttctcttgataaatgtctctatttgcatgacatatatcattactacattttttaatatataatggctatatataattaatataaatattaattaaacttttaaaaaaagaaatcttatagtatcccgatactacgatacgatattactttgaggaaaacgatactgtctaatatcccgatcctgacaaccttgctctacactacagctgattactatagctgagtgagcaaaaccagttcagaccatgcaccactattactctattattatcatggacatgttcttatatatactactcgaatgtctgatgataatactgctagtagtcattaacaactatagttcgaaaacgttttgtcaaccatgtttgaatgattgaatcccggggcacggcgcactgcttgccgcatgtcgcgcatggattcgggcatctttgaccattgcgccatgtgccgcgcttgtgtgtcttcggttaatttaccaaatcgatcgatcttggccatttcatggccggccccatgcaatggacacttgtttggccgtgacaatgtctgcaggcagggacaacgcaagtaacggaatacatgtgtgcgtctggcagcctcggctctcaccctttttactcctgggccatccattggtcgatcgtaagctaggcagcagtcgtgactcgcgattccggccccccacgataaatcctgggggctcggtttcaaatttttgaaacgtataactgttctaaatttgattcttataaaaaacgtacttgccaccttacgtcctccatgcatggcccgtaaaaagtccacggcagcaagcgagaatcttgtcgcccccccctttttccaaccttttgcgtggaatttcttcctctgtatatatatatctttcgaattcgaagtaagcattcaataaaatctttatccgttcactgtttctcgtgcaaatttgtgcattcttgctgcacccaacagcatgatggctgctgctgcgtgtgtccaacgaacgagacatcatgccaccaatcttatgcatctaggctgaaaaattttggcgtatcacatcagatatacggacacacatttaaagtattaaacgtagactaataataaaacaaattacaaatttcgtctgtaaaccacgagacgaatttattaagtctaattaatccgtcattagcaaatatttactgtagcactatattgtcaaatcgtgaaccaattaggtttaaaagattcgtctcgcaatttacacgtaatctgtgtaattagttttttttaatatttaatactctatgtatttgtccaaacattcgatgtgacagggtgaaaagtttttgcgtgggaggttgggaacgctaccctctggcacagaaaacggaatatttcattagcacgtgattaattaagtgtttgctatttttttaaaaaaaagatcaatatgattattttaaataactttcgtatatatatatttttttaaaaaatataccgtttaataatttaaaaaacgtacgcgtggaaaacgaggaagagggggttccgaacaagctgcaacgaacgcaagcgcggacgctcgctggcatcctccacgtctcgcgtcgctgccgcggctgcggctaccatgcagacgacggcattggcaacttggctcctgctgcgcgctgatacagcgttttccttttacccatcgtctctgcgagtttcacgcgcgtggccagggggcgtttcttccctctcgctgatactggcccggcgctccgcgcgcgcgcgtgcatggcgaggccgatagacgacgacggatgccacggcgcgtcgcagggagccgcggccgtcggcacagcgcggcataagcgcggaaaagatggggccgtgtccgtgctcgagccggtacaatgatgctagctagcttttgtgttttctgggtgatgctaccagtggtacagtaccactgctactccctccatcccacagtataaggaatttgaattttgactttttgattgtaacgtttgaccactcattttattcaaattatttttgtaaatataaaaaacgaaaagttgtgtttaaagtaacatagataataaagtaagtcacaaataaaataaataataatttaaaaaattttgaatagaacgagtgatcaaacgttacaagcaaaaaattaaaatctcttatatgacggagggagtacttcctgctggatgtgttgtactgagtggagatcgtaccgcgcgcgtatgtgcggtgtctggtatcccggtcggtcgtccggtgattttttttttcgcggcgtggtaattattgttggcgcagcttggcgttgaaagggaaaggaggggtgcagtgggtggtgtcatttgggtatccgggtagtatgattgattagctgatacgattttcggtccgggtcgtcttctgtatgagctgtgagcaggcgtgtttgaattttcttggtgtggaaaagcttgagctgcgaatgatgattgttcagagcaccagtcgcgagctaagggagcttatcattagatcttgttcgagtcatcgtcgttcgtattggggattctctgccggtgaaaggtaactacgtactactactactatcgatcaccgaaaaaaaaaggaaggaaaaaaacattgctgcccatcaaacatcggcaaaatgtttagaggttgtttggttaccaacatccctcttggggtcatagaaatggtttaaagtttcggtctctgccaacaatcaaacggttaatgagtcaagaaaagataaataactaatgttattatggggcaggcacgtgcggtgccggccgatggtgctcgcagacgccggtcgttggtgcttgcaggcggcggggatggcgattgcggcgggcgcgaaggcggctgcggtggtccctacgcagcggcggcgcggtgctcggcggcggtctccctcagatctgcgcctcttggctggatctggagggtggccggcggtggtcgtcggcgacggcggctgacttgcgacggctggtgacggcagcgacagtggtggtcgcggcagttggcggcgacggcgtcggctgacgacgcctatggaggacttggcggcgacgtggcggacgacgacagcgaagcggccgctggcagtggctggcgtcagtggcagcggtgacagcggccgatttgcggcggctgtgactgtggaggcgctggcgatgtcggcagatgcgggtcgctggtggcagcaagtggaggtgcgcggtgaggatggcgacggcgaggtggctaggcgttcaacagcagcggctgtggtggtggtggccgtaattgcggtcaccggaggcatgatggcctcagatggctagccgagggagtgggagacggctacatttggccgccgcggcatcgtttggtggagggtcggagaccggcttggcgcagagaggcgcagccgatggcagcggaggtcagctcggcgcgagaggcgcggacggcggagatggaggccggcttggccaagaggcgcgacagatggagggaggctggattggcgcgagaggcacgtccggtggagaaggccggcttggcacgagaggcgcggccggcgatggaggaggcgacctaggtgtgaggaggagttgccggtgggtgtggcgcgatcttcggcgctcgaaggctggccggcaggggacgccggtgcaggggtcccacaggtcagcagagcttctgtggtggtagggcatcggtgcgtcagtcgtggatttgcaggtggtgaacggcgggtgaaaactcagtccggccttggccggaccgacaacgatggttcattccccctcctaagggcgttgtcgtgctgtctcacccctcaagggtgtttgtcgggcgaaaacccagtcttggctcctttgagtcccgacggacggacggcggcggcttttccctcgcttctcttcttgaagacgtcgttttggcatcccctaggaggcgatcttgtctgggaccctttgttggtctagtagcggtcggtcacgcttagcggcggccggtccggtgctagccttctccttggcttgtgtgttggcgatgtcggtgtgtgggtggtggtatattttttctttttcctgattacgaccctacagggttttaatcttgtaattttttcctgctttatcaatagaacttcgcaccgtctcgtgcgagtcgttcaaaaaaaatgttattatggggcacatctccatctccctcctaattatgtccaactgggttgtttgatagcctatgacagtttatgaaactttgtcacattttatgaaacgcttgtttgttcccacaattgtaatgtgccacggatttttcactcttagacccactagcgatatatttgctcacaattttactaaaatttgccagtaaaattttgcctaagatgtggtcatcattttgtgggctaacaacttaggctagattattttgacaaggtgtccgttgtactatatgatgtaggattgttttggtttactatcgtatcaaaatattaacaataccaaaaccaatattttagcatattatatggctgattggcatattttgacagctaaccaaatattaccgtattactattcaaagtacttaatatattatagtgctaaaactcggataagttttttacaatttatatatgtattggtaacttttggcagcagtccaaacctttctaaatcactatttaaaataccaatagtttagtggagcaaaatttgacatcaaaccaaaacaacactaaactaaaacatccttaagaattctcacgagcttaatgtgtcccagatgctgttagtgtaagcgttaggttaggccccgttattttttttctgttaggatgagctaatcccttgattatcatcagcacacttttttaaacttataaaaggtgtgtgtttgaagtaaagttctatgtaggacggtaggattttattaaaaagactcaaataaacccgttgtcgattttctagatcaacgataaaaaaaaaagcgtatagtacgagatctaaggagtatgagtaaaagggacaaggtctaaacagattcaaccattcttgataataagtaatactctagtcctgtttcggtgattgaatccgctaggtatgtatacaatcgagttatgattatatccttatataggttgggaggtagggttagttacaaaggaagacctagtcaaatacgtaacaaatttctaaactattacataatagtatctactgtctctgtcccataatataagggattttgatattttgattgcattgtttgaccactcgtcctattcaaaaaatttatgcaaatataaaaaacaaaaagttgtgcttaaaatactttggataataaagtaagtaaaaaaaataaataataattttaatttttttaaataagacgaatgataaaacagcgcgagaaaaattgtcaaaatcccttatattagaggacaaagggagtaacacaaactacagaacatgccatattacagaaaacgacgttaaatccaagtccgagcatatttttttttgaccggaaatactgccagggttttgtccagcagtataattttataaagaaagaaaatatttacaagattacagagttacacgagggtcacataggaagattataaggtttgtaaccaattaaaaacagtttgctttaaaggatctttcattctacacatatacagaagaacttcgttgacaaaaaaaaatctccatgcttgaaaggaaggttgaacgttctgaaatattaagccattctttgctttcagatgtgccaaagtccgagcatattacatattatatgtactaatatttaattaatcatcattgcgttaatcgctcgagattagtttccctgccatcgaatagctcaggagcatcactttcgaacgtgcatctgcacagcacgatgacagatggagtacttttacagcccagcacgctatctgaactagtcggacttttacagcccggagcgttcgtgggttcggcccaaccccaagtacctcccaaaacatatgggcctatttctatacgaaatttggtctagtatccgggccgtgtgcactgggcctagatctccgctgcatttccaggcccacggaagccacgcttcttctccagcggcgtctcgccgcttcccgacgcttcgggagcccggctccgcactgtcggcgtgcgcgccgcgtgccgcctcccgtcctctccggaaaactccggcgcggctttctttcttcctccgccttcttcaaggctccagtccagctgctcgctcccaccacccttcgcctccccaagcttcgtcttcgcccgcactccctcccagcaaccgccgccccggagagtcccggatttcgtggccatctccgtcgcacgatcgagtggcgaggtatctccgcacaccctgcgcttgccttgttttctttacctgcttcggtttgttccccgtcgtagtgctgtaactgtaagcccggatctgtgaacctgttgtggtcgctgaatactttctcttgatggaagcctaatgcgatgcgatgcgattgtctgctagctagtagctaggtgttactactggaaaatcccgacatttaatcctatcccgttgatgttggatgtgttgttgtcagtgctagaggttggagaaattcctgaaccccggcaaggcatgaaattggcataatcagtggaatcgaagtacgtgacctactaagtcctaagtttgtcttgtcgcagagaactcaactcattacttggttcattggtttttagcaatcttattccttggtcgatccaggatagtgtcatctagttacatgagttgagaccactatatacaactgtactgcaagacaagttacttgtttcaaatacgcgaattggttatctataattcaagctgccttcgcgggtgcatcaagtgagtccgatatgcatggatgaggacagagccagaaaaaaaaaaggaatttctttttatctgtatgtgaaatgtacaagtactgtcaggactcctgaaaaaagaaaaggaaatactgttaggattcagaaaatatcacttgaatggattgcttattttgaaatagtttcatgggtagctcctttaaatggctcgaataggtcatttctgagtcatggacatgtttggtttgctaggatttcacaccgtttcatcgagtgtcattggaattctgttttcttgcttgtttttttgccttatgtattggcttacacttttatgttacattttgcaaatgcaataaaatagtactatcataaacccttggccttaaaactactaattcaaatggcgggcatagtttggattaaccagatctttttccctttttagaacaagaagaatgttaggtacacaatactgacgctgcattgtttgcaggatgactgaacaattatacactgtggcatctgacagtgaaaccactggggaagataagtcgcagatgtcgtttcctgatgttgctattggaatcgacattgggacctcaaattgtagtgttgccgtttggactggccatcaggttgaactcctcaaaaacactcgcaaccagaaagggatgaggtcatatgtgatgttcaaagatgacagcctttcagcaggagttacaggaggagcaacccgggaacatggacatgaggaaagagatattttgtcaggaagtgccatatttaacatgaaacgtttgattgggagaatggacacagatgaagtggttcaagctagcaagagccttccttttcttgtgcagacattgggtattggggtgagaccattcattgcagcactggtgaacaatatgtggcggtctaccactcctgaagaagttcttgccatctttctccttgaattgaaggccttggtagagatgcatctcaaacatccggtgaggaatgctgttcttaccattccagttgcattcagtcggtttcaacagaccaggattgagagagcatgtgcgatggctgggctgcatgtgttacggctcatgccagagccgaccgctatcgcacttttgtatgcccaacagcagcagcaattgctacatgacaatatgggaagtggcattgagaaaattgctctgatatttaacatgggtgctggctactgtgatgctgctgtggctgccactgctggaggtgtttctcagataagagcactttcaggaagcactgttggtggagaggatatccttcagaatgtcatgcgccatctcatgcctgattttgatagtctatatgctggtcaaacaatggacagaatcaagtcaattggcttactccggatggcaactcaggatgcaattcacaaactggctacgcaggagcatgtggagatcaatgtagatttgggggctggccacaaagtgtcaaagatcttggaccgtggagaatttgaaaaggtgaatcagtctatttttgagaaatgtgaagggatcatcaagcaatgcctggctgatgcaaagttaacaccagaggacatcaatgatgtgatattggttggaggatgttccagaattcctaaaatcagaagcgttgtccttggcttatgcaagaaggacgactcttacagtggtatagacccacttgaagctgcagtttcaggggctgctttggaaggagccattgcctcaggagtatctgacccttcagggagcctggatctgttgacaattcaggcaactccaatgaaccttggaattcgtgctgacggcggtaacttcgccgcaatcattccaaggaacactgctgttcctgcgagaagggacatgctctttaccacaacccacgacaatcagaccgaagctctcattgccgtctatgaaggcgaagggaatcaggctgaagacaaccatctattgggatacttcaagatcaccggtattccagcagcagcaaagggcaccgtcgaaatcaatgtctgcatggacatcgacgctggcaatgtcctcagggtattcgccggcgtcgtcaagcctcagggccaggctgttccaccgttcattgaggtgaggatgccaacgctagacgatggccatggctggtgcggacaggctctcgccaagatgtatggcagtacgcttgacctggctactatcccgaagaagctgcatccttgagaaattgcatatcgtcgcatgtagttgtatgactccattatctaaaaaaaatgtagttgtatgactcgtatcatccggtgccgtagttcgtgcatatgtggttcgaccgtgtcatgatggttacttggttcagtagcttgtttgccggactttttacatgtaaacataaagagtgccaatgtcatctctgtacaaaaaatgtgtgtcgcgtgtatagaataaatcaatgttaccggctgttcggaactcgagtattccactttgtataacactagagtagaaaactaaaggtgtctaatccgttgcttgtgaaatataagggcctgtttactttaatgctaaaaaaaattttatcaaattttagcattgccaaaattttggcatagttgctaaaattttggtaacttgtcaaaattttggcaagatttcttatatagttatcaaattttggcagcaaactaaatatagctatttttttagcaactttatcaaaacttggtaaggttgaaaatggcattaaattgaaccggccctagctccaaaaggttctacctggcttaaacccagtgttgatcgctttcctttatatccttccctgagttctctgttcatcatatttgttacattcagatgtagtagcaacggcgagtgacaaacgtaagtgttcatcatatttgttacaaaagtactaatataacataagcttctaagcacaaatcctaaaatggtactccctccgtcccataatataagggatttttagcttttgcttgcactgtttaatcactcgtcttattaaaaaaaatttgtgcaaatataaaaaatgaaaaattgtgcttaaagtactttggataataaagtaagtcaaaaaaattccaaattttttttgaataagacgagtggtcaaacagtgcaagcaaaaatttaaaatcccttatattatgggacgaagggagtagtatataaacttagatgatgagatggagaaaagaagtaattaggagagagaggataagttatccctcgtaagagactctaggagagaaaatgcaaagagtagaaaggaaaaagaactctaaagatactttaagggtgtgtttgggaaccctcacttccctagcatgcaaaacggagcaacatgtagcgcatgattaattaagtactccctccatctacttttgataggaatattttcaaatctaaaaaaattatttttgataggtatatttcaatccaacaacatatcatcttaatagctttctcggatttaatgtgtgactctccattcttcttcacaagattgactacatgggtatcgagaaatttacatattaatgaatcgcttatttacaaggaatgactaatagcatgtttaaatagatgataagtaaaattacttatgccaagataaaatatgactatcaaaagtagatgggggagtattagctaaaataaattttaaaaatggattaatatgatttttaaagtaactttcatatataaagtttttgcaaaaaacaaaccctccctccctaacacgtaaaacagagcaacgtgtagcgcatgattaattaagtattagctaaaataaatttaaaaaatggattaatatgattttttaaaaaataactttcgtatataaagtttttgcaaaaaacacactgtttagccatttgaaaagtgtgcacgcgaaaaacgagggaggtgagttggataaatagagataagaactcagcgttagggtttatttagatcccactccaaaatttttcatcatgttacatcgaacgtttgaacatctacatgaagtattaaatatatgctaaaaataactaattgcacagattgcaactaatttgcgagacaaattttttaagcctaattgccacataatttgacaatatgttgctacagtaaacatttattaatgacagattaattagtcttaataaattcatctcgcgatttactgacagattctgtaattagtttttttattagtactcgaacaccacatacgacaccgtatataatacctgcatgtgacatgtaatttaacacccctttattactacctttgttccaaatataaaggatattcatgcaaatctaaccagaaattccttgataggtccaccacctgtactgctaaccaccagacccaggagagtctttctacctgactaacccagtgcaaatcgtggtcctgtatacacggcccatcgttctcggttcaccaatcaacatgcttgtttagcctcattgcttgttttgagaagcttaaaaaactgagaaacaactgattgatagtcagtttttgacaatatagaaaaactcgattgtccagcttctagtttattttctaaattttacaactataactcctcagaatctgaatcaaaagctgaactgtttaaatgagtttctgattctgagagaaagtagtagttaaaagctccctaagcatgctctcagtaatggccagtggcgggccggcgtactgtctctctctgtcacaactcacatcgtccttaggacgacaggcggtgtgatgtgtcatgcacctgcacaaattcgtccaggtctttctaccggtcatgcgagaaggaagctctggtgggttggtgatatgtaacggctgcgacatccggagggcgaattggcatcacagaacgggctaaaacgtgcacgtatagatcatgggctaatgcatcgatgtatgctgggtgcaagcatcgatcaccacaactaatttcgagaatctaatgaccccttttcctgcttgccctctgcaccaacatgttgccgtgtgaatcaacaattatctgcttcaggttggccgcatatatttttgaccaataggcattactagacgccgtagcagccaaacaatcagagagttccattgcttacgcctgcctcgtctccggggtcaactcccccggtttcgtgttgctccagtgcatgcaaccctaatacacagcctcgtcattttcacttatacttataatcaaagttttaatttttaatttttaattttactaaaaaaaatttgtgcgttgtaaacgggtgaaggttatttttaatcttattattgttatacggtttagttaagataaaattcattgtgggaattcacttagatatatatatttttctagaaaagcgagttttttaaaagagatttttatgcgactccttatatatttctaatatcaaacaattttaaaacacgattcaaatgtgatctgtatttctaaaagcgaaaaaatttaaaaatcgacccatacacggatgacgtaccaaagtaccggcaaaaaacatcttcaatttttataataatagagatatttgatttgatagtgtttccatttgtaatttattttattgcatttgcttttcaatcaaatcaataagggcacatatgtgaaaatttttatccataatcttttattagtaaaccgtacgaacataaataacataagtataagtgaaacaatgagacggacactactcgacacgtcctatggctccttcacgtcattcttataagcagaatgcaaacttgcaatggcactgtagcaacaaaacaacaacttaaaaaaatatattgcatgccagcaacagttgactgcaagtacggtgaaatccaaacacacatacacacacacaaaaaccagtcggccagttcctgcgcgtacagctgtgcggtggatggtactagtagttacaactccgaaattaccaaaagtccaaagcagtattagaagtcaactaagcaggatgaaattaacggacgtgtcaaggggcaaagcgcgtgtacgtcaccacttgccacgcacgggggatcggagtcatgcccaacctggacacgtgcacgtatcgcgcctgcctccctgccatctgccgctcaagccccgatcgcgacgggtgtttattttagaaattgtaacacacgaacaatctcaaatgcagagatcgttgggaaaatttaccacgggataaaaaacggcggtgtcaccgtgatctacgtgcatgaaaccgacaccgattacgtgcgcgcgcggacttggactgcatacggctggtattcgagtggctggtattcgagtgttccaagtccggggaatagtactgctccacgcgaaggatttctcgcgaaatcgtcacgtaccttacggtggcaactcgtgtatgcagcgcccaaggatcgagctgtgatcaatcgtgcacgcgtcaagcgtcagcgaaagaaattccatggaaattttcaccatgttaattcgtgaggcttgagtacatttgtcggtgtgtacacaatcagttcatggtcgatcaagtggagtagttccatccggtaagcgtcaaacatcgtatcacagcacgattccgacgacaaggagttcacccagttcgatcggcttacgtgaaaattcccataggcacggagagtacgtacgtgcagattgtaagttgcaaaacggtgccaaatattagttgatcgatctgacatgaccacttgactatgatacggttgtatgaactcaacaagagtgagagcgtgcgaatatttttcgatgttcaattcgttgatatgcagagaagaacgaagcaaaattaaatttgtgtagacataggtacggaggttatttggagagtgactggccgttagaccacacgtttgttaattcgtgttcacggttttttttttttgttctttctcatgaactacacatggctgattaacggatacctattaattattactagcaactgtgtccggtactacgtacgtatatcttatacaatcatatcttaatgagaatcacgagtagatcaaatccaataacaatacaaagatgactaaactagcagctcttgggcaagaatagcggcggctaatcaccactgcttgtgttctgattaaacgccgtcatctacactagctactactaatatagtactatgggaatgtttagatgcagaagtgtaaagttttagcgtgtcgtatcgggtattatatagggtgttatatggggtgttcgatcactaataaaaaaactaattacagtatccgttagtaaactgcgagacgaatttactaagactaattgatcagtcattagcacatgtttactgtagcaccatattgtcaaaccatgaaacaattaggtttaaaagatctgtctcgcaaagtagtcgaaatctatgcaattagttattttttttctatatttagtactttatgcaagtgtttaaacgtttcatgtgatatggtgtaaaattttggggtgtgccctatgataccacgtttactagaaggaaaatattacaagctaggtaagccgactagccgaactagaagtcattttctttagctcgcattttccacagaaccacaatttcccaagtaatagtactacactactactccaccatgtccatcgcacatgttgcttaattttccttagcaaatattcaagtcaaggtcctccattcacatgatcagctcgccaaagattcaagtgagcatcaccgtacagtaccaagacagcaaccagcgtcaaggcactgacatgcgggcccgcctaacgccaggaatcaatactgtagtaccgtacatccagcgtcaaaaaggccggcgttcaaacttcaatatatccaactatatatccaaatttccaaactgctgctcctacttgctctctccctcttttccaaaaggagctcaaaaagctttaaaaaaaggttttaatttggataagcaaaaaaaattaaagtgggatttgaaagtcttgtgctgcttatgcaacagtcgcagacttgc

SEQ ID NO: 57035 - DNA, 5251 bp, Oryza sativa
cgcacattttgttgtctgattattgatttttggcgaaaccatttgatcatatgacaagatgtgtatctaccttaacttaatgattttgataaaaatcattaggggattcatcagtataaagcggtggctggtttgagaatttgcatcacaagcaagccgaattttctgcttccatgaaaacgacgtgcgttcctgcctgcctaatactcctatatgaaccaccgtcctgattagaatttttatactcgagtcgagcatatacattactaaaaattatatttttatacgtatttcttatggcgtcggatactggggtagttagtactgtacttaaacacggggcccttcgtaattgccgtaattttggggtcaaacgcgtagaagtatgggcatatatatacatggatttatggacacctcggccggtgccgagagagtcttgatcgtgcatgacttgtgttcgtctacgttgacatcttccattggcagcagcatgcgtgtgataaactttttaagttccaagattccgatgtcctcgtgactctcctagtttaggattagccacgcttcttaattaatccttactgaacctggctaaattacccattttttgttgtccaagtttgtagtcgagacgtctgaagaagttgcagccaaccaagaggcgataggtgtgcatgattttacagccggtagttttgcgtgtggctgcctgctatctggccgtcgcagttgttatcaacggaggaatcgacctgtgtagtgtagcaacagacttgtgtttgtcacgtttgttggagattggtcagctttgttgactgatctttacagcaacttctagctagttacagccacaactgtcaagtcctcaatggatgcagcttggaatacacacatgctgttgcagctttggcttgctctggtttgatttttaagcagaggctgctatggctgtccacgcatatgccacacgggtcgcaatatgtagacctttggtttggttcactgagttttgggctgcaaagtactagttggctgctagtgtgcttgattggtaggagagtaggagtagtacttaatttgcttggcttcttctgaatttattcgtgtctaatagatgaaacagtagtttacatattacgcacactcgccaacatatgggacgtctagactcaattatgaagctgccaagacaataaactaaatatgcaagaggtttagtacaggacagagttcatgtgatcagttattcagtcaccacctaacaagactttgatggaggcctaggttcaacaaacattagagtggtagcagcagtcagcagacactatcgtactcgtagtagtagtctaatactaccatatgtacaactactacggtttgttaattccacctctaccgatcagcccccttgattatggttaagataacaaaaactatcttctctgaataacaaaactatctacataattcaagggtcatgccgtattgccatgtgattaggtattaggttcaacgcctaacctagcttgggttgttattatactcagaaatacgcacggggaatttattggcagagttggtgcctttgtaagtttattattactattgaatgatgagctaggtatctgcacgctaaacaaaggcgaatcaagtgtcactttgggcctaatgggcctcgtcaagcccatctgaatttaataacagaggtgaatacgtgcaggccgttccattgttcctgtcggagatcgcgccgacgaggatccgcggcgggctcaacatcctcttccagctcaacgtcaccatcggcatcctcttcgccaacctcgtcaactacggcaccgccaagtacgtcacacatcatcatacacacacattcagatacaaatgcaatgcattgtacgtatgatgatgaactgacatgagctgcatcattttacgtacgcatgcaggatccacccgtggggatggcggctgtcgctgtcgctggccggcatcccggcggcgctgctgacgctgggcgcgctgttcgtggtggacacgcccaacagcctgatcgagcgcgggaggctggaggaagggaaggcggtgctgaggaagatccgggggacggacaacgtggagccggagttcaacgagatcgtggaggcgagccgcgtggcgcaggaggtgaagcacccgttccgcaacctgctccagcgccggaaccggccgcagctggtgatcgccgtgctgctgcagatattccagcagttcacgggcatcaacgccatcatgttctacgcgcccgtgctgttcaacacgctcgggttcaagaccgacgcgtcgctctactccgcggtgatcacgggggccgtgaacgtgctgtccacgctggtgtccgtctactcggtggacagggtggggaggcggatgctgctgctggaggccggcgtgcagatgttcctgtcgcaggtggccatcgccgtcgtgctggggatcaaggtgacggaccggtcggacaacctcggccacgggtgggcgatcatggtggtggtgatggtgtgcacgttcgtgtcctccttcgcgtggtcgtggggcccgctcgggtggctcatccccagcgagacgttcccgctggagacgcggtcggcggggcagagcgtcaccgtgtgcgtcaacctgctcttcaccttcgtcatcgcgcaggcgttcctctccatgctctgccacctcaagtacgccatcttcgccttcttctccgcgtgggtcgtcgtcatgtcgctcttcgtgctcttcttcctgcccgagaccaagaacatccccatcgaggagatgaccgagagggtgtggaagcagcactggttctggaagcgcttcatggacgacgccgacaaacaccacgtcgtccccaatggcgggaagagcaacggcgccaccgtttaatttagtcgctgaactgttctatatatatgtcactgtctcactgatcaaatcacggttgagaaactacaccgatgctatgtatcagctcatgcgtggccatgtgagattgatcgataagcagctagcgacggcatgcaaacttaagggtagtgtagcaatttcggctctgtacgtactgcaagcaatggcgagtatttcaattcggagtgcttcttgagtttgtagtttgttgtatgagttgtatccttttatgtttctccgagcaagcctgacacgagttggcgcctcagtgtaacttgcagaacagaatgccatatatctgcacctttttttgccaaattttaattctggagctctgaaattcgacggttttatgcatatagtcggtgacggtgagggtacagttcaatactgtatatcagcaatgtgatcccagcaggagcggctggcgacacatttccggattgcatttcacactcattccatgccggcgcattcccatgcacgtacgtggccgacgtacaaacgctgcataatttagataaaaaaaaaaaggaaactggtaatgcatcttctcactgaagatcagaaccataaaccttatcataatttacatacgagaaataattcatgcctacctatactattgccaacatcaattcataatttagatgctgtctagctacgttctgaaattctgcttcgaggaccttgcaggcctgattactgtgcttcagtttgtgttctcccttgcaacaacaatccatactggattcagaattgtatttgaccaaacaggttttgcaacgattatgatccactcgcctgttctcataagagaacattcatgctcatcttcattgtgatgcttaaagttgcagatttgcagtctagcacccttccataagaactgtccagatatgtagtaaggcacgccacgatgataagaactgccctcctgtaaacaagataaactccaaaacgtcactatttccccttattttcaattaagggatgtgatgcggtgcacctaaagataagtatgcaaaagaacaaagccagtgccaaattggcgcacaataagtcataggtcattgtcttcagtcttgactgttaagtctaaagccacaaaaacagttaactccacacagacttataacagcagatcagtaaataaaagtgaagtatatactgtaacagctaaagtttattgcacatcatcaaaactcaataacagattgttaaataaaacaacagaaacataaactatatcaaaatactagaaaattgataatcgtgcagtaagtcttagaacttacatcacatggaaccttcattaggcaagttgagtaaatcctggtatcttcaacccagagctgttatcttggctcatgtgctaaaattttgttttgttgcttccatcttcaacaataattccctaatactaccttccatccttgttttcatgctgagaaatcgatggtgtgtcctttcaatgacttgcagttcttcaatctttcttttgcgttgctcttgtaactcatttatgtggagttcacctatttgagtagcataatgttcctctatttgtgcatgtttaaccatggtgacgtgtttcagagtctcagcttctttgcgtgcatcattggcacgttgctggtacatatttgcttcagcctgctttaacctgattagggcatccagttcatcaacagtaggcttattatcaactgtctggaagtcagttccgccaaattttctaagcgttaatgggctcccggtggttgaaattactccttgtttttctaaaaatggaactccctccagggtcaccgatggtagccatgatggtgcctttcgacttgaactaggaatcccatctattctttcagcaatgttgcatggaatgcccttcagtggtactgatgtaccactaccagcgttagaattgtcatctagaacagggaaaatcgagcattagcctggttttattgccaaaagaccattagcatctctaatataacaacatgatatcagaacatggatcacataatctttttgccaatatagctgatacttctgctatagcattgtgtaaaatatagaaatcttatttctatttccagaaatataaaatatcttacaggacaacaaaacaaaaaacaaacatctttatcaagcatgaaaatgataactattattttttttattatgaactatgattagtagcttaccagaaaagaacgccatgatatatttcactacttcaggatgataggccctgttttccagtttaattatcatctgttttacaaagtccctgact

SEQ ID NO: 57036 - DNA, 4563 bp, Oryza sativa
ctgccgactgaatgctcatagttgtctaatgactgttgggtaagtgagcaactaggattgtgaacaaatgtttgagaattggtcaatgatacagaacctgtgaacccttctgaatttgtgcggaacgatgatgatggcaacatttgggagcatgttgcaaggtctagagattcagatctgggaactgagcatttgaattcaggattctgtaaacaacctgataagctaagtgaaaggtcaagcctccctatcttaggtgtgtcatcttcctgctttacagaaacagtcccactagattttagcacctctgttcggtcaatgtcaggttgcagtgctaagtcaaatgatcttcctactgaacttcctacccctatgtcttcttctttactaaggacatcaaatgctataccctttcctttatcttcagcactaggtttccccataattaaatttaaagctgtaccctcttccttcctatccccattacattccttgcttggttgaaggaacacattagcacctactgagtttgcttccaaacaaaaaccttttacttccttctcgatagttttgttctcagcagctgcctcttgttctgggacttcagtatcacttaatgcaactatattttcacggccatccctcgggagtgcctcttccacatgttgagacgcatcaggttcaaatgattcactcatcttcttgctggatatagtacctttttcattttttttcatttctggggccccttggcttggagaggtcgccaccttttcatgtaccagttcctctgtaatagccgactgcttgcactttttagctatttcaagagcactactgggacaaccgtcttctgcagttatttttccatgcattgcttcctttacagtgctaggtgaatttccctctcccaccacatcagcagttccatctagcaccagctctccttcaatcgtttccttcaacatatcagaatcaatcttctctggctcaacagcattggcagttccatctattgatgccattccttcctgtggtgtcacctgcagaagaccagatgaagtactacattcaaccctgtcaacatcattggcagtttgatctctcgttttccccagaagagcttcttgatgcataccgcacaaactgaccttcctaaccacatcagcagcatcaacagcttcatctaatgccatcgcttcctcctgaagtccttgatgtatgctggatgaagtgcccagcccagattcatcaacagcgttggttgtttcatcttgtacaggcaccttttcctgaatagccgcctcctggttgctagatgaagtgccattcccagcttcatcaacagcattggtagtttcatctcgtatagtcgccttttgctgaatagcatccttccggatgttagatgaagtgctctgcccagcttcatcaacatcactagcagtttcattccgtatagttgcctgttcatgaatagcctcctcatgtacactagatgaagttctctgcccagcttcctcagcagcattagcagtttcatctcgtacagccgccttctcacaaacagcttcctgctggatatcagacgaagtgctctgcccaatcgcatcaacaacgttggcagcctcatcccgtatcatcgtttcctcctgtggcaccttgtgacttccactggatgaaacgcactgtccaacttgattgagagcattggcagcctcatcttgcccttgcacctcatgtcctctccccgttgatactgcggcatctgaggtggatttttcatgccttgtatgagttaccgttcctgcttctgcaatcatactatccttgatcttcccttcttccctccctgcattgcgagcagcagatgaaccagccactcctttaccatgagctcctaaatcccctctcacaccggattccacttttttcacctcaccgcgctccggtcctttctccttggcatgcccagaaaactcgatctgcttccggtgatccaccgcagcagcgcgggccttggtctcgggatctggcgcaacctccccttcctccatctcgctgatgccaaagctctgcttcctggacttctccaccctcgcaccatcaaacctcctgctagactcactgggcaaccgcagtggcggcgtcggcggcgacgccccggaccgcctgggcgccgccctgtacccgtccaaaccttccgaatccctccacccgccgctctgccgcctccacgccgagctgccgccaccgtcccgccgagaccggtcgcgctccgagcggaaccccttggggaactcccgccggaagcctgagaagctctcggaccggtgcatcgcccggtccccgccgtaccctcgcggagatggggactccctgtaccggtggtcgtagaaaccaccgccaccgccgccgccgccgccgaaccccttccggcggtcgaacccatcgccgtcgtagtcccccggccgccgccgcgaagccggcggcggcggcgggggtcctcggtcgtagaacctcctccggtcgtcgtccatgtcatctccgtacgacctctgccgcttcatggcgccgccgccgccgcccggaaatcaactgcccctccgatccgccgaggagggcgggggctgcagctgctgggtagtaatcagggggggagagataaggaaagagaggagcagcttgtacggggaaaggcgtgcgcgagatggctaccaccgcccccactcccccatccgctgctggcttggctgctcgccctccgcttgcttccgggtcactcctcccctcgatgtctccttcctcctcccgctcgctcccggccaccacttcactgcccccacggtcgcggtcaacggccgtcacctggatttggacccgggtcggagattttttcaccaccccgctgagcaccgcggttaaaaacgcctcctcctctctgtttttcttttcctttttcaccgacgacgacgagagggagaggggccgcaggacacgcacacacgcgggcgcctgcgtgcggcgggacccgggcgacggcggtggggtaaaccggggacgcctgcgccacgtgaaggtgaagcggatccggagccggggggcggaacaggggacgcggggacggggccgcagcggcgcggcgcgtggtgcggtgtgggattcgggcgctcgggggttcgtgcggcggtggtggtggttggtggcgagttggggatgcggtgatgggtttgaatgtttgataattgatactcctactcgtttgatgacgggtggtgggggtggaggtgggaggagtcggagcggagcagcgtggtggtggcgtgggtgggtcagctttttgactggtgtttgcctagataggcgagcggttagcatcagcgctttgacttttttgaccccacaagcacaaggcacacaccaccacacggatgccttccgtcgtctcgtctccaagtccaagcgggctgtgtgtttctctcatttataattttcttttctttttcttcgctctgaaaagaataaaaaaagggcaaaacaattgtggggctttggtgggagtattgtttcgctcgccgcctcgcttcgccgacgctgggaggaccaatagtccaagagtgagagagggagagaatagagaggacacagcacaaatgatcgtaatcctttttttttatataaaattaaggccaaaagctcaaatcttgtgcttccacgtcatcatcaaattctgaaccgttggatgaatgtattagattgcttctaagacgtttgatgcaatacaggatagagcccaacccatcagtcatcgggtgagtcttttcgcctcttcagtgctaaatgtagcccacatgaacacattggcccatctctacacacatctacatgtatccaacccgtctaaccgtataaaagatctttatggttgaacgctccttcagttgacatgtgctacctaaattatctacaaattattgataggtctgctaaaaaaaatttctctaagaaagctatctgtttattctgtttcttcttgagatcatatctcttatctaacaaattgatgttaaccaaattccgcagcaacgcgcaaggcatcctctagttttttttagttataaggccatatacaatacaccactgtgaatagtggtttcaatcctccccattagaaccgttgttccataagcccttgtcgtgcttgtagaggtcatggttgcctcggcacgcttcggctcttgaggtgtgaaaccactgtttagggccacgcattggggagaaccggagcctcttgatgtgcttggggaaaaaggagaggtcgaggagggcttgccgtggtcatcatcgcgctctcaccgcggccgttgtggtcgccaatcgtcggatccagcgaactcacagccaaatctaccgctcgccactgttgtggtcgcatcgccattccccaacgaggttgatggatctggcaagctcgtgagcccctcgaccacaaaaagagggtgggaagggagaggccagcggccagattcgatgtcgttgtggggatccgcgtcgccactcgca

SEQ ID NO: 57037 - DNA, 5650 bp, Oryza sativa
  unsure (1)..(5650): unsure at all n locations
tggtcagatcttattcgtatatctcaatcacaaaaccggatatatcgaccccttcaactattaaaaccgtgtaaaattgacaagataaatcaatatgtaatatatcactccacaaccatgcaagttaaaaaatcaacttatataaattgtaataaaaataacaaacaaagctcaaattactatacgtttatttgcagttaaatttattatttttttaaacttgtagaattttaatttgaacttgcatagttatggaatgatatattacatattgatatatatttttaattttttaaatttttcgtaacatttagttggcatgcaataaacgggtgagaatccatcttcctaaaactgccatgggaacaacaaaaaggagtcaatttttaagttttcagtaattggatgggtcaaatacccggttttacggttgaggatacaaatcaaatctgacctataataagggacttaaattggactttttggttcccggtgtgtgcgcttaatttgcacggtttctgtccagtctcatctttagggcccagctttgctatcgtgtgcatccggcgtcgtcgtcctcctcatccagtgtagtagtatactagtatgagtaggcttggtaggtcgcccggcccggcggcgccgactcgatttcctcccctcgcgtctcgtttgattcagaaagaaattgtaagcgagcgcagcattgggttcaaataatcagagaatcgagaggagaaagacattagatcagtagaggaagcgggagagaaggcaagtctgaggtgcccccgacccgatgcctccgatttctcgactagatccgagatatcatcgcgccaggggactacatgagctgaatcggttaatgtccctaaggcgggagcagcgccgtctccaaatcgaaacctgtaagccacctatttggctcctaggtccatataattcatctagtcctatattgtgctatccgcatgacatgctttttcttattcgattcatgacgtgctgtgctataccacttctaaactgttaaagccgattcctaagcttatatacgttacagaacgttgaagaaaaatcctctttttaatgtgttttgctgtttgtccattttttatgtgaccttcaaaacatacctagttggatatatagcacgcttcttcctttccatggtggaggctatcatggttaagaggagcaagaattattcagccaaacacaacagtgagcagggttagatgttataactacgaggttggagattccaactcattgtctgatggtcttttgggacggttgcatcatttttcaataatacctcaaatgctcaattgacgtttttttttatatactgtaacaagttccctctactgaaattcttgtctgtaactaatggatccaattttgttctctgcgtgtttcattgtgactggtatcaaccttggtcttgttgttttcttcttgtatgtaatatcatgagcataacatgttgcagatcaatttcttgctcaatgtgctaaaagaaaggaatctccctgccaacaagataattctcaatgtgtgaagagaatgagatattcaggtccggaccttccagaggtacgccgtaaatgccagaatcatatatttggatgtctcagaaagtaatttcatattatcataatcttatcaggctaacaatagattataatgtaaattattagtcaatgttctgttttggagaccgtgtcaatgtccaaaagactttttgtaagcagagggagctaatgtcaccgttattgctctaaccacaaaccgttgggttgatcgttagcaaaatattgagttgtgaacaaatcctgcaatactgcaatcttgtacggtcctacatagggatggcaacggaccattccctagtgagggtggttgcaccaaaatttggtttgtcaaacaaactggttctactacaacttaaaaaataatcacatcgtgcacaatacacaaacacaaactgaaaaatgagctcagactccattcgaatgccatatgcattttatacaaccatgtgtagagcaacattatagaatgccactatatatgtatcttttttttttttgctttctctaattgtgttaattatttactcttgaattccaatattgagatttttctaaatgcttgtggatgcaggacatatggcaccatatacattccttgttgccactgcaagatgctgcccgtgctgcttgcgtgtctcaggcttttctacgtttctggaggtgtcatcccaacctcattttcagttggaaaacgatgggtttgaataaagtgccacataaaaagggtgggatagttagagattacaacaacaaagttgaccgcataatgaaaaatcactcaggaggtataaagacatttagccttgaattacatcctttttccaatgccaacacctattatcatctcaatagttggcttgagattgctattacatctgggattaaagaactcactctcgtgttgacttcaaatgaggaaaagtacaatttcccatgctcacttttatctaatgagagtggcgactctattcagtctcttcgacttgttcattgttccttctgtccaacagttggccttgttagcttgagaagcctgacaagattgcatctatcttgtcacgtcccgaactagccccgaacggaactagcccgtgacgctccaaattaacctgttaatcgataccagtcccaggaaacagtgctggtatcacgggaagacagaatatcacagcaacagtggtctctttattacagagtaggagtacagtcatgttgggctgcggacagatcccgagctcacaactgcattacaaaagggaaagcggaagccgagacttggaccaatcatcacaggcgcgacttgggaactaggccgaaaccctaaaactcgtcgtaaccgacttgctcctagaagaactcctcgtcagcgggatccacatcatcttcttcagcaactggggggggggagattatttatatagagcaagggtgagtacaggagtactcagcaagccatgggaaataagtgtttaatgcaggcttcaacgggaaggctgttgtttttgcaaatgattttattcaaactcctttttgaaacatctaagtgagtgcttctcaaacggcacggatgaggcagtgcgtctcgtccggtcggagtatgtgcaatgtatcagtctttgaattggtttcaaggttggcacccggccaacaactttcaaacggccacccgggcctggctgatcccatcagccgccgcagattttccaaacgtcgaacccaatccccaacagcaatttcacaaagcagtagtcaaacaaaactacgctatgaatcacctcacatccgcccatgaccgtgggcacagctgttcgaacagtttgataacctctgcagagggggtacactttacccacacgacattactaacccgaatcacccagcccgtgcagaacggccacgtctggtgacctaaaggttttcatgacaaggcatttcgagagcagacacagggttgccatatgccgacgagaggggtcccagaccaacaacaggttaggtcccagaccatactgtgccaggaagcccgggggttctccccgacaccaccccgttgaatccacatgtctcttncggggncatcaaggcttncccccgattagcntagttactcaatcggggtgtcccattccacccatgtggtcgcacttgtcttatgttcggatgaaattccaaggaaacggttcttaagtgcgagagcgggaaaccgtgcacccggtacgttccccggtccgcgattttggaaatttatttagttcgcaagcaccgacccaggtgtcgggttttccaagtcttttgtaaaacccaagttttacccatcgttggatattttatattttgagggggggggaagggtgttccggtacacgtacctgagggcccgtgcatcgaagcacaacagttgacaaaggaggtttaagtgttcaataattcaaggagggtaattgcagcaattaggattggggggccggcaggctatctcacaagccgcggccgaattacttgtgtaaatcctattcatgcaatatttgcgaaaaagaaatacttagatttacattataggtgcaagatgttcaaaggtgacttgccttgctcgagatcttgagcttgatcctcgaaatcctcgcactgcgggtcttcgggctctgaaactacacgcgaaacgggacagctcaacaaacggcgaaaataaagccctattattgacctctaggcatgccattagatagatctcgagatttgaggaattttggaagttgaacggagtcaaacggacttacggttgggaagatattgagtttctaagattattggatttttggtctaaaggaaaaggatttatttaaatcctttttgaaaaagaaaagaaaagaaaagaaagagggacgggaattagatttcgctggcggcttgagcgcggcccgagaggggttggcgcggcccggccttgccattgggccggccggcctgagggacggcccaaggggctcgcggggaggagaggagagagggagcgggtgggccgggttcaccttgcatggtcccgggtgggacccgcttgtcggcggctcggctcaccgtgagcgaggtgcacgcggggcgtgctagggtttggggaggggaggcgcggtgcatgcgcgcggtttgcggaggacacggtgcggcgggcccacgcgcagcctcacggctcgcggtggaccgcgcgcgcgagcagggccgaagggagcggccgaccgaggtcggctcgacccggtcgcggctgaggtggcaccgacgtggcgcctacgtggctgccacgcgggccggctggaggaagacgaaggcgccggccgcgaatggacggcgggcggcggcggtttctccgggacgccgtgcgacgacgaggggcgacggggtgtacaccggaatgacgagggagaacgagagggagcgagccaacggcttggattcgccggagggagctcgacggcagcggattgcggcggcggcaaccggcggcgagggaagggggaaacggcgacggcgcgacgggagatcgattcgggcgagctagagcatctacgcgactccgggaatccgtcccttgcgccggattaggaggaaacgcaccgagggaggccggcgacggcggcgggcacgcggcgagcgacggcagcagtcggggcggcgccagctagctactggggtgctacacatgctactaaccgagtctaaggggaggagatggatcgaggagggagaacggggagatgcactaccgagacgaggcggggcgctgtgacgagaggccgacggcacgggagtgatctctccggcctcgggccggggaagcggaggaagacgagcgcccagagtccccttccgcgtccttcgcacgctccggctctcccggtgcttggcgatgaatggcggaggcgagacagaggggcggcaatggcgcggtggcggcgagcgaaacgggaggaggaatgatgggagggcgccttggttaaatgggaggcaatgtcggtttgggaaccgacctagggcggtcaagggagagggctagcgct

SEQ ID NO: 57038 - DNA, 8073 bp, Oryza sativa
tacattttcccgctaggcgccacgacggaacgggcgctacatatcttgtgtgcgtattattgataccgacatagaatatcttctttccaatgctttagctttggagaggttggaaatcaagcgttgtggcgagattaatcgcctgacaataccttgtctgctacagcggcttagcttcctgggggtatttggatgtttcgggctacaaatgctagaaagcaaagctccaaatctatgcagttttcactttgaaggtaaacaagcgcaattctcactagaggaacctgtgcgattgaagaatctggaagtggttttccccaacagtgtctgttatgctcgtgttgagcttccgtttagtatgccagatattgaaactcttaatgtcattttgtcttgtgaggtatgcaccgcactttaggtgatacattgttggcgtgtaatgtagtaccatgctctgaaatataattggtctgagccttctttttgcagatggtggatacaccaactggccctggcaaattcctccaccttagatacttgaggattacttttgcaacatggagattttcctgggcttatgattatttttctcttgcatcttttcttgatgcttctccttccttggagactttcatcctatgtgtaagttgccgttcattatgcaatgcttatctaataactatggtggaccatttataatttattgaagtatcattgatttttcatcttcagatttcacagaaagagaagcatgacttgacatttaaggatcccatatgtctaaggcaaatccccgaacaccggcacgacaagcttaagaatgtgaagatcactggtttcagtgccacaagaagcttggctgagctaatatgtcatattatggaaaatacaacgtcccttgagtgccttacattggacactctttgcactcaacttcggtgttctgacggcaacatcgatgtctgcctcccattggatcaggatgttatcaagggagtgcataattcgctcttggctatccgaacatacatcgaggggaaaattccctctacagtcaagttcaatgtccgggagccttgcagccgttgccatggttggtaacttggatgtcggatcattattacccagtatttaattttgtaacttaaggtgtgttgtcctttatgttttaagttatttgttgtgtccattgtttaggtatgtgccttggttaatttattaataacagacttgtgtaacttgagatgtgtcgtgctttacgttttgagttattagtggtgtggtgtccattatttaggtctgtgcctccattaatttatttggagttattaataacagacttgtgtaacttgaggtgtgtcgtgcttttatccaagtcatcagtggtctattcagccatgtgcttggttaattcatcaccagagtgccagtaccagaccatcctacgttcattgatgaaactgtaggaaagctgaaaacaggtggtattttacctgtctcccactggcttggttaagatttggaggattggagcaaggtacactggctggctccgccccttcatcggcgccaggcgagaacaggggacggtggtcattggtgacagggtcggctgacggtgtgattgttgtcagctcgcctaatgcagatgaggctggtggcagtgtcctagaggcatcacttgccaagcgagcgtcgacaccaaatctgattgctaagaggtgtggatgacagtggagcatctccaacgatctcatggcaataaaggcagttgcagcaacactctaggagcgacgacgagtttgacgatctgcgcaagacaatggtagcgctgcaaagcggcttcgcggtgcactgggagcgttcaaaatacggcgacagcataaggggattgagtttgaatggtagcgctgcaaagtggcttcgcggtgcactaggagcgttcaaaatacgggcgacagcataaggggatttagatgatgacggacaacagttgtagcagatggttgttatgatccgcagaggcataaatggtgtgacaactgacaacaggcagcacggaccaattttgattatcccttccgcccttgtacggtgacgaagcaatcttctagctttccatttcctttttgtatgtgtcatgctagggtgtgacctccacgatgaggtcattggtgtgacctccatgtgtctagcccccaccattgtcttgtctcctctctcccgccaccgccactccccatgtcaacactggtcgtcgccctaaagagggatggggaaagaaggaagaagtgggagagatgggaatagatgagagagggcgatcaaaggaaatagagatctcctaacatatatggatctcaaatgttttttattttctttctattggctaggatgcacataagttaaaacaaccatccatactatgatgggacccgactaagacggttttgctacgatggaaggtgaagatatttggttttgcggtttagggatttcaactaaattccacgtaaagatgacgaatgttaagcggacttattccgaggaagtacgctagctaataagtccacacatgtttactggtggcgtctcctgcctttgtgcctcctgcccaagatcgccaccttcatagcttcatagcaccgtacaccttgtgtacacgttgtatgccacaacgcccatcgccataggcttcattgcgacgtagaggaatacatacaaacacacacagcgctagcagcaaccaacggtggtggtggactgccgggctgcacggtgagttcgctaccgtcaacgccatcatcgagctctgcctcgtcgttgctggcacttccacatggacaccatagttgcaatctcctaagcctagtactccccggacagcaaaacgatccttggccatcaccgtggcctctgagctcgccatcgtcatccaccacctcgtcccctctgccccccgtaaaatcttcggttatgatcttccatgtcgaaatactggtagcacacttcacacatgtataaagtcacagatgattcatgttgaattacaaaatatcatgtcgattagttaatgaaaaacttcatcgtcaaacttctctggtgcaggattgtaaagaatgtacatgttgctttccccgtcttatgtgctctatgcatgacaaaatttgaatgtatgatcatacaaatgtatcatgtatatgcctgtgctatgaccaaggcaagcaggaaagatatatgattaaaaacagtaaccacttattgtaaaaatgaaaatctatgaaaatagaatcaaacaatcatatagaagaacagccatttggtcagaatgtctagctgttgagtaaaaatcaggatttgcaatagattgaaaaagtaactaataatgtatacccacaaactgcactattttctttaaaaacagagaagatattatgttgggctagggcgctattccctttgaatgtgcatacagcttgcacagttctagcactacaatttgaaatggtctgcattaagaacactgttaattccaacaacttgccaataattactaaacctatcatcttttacacccagtgtactactctgtaaaagtctaatatttacactaatgtttggtttagccttgagtacgtataagcatttcattttttttgaacgactcgcacgagacggtgcgaagttagcttataggtacttactgtgagcagatcatttatcgtttccatgtatgaaatcctgaatgttttataaatgacctgcagcacatcacaaaatacaaccagaaaacccatgtaagaatttatctgacgtgaggccaagaatggccacaattttcatcaagattttgtctatgaaagatcatgtgtaattaaaaatcagtcagcattccatcaattttgttgtttacatataaataaacatccacttgtttaagtttgagctacacaccaagaaacatgtttaagtttgaggtacataccaagaaaccaacagcctggcatatgtgcttgagtcatcccacgcagatcctgtatactgttagtgtctcagttaggtagaactgcaggagaaaaacagaaagatactggcagtacaatatgacctgtttctttctgatataggtcaaatgtagaggtcatacaagacagcagtgaaatggtgatgatttaatttgaaaaccaaattttatagaaaaaatacagtgttttatgcttgattttcacttaagttcactcatctcggttagaatttgtttggttttccatgtaactgtcaatacagatttacataatgtagaggtggcgatgtgccgacagtgcggttcacatatttatacagattcagtgttagatttctttgtgatagctttgatttcagggtagtgcttctcattatagcaatgtgcagccatatagtacgtgagacttgtcattaaaacttgtatgcatgtgttatagccaagtctattgataaacaaaggaagctttgtgctcagaaacttcccacaggataaaaaattgtctgctcaggaatacataaactttctacaggaatacgaagcttattacgcataaattttctagaacacaaatctttgtgctcagaaacttctagtcaaaaagtttatacaagaaataaacattactatgcataaactttctataacaatacaaaaaactttctgcttaaaaacctttttgaaaccgcactgcctagaaacttcctacagggataaaaaaaaattccagcgatggtagctaataaaatagaaataagaatatgatcgagtagaaaagagagagaaaattgataatcactgaattgtttgccaatgtaaacaccacaaacctaaagtctccttgagaaagctacagtcctatcattacactttcttgaagatttagccccactgttgggcctattacggtagttgttcaataaatctctaagaatattatgctgctctcagatgagaaagctacacatggacagataactcaagatggattaaaagaatatccaaggatgttttgtacaagtcaaagcacatcaatgccactaagagcaactgcctgaaagacaaagcacatcaatgccactaagatggatctgtgaatgcaagtggcaagtggacaagcagcatttagtacaccctacacatgtttctccgtttagctaatactatgaagcaatattaaggtaatatgttgcgaaagtagtagttaggaaagtaggagaccatagagactataacaagttattactgattctatatgagtgtgcttaattgcttagcatatctacctttgtgatactatcctcatttgtaaataaaacaatctcgttgaagtgaagttattgcaataataagcataataatgtccaaaggcactaacaagcccttatgttgaattaggtgcaattaataatacaggtctgcagtgctgaatttctgcgtaccttaactctctagcacagggagtatgaccaagagaggaaccgctgtgcaatatcctgaggtttcaacagaagacattctggattaatgcatcatacatttatttgaaagaaacatttctttagaaatatcagtttagagaagaaaaaggaagactggtacagtttatcacctgcaggaggattcccagtgtagctgatctaaaccaaatctctttgggagttcacctttctcagcaaaaaaggctgcagatggcttccaaaagcccttactttaagaacagtcctggtgattgggctcacacaagaagataagttgacatatggaaagaccttcagcaaaagattgttgtaaattacattagccagtacttttcagtaattgcagtattcgtatgaactttgcaaagttacaggtaccacttgttaagtcagggcatacctttcctggatgagaagagtgaatcagagctccgatatcattttcttctatcccataaagacgatccagatagatattttcatcctcaagtctactattttacatatctaattcagagaacacataaaaaaatagcaaacacataaaaatgtaaatggcaagcggtaactgatgaaaaacctcattaggaaggtccattacaaactgcccatattttgtggtcaacacccttgcagtactctaataataaggatgtcatctcagaccacctttgacgcagacaaatctcaaataatgtcctcataacatgatccaagcttcgactaatgctttgagcattagagtgcaaagaggagttatcaagtagagcacgtgatatgtaaacctgcaaagttgatacaagtgctcagttaaagaaagttgttagactcaagaattattgataaacagcatttctccaatagatacctgtatgagaattgaaattttcctatgtttgtcagtgggtcccccctcccaaacttccccttaatatcttgtgggcatgcattctaattcatcctgctcttcttctcttaatacactattttcgaatccagaggaatgggacccccagtatccagaaaggtgttggaaatatagtcattattcggcatattttaatccaagaaattgaaactatgatcatggcataagcagtgtagggtgatcttaacataaccagtagcatactaagcgcatcatgaatgtcagaaacaggaacataccagtaatgcgataacatgctagaggcatcatgtagaacaggaacaagaacatagcgcacacagtatagcgctaacaatgggaacaggagtagcgctaacagcagtagaaggagaagattataccccgagaatggccctccgctggatggtgaggcagaattgcctccgttgttgtagtcgttcacggcacctcctcctggcgcaccagctccggatccagctcctgtcggcggcggcgcaccacctccgccaatagcggcggcagcaactccagacatggcgatgagcagtcgtgcaggaggcactccccaaaaacctgatcacccgcctacccggtgcagatctcaggcgaaggtgtggtttcggaggcactgcttcttccaatctctcgtgcgcgcaagagatcagaagcggagaagcgagagcaactcaggcgcggagaaggagaaactaacaccgggaaagaagcgaggaactcggatcggactcgcggcctccttatctatcaggagaaagaacgtggacgcgctgttgcggagggaatcgtggaacgtgggttagtggctgcaaaaggatagcgacgtgacgcacgcacgccgccagccagccacgcctcgcctcgccctcgcccacgcccacgcccacgcccacgcccggcccggcgcgcgcgcgcgcgtgtggcattccgacccccacctcaactggtcaacagggagcctctaataactccctatttaggttgagatatttctcgcttaaatccagaggtggtattattatccttaacatttattatgggcctttgagatttaatagaataaattgggcctagcccaattattctaacaatccccaccaaatttcaaggctcataagaaatgttctcaatgttgtgcctgtttgatataccagggttttggtggagactgttaagttgaacttccacctaggaaatgagctacatcagaccacaacttaacaatggactatgccttgaattgtaagttttgtgtgatcaggtttcactcagaaccttgactggtactgggctgccgttcgcatcccctctgtttggagcatataagtcaaactccaggcctttcatgagtatctagagattgcccaaacctcatagactgtgactagcagtcgaactcatataggtgtgttccttctgagatgttctgcaggtcaacatctctgcttggaaaagccactcggatcacattaagacataagccatcctaccatacaggaaagaagagaagcacatcatgaaaatgagcccctttcaagggtctcttctctcagtcacacaatagtttgtttcaccatccaaattcacgggatctccgatcacaatggacaggtttccactattatgcaaccttaggtgggtat

SEQ ID NO: 57039 - DNA, 4911 bp, Oryza sativa
  unsure (1)..(4911): unsure at all n locations
tgccaatgatcatctcccggatttgagacaaaccggctcagcttgcttacagcaaatgagatgtcaggcctcgttgcgctagccaagtacatcaatgaaccaatgatttgagagtatctcagttgatcccttgctattcttcggtttttccttaatagcacgctgggatcataaggagtaggagctggcttacagtcactatatccaaagcgactcaaaaccttgtccacatagtgggattgcacaagtgtaatcccaccctcatctcctctttgtagtttgatgttaagaataacatcagcctctcccaaatccttcatttcaaaattcttagacagatagtctttgacctcctcaatcacattaaggctggtcccaaagatcagtatgtcatcgacatacaagcacaagatcaccccttctcccccaccatagcgatagtatacacatttgtcagcttcgttcacaacaaagcctgcagatgtaagcgtgatgtcaaacttctcatgccattgcttaggtgcttgcttgaggccatacaaggatttcaatagtttacacaccatttcctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtagtcaagcgagcaactggtgaatatgtgtcgaagaaatcctcgccttccttttgggtataaccctggccacaagccttgccttgtacttttcgattgtaccatcaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatacgcctcttctatggttcttggggtgtcatccacgaggtatacaatgtagtcatctccaaaggattttgcaaccctttgtctcttactcttgcgagtatctacaatgttgtcctcctcaggattttcctcaggcgtttcatcattgtgttctatcggtgcaaagtgctcatggggcatgacagtttctttactagaagtgctaggtgtatatttcatagaaaattcattctcaaagaatgtagcatctctggactcaaaaattgtaccagcatgcatgtcgggtactccagagtttactattaagaatctataacccacactatggatagcataaccaagaaacacgcaatcaacagtttttggtccaagtttccgctttttgactataggtacatttaccttggccaaacagccccatgttcgtaggtatgagagatttaatttcttcctttcccattcctcgaatggtgttacttccttatgcttcattggaattttattcaggacatgacacgcagtcaaaactgcctcaccccaccattccttcgaaagccccgcagtgtctaacatggcattcaccatctcagttagagtacggttctttctttcggccaccccatttgattggggtgaatagggaggcgtcatctcatgaataattccaaactcttcgcaaaaagatgcaaactcattggaaaaatactccccacctctatcagacctcaaccgtttgattttcctttcaagttggttttctacctcagctttatagattttaaagtaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaactttgaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacaaccgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaattttttaccgtaccccgatgttcctccgccctcgctaatgatcatgttggcagacttcctgtctttgcgctcaagacagtccttggcccaatgcccagacttgccacacacaaagcagtctccttttgcctttcccttgcctttcttcttaaaattggttgcagccttgggtttgacatcaggcttgactttcttgttgttgtgggatgcatgagggttcttcttctgtaccatattggcactagaacctccctcaacctttttgccccggatgtcctttgccctcgccttctcctcaacacccaaagagccaatgagatcaggaacactgaactcttgtctcttgtgctttagagaagtggcaaagtccgaccaagaaggtggtagtttggcaataatgccacccgccacaaacttgtccggcaactcacagttgttgttctcaagttccttagccagcatctgaatctcatgagcttgttctactacagaacggtcatcgaccatcttgtagtcatagaactgctccatgacatacagctcactgccggcgtcagactccgaacttggcctcgagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctatcaggtttttggattgttggaaatatagtcattattcggcatattttaatccaagaaattgaaactatgatcatggcataagcagtgtagggtgatcttaacataaccagtagcatactaagcgcatcatgaatgtcagaatcaggaacataccaataatgcgataacatgctaaaggcatcatgtagaacaggaacaagaacatagcgcacacagtatagcgctaacaatgggaacaggagtaacgctaacagcagtagaaggagaagattataccccgagaatggccctccgctggatggtgaggcagaattgcctccgttgttgtagtcgttcacggcacctcctcctggcgcaccagctcctgtcggcggcggcgcaccacctccgccaatagcggcggcagcaactccagacatggcgatgagcagtcgtgcaggaggcactcccccaaaaacctgatcacccatctcaggcgaaggtgtggtttcggaggcactgcttcttccaatctctcgtgcgcgcaagagatcagaagcggagaagcgagagcaactcaggcgcggagaaggagaaactaacaccgggaaagaagcgaggaactcggatcggactcgcggcctccttatctatcaggagaaagaacgtggacgcgctgttgcggagggaatcgtggaacgtgggttagtggctgcaaaaggatagcgacgtgacgcacgcacgccgccagccagccacgccctcgcctcgccctcgcccacgccccggcccggcccggcgcgcgcgcgcgtgtggcattccgacccccacctcaactggtcaacagggagcctctaataactccctatttaggttgagatatttctcgcttaaatccagaggtggtattattatccttaacatttattatgggcctttgagatttaatagaataaattgggcctagcccaattattctaacaaaaggttagtgcaaatttacaagcatcatataaataaaaagagaaaaatatatattatcaccttactctcattcatgtgatgccaaagcatctcattgtaagtctccacactggagtactgaaggtaaaagtggtttgcaattcgaccaagttctgtgcaataaaagttgccgctcttttcacataaccgcaccatcatagctttatctagcgcacatgcagcatgaataataaacgctctttgcttggcaaccaaggaacaatcaccaataaccttggcaaatatgaaactgggagttgcaaaaagattcaatttagattcaaaaaccagagcatgagtatcaatagtgcaatgaagtaccataacaaagacaattatcttgcttgtcgcatgatagaaatgatcatcagtaatacacagaatatgtcacactaccgcaactgctaatgcataaaaagttagcatacaacacagtagtcaactcacactacaaaatacgtacttccagaatnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57040 - DNA, 812 bp, Oryza sativa
attcacaggcgccagggatctcagtgttttgtcgccaactcatagtcgggattctcatgattcaggatttgaacaaagtagacatagaaggcagctcacaagagagagaagcagcagcagtcttacaaggggtgagcggcaggatgggcaacaacttgtccttaatggtgctggtgtcatcgaaaggattatttccaagatagtatcagaacctttgcatcatacaggaaggatgcttgacgagatgacaagcaattctgtaacatacttgagggaggccatttctgatatcatagctgatgcggataaaagagggcaggtggtagcattgcaggaggcacttaaaaaaaggtctgacttgaatagtgaaatgctgcaaaggtgtccacgcgtattgctggagatactcgttgctataagaactggtcttccagattttatgaagaaaagtaatagcattggtacatgtgatttggttgacatttttctgtatttgaaatgccgcaatctctcatgcaagagcattctaccagtagatgattgtgattgtaaagtttgccaacggaagactggtttctgtagttcttgcatgtgcattgtctgctcaaattttgacatggcatctaatacatgtagttgggttggttgtgacgtatgtcttcactggtgccatactgattgtggcctgcgccactctcttattcggaaggggggaagtggctcgagggcatatagtactaatgagctgcagtttcattgcgctgcttgtgggcatccatcagagatgtttggttttgtgaaggaagtcttcc

SEQ ID NO: 57041 - DNA, 1609 bp, Oryza sativa
cgagtataaaaattctaatcaggacggtggttcatataggagtattaggcaggcaggaacgcacgtcgttttcatggaagcagaaaattcggcttgcttgtgatgcaaattctcaaaccagccaccgctttatatgtttgacttaaactctgtgctaagacttttggactcaagtgagtagtatcagtttatattagtactagtcaataatatatggaatcaaagaagatgatgttgcgaagaaagtacaggacgaaaaaaggaacatggaaatatccgtgcaaattatgagtgaaaacaatagtataaggcgtaatgactttgtttaactccatagcttattatatgaaatgatataatgctgtaagcctgtaacgataagattattggaaagttgcttgcctggttggcaaagccgacgccacagccgagcaggatcctgccgactatgagcatggcgaggttctgggcggcgccgttgaagatgacgccgacgatgaagaagacgccggcgatgagcatggtgaggcggcggccgagccggcgagtggtgtaggaggcgaagaaggtggccgtgaggccggcgaggtacagcgacgaggtgaacagctgcaggccctggttgtcatacttgcagtagttgctctccttgtcctcgtgcttcttcttcagcaccgtcgggaagaactcgcgcaggaagtcatccatcgatgtcactccgcctaaccaagaaaaagaaattcacaagattttcaacggatattatttagtttcataagtcgtaaagttcgtcatctattgtggcaaaaatggcatgtataagtatgaacttggaatgttttaaaatgttgtgttagtgcgccatggaaaaggttgaatcagagagtggataagattttttttccgttttaattggaatttattgtcttagatgtaaaaagggaacatggccacacaaaattaggaaagaaagctgagagagttgcaagaaacgtgatccgtggataaacaaatgcattgacttaccagcctgtcaaagcaggtggctagctcataacactcgattccttctctaaaataacatctaaaaattttaatgctttgggatcctcaagaaaatcatactactagctggactgtaggagcactacaagccggaaactaatgaaaaaggataaaattgcaccaaatggactcaataaaatggcaagatcttttttgatcctctgtaaatggtaggtatttaatgacaaggataaaatcatccgtttcgctttaatctttgcgcttatatgtgcttatccatagcaagataacacaaatatgtagacagatcaaaccgataacacacacgtgcaagaggaatctcactcaatttcaagcaggagacaccaatatgaataatcgagatgaaccaactaatcaacagaaggacatcaaagccggccatggccatgttcggacatcgccggcggccggccgtgcgtagatatatacctgagataccgacgtcgtagccgaacatgaggccgccggtggccgccatgatgcaggagatgatgacgatcggcgtgatcttcgcctcgaactccaccccggaccccgacac

SEQ ID NO: 57042 - DNA, 9766 bp, Oryza sativa
gacgaaatgtgtaatcgtgaaagaaaatcttctttccgcaaaagtaacattttcatatgtagtaggagtagtccagtgcagactgcagagcaattgtgagcacatttcttcttgtttttttggttgtgagctcgcacgatagagtgcaatgtattggaggagtagcagcaaagcaaaagcgagtggcagaagggagggatatatactcctacactgcgtgcactgatgctgctactgttgcacgcgtaggctatagcttagctgaggtcgtaggccgcaatttgaggcagtttgagcaaagtgtatcgtggcatgcagaaaccgaccgatccatggctttggcttttgacgaagggggtgtacggatggaacacgggaaggaaaaggctttggctcaccatcaaacacgcacgcgccgcgccgccactgtacccagcattcactccacagaaacgcatgctatgaacagtaccagactgtgtgactgtacgcctgtacgtatcaacatggagcaccataccccccacgttatacgttccgcatttgcagcttgagaggtgagaggacaactcgcattgtgtgcttctaaaaatccgctcggtacatccggcaacatactagtaggagcactgtattttggagcggtgtattactgtgctctcggaacttcttttttttaaggtaaggttggggatagcctgtgttgtttggtactagtactagtagctattttgctcgaatatcagaaaaaagggagagaaatactctgggttttatcttggtgtcactggtcaagaccagggtttacgattctgacgaaatccggtcggatttcgcgaaatttcgacattccgacgagggtcgaaagtagaaactgtctgagattttgaggagtttcatccaaattcaaatttgaattgataaaaaagaaaaaaaaaataaaatctttaaatactatgatattcatagaatctattgggatataaatattcggaaaaaaataatgtattgtgtgtatttactaaaacttacacaggaaagaaaagaataaaaaattaaaaaaggaaaacacctatagggccagttaatagttgatccaaattacagattactgatcaaaatttcgatgattttgattggaatttcaccaaaaccgaccagttttcgagaacttgtcagcaaacttagataatttgtattcaaattttggtttatgaaatttattcggaatttaccggttttccaccgaatttcatgaaattccgaattctgccgttacccgaaacgaaagggtctgtcaaaatcataaaccctggtcaagacacaagcaaaacattttgttgattatcgatcggttggattggtttgaaccggcacagcacagtacatttctgccgatgtgagaggcagaagtgttgtggttgggtggtgtggcacgcagcggcaattcgcatgcgaatagcgaggcgtggtggtgaaaaggcctgcgcggttgtaccatgattacaagggggagctcgtacctctcgtagctgctgcttttgattccctctgacggtgacgtcatgtgacacgtcctgtctcccgagtggcgtggcgtgggccccgcccaccgcaacattcccgggattctgtctcccgctgctcccgccaacccggccccaccctctcatcacacacagttgcagtcaccgttctcttcgtcgtcgtcgtctcgcaggctgagacacggcacgacagtctcatgcccgaccgaaaatcctcgcatcccgacggcgacggcgagccgttggatccaccatccgacggccacaaacgactgcagccgaaacagtgcccggccgtacgcacatcggagtactacagtatacagagaaaagtacgtgtactgtacacttggactggtacgaaaaaaagtttcacgcctgcactgcatagctggacctgttcgcctgtggttgtgtgtggttgccgatgcatgcaaaaatacaacgcccaaatgcattcggtgcagtcgtttgtggcgtgtggtcaagcttgcttggaaaacctgtctctctgtactgctcggtcaagcaggctccgtacgtacgtacatgctccagccagtacatgaggctgtactcctacatggaaggcgtcttcttttggcacatctatcgttgatcgatcggtcgaatccgtcgttcgacgccatggtgatgcacaagacgacgacgcgtgtgtgtgtttttgtgttgttatgtgatgtgatgggcctcgctgagactgagtgcgtctgtgtagtactacgtgtgtgcatgtgtggagcgagagctcgagcttcctgcccgagacgacgagatatggatcggaatcggattccatgcgccgcgcggcgagcgatccatccatcgacgcgacccaagaccgaagcgtgtgtgcgggtgtgtagccgcgtcctggttttttcggctacgtcttgtatgacatctgctctgctcagcctcagctgaatcagtactagctcagcacaagattcctgctgcctttgtcacaccctaaaaatcctaaatatataaattgttgtttaattgaaattattagaatttattttaaaagcctagaagagaagatctaattttaattaataaattccaatataaaatagggccagataaaatttcattaaatactttgcttaactctataattcctagatttttctgggatttatttgagctaaggaagtatttttaataaatagaattacatttaatgaataatttaaattgaaaaagatttttaaaatcctcttttggcttcggcccaaaaccttctctctccctctccccggcccaagccggcccagtccgcccgcagccgcccgcccgcgcgcgctcggccgctgacaggtgggtcccacctgtcggactcgtcgtcctcatcgcgccgtcgcccggccggaaccctagccgcgccgccgccgctattccaaatccagccgtccctttccgtttccggtgaaatcaattgaggggaaaggatccccatgatccactctacgttttcccttttggaaacatcgtctaaatcgctttggaaattcgcggattcgatctcgaatcggattcgtctctctctcccgaaccctaatctttccatcgcgtcgccggtcgccgtgggccttcgccgccgcgccctagtccctatttaagcacccccaggtcctccgctactcgtcgccaccctcgccttcgtctctcgtcaccggtagaaccctagcaccgtgtagcctcgcgccgccgtcgtcgccgccgctccagccgtgtgtcgccgtcgctccagtcgtcgccgtagctcggggaggtcaccgtcgtggtcgccgtctcgtcgccgtcctcgtccgccccttcgccgtcgttgtcaaccgccggagcaccgtcgccgccgtcgacctgatcgtctccgccgccttttcctcatcgccggcgccgtccgttgcccctccgccgctactttggtcaccggtgagttcgccgtgccgtccgctaccagtaggtgccctccgttcgcgatgtcgtgccgtcgttcgccggcgagcatgcacgcccgagccgccgccggtggtgacgtcaccaccgacgtcatcgtcgtcgttccccgtggcccggtcgtggaccgatggatcttggccgtccgttgtggataggatcgatctcggccgttcgtttccgtgagctgccgccgtgcacccgattcaccgcgaaccctagccgctgacgcaataattcccttttccttttcaaaaataattcattattgcgtcataattcaattaaaatctaaataaatgatttaatccgatttaatctttgaaaattcataactaattcatcttagctcggatttagttggttcaagtctctaattttttctaaaatagagatctacatgttaaaaatatccacattactgttcatgcttgtttatgtacttttttggtgtttttgctcttttctgtttagatcccgacgtttccggagagtttgttttcgcaggagaagaatttgaagagttccaaggccagcaaggcaagtcacacagatcccaaacaaccctttgagcatgttgatcccgtttaaagctattgtttctattcaactattgcatttattttcgaatgtcattgggtggaattgacctattgtttgttatagcccttttgttcttgattactttattccttgataccttgggttattataacttgactagttgggctatatatattggttcagctagatattagatatgattgcttagccatgcttagaaacattagcacactattgggttgacttatgactcactattatttaacaatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcctacgggggtcgctggggagtccatgccttgtttataagggggtgattatgatctaggaaaggtgcgctgtggtggattgtgttgtgcgaggggtactgtcacagctcctttccgaggtaccgtggtggtattgaggcacatggtgacatgttgtggggctgtgtcttgtgggtacagtggtacacctctggctagagtaaaactattcgaatagccgtgcccgcggttatgggcgggtctaacaatgtctttcgtgattagtttcacacttctcaccataataaaagatgctataactggtaataatttgtttagctcttggtttggaatggtatattcctggtttggagatagatctgtacagccgggtatggttgttcaggatggttgggcctgagcagcatgggtgtgctgtttagtgttgattaaaattgatgattaattactctactgttttataattctcaaatgtttgctaaatgctgcttttgcaaatgacccctatattatgccattctttggtatccttgtgcacttgcatatttgctgcgtggcttgctgagtatgtcatatactcaccttgcaatcattcatcagagaaagagttctacagcgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttattattgtgtgcctcggctgattcctggacgagggttcacacacatgtaagcgtttggaattttggatagaaattccgggcgtgacaagttagtatcagagccccttgaccctaggttatgccaaatggttacccatagaagccctctaaaaatattggaaaagtagaactgttctcctccctttctcttttaattaaaccaaactaatggcacatgcacttcataatctcttttagtggttctcattcaaaatttattccagtgttattagtactgtacatctattactgtactaatggctcatttaccagcaaatgttttacaacattgttttatttaatcttgctgcaatgaaataaatttagcatgttgattttataactttcttttatttcttttggaacctgttgttcaaaagtacaaaatttgtgaccttgtttccaactgtttcaacttatcttgcaagcttggtttactttatttacttaccttttactttgattttataactttattcaaattaatccaaaaacttgtgctattaattggataaatatcttaactccctcctttcacttgtctttagatgccgcgctacaagcctgagtacttgtttggtgttgagggatttgtccaggagttgcgtacgatgtcctttgccataggatttgggactgcccctttgtatgcccagattcctcatgatcgtcacgaagagaagtgccgagtcaaagtcaccttgaacagtaatagtgaagatatcccatcagtgatgttcgaagctggaggaggaaactacatccatgcatgtcaggaggtggcaaggatcgccataggagagctccgcgatcgctacagtgatcagttggccgacactgagtatcgctaccatcctcgccaaccccagggaagtgaccgtggcggctaccttgagactgaggagattgagaatgatgctaccacaaggcatttggttgagatgctgtgggctatggatgaaacccgcgcggaggttgtgctagcagctcaagatcgtgaagaccggaatcgtggtaagatttgcaggctagaggacaaggtggatcgtttggaaaaggaactagccgcgttgaagggagaagcaccaccgcagaaggccaggattcgtcttaccgcaaggaagagagctctatttgtccctcgctaccaattggcgccaaaggtccgtgtggtggagaaagaagttaccccagccctagcggatcctccggtcgtcaatgtaagtgatgatgaaggagaaaaattgaagcgcacccattcaaaggtcgagtggggagctactcaagatgatggagacgagccgaacgagccttcaatcaactccgatgcccggaagacctagagtgccttgtcaagccgttgtcttagattgttgtgttagtttgtttgtttaagtttggttgtgtgtgtctcgcatgtgatttacatcagtggtgggatgtaagtgcatgcgtttgtttgcttttgagtgttaggaagttggtgagtttggtggtgtgagagtctttagttttgtagtaatgaaactcagttaagatcaataaaagttaagttagtagaaaaattaattctctgtcctaagtagttttccccggtttctcttcttgtgatcctacccatgccagatggtgctcactcgcagcaacgggaatggccccaacatcaacaataacaacaacaacaacaatggagagaatcccacacttgcccaagtcctggctcaacaggcacagctgatgaacatgatgatgcagcaactccagaaccagcagaaccagggaaataaccatgcacctccccagaacaagttagcagaatttcttcgtgtgaggccgcccactttctctagcaccactaatcctgttgaagctggtgattggctgcatgccatagagaagaagttggatttgcttcagtgcattgatcaggagaaggtctcatttgcatcacaccagctgcatggccctgcctctgagtggtgggatcacttccgccttaacagaactactgctgaacctatcacttggcttgaattcaccgctgcgttccggaagacgcatataccatcgggagtggtgtctctcaagaagaaggaattcaggtcgctcacccagggatctcgcacggtcaccgagtatctgcacgagttcaatcgtctggctcgttatgctccggaagatgtgcgcactgatgaagagcgccaggagaggttcttggaaggacttaatgatgagctttcttacccactcatgactggggattatcatgatttccagaagttagtggataaggctattcgccaggaggacaagtacaaccgcatggagcagaagaaacgccggattgctcacttcaaggcacaacaggggaatagtcagaggccgcgtcttactttaggaccccagtccatgccacagggaggttcttcgtctgttgttcgtccgcagcatcagttcttcaacaacaatgctggcaacaacatccgcaatcaagctccacgccctgttgcagctccaacacagcaacagcctgccaagagggagcaaggcagcaagcccggggtgtgcttcaactgtggagacccaggacattactctgacaagtgtccgaagccccgacgcgtgaaggttgtccctgcccagaacaactctaccgcaccagcatcaaaggcccgtgtcaatcatgttgctgctgcagaagctcaaggtgctccagatgtgattttgggtacgttccttgtcaactcagttcctgcaacagtgcttttcgattctggtgctacacattcatttttatctatgagttttgcgggaaatcatgggatggaagtagaagatcttagacgtcctttgatggttagtaccccaagtaataattgtactctattatcaatttgttattgtgtgcctcggctgattcctggacgagggttcacacacatgtaagcgtttggaattttggatagaaattccgggcgtgacatgcctcgtaagcgttaccattgaatcgagattgttttcagccaccaggaggagcaactctaagagtaaggccattcatagtggacttatatgacattcagcctccaataaaaaatgaatattccttgccacatccttaaactgtgtagctttattaggttcgcgtagccaactttagctactcgttcctcgtctcaaggcgggacccacactagggcttgaggagagagaggggagaggggcgaggtagccgacggctcggaagaggaggggagagcgggggaggagaagaggaggctagtgccgccgtcatagtcatcactcgcgctcgacggggcggcgtcagcggcctgcagggagagacaaagattgggagaaaggaggaaggaaccatcgtcgtcgccaccgttcgaggatggatctagcgagctcaatgccgccctagtctaaagaggtggatatggcgagctcggcagtgccactatcgtcatccaccagagaggagagaaagacccagcaccgtctcctccaccgtagcgaccgaggtcaattcgtcctcgctcccgtgctgagtccacgccgtggacctcattgacccccgccgccagattcgcgccaccaacctcgcgcttccccggctcctgtgccgattccctccgtcgctcttgccgcgccgtcctctcgactgctgctgaagcatctagacccccggtgttaattttggtaattaatgacaagcactaattgtggactaaccgttgtctttgagctatacattttaagttaggtccacgtcatatgtgcgcatggatgattatcgatggattaaaattgacagcgcaaagcaaagggaaagaagacggtaaaactagcgctttaatttagaattgatcgaggtgtagggcgatctaatttgctagtttaattttagtttcgccgtactattaagaggggtaatgacctagcaaagagatgattttaattgccacattaggtcattgcattttcatttgtgctctctttttcattacacacacattcacttacaaattcactgggttcggcctgaccaggggcggtcagaccggccacatagtggcggtctgaccggcgtgccctggccggtcagaccggctacatagtggcggtctgaccgatggcactttcccggtcagaccggccccctaaaggccgagatggtgctgctcgggatggccgatacagagccgacggagccgtattcggtcagaccgagccgatggtggtctgatcgagccgaggccggtctgaccggccaccccatgccggtctgacccgccagaccgatgg

SEQ ID NO: 57043 - DNA, 3177 bp, Oryza sativa
gtggcactggatcatctccacaccgggtcatttcttgttactcttggaggttgccgcctcctagacggcttgtggaggagttgcccggtgacctctccgagaagattatggaggaggcccggcgccggtttgtgagtggtttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggagtaggaaaccgacgagtttccgaacctcggtgaaaaatctcttgtctcattgtctcatttgattgtcacatttacatttgtgcaatttacatttctagaaacacacttgagatcatatcaccctaggattgcaaaacattgacatatgagcgtgatttactttcctagagatataattgagccactatcaccctaggtttgcaaaacattacttagttgcttagttagagttcatcctcaccaagcctagcaacttaggttagatttgattaggtgttatttagttttaaatcgcttattctcccccctctagtcgatatctcgatcctacaagtggtatcagagcttggtctctcttgattgggcttcaccgcctagagagaagatgtcgaacgagttgaaccatgtagggaaggctcccatgtttaatggcacaaactactccacttggaaaattaaaatgtctactcacctcaaagctatgagcttccaggagtattgtggatgtaggctttgccatcaccgacacacccttgacgtagattgatcaccacaacctccaactcaatgcccaagccatgaatgccttgttcaactctttgagccaagaggagttcgatagagtgagcaacctggagaccgcatatgagatttggaacaagttggcggagattcatgagggtacaagtgagtacaaggatgccaagcttcatttcctcaagatccaatatgagacattctccatgttgcctcatgagagtgtgaatgatatgtatgggaggctcaatgtcattgtgaatgatctcaaggggcttggggcaaactacactgatcttgaggttgcccaaaagatgcttagagccctaccgaagaagtatgagacccttgttaccatgctcatcaactccgacatgtcaagaatgacacccgcaagcctcttgggaagatcaacaccaatgacatgtacaagttgaagaagaaggagatggaggaagcctcaccctccaagaagtgcattgctctctaagccgaagttgaagacaagagcaagagcaaggtgaatgaagtcaatgaggacttggaggaagagatggtctttcttactagaaggttcaatgatcttttgggaaggagaaaggagagaggaaggggctccaactccaataggagaagaaatagaagacctaacaagactctctccaacttgaggtgttttgagtgtggtgagaatggacactttgcttgcaagtgcccttccaaggatgatgatggagacaagtcatccaagaagaagagtggaggctacaagctcatgaagaagcttaagaaggaagggaagaagattgaggctttcaacggggactgggactcaaatgaggagatctccgcctcatccgggtccgaggaagaaggtggtgatgatgcaagctccaagaagaagaagatggccgttgttgccatcaagaaggctccatcactgttcgctccactttgtctcatggcaaagggctcctctaaggtaacatctcttagtgataatgagagtgatgatgattgtgatgatgtttcctatgatgagcttgtgagtatgtttgaggagctccatgcttatagtgagaaggagattgtcaagttcaaggctctaaagaaggatcatgcttctttggaggtcttgtatgaggagctaaagacctctaatgagagactcactatttttcatgagaagcttaaggaagctcatgacaacctcctttccactactcaacatggagctcacatagatgttggcatatcttgtgatttgcttgatgatagtgctacttgccatattgctcatgttgcatcatctagcatttatacctcttgtgatgatcttatggatatgcctagcccttgctctagttctagctcttgtgtttctatttgtgatgcctcacttgttgttgagaacaatgagcttaagtagcaagtggctaagctcaacaagagtttggagagatgcttcaagggtaagaacactcttgacaagattttgagtgagcaacggtgcatccttaacaaggagggacttggattcattccaaagaagggtaagaaaccttctcaccatgccactcgttttgtcaagagaaatggtaagtattgctccaagtgtcgtgaggttgggcatttggtgagtgattgccccggaggtaagcctcctaagacatgcatgtttgattctcattatatgcttaggaaggctcatgatggtagcattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccgcaccggtgggagccattgagtgcttgatagtggatgcactcaacacatgaccggtgatagggctatgttcaccacattttaagtaggagggaatgaacaagagaaagtgacatttggagacaatagcaaaggaaaggtaattgggttaggtaaaattgctatctccaatgatttgtcaattgaaaatgtctctcttattaaatctctaaatttcaatttgctttcggttgctcaaatttgtgatcttggcttgttatgtgccttcttcccacaagaagttattgtttctaaccttcttgacaagtcttgtgtgttcaaaggttttagatatggaaatctttatttggttgattttaattctagtgaagcaaatttgaaaacttgtttagttgcaaaaacttcattgggttggctttggcataggaggctagctcatgttggcatgaatcaattgagcaaactttcaaaacg

SEQ ID NO: 57044 - DNA, 23640 bp, Oryza sativa
aaaagtttgcaaaaagggcccaaaatgaattagttgcactcttgtgaaaattagaagtgacaatggttccgaatttaagaataccaatatcgaggactattgtgatgatcttggcatcaaacacgaactttccgctacctactcacctcaacaaaatgctgtagtggaaaggaaaaatcgtacattgattgagatggcaaggactatgctagatgaatatagtgtttccgattccttttgggcggaagccataaacaccgcttggcatgcaaccaataggctttatttgcatcgtctcttgaaaaagacttcctatgagctaattgttgggaggaagccaaatgtcgcccattttcgagtttttggttgcaaatgttatatttaccgaaagagtgttagactaaccaaatttgaaagtcggtgtgatgaagggttttttctaggttatgcctcaaatagcaaggcataccaggtctataacaagaacaaaggtattgtggaagaaaccgccgatgttcaatttgatgagactaatggctcctaagaggggcacgagaatttggatgatgtaggtgatgaaggcttgatgagagctatgaagaacatgtctattggagatgtcaagcctattgaagtggaagacaagccatccacctccactcaagatgagccatctacttccgcctcgccaagtcaagctcaagttgaagtggaggaggagaaggcacaagatccacctatgcctctaagaatacacaccgctctttccaaggatcacccaattgaccaagtgttgggtgacattagtaagggtgttcaaactcgatctcgtgtcgcttcgatttgtgaacattactcgtttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtggatctttaggaacaaacaagatgagaacggattggtggtgagaaacaaggcaaggttggtggcgcaaggtttcacacaagttgaaggtttggactttggtgaaacttttgcccccatagtaagacttgaggctattcgcatccttcttgcatttgcatcatgctttgatataaaactatttcaaatggatgtgaaaagtgcttttctaaatggtgaaattgccgaacttgtctttgttgaacaacctcccggttttgaagatcctaaaaattctaaccatgtttacaaactctcaaaagctctttatggtttaaaacaagctcctagggcttggtatgaaagattgagagattttcttttgtcaaaggatttcaaaattggaaaagttgacaccacccttttcacaaaaatcattggtgatgatttctttgtttgtcaaatttatgttgatgacatcatattcggttctactaatgaggtattttgcaaggaatttgatgatatgatgtttagggaatttgagatgtccatgattgaagagttgagcttcttccttggacttcaaatcaagcaactcaaggatgggatgttcgtgagccaaaccaagtacatcaaggatctactcaagaggtttggcttggaggatgcgaagcccatcaagacacctatggcaaccaacggacatctcgaccttgatgagggaggtaaactggtagatttaaagctttatcgttccatgattggtagcttgctttactttaccgtatctaggccggatatcatgtttagtgtttgcatgtgtgcacggtttcaagccgctcctaaggagtgtcacttagtggctgtgaaaaggattctaagatatttaaagcattcctctactattggcttgtggtacccaaaaggtgctaaatttaagcttgttggctattccgattcggattatgccggttgcaaagtggatagaaagagcacatccggtagttgccaaatgcttggtagatcccttgggtcatggtcatccaagaaacaaaactccgtagccctctctaccgccgaggcggaatatgtttcggcgggtagttgttgtgcccaattgctttggatgaaacaaaccttgttggactatggcatatccttcaccaaaaccctactcctatgtgacaatgatagtgccataaaaatagccaataacccggtccaacattctagaaccaagcatatcgacattcgccatcacttcctaagagaccatgttgccaagtgtgacatagtcattagccacataagaaccgaggaccaactagctgacatctttaccaagcctcttgatgaaacccgcttttgcaagttgaggaatgagttaaatgtcatagatttctctaatgtggtttgagattgtgcactatggttgcttcttttgcattttatatatttgctcctatttgctcttatgctttggacttattgccatttggttcttcattgcgaaaatggagcatgtcacattaagggggagttttggactcttgcatgtgctttacttccttttatatgtgagcaaatcaaccaaaagtgctagtagtgtttttcaaaatgcccaagtcaacataagtcaaaacttttgcaaaatcaatgatatttgaaaactaactctttggaaaatgtttcaaaagggtccctatatgttttccaagcctcacattgctagaaaaatgatttttgaatgaaaaataccattttggctctcttttgaagaatctagattcttgtttttggtcaaaataagattaaaccccaaaatgagtttgagaaggaatctgagaaaagattcaaaacaaagttggtagtgaggaggatttgaaatgtttttggtattcaaatcatattcaaaacccaatttttcaaaaagtggttaaaatcaaattcgtccaaaaacccctatagaccataaaaggccacatcctagcactcaagtgagttttgttgcaaatcttcataaatttcaaatattatgaatggttggcaatatttcaactcacacatttcaaaattgctccaaaaatcaaaattttattgatttttattgagtgggggcagccaactgtgcaagggctgtgcacagtcggctggggggccaggcggtctgactggcgctatatgcgcggtctgactggcctggtagtagcggtctgaccggccactagggcacggtctgaccggcggcaacccggcggtctgaccgaccacgtaaagccggtctgaccagctggggatggtgggcccaggactttgtcctttcttcctcctcctccttctacccgacccctcctcatcccatctcatctcttctcttctccaactcgaaaaaactcctcctctctcctctcccaaaccctagccacctccctccaccaaatccatccggttcaaccgtcaaaatcactccggttacaccgtaagtgaatctcctcctcttcctctctctattccatggattgatttgagttcttattgagtttgtgatccatggcatggaaccctaggtgaaggaagaggtgttcttcgatttgcaccaatagagggtggtttcttggtgtgattcaactccttcaaccggtaaatcactctcactcttgtgcttttctctcaaatcggtctatttcaattctagggttaagggtagtttccccctttgcttcaatctctatgaaatagacctacactttgatgttcatgttccaatcttgtgcaactttgtcctaacaatatttttttagaatcatttgtgtggattgtggaaggattcggttgtgctactgtcagtggcggtctgaccggccgagagcctgcggtctgaccggccgaggaccgtcggtctgaccagccgtaagccgccggtctgaccggcctatggccgtcggtctgaccgacttggggcttgcggtctgaccggccttggctctcggtctgaccgcccctgacagacagcactcccccttctcccacttcactatgtggcttctaaaactgttgtttatccatcctttgctccatgtttttcagctatgcctccccgcactcgccatggtcgtcgtgagcccacgcccgatcccgtcagtgagaatgaggattcaagcggagatgagtatgttcaaagtgatgatgacatatggaaaatgttgagggtgatgagatggaagtaagtgatgatggtgatgacaatgagagtggaaatggtgaagatgatgaggcaagtgatgataggagtcctctcgattccaccatccaatttgtgcttaatttgaggaatgctcaacaatacactatcctccgtcatcataatcaattccgaaggcctaacgattgtaatgatccaagatttcatacacggttccaaaagtccgtgtatgcacaagtgtatgccaacaaagccttcgccgaacacaagtggatttcttggaagcacattggtgagacaccggagtttgagaatttgcaagagatgttccggaccgttgggattgatagaattgtcaccatgaagcaaccttttgatgaagatctcatccggcaattctatgccaccgtatgggtgtccggcgattgtgatgcaatgaagtggatgtcgaggaccctccgatgctctatcaaccgccgtgaatccaaggagctcttgcacattcgcttcaacaacggggatgaccttcatgatgagcacacccacaaccccttccccattgatcacttttctcagttttatgaagaagggggaaggcacacatatggcaaggtggcgggtttgagggctctcccaagtgtgatcaaccgcatagtaagggccaccatcctcccaagatgcggcaacaatgatgacatacgcggagttgcttggcatgttattgatgccattatggatggtcgtcggtttgatgttatcaaccttatgatgaaggagattgccatctcaaaggggactcttggacaaggaatctattatgctccctacataatgaggttgattcaaagcaagttgggacaaattggtcacaatttaaaagaacataaggagtacaagcctcgtctccaactctcctcccctagagctcctcgtgtgcgccaaccaacattcgatcaaggtgcaagctcaagtgcagcccccccttctcctcaagggtatgatccaagtgcttttttccatctacaatatgcctactttggaatgcaacccaatgacttcttcaacccggtccttggggctattcataccctaagtgaaagcattcaacgcttatccaccgggcatgaagcattgcatgaggatgttcgtggcttgtgcaccgatgttggcaacttgaatacttcggtgggaagattgcatactagggtgggtgtattggattctcgagtccaaaccttggagagtacccaagcttttgtctatcatcgccaccgtgatgcttctcatccttccacttcggcgcgtcctccttctcctccacaagagtgaagacctttttggtgcttgatgccaaaagggggagaatagtgtgttttatgttttgtgggttgggtctagtagtagtgaggttagtcacctcatatttaataggttaaggaggattgggctatatttggtatgggtatgggctattactctatattgtgtgttcctttttcgttttgttgttctctatgtcatttggacccttcgtggtcttgtaatagcctatatttatttgtgagccctttatgtggtcttaatgtgaacttgttctatgatggatggttggtgtgacattgatatatttgtgaccatcttatgctcatggatgaatatttcttgaagttcacattgagatattgctcttgtgtttgtgatatgttgaaatgtgaaattgaattgtgcattggctccatatttgctatttgtgattgttatgcatatgtttagggggagcttttgcttgtcaaaacaatatatgtccatgtgctctatgtttgattatatatatttgtggtgtttgtcatcaattaccaaaaagggggagattgaagcatctaggcccctagtgttaattttggtaattaatgacaagcactaattgtggactaaccgttgtctttgagctatacattttaagttaggtccacgtcatatgtgcgcatggatgattatcgatggattaaaattgacggcgcaaagcaaagggaaagaagacggtaaaactagcgctttaatttagaattgatcgaggtgtagggcgatcaaatttgctagtttaattttagtttcgccgtactattaagaggggtaatgacctagcaaacagatgattttaattgccacattaggtcattgcattttcatttgtgctctctttttcattacacacacattcacttgcaaattcactgggttcggcctgaccaggggcggtcagaccggccacatagtggcggtctgaccggcgtgccctggccggtcagaccggctacatagtggcggtctgaccgatggcactttcccggtcagaccggccccctaaaggccgagatggtgctgctcgggatggccgatacagagccaacggagccgtattcggtcagaccgagccgatggtggtctgaccgagccgaggccggtctgaccggccaccccatgccggtctgaccggccagaccgatggggccctctgacagggctacaacggctagttttctagccgttgcagagtagcacggtctgaccggccacatacctccggttagaccggcagagcacagagttgggggatttcgcccccaacggctagttttggtgggtgggagtataaatactcccccaccagcagcaagggggctctcttggcacccaattcaattgcatacaccccttgcacctctctcacactcacttgagctttgtgttcatccatctagtgtgttagagggttgtttagccaagagtcaagtgcatttgcttccattgtagagctagtgtggcacttgatcatctccacaccgggtcattgcttgttactcttggaggttgccgcctcctagacggcttgtggaggagttgcccggtgacctctccgagaagattgtggaggaggcccggcgccggtttgtgagtggtttagagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcttttgattgtcgcatttaaatttgtgcaatttacatttctagagacactttgagatcatatcaccctaggattgcaaaacattgacataggagcgtgatttactttcctagagatataattgagccactatcaccctaggtttgcaaaacataacttagttgcttagttagagttcaccctcaccaagcctagcaacttaagttagatttgattaggtgttatttagttttaaatcgcctattcatcccccctctagtcgacatctcgatcctacagctgcacgcgcccggtgccgcgcagctcgtgcggaaggagctcgggccgccgcttgattgccccgccgcccgatgccgtcctagatcaactgggggagtcgggccgccgccaagctcctcctccacttccgcgcgccggcgctcatcttttttcgccgcggggggggggggggggaggggggaggaggaggctggtgcgccggcgagagccaagccccgtcgcccctccggtcggtgccgtcgccgcttggctgctcagtgcggtgaatgcggtggggaaagaagacaggagagaggggagagaaaaaagtggtaaaagctgatactggtgggacccacaagtagtaacttgcactgtggcacatgtagctaaacattgttcctgatctaggtggtgtgcgaggcttcgcaaatactagtggcgcattatgaatgtcctaaggtatacacgctgcacaattgcacagtacactatactgatggagtatgcaactgtgcacgatgtgagttctgtcccaaaaaaactgcttttggatacaatgcaaaggttagtggattttcagctcacaatatgaaagtcgtcgcatgacttctttttgtaatcgtactaatcgcgcgctttttgtgacggcatggcatagacgcatgtaaacgcatgccttttcgcaaatttgtaaaacgaaacgaaccttttgtcccaactggtgcaaaagcgtgaggaaaacgaaatgattcgtggtgagctacaacacacttcactcgatcgatcgtagtagcaggctactagccgcagcagcagtaggtcatcggacgccacagcgatgatttgcatgattcctcatgttgatccctggcggtggtaagaagagggggaaaaagtgactttttatcgtcaacagcgaaaagcaaaccgctcgcgggaatctcattattggcgtaccatttgttttttaacctttcgaggccaaatacgccatgccttccatccgtcgatctaccggttggagtagtagctgttatattgtgctcacgtttttgctagtgttgtagacgtggccgcgtgcgtgagaaaacgagaccgagaaaatgtggcgtgcgtcgcatggtggagggagggacagagatgtggcacggctcggcgcgtcgcgtttggctggacacgaggacagtacgtacgcctgcgctgacaagtgggggatcaccatgggaaagagaagcgagcaaatggggatagtgtcgtgcattgagagagagagagagagaggcgatcgactgacgacgacgacgcaaggaaaagctacagcgggtagcgagggacgacacgcagcgagcgagcctgcgcaaatgaggaatcatggcttcccccctcgaaaggtcggcatctttcgcgcaaagcagccgcggtcagcagcatcacacactgcagcagcagcagcagcagcagcaggagagaggctgggaagccaagaccaagagagagaaggcaaaaggcgcaaaggggaagaggggagcacgaccaccctcctccgtatcattgccatctactgcccccatcctactactactcctacacccgtctactccactccacaacctcttcttcttcctcctcgcgtgcgtccgggcctagctgtagcacgagctcgcctgcccatctctctctcttcaccgctttgcctttgctggcgttgcgcgttttgccacactcgctgcttcttttttatacttcgggtttgggcgggtgccactggagacattcgtggggtgccattgcggcgtcttctcctctctcaggaggtgagtgggctctgtgctcttggcttgtctctcagctacttgcttcttcttagcattacccattttaagtttttggttgttctaatccggtgatcttgggtgttccctccggcattgccgatgttcttgagactacgatcacacattcatatgcatgggtgagtgatggtcttcgcttcttgtgaaaatgcctcacctgggggaaggagggctggtactagtgctactagaggggtggcgttcctgttcccttgttcgtaggcattcgcctggagttgtgtttgcatttacaagctgcacggcagaggatgattgccaagtggcatttcgtcgagcacgtagctgatatattcgtggtgacatttactagtactagtgctactactctccgcgtagctttctactgctactaatcctagagacatgagctgtgtggcgtaaaaacacaaaagccgcctgctttcttgggaaagggaggtggttttggccgccatggggacccaacacccaagctatagctagccaatgcattttgaacctcccttctccacgaattcctattttattttggctctccactttgactgctgctcacactgcacaccgtatgaaatgatatcctctgcctctgttgcaatggtatgcaggcatttgtgacatttggtcgatggtgaagtgtggctaagctgctcgcttggcttagtactctggaattgaggttttatcagaatcttggcattcagattgcagctgttcttgggtttcttggagacatatggcgtcctcgcaggagaaggccaagacgggtgttctgagaaatgccgcagcgctgctcgacgaaatgcagctcatgggagaaacacagggtgagtgtttcagactttcagtcagattctgctgcttgttgatgcataattgcgcacaaatttgttgcaatttttggcatgatgcgagtagcgtccgttccttcttcaggtgccaagaaggtgatcaactcggagctctggcacgcttgtgccgggccgcttgtgtgcttgccgcagcgggggagcctcgtgtactacttccctcaggggcacagtgaacaggtcaatcttactgtcttttttcacaaattgcagctaatctcgttttgaaatgctgcaaccatagacaacaatttggtcagattgatgctcaataatactttgggattgctattggaatgatcaatgttgaagggatgatgcccttgcaggttgcagcgacaactagaaagattccaaattcccgcattccgaactacccaaacctgccatctcagttgctgtgtcaagttcacaacatcaccttgcatgtgagttcaagcaaattcaattccaaacatatttgtggccaaatgtgttttgcctgtgcttgattgtttgttttgcacaggccgacaaggacactgatgaagtttatgcacagatgacccttcagccagtaaactctgtaagtatgatgtttctctgttacattgtgtactgagttctgtactactttatttggttctattaaaatgtaaacaccaattgttattgaaatgcataaaatgtgattacagaaacaaaaattcagtgtgcaaggaataaaagatggattctaaattaatatttatttgtgccgtctattgtaggaaacggatgtattccctattccaactcttggtgcttataccaaaagcaagcaccccactgaatatttctgcaagaatttaaccgcaagtgatacgagtacacatggtggtttctcggtgccacgaagggctgcagagaagttgttcccacaactggtatagcctttatctacattttgtttgccgcatagtttttctgtaaaaaaatgcttcagctcatgggtttaagttttgtaccgacaggattactcaatgcaacctcctaaccaggagcttattgttcgagatttgcatgataacatgtggacattccgtcacatttatcgtggtagggtcaaacaatattcggattttatttgtcttgttcattgatacataaatatatgcttcttgggccactgtctcctaaaagtttcttcttttcttgtcccttgcaggacagccaaaacgacatcttctaacaactggatggagtctctttgttggggcaaagcgtctaaaagcaggggactctgtcttatttataaggtgaaataagttctataaatacatgcaaagtctgtttgttacttaacctgtgtgtgctatcagaaaattgaatctgagattgttaagccttttgatactaaaccctatgcaacaattcatgcattgaaataccacaagaactgcttatgttatttgctctttcgaaagaatgtccattaccagtattagattttcctacagcggctatctacttaaccttaaccaatatatacatattcaactttctagaatattaaaatctcaacaacaataacttttctatttcttgtcagttctaatgtgaatatgactgttataggacaccgcactttttactcgctcggactgacaacagcttgtatgtaatagtataatattttcttcacaaatatgtgaggatgaaatgccatttttgacagaagttcctgattgcagggatgagaagtcacaacttcttttgggtgttaggcgagccacgcgacaacaaacaatgttgtcatcttctgttctatctactgatagcatgcacattggcgttcttgctgctgcagctcatgccgcatcaagtggtagttcatttactatctactacaatcctaggtacagaaatttacttacccttttacatatgcttttttttttcctggtgagcatttggtcattcatggaatctccataggacaagtccttcgccatttgtaattcctgtagcaaggtacaacaaggcaacatatatgcaaccatcagttggaatgagatttgcgatgatgtttgagacagaggagtcaagcaagcgcaggtttgtccactttttgttctcattttacatagcttttgttttctgtttcagattttatctttatgctatttatttatgtccacaaactagaccttggtgtacaaccgtgtaatggattatgctgctttaaaagtataaataattcaactgtgaattttcatgattcacattggaaaaataatgactacatcaaatgtcgttgcatgggcatacttgcgttctatgttgagtttagcgttttgttgattaagtacagctagaaaacatattccatattgtaaacaaaattgtcttgttttacagatacacaggtacagttgtgggaataagtgactacgaccccatgagatggcccaattctaaatggcgcaacttacaggtgcctttttcatgcaaaagcttaaggaaaactcagaattctgcctatcatggtgtatttgatatttatatacttcttgctactaggtcgaatgggatgaacatgggtatggagaaagacctgagcgtgtgagcatatgggatattgaaactccagaaaacactcttgtgttcccttcgtcgaccttgaattcaaagcggcaatgtcttcctggttatggaggtatgtctctgacatatgctatacaaatatttatggtcgtgcaatatgctgaaacatgccttacccttttgcagtttcagtgcctgggatggaaattggatcagcaaatatgtcatcatttccaagggctcagggtaatccctatggcagtttgcagcacattccagctgttggatcagaattggctatcatgcttctcaaccaatctggtcaaacccttgggagtccccttagttttcaccagtcctcatattctagtattatccaaaatgtgaagcaaaattatatccctcctctaacagttagcacttcagcttgtttgacaaagcaagaaagcctgccttcagatgatgcccagcaccagttccatatggcaaatatgcagaatggtgatcttgaaggctctgaagtccagcctgtcattgattcgatttctgagtcaaagttgaatgctacatcaagagatccaagaaacacagattcatacacaagtcgaagtacttcggagcaaaacagtaagggtgagcctagaggcaagactcgtaggagtaagaagggcttgcctcacaaaaccgtttcagagaaatctgacctttcttcagccccttcttggatctgtgacaatcagcaggttggtttagaatcgaaactggttggttgtgatgaacaagtaaactgtggaaatattgaagattcatcaggtgcacttactcaaggtaattttgttggacagccgcatggccatcaggttgaacaaaagggagtgctgtcgccaccaaaggtagaatcatcaaaatcacctgatggaggaaagtctgtcaattcgtttccaaaccaagggtgtttttcgcagttcattgatggtcttgattggatgactcagccttcctactaccaagactccaatgtaattcaaccagccggtgtgtcagagaacattttcagttcttctgcagatatacctccctcaatgattgctgatactatggagacttttcaggcttcatgtctttctgattgccttcctaattccatacaagaattcatctccagcccagatctgaattcactaacctttctttcacctgacatgcaaaatttggaggtccaactccagcatgatggaagcaatttgccaagcacgtccaactcgtttgtacagatgagtttttctgaagagagtgcaagtcagagtgcaaacttaagtggacttcacatggaatctacacacagaagcataaacaccacttcatgctctcaaccaatgtctactgggggctttgatgcagggatgtactcaaagttgccacgtttaaaagaatcccaaatcttgtctttgccagagattcataccaattccatgggaacatcagcttgcagtatggatgcaaccgagtacagccttgaccgaagtgcgaagccgatgaaaccaccagtgcggacatatacaaaggtttatactacttgactgtttatatgttaccatttgtcaaatgctcttgatagtaaatataacttaacaactatctattatgtttttttttgtaatacataggttcaaaagcaaggatcagttggaagatctatcgatgttacagggtttagaaattaccatgagttgagatctgccatcgcttgcatgtttggtctccaggggaaattggagcatcctggcagttcagagtggaagcttgtatatgtcgactacgaaaatgatgttcttcttgtcggagatgatccatgggagtaagtagacatgtcttcgaattggtgtctcctgttctttctactcctggtcagcatattaattgacactcatacctatgtgcttttgcttctacagggaattcatcaactgtgtccggtgcatccggattttgtcaccttcagaagtacaacagatgagcgagaatggcatgcatgttttgaacgactgtattcaagcagcttagtagtaccattttctggatgaagctctatatcgacatgaaggccacaagagaaatgcacatccgagaagctgtagttctctgaatgcgttgcattactgaatgttaagctgatttgttgacacttgacagtagtgtttgtggtagagacttacaggaaaaaaaaaggctcatcttttgcaagaagaccaggtaggaaagcccaagctgtggaaaatagtgtgcagtgattactcatgctttgatgcatttccaacttccactgtatgttgcgagctatgtcgaatcagaaacttatttggttccttacttcactcagtatacattcagtttgatctctctccatgatgcaatacgaggggaggtagtacagtatacaaacatgagttagattgtagaaccaaaaacaatgattttcaaatttttcaatgtagtattatagaacgacatatatgatctggagaagggtgaggctacaagcaaggtcgcaaggtccgtaggagtaagagcttgtctcacaaaaccatttcagaaaaatctgacatttctactttgagcgaacaatcattgtttgcaacaccccgagtacctaagaccctcatgctacatgtgagcatcaaaggatgatagaacaatagccaaaaaaccagtgcaatcacaaaggagtagtatctactagcgacgatccaaaagaaaccgcttcctggtagaaatcctctcctgcaaacgttccaatcaatccagttgatttcgccacccgcatcttgataagtactcgtagaagacttcaccagacataagttcgtctgcattcaaaatatgtgacccaacgtaaaatttactcattattttgattgctaataagctatatgaataagcatataagtataattgaaacaatgagtccctcactttatgctatatttttccatgcctccagaaaccatacctttagaggccggccacatcaatatcaacactggccttgcaataaaactggatagctgcagcacccatgatttcaagaaaataagcaacagcatgcgcaaccacctttgagtgattttttcagatttttgtgtgacccagcaagagaaacaccacaagtgtggaagcatggaggcacagatggatgaactcggtctttctagtgggctcaaaatcataggcagtgtcaacaagatacttcccagcttggagagctataaagagaccaaaccaaaagagagcaatatacacatcaagctctgactcatctgtaatgtgtttcagcagcttccaggtaattagcacaagtgagccatggaacgcaagaagcaatagtgccagtatacctagccgcatccaacgcttgcgttctttttccctactttcatcactctcagtatggccattgttgatcccattgctgcctctctccctactcctatcgctgttcatgttgttgctcctcctgctgctgctactgctgctgcagctgctgctgccaccgctgttgctgcccctcctcctcctcctcctcctcctgctgctgctgctgctgtctctctcccttgtcctctgtctgaattgcccagcaggtccaagcagcctttccgtgccattttcagtgtcttgagctgtatcccactcccgagccaaattgttcaagccattttccatcctccattcatggcctgatccagtgttgttgctctggccagccagattttgtaattccactatatcaagagttacatcagctctctgcctgtctgtcaccacatttgtgcttgggcctgccagaaaattggagctgagctcaatggtgctccttgacatttcctggtgaggcacttggcctggtggattgaaaggcgggagaggtggagcacggaaagatggcagggatccatcccttgagactgctgctgaaggaggcggcgctgctgcacttgccgtagtggacgaggtctgtgtagaaagccgaaccgtgggcggtgatggaaccattggcggcggcagagcgcgcgagctggcggacgctggtggggagaaggtcggtgaaggcggtgatggaaccattggcggtggcagagcgcgcgagctggcggacgctggtggggagaaggtcggtgaaggagaaaatcctggcaacgacgaactggaacagctcttccataccgtcgacgagctggtcggtgagagctccagaagcggtggtggtgttggtggcgacgaggtggatggagccgagaccttcgtcgagggcggtgacaaggagggcgagcgggccgcccctcgccgccgccgtgtaggagcggacgtggcgtcgcgggtatgcggcggggccgacgaggagcgcgtaccccttccccgccgtgccgaggtagctgctgctggtgaaatcatcgtcggcgacgtgcttgtgatcggcgtggagtggaggaagacgaaggttggcgacgaggagccgtcgcgtggcctcgcaatgttgcggcggcgccgacaaggagagtgtacgccctccccgccgcgccgcggcgggtggggttggtttgctcgcgttcttcgtcggaagggacgaacagtaccccgcagatttgggaggaattggatttgattttggtaagacggtagaaataatggtgagaggtttatgaatttttgggggacacgccggtggcacgggaagtgtgtgcacgcagcaattcctttgcctcgttcccgcttcccgctggctgacagacagctctgtttattgctgtgtgtacgctgtagaagttacaccgttcttgcaacaaatcgaaaaacaaaagatgcatttatgagcagggagtagggaataaacccactaccaccggtatttgttacggaaactactagtacgactagtcctgttcttctgttctgggaggagctaaggcaaaccatggttttctctgtgttctaggagtagttcgcaatagattctctaactagttttgttttgtccattttagattgatgccaaaatatgttctacaattttttttatgatttgaatggtaattgtgatgttttgatttgaaactaaatggttggcattgcccatccctaataatagatagaaatccgtcctctacatccatatacacaaccagacatgagataatcataaacgtttgatataattagtgagcatattttaattttttggacgacccttatctctctcttcttcctcctcctcttcctcctttcaccccttcactggccaactcctctcattcctcttctccacatcgccccccttggcagcttgttgtgtgggaggtactttcacctcctcaccttggtgacgttgctggcgagggatggtagtggtggaggccacccccatcttctccacctttggcttgacgatgctcgactgccatcttcattcccaattcgggcacaaagaagaagagggaggaagtggcggtcaagaaagcgcgttgagctttggtcgaagtgggaggaggaaggaagaggcagcttcctccatgaccgccatcgccggacgacaccaacgtggcaaggctggttagtgtcgtggcagccaccatcgtgatcattccgtcgaacggtgggggaatgacgctccttgtcgatgggtgtcgttgcaccaacaccgaccgccatccctactcgagcccgtgtggcactatgaggaagggagaggggaggggaaacatctaaggaagaaaggtacatagattttaatagttagggattaaaatatctggtattatagttgaaggacgaatcagattggatgtagtagatttgaggagttaagtggactaaggccctacttggttcatgggactaatccattagtccctccattttagtcccttttaatccctaagaattcagacataggtaactaaaagtgtacactctgggactaaaatttattagtccctcttgaaggtacttataggcatagtagaaaaaaccggaacggtagatgactcgatcaccatgctggttcaccagttcgatagtccaaccgtaaaccggctggtagaaccgcggtttactaagtacatataatatatatgtaatatatatattttcagactgtcacatacattcggctggtagtatggctacaggggttggcttaacttatcttacaggggtcgactccccatcggcgcacatttcctttgatttttgctaaaaaaaaacaagcctgcggacatatatggcccaaaacacactaacatcgcattccagagcatgacaaagagctgcaccatgctcagaagcgaagcccgacaacccattgcgcttgcagacagtcttgaagaaccggcggcacaaccaccatggcgaccgtttgtgacagcactggtgcgttggcgtcggccgtaccatggggcctatcagcctatgcccacaacctacccaggccgtgtttagttgagccgatgtcgctgtcgtcgtgaaactctacgtaatcgcggacaatgagaacgaatcactcctccatggctggcgccctctcctccagggctacattcattcttggcattggcggcgcttctacgtagatcaaaccaatcatggttaactgaataactggtggtgaagatttcaatgcacgctcctcattgacggctcatgcatgaatcaaggccacagctcagagatacggtgtgtcccaagagtgtcccgcgtccgacgttgtgagcgatgtggtggtttaatcacattaggaatcgatgtatatatgtctgaaaacacaaaaattaaagctacgtgactggtgggccggggcgtatatcggagatgaagaaagaaaacacaaaatgcggacatcgcacgtggcgaacacgactacggacgaaagcgtgtacgtaacgattgagaaaatccaaatctactttaagtaggttagattagaatagataaatccgaacaaatggcgtttttcatagtttttcatattttatacttacactattacgcatgtgcatcatataatccatcactccgccctcttccactacactattttcgatgcaattgaattttattgtcttcatattgatgaatgaaaatggcgtgcatgtttgtttacaactagatgaaatctcgtgcgttgtatgaaagttttgtataatattagtgaaaataacatgtaaaatagctacatattatagtaatttttttatcgttgatcgactattgaaaaaaaaagctatatatataaaccatttgatgatgtggtctataactatttaaatcatatatgtattgatcgtttaaaaggaaaactaagatgatatgacccaataacagaaggaaaagagaaaataatataaattaatcatcaaagataaaactaaggtgatatgattttataagaaaagaaagaaaaaatgagataatttgggcataaaaccattccataactagaaacaattaagttgatgtgacgtaatgaaagaaagaagtacgtagtagtactgaagatgaactttctaaatttctataggattagagaggcaaacaggaattaaatcagcatatctccatgagtgtaagtcgttatctcggtatatagatcacttttatctcctcgtcgtcaagtcgtgtgcgcatgcatgcatgatcctaatgatcctttctcatggataatgtttcacgaggatttgttcgtttaatccctcccaaaaaaataagagagatttagaaggattaatttcacatctacgtggaattattttttcttaatcccctctataccttttttttttgagattatacgaacaaagacccagatttgagggatgatcgatttttgagatcgatatatagccgtcactcagcaacggtcgtgccccacgggcggcagttgatgctcttcgttgctgaagtcggagatcttggggatggacaagccatactctctgagatggccgacgacgaggtatagccagaataggcactcaaacacaccacaggtgacgaagaaccggcgccacgacacggacatgtggtggtcgagggtcccgatgagcaacaaaaccacccaaaatacgaggaagacagcggtgccgatgactgtcagcttgaattccctgagcttgtgtttgtacctggcgacttggcgacgcacctccgcgtccacgatctcacgcgccgtctcatcctccgccgtatgctcgctccccgggtcctccgaaaccgctctgtttgggccgctgccgccgtttccaaggcagagtaccggaataatctgcgtcttctcggccgccatctccaaactctctgtacttccggacccgccgctcattacgccgacgacgacgagaaacgcgccggagactcgattcgatacagctcgacgacgaacgcgcggcgtagggcgcgaatcgacgaggaggaagaaaaggaccagcgtggtctgggcaaattaagaccgagtcggtgtcggttttggagttctggacgacgtatggttgggctcggctcacattgcaaaggcccattgatctgtgagactgtgacgatcagcagcccttttttttgggaaaagctagataccggtatcccgtccctagcatccacgacggtatcttctttttccttgttcccagagcacgagcacacacatgcagctgcggagcagcgctagcatcgggcatgcgacaacggaggaagaagggagctcactggagaagctccccgctgcctcgcgagcacatcaacagagaagatatgcagtgccgcgggcgacgcgttccggcgtgacggcggagcacgtggccgctggtgacgagttccggcatggggcgttgacgatggaggtgttaacagtgaaatttggtaagccctgagtagtcatcggcttagagtcagcatcggctttgaagtcctgagattagccgatgagagttgtcaagtcgtcagttgtcggattcttactatattcggttaagaaaattgatctactaaaggaagcttatccagaagagaccgagttcaaagagaatgcggcatggcaagttatctattaattaggaatagtttgttagttttcttttatcttgaggaaaatgtgtttagtgtcctataaagactttatcttttccttttatctttagaaaagtttctttcttgtccgacaatgacttgtatcaacccatgggtataaatatgtacaccaggggtctatgtaatctatcgctacaatcaatacaattcggcgcatcgccaccttttaccttttctactttattttatcgtccggcgggacttggcacctgacgcggggctgcatcggtgttcgatctccggctaaggggtaagtccaatgttccgtcggcccaggcaattatatcatttacgtcggcgtcgttcaaggctacatcagtacattcaacctcttgaattgctctggtttggattatatttgcctacctatttatcatatgtctctgttaatctagtctttgcatatcaatttagctctatcggctgcttctcgttttagggtttctgccggtatcagctaaatcgcgttgctagattagattagcttagacatctaccaccctgaaaactcagtcaacggcttgattgtctagatattgtgttttttttcatacttagtgttgcatcagttaagtttgatctactaagtcgtgtttagaactataatctctagtctgcttcttgattgccaataagggtttcatcggggtttcagctgatgagttatctagacgttacattggcttgtaaggattgcatatacatacatattggatttagccgatcgtaacaaaggtttcactgtttaatctaatcttgtggatttaatgacatcggacctccagccgatgtatgctttaaccttcggatcagtgcttattctatcatatcattgttagccgattggtttctaccggattatattactatattatattatcatcaaccgattgcctttatatcattatctacattggacatatagccgattgcttaaaccttatcgctattggctggtatcggcatcggctggaatcactccatcggtttgtcagccgatcggctgttttatctgctgtttacatatcttgtcagttgcaagatcaaactgactggcacgcccgcatctcatcaatctttggacctgcacagaagttaagcagatttcccaggccggtgtgttcgattttttcgtcaacaggaggacgcagccaccagtgtggggcgtggcagcggaggcatggccgctggcgacgagctccggtgtggggcgttgacgacggaagacgcgaccgccggcaacttgctccgacgtgggacgtgacggcggaggacgcggccgtcggcgatgcgatgagcccggtgtggggcgtggatgacggaggagcggtcgcaggtgacaagctccattgtggcatggacagtggaggatgtggtcgccgacgacgagctccaacgtgggatgtggacgatgggaccaccagcgatgacactttggtgcccggctcccgatatctcgtaagtatcacctaatacatggtaggaatcgtctgatatctgacaggtatatcacctgatacgtggtaggaatcgctgttaacgaccatatttggaaatgccacgtcatggattcaaagctagagtc

SEQ ID NO: 57045 - DNA, 17893 bp, Oryza sativa
ctataggcggtatcagctgccacatatcggctaagggtcggatccgatggagttaagccgatgcaaccagtctcaggaaagatggtcccacgtccgtcattggaattggtcgaagcacttcatagccattgccacgcaaggattggagtcctaaaaatacaattgtagctattaattaggacatttttcagtttccttagagatatgtttggtaagagtccacctaaaagacttattcgtattttaggttgtgttagagataagaggtgtctagtaaggacacattatgtacttgggtataaatatgacccgacaccatgtaatcaagggatgacagttcaataatacttcagcgcatcgccaccctttttattttcgttgtttcgataagtttttactttcgagttgggctgcatcgggttcgatctccgacgaagaggtaaagctttttatggcggcttgcgttctcgagattagtgcttacatcttcatgacactctaatcctgtctatatgtaaaccaccgagttatcaaatataccgcataatctagattgatctcgtcatctaaacttcatcagctagcctctattatcgaaaacagccagcaggtttaggtttcgatatcaagctagactatgcagtgtatctaccatcttgaatgagttttcatcgatttgattagatattatgtgtcttttcacgcttaatgctgcatcggttaggttcgatctgttaagtcgtgtcttgaaatattttatctagctctttctttgattgttaatagagatagcatcggagtttcagccgatcttacctgatttagtcatcttgtttccttatttggttctagatcatctaaatctgccccttatatcaagatctcatacgtttaaagtatattaagcttcctatcaatctgctagttcactctgcttgttagattggtttcagttttgtatatttcatctgtgctgatatcttggtataaggtggtatcggaatactagccgatacaagttaggtttgcccaaacctatcggctatgctgtgaacgtacatatccttactttggggctcgtctagatattgagtgatttatactgtctcaatgcagcgaccaatcttatcccaatcacttagtctaaacgtgttccattggacagattatgtatcgttaacatctacagccgatcgagtagacccaacaatctccaagttttatctgcctttgccaatctgacgcaagttacatcggcatggcttcggacgatatgtcatcggcaatccagccgatcggcaatcgttgatggatttaactttgtctttttttatatcttattggttgcaggatcaaaccagctggcatgctcagaacccgaagaaaatctctttgaacctgcactagagttaagtagatctctcgggccagtacgtgtttttcgtgtcaacaatcgcctgataccttataggtatcatctgatacctcgcaagtatcgtctgataccggctaggtattaggacatgatacctcatagttatcaggacctgatacctaaacagtatcatcccgtcccaacaggattccgttgtatagcagcccttctttttttcatgaaggttgttgtcacaccccgaaccggcaccgccgtacaacttatgacagagacaagagataacagaaacttgacataatagtatgatagaattggacctacatatatagaagtatagaacgatctggattttggagtgaccccctcttgtgagggataatcgatctatagccgtcagtcagcaaaggtcgtggcccacggggcggcagctgatgctcttggttgctgaagtcggacatcttggggacggacaagccataatctctgagatggcagatgaccatgaatagccagggtccggacgcaaccatgccagagctgacgtaggtctggcgccacgactcggacatgtggtggtcgagggtcccgacgagcaatagggccacccaaaatgcgaggacgagaacgatgacgatggctgacagcttgaattcccagagcgtctgcttgtacctggcgacttggcgacgctcctccgccgccgccgtatcctcattccccgtgtcctccgaaaccgctctgtttgggccgccgccgccgcttccaaggcagagtgccatatggtcgcccggcgtcttctcggccgccatctcaactcgctgtacttccggacccgccgcttctcaggccttccaaaatcgacgacaacgagaatgccgcgccggggactcgattcgatacacctcgacgacgaatgcgcggcgtagggcgcgaatcgacgaggacgaagaaaaggaccagcgtgtagatggatcggtctgggaccgagtcggttttggagttctggacgacgtatggttgggctcggcccacattgcagaggcccattgatacgtgagactgtgacgatcagcagcgcttttttttttcatgaaggttggttacttgtgaatttgtgtttgacagtataaatccgacacgggtattcttcagttttctgatggttttgaaatttttgaattgtcggcctttctattagagatgggattgtctagtagtgtttgaaaataccaccatgatataatgaggtgatacccacgtttgctttgaaatacatgttaaatctctactattataaaaattgaagatgtttttaccgtattttggtatgtcatccatatttgagtcgggttttaagttcgtttgttttgaaatacagatccatgtctgagttagattttaagcttgttcctgtcggaagtataaacggagtcatataagaaatcttttaaaaaaaactcgtatgctaacttgagatgaaatacgtactcctaataaatatcctaactaaaccataaaacaataataaaattaaaatagcatttatctgttacaatgcacgggtattttttagtattataatataaaagataataatattatattctaaatgatgtcatgtttgaatgaaatttaagatactcttgagtagttattggtacaattcaattttttttgagcgattcgatccgccatgctcgtagtttttgacgaatctaaattgtttggttagactccagctataggaaaggtggattcgagagatggagttctgctaaacagggccttacatgatctttattttctaataattgctagtagatgttaattatatgtaaggtaggagtatatatttattgccatgaacaccaatataaccattggggacgctatatagctaggaagtgactatgattataccggtcatcgataactgagtggtagtaattatggatatccataaaatgtgctgggaaacaatactcgttgatatatttttcactctgctaccaataaccatggttcattttaaaacatagattatgaaaacacgggaataaagaaaacacataaatgaagttatagccccataggtctataggaatatttaatttattatgtttttatttcagtcctattcttttgttgtaacttgtaaagtctactagaatttatttttaaataaataatgaaattccttgatgcaaagaatccgtaagcgaagccacctgatccaaagcggacgctgctatatagcaaaaaccggctcattctctcgagtccgagcagcaaaccaaaaaccaaggctctctcccactcgaccgaaccccctctctctgcttcctctgctcctcggagagcccagccaaggacgccaagatagggaccgaaacccccgccgccgatggcgacgccgcccgcaagcggcccagcgccggcgacgcgcccgccccagccccccttgcggacaagcgccaccgccccaaccccccgtcctccggctcccgcgaccgcgaccgccaccaccgccacggccacagccacagccacggccacgcccggccgtccaccgcgggcggcggggagaagaagctgcgggcctcgcacatcctgatcaagcacgagggctcccgccgcaaggcctcgtggcgcgaccccgagggcgtcgccatctccgccaccacccgcgacgacgccgccgacctcgcgcgggccctccgcgagaagatcgtcgccggggagcgcaagttcgaggacgtcgccaccgaggagtccgactgcaactccgccaagcgtgggggtgacctaggtcagtacgccacacgccgctacccatccacccccatgtcaatctgttggtgtgtttctatacagaactatgagatttgctttctgatgagcgtctgattagatgtgcggatggaacttgttatttcgaatcgatctgaattttagattagtactaatgttatacaggcacagaaatttgatttatcaagtacacttcgtgagatctatgtgaaggaggtggtgccgtgttagtttgtattaggacggtcaattttgatgaagctatccccgttttaattatgtgcagtaattgaattttacatgtgacaattgtgctataattcgtgaagacagtcatgttagctcttaatatgagacaattactatcagtgtaccatcgcttcagcgtgataaagtatgaacatcactgccagattctcagttttgattggtgacctagtccacttaataagagtcttaagaatcatgcgctgatgcagttttgtttgcgccacccttatctagtatccgttgtgttttccatatcgaactgtcctttttgatggaattggggctctagtaactgctattatggcggggatcattaatttcttttcttgttatgaacatgtcatgtccttatggtccgcctttgggtatgggccgagagggccaaggcccaacaggaacggtatacgtaacttagttggttagagagtctagggttagaagttcccctctatctatatataaagggttaggaagttcccctctatataaaggggatggttccccaggttagggtaggaattagattgaattatctcttcgtgcccaccgaccctgtctcctcggcgctgtatatcttattctttaggaaaaaggaaaaatgttactccgcaggcggaaaccatggtcatggtgaccaacttggaatgtgtgacagcagtcaattccttcatttttcttctttctatgaataccttgtaaaataatcacctgtattttactctgccatttgttgataagatggacagttttgcggaacatggcataatttgctatatgtagttatgtacatgaggcaaacacattcggggcatgagacacagcacaatacactattacagatatagcggtgtgctattgctttttttttttctcaaaaggattttctcagcatgtgatggctggctatattgatcttttgtggatatttgcattcagaccatttccatccctgggactattaagcactattatgagcatgcacatgagggactaagatcacaaaaacaacgcacgatacactagtaatgaattttcttgcaggtctattgttccctgtgcgggaaattattacctgcccaaatcggaataaccacttgtgacatcacaattaagttggaatatcttgggctgggtggtctcccctattatgtcgctgccataatgaaatgatgcttttggagacggttattctggcagatgcgttagcatttggcacagtatctgacagggaacatatgagttgtaattgaggtctcatggtttgctagtgtgattactatgaagtagtgagaaggagacggcaataggtgtaagctgacagaaaattttgatattgtccctttttttcagatgtctcctatttatctgttctttctattccacatatatgattaatatgtttgcaaattatttggtactgtttatcttggtgttagtaattttttggtgcgaaaaaggagaagaaattgcaggggagcaaagtgccacatgctattgtggcaactaacttggttcttctcacaaggaattcatgtccatgattctatttctactgatgattcttgatttcacacttctcttactagccgagacctcataattaagagtgatcttactttcgcagtttatggctgcaggtccatttgaaagaggcaagatgcagaaggcttttgagaaggcagttcttgctctgaaagttggggagataagtgatgtggttgatacagacagtggggtgcatatcatactgaggactgcctgattacggcggcagtacgggccttctcaatctctcattctctatacactccgtcgctgtctgcaactctgcatatcatattgaggctgtttgggggcagaagtatgggccttgtcaatctgtatacactggggaaattggatgttggttattgcttcgttacaaacctgtgcatgtactctcgatctgcgaaaagtttatgttttactcttacattttgctggagacatttgctctggaatgatgctcaagacaacctatgaatattgattgttacaacatgtttggaattagctgaactgagcaggaagttatcgatgcattcctgcttacattcttgtttttgggtcgaaatgcgagctcagtcagatgatgaattttaaaaaatttctacacaaatccagctgtttggtagagtttgccactttcgaatgaaattcgaacgaaatcgtgaatctgacaggcgtacgagtgctccagcgtacaggaggcagctgccgattggatcccgcaaacctcgcgccttttccgcgattcagccacgtacacgcaccgtccccttcctgggctcctcttcgtcttgctgctgcagctttccttcttctccaccccctcggatctccaggagtcgatcgattctcttctccttctcccccaactctccaccttccacacccttcggcgacacgccgacgcagacagccaccgcacgcggcggcgacgacagcaacaccggccaccatgggcgcgtccacctccaccagcaacccgtcactggaggcgcaggagcaggagaccctcgcgtcggcctccctcgccctcccgcttctccgcgccgccttctcccgctcgaacggttcgctggcggaggcgctgtccccgccgcccgccgccttccgatccgactcgccgccggtgcccccgcgcttccacgacctcgtcgcccgcctcggccccgccatcgcctctctcttcttctccgacgtcggccccgcgggggacgcggccggctggctcgggttcctcaggggattcaaccgctgctgcgcgcgcgttccggcgtcgcagtcgctggcgctgctcctccgcgtgtacgccgcggcctgcgccgacgcgggtgctccctgcggccttcagttccacccggacgaggacggcgccggtggcgaggggaaggtcgtgggggagctggcgccgggggagatcgccgtgttgctctggatgtgctgggtcatggcgtggagcggttcggctcccggggtttcgggtggtcaggagggaggcggcaagggggaacccgtgttgctcccggacgtgacgcacctggtgctgtcggcgctcgtgtcggcgggcgccgtcgcggatgacgctggtgtttggggatgggaggtttcccgtggtgggaagggggtgaaggtccaggagttcacgtcttgggtgctgtccacggctgctgggcttggcaactgcctctcgcggtatgtgcaggaaaggttccggtcgtgcgcagctgatccagtagaggtaagcaagctgcattgcagagtcagtaatttactgtgaaaggttagctgcattgcctttgttttgcatagaacatggattttgagaaccagacatattgcatacttcagataagtgcaaaatggtgggggatcttcaattgatgtgattttgccatgttttcattagttatgctgtactccctctatttactttttcaatttaacgtcctcattaaaaaatgatggaagggatattaatcttaggtgttctttagtagattcatatttgatgacacattgtcagttgtgggagaactaaattatgtagtcagattctgtttattcccagtatgcaaattataagaaaaattctgggatgcttagattcaaaatgagtaaatgactggtaagaagacaaggatgcttagagtcaaaatgaataaatgactgctaagaaaacatgccatttcttctttatatctgatagttcagggtgactaaagaatcctactgaggatgtccaggcataatggtgtttggttagtaaattgctctggtgtttctgatgtggctgggtctttactgtaacaaaaagataaataagtcacaaaaacttttggtttgcacttggttttagtagtttggagctcctttctgtgatgatcattgttttgctacaatgatgaagctttatttattttacccattttattggaggaaccaattagatggcatattaatgatcattaagcttcaaccaaatgtttgatcttagacgttgattcttacacgcaggaacgttctgtttcaactggtaacacgtcatcttgtaaccctgacgtatatttgttaacacgtgggagggcatgggcaatctctctcagcctcagaaacacattgagtgaaaagtttttatcagcatctgtcattggaatggatacagaagaccttctttataggttactccttgttctaaacatctggtgacattttactcgttcttatgtttttttaatgtttctattgaaggccgtaaacttctaaactgtaatcaataccagatcaattcctattatggtttttcattacattttggtaacttttagcctttactgaatacatctctgcaggtcgtcagttcatggaaaagggctgagccggttttggtcttgtgttgagggatataaaggaccagtgctaattttactctcagctttctctcgtagtggtggtgacaatgttgatactgatcaaagatggggcattggtatattaaccgaggagggtttacagaacaaagacaccttctatggtagctctgcttccctgtgctccacatatccaatattccgcatgctcccaccatctggtatgacttgtgctggtcatttcctttttaccacagctgatagtagcttacggccttactgtgcctctgacctagcaggtaaggagaagaatttcatatattgccacctacatcctcagataagggtgtacgaggcaaagccaaagcctgttggtttaggatttggtggaacgattggaaatgagagaatctttttagatgaggacttctctaaacttacagttcgccatcatgctgttgataagacttaccaacatggctccctcattcccaaccaggtgaatttttgcatgtactagtcattacaaattataacctgattgtgctgtgaagttttttaggtaggaaatctgaatctgttttgttcctgaaatacagtttgtcaattagttggtagcagaagcagaatgggttttcaaaatgtcgttgtagtgccaagggaagtaataagattgaggcaatggatgatttttcagttgagtagtactgacactaagctaaaaagaattcacaaattagaaactgcatcctgtttataatttacataaattacgaacaacactggtagccatgtaaactgccttttaggtttcattttaatagggcacaagaacactttgccactttccttcccttgtaaggtctggaatgaattgtagtagcagtatgtgttgtgaaacaaagaattcatgaactgatatcatctgacctcgcttcagacaaatcctggccttcgattaaatgctagcaaaacatattactctacactctgtttcttttcatgtagggttatttacctgttgaggcttcagtacttgatgttgaagtatggggccttggtggagaagcaacgagacggcaacaggatatgtacaagaagagggaggatattttctcagagcagcgaagaaaagtactaatcaaagcacctaaatcttttaactactaactatgctagtactgttaaacgtgtgacagaaattttaatgactgtcccctatttttgttttcaggttgatctcaaaacatttggcaattgggaggactctccagagaaaatgatgatggacatgatttctgatccaaatgcagttcgacgggaggaccgttgaatacaattttggactatatgtttattatagctcattatctaaaaaatgtttattatagctgccttagtgccagtacatatctggacatgggaaatggacgatcttgaggtttcatctttcttgtaccttggagatatatagaggagtaggtgcacatatttgctccatttgatgtttgggccatttgactgggcaacacgtcatgtaagtattgaattgaaaagagtcttgtatacagaatatcggtctacaacggcatagagcttcctttctcatgctccccttgttttatgggaatcgatagcaaacaaatttgtatctgtattgtaaattgtagattattcccgtgtccagactatcacacagacatggtaatttccgattatctcacatcggtttgcaaacggcctggtttctcgttaatgtctgacggttcccttggccgattcatcccggctcctgcagtatcataggctcacgttatcagtatctgttaaaccaaactacatttttcgagttctgtacatatgctgaaaggtgctccctccgtggcttcatccaatttttttttatttctagctacaaaactggacaaacattgagttcatagttagaattgaatttttggaccaagaatgtagctggtaataatataaaaaagctgagtttgccggcttataacttctaatttattttctaaattttgtaggtgcttgttttcaaaaactaggtaaaaatttaaatcgtttatgactcaaacagtgcataggtttggcccgtgtctgttccaagagagaacaaggatacctttgcagccatgattgggtagaaagaacacacacacagttacacatagtacgatggacgtgacgagacagtacgagataaacacacacagagcgggagctagcggtagaccatatgcctgctactagtagcaaaagtacgtgcaggctgctgctgctgcccttccccgggttgtgctgttcatttcacaaactctggtgcaaccactggcctgatcgatgatcgatcgatcggatagtacaaaaaatgtactaggcatgcatgttcagtttcaccgaccaattgcccatcaactaccgcggcggcaacaaattctctgcccgaccatgatttgcccggagactcaccaccccacgccatgttggtggctgctactccctcctgtggtcctgcctgtcggctccttaatctcgagagcacacattccattttccaccttgggcagacatgtcccttcaacttcaacttgtccgtgctcgcttccactgtagtgcattcattttgcacaccaaaagttcctagtgagcaaccaattcagatcctatatggtggagtattacaatttacacatgtagcatttctcaccgacatgtgagcccgaggatctatgcacccacgtgttagtgagcagtactacagcagaggaccctcacttagaagaaccacattttttctagtgtacctagatatgtttttcaaatattatctttatcctaaaataattattgtttaaaaataattatcattttatactaatttggtataaagattaaggttttaaaaatataaccataggatatactatattgaataatgtactccatcactatttactcctactaaacaacatattaatctttatattttgcaatagtgggagtatttttatcatgatcatggatcgtacagtttggatccaaaaactttttttttaagtacgtgtctctcgcctcgccttctctcttatatcctcggtaaaaaaatattaaattctatctataaatctggataatcatttatctaaatttattgctagaatctttttttaacgaaaagagtatccaactagacattaatatgagatgtggagatccctatctcctattgacaggtttattgtatctgcccctcgtttctccaccactccgacgttgccctaccctggctagctctgatcaccatgccgccattccattcatgctactcgtactcccagctgctgccgatggcaaccaagggtggcgccttctccgacctccatgctactgtagctagcaattggcaatgtagcatgctgcaagcttctgctggctgctgctgcgtgtgtgagataagtactagcttctgctgcctgtgtgagataagtactagctagcagtagtgatctctatagagagagcagctgaatctttttcagattacactgaaaggtagacgtacgagctgtggtatagagagcagctgaatctttttcagattacactgaaaggtagacgtacgagctgtgaatagacgtacaatgtacagtactctcctactactactactacgatggctaccaccagcttatcctactacttctacactgtaaaagcagaaaagaaatgatacgacacgaagtaaataaagatggatctatgggtcgatggacaggcggcggcagcagcgcaacgcagtggactgaaaaccggctgctagtagcccccttccaacgctacagtagcttttcttcagtgatagctagcctcgggaacgtatgcttgcatgaatacgatcgccatacgccttggacaagagcatgcatgattggctcactgaatataaacacaaactccgatcgatcctgtacaaactcgcgacactgttttgtttacggttgattcgataggtgcttttctctgcctgtcttctggtcgagttattccactccccttttgcaatcctcacaaagtttgatttgttttccccagctgatctcttccttttcttttttaatatactacctccatcctgaaataaattaatttttcacccatacatatcaatatacgaaggaaaaaactgaaatatccttcactttatcaaatatttgctactaagtttttaggaacaaataaattgaagaaagaagtaattttggtatgaagaaaatagttactactcagtaatgtacaccaaatacggttggaatttcatatagacaagccaatgcagcaagtagccatgaatgtgtgtttggatacatgcaatatgacggtattgtattttgttttcgttgcatatttcatttatttcttcgagtaaattggaaccatgccattataattttcccttcttcattaggagtatagctgatagcaagagtagcaagcagaagattcttgtagccatgtgtttatgcagccgaacggctacgctgtacagcacagcttaaaacgctgtaacaaaggtctaccgaacaggtcccatgattacatgagtatattagtttctttgattaaattaagtggagttattttgagacggagttagcataacatttctttgaacacacccgaaacttgttaccctctactccctgtgtatcagtttggatagttcctatgagtataaccacgggatccccgtgaaacttcagttaaccgtagcttcagccctggtactgatagcaggagcagctagccggagtagctagagctttcatactgcctttcttcagtcaccgtttgcctgtcttccagtttccatgtggtgccacagagatgttgtccactcctctccctatcatgcaaaacaagaagcacttgatggctgaactgaagttatacacaagctctcttgcagttgcagctcacaacacattcaattcgcacacctctctcaatctctctctctctctctctcatgtagagagagagagaaggctgcaggagggcatgcagaacagagcaggcccttaataggaagaacctaagttccttagggacagataggtacaggggaggaaagggggaagagagagacaagtttctatagggcaatcatgctcctctttctgatcactgcaagaagagaagaggagaggagatcaccgagaagatatcacaaggtgtccatccgggcacagccatggatgcatgtgttgttctgtgtccttctgttggaaagcaagaaccagcgtgccctttgtctctctagctgcttgctgcttgaattgccatggacacaaaattgcaccattgatatggagtgaaaagggctatgagatgagatgggatcagggagtaggttcttctcttgactgactcggcgtttcccattctgtagagattcgtcatactcctccatggtgaaccaaccggttgatcgatctctcatctctcctcatgtgatctgctgcactgcacaacaggggccggggttcagttcaagtcaagagttatggcgaggtagctggctggaattgctgctagctagtatactagggttcatgcatgcattcttgtgaactgtggcggtcactatgtgaactgtagcggtcactgtgccggggcggcgcgtgccgtggacatgcttgtatgaggctgtgttgagatacagacattggatccaaacttcggttcttttccatcacatcaacctttcatacatacataacttttcagtcacatcatttctaattttaaccaaaatctaaactttgcgctgaactaaacacagcctgagtataggcacgaataaattgtaggaggttccaataatcaaataaaaccgtgaatgcaaattaaaagaatggatacattttcccctttatgctcccgtcaattgatcacttgccacacgttcacagagtgagtataatatgtaaactgttaccccactcaattgaattgatattgaattagaagagagagaagagatcacaaagccggatgcagcacaaggtacaacagacgttacaagataaagagatatgccgtactaaaggttgttgtggaatgagcggaaccctagggttttctattcctcgctctcgccggtgttagtggttctcaaatccatcctgcaggaaggccggctctggtcatcggcgggtaccgctttgtttgggggcctactaggagcttagtggggttccctccaccacaatctccctctatatgggagcagcttctctcttgtagtttaatctcagtagtcttttagtttttcacttatttttcatgtcccccggcgatgacctttttggttgttgcgttgtgtacttgaaactctgcttttttctaatatattgatgtgcaatctatttgtaataggatgtgtcacatccacctaaaatcccttatattatgggacggagggagtatttagcatggttgcattcccaacacacactttcataagagagtttttttagttaaaatatttgtaatattcaatatggaagcttgagttcacaattgaaaagtttcatgtgatctaaggcattgtttagttcccttcaaacttctaaaaattacgtcacatcaaatatttggacacatgcatagagtattaaatgtggacgaaaaaaaatcaattacacagtttgcatgtaaattgcgagatgaatcttttgagcataattacgccatgatttgacaatgtgatgctacagtaaacattgctaatgacaaattaattaggcttaataaattcgtcttgcagtttataggcggagtatgtaatttgttttgttattagtctatgtttaatacttcaaaatatgtgtccgtatacttaaaaaaaaatttggcacacgaactaacacagcctaacttgaaagctttggttgaaacttgaaagtgctaaagtgtgtgctggcaattcgtctgcacgtactaaattgcaattctcttgttatagctaggagtatggttataccagcaaacataatttagccttttgatgaggagcacctatatatagtaccacattccgagtacctttaggataatctatattgaaaatatcctaatactagtattatcagtactagtaaaaaatcttaattgttgatttatgagttttacaaataaaagataaaatattttacagcaattaagtggtaatagtataaatagatactacaatccataatacgatcaattaaaattaattatactactaatcataaagatcattgtaaaacatctccagttcggctgtatttaaatccaaagtttggatcaaacttcagtctttttccatcacatcaatctgtcatacacacaacttacatcatctctaattttaactaaaatccaaactttgcgctgaactaaacacagccttcatatacatcgaccacactgaagttcatcaaaaccgtacgttcgtcaaatttaagaaacataaaacagaggatatatgcaccactgcatgtaaggcaattgcacagaaaaccttgtgctagctggatcgtatgctacagtagactgcgtaggatgcattggtactgaaaaaaagttttgttcagaatgcatgcaaccgcgcgcctaccagcagtctattgtgtccatgaaccaatcatgacagaatatcctcgcgttcccgagggagaaaaatcgaactgaatgaagctagagtttacacgaaattcgaataaaataatccaaatgaactaggagtatatgtgcattcatatgtgtatttggtttccttctaatatactccatccgttttataatagtcataataaaaaaaaattagatgtatatgacacatccatccaaaatctcttatattatgagatagagggagtaacaccacgtaaatccatcttatgtcgttacaaacacccttttattcttataagtagttaaaataaaacccgtattttaaaagttttagagggtgtctcgtaaagacctgtttttgcgtgtggttgtgatgtcgcgcgcgcctaaaaattgtttcaactgtttacagatatttggggatagacggttgctacatccatatatgaaaaatacattttagctgtttgcaaagactttctgtagtaatgtgagagttcaaaaaagaatatgggtatttggtacatggagtatagaagtcagctaaacctctatctttctttcccctgcgtaccaggctaccagtagcttacatttcttctttgtaatttctctcatcaaaatgcaaggttgaaaaggctatatacctactagctaatagtatctctcaagatcaaaacattgtcgaatcacggatcaaaataacgtcagatttcaccattcaaacgcagtactgaggctatgtttagatgctaccctaaaatttttcatcatattatatcaaacgtttgaacacctgtatgaagtattaaatacatgctaaaaaataactaattgcacatattgcgactaatttgcgagacgaatcttttaagcttaatgacggattaattaggcttaataaattcatctcacggtttactgatggattccgtaattttttttgttattagactatgtttaatactttaaatgtgtattcgtatatccgattttcgatgtgacacggtaacaaattttacccttggatctaaacacagctataaagcaccggacgaactggattattttccctgtcaatctgatcgacacacacctctcataacgtaacattattcacagagaactgaaaacacaggcaagtttgaagaagcaacatggtaccaactctcacatcacaacacaaaccatgccaccaccatggttgcctccaaatacagctcaatgaaagcatcaacatgcatgctctctctctctctctctctgtgtatgatgagagagaaggcttgcagcttagctaaggatc

SEQ ID NO: 57046 - DNA, 9180 bp, Oryza sativa
ataaaccctcatgtccctcctccacccagtccaaggccacaagccctttcttcctcttcatcttgatcttgatcctcttcttgatcttctacttcttcttcttggtttcacttggcatccgtttccatggatcacatgcagcagcagcagcggcagcaggtgggtggagggggaggagaggaggtgcggggaggggtggtgtgccggtgtgccggccgagcgggacgaggtggacgccgacgacggagcagatcaagatcctgcgggagctgtactacagctgcggcatcaggtcgcccaactcggagcagatccagcggatcgccgccatgctgcgccagtacggccgcatcgagggcaagaacgtcttctactggttccagaaccacaaggcccgcgagcgccagaagaagcgcctcaccacgctcgacgtcaccaccaccaccgccgccgccgccgacgccgacgccagccacctcgccgtcctctccctctcgcctacagcagctggtacgttgctgcgtcatggctaattccgatcgctgcttccctgctaagctgtaatgcgcgagccggcgccgagccgccgatcgatgcttctgcgtgtgcaggcgcgacggctccctctttcccgggcttatacgtcggcaatggcggcgccgtgcagacggatcaggccaacgtcgtcaactgggactgcaccgccatggcagccgagaaaaccttcctgcaggtatgatcacacgtactactacctcctccaggtgtgtgtgaattcaccatgcaagagcaagctaatgtgcaatgctgcaggactacatgggcgtgagcgacggcggcggcgccgccgcggcggccccgacgccgtgggcgatgacgacgacgactcgcgagcccgagacgcttccactcttcccagtcggcggcggcggcggcgacggcgcgcatcgtcacgccggccacggcggtttcccgtccaacttccagcgctggggttctgctgctgctaccaccaacaccattacggtccagcagcatttgcagcagcacaacttttacagcagcagcagcagccagctgcacagccaggatgggccggcagcaggcacatccctggagctcactctcagctcctactactgctcatgctcaccttaccctgcagggtccatgtgatagagctgttttgccttcatgccatgatgccaactgcttgatgagaagaacagtgtgagtgtttctgattgagagagcaatggtgtccatgtcctagctactagagagcttagctagaaggaagcatatatagaagcatgtctgaaagatactatatttatatagctagggagtatgcagcattataacatgcatgctgcctgtagaatgcagtggtcctcaactggtagtgcactgcatgctaagttgctactactaactacactagtggctggctggttgtgatgtgtttgggcacagttgtgtcaaacttgtctctccctttgatggcttccagctgaaggaaaaaagttatctatatctctctgtctgtctgctgtttactactgcctggttgctcatgctcatcacctgttgagatttttctcattccttttttcagcaggagtataattttcgctttttgtactgccagtttcttgtttcagaattccatgtatagtagcaagcctgggaccactttggttgaacttgaattgttggctagtgttaggaaatggtcagcctttccagtgtgatcatcacatttacttctgcagtgttggaaatgctctcgcctgctcacgtacacacattctcgctttatgcctttttcatatctgatgatcagacaaagcatatcgtcgcaatagctgttagcacagtgaagaaatgcaagtttttcttcgatagagatattaagagaaaacttatatatatattttttgttcgatagagatattgtactatatactatgaccctatgagctgcgattataaaaaatgaaaatgatcctgaacatttcagagctttctgaaacaaacaaacaaaaagtatagtaggagttcactcatagattaattacttacaaagcctaagaagcattcacaacctaattacttgaactgagagcatcatttttaagatcaaacatagctgaggaattggttccataatattaccccctcaaaagatagtacaagtgaaagatgtattaccacgcctaagtcctaactactgaaaacttacatgactgaaagtagctacaatataagaacatatgaaacgcttgcacgatctgctcttggttctaaaaaaaaaagatattacagctcttttccagctgagattatcgaagaatttcagaacaatggtttcatgctacatgcttccctcatgtcaatagaactgaaggttggccacctctttgtctctgatgtgaccatgctgctccccaacaccagctcaaataaacaagatgggatcacattttcctatgaagaccatggaaaaagcggtgttttcttcttcttgagtgctttcgatataccctggacataacgtgcggcgagaaataaacctagattgacagaacatagagatgaagtcaaacagatgtgtgcagtatcctcaactgtgcacactttgtaagtaatataataagtattactagtaagtaatatcctcaaacagatgtgtgccatgtaggttaaactgtgtcatatcatcaaataagacaggcgctcaaattttgtactagaatgcaaaaagaaaagagaaacagaaaataaaggatataactcccaacaagcatatgtgattaaaaacatttaacagaaaattgacgaacattatggttaattaaagcggatatactctggtattcttcaataaaagaactaccttggagttattacaaatgccattagacgaaagcacggaattgtcatctatcaacttctcattttgatgtgtcagacagtagttatcccaaatatgcttcctggaacaaagagaactaatattacagagggcatacataacaataaaaatgcataaatcagatttcagatgttcacaatatccttaacggtgggagatatcgacaaacaacatgtccgtgcatttcagttactatgtgtagggaacagatggaaacatggagtttgcggaacggattcagatgaattatgaaacaaagagatcgatgaacatctagctcacatataacgtattctgtgggctgtggctcaaacctgaagcaaacaaagagtcagcctattcaggataacgtataactcttatatcagctattctgtgggctgtggctcaaacctgaagctaagtttctggctaaggctgtgttagcatcagggagacagaatctcaaactagttctatggctacaatttcaacacaacatgttatttcgttgcttcctttaaaataaaacgcattattttgttgtcactagtcatctggtaatgcaaatgctctggttgtacagaagtaacaaaagttactccttccataatttatagtttagcttaacaaacagccatacttgattccagggattgaacttacccccagcatgtcaggcaccatatatgcaaatttagtggtagtagtgttgggatctctttccagtgatcactacttgctaggtaaaagaaatgcacaagcataatcagcagagaagtgtgatccttgacagggtaggacaacaggactgaagcttcctaaaattaaggaaatatgattatacctgtgaagggatctgatagttcttgaaaaaaagccataaagaaaaatagaaacctagaaggatcagcacgatcatgattataatttacttagtttcaactgacaagtaataagatatggaggacctgtctataacctcaactaaatgggcttcactcattatgcatacagattcaggcctacaaaagttgagctcaccaatttgctgtaagatcaactcaaaatcaaaacaaatttcagcttgggttcatatggggtttgagctaagctgcaaccctacaaggctgcaactcaaatcaatctcatatatcctgtgactctcactctttcagcatatataccccatgacatccttatgcacaatacctctggattgatcaatacgttgctctagtctcccttgtaggagatgctagacagcgaaattacattgcaaatgtttcaaagatcatttagtgatcaggacaaataaggttaccatgagtgaaagtaaatggtattcatcgcaggatatcatccaccgtagaaaggagaaacaatttgcaatcatcacattgtttaaagagatgtgggctttaccatgagatatgacgatggcccatcttttcctgttcaatctcatccgtcttcttcctgatagccatcttcaaatccttgacagtggctgtgttcaacattgcaacatctttcacacacacaaagaagacattaaaacgtcatacgatttatgcaatctactagtagatgcaaattaaccaaacaggcagtgaaatgtggcattcgaagggaccagtaccgaaggaggtgccatccagcttgacgacggttagccgcatggcgctgccgagctcgaggttgatcagcgtgtcgacgtcggcgagggagggcttcctgggcacgtcggcgagtatggggtcgtcgaggagggcggcgagcatggactgtagcttcgcctgcttggcctcgctgctctggtaagccgcaacctcctccggcttcgtagagaccgaatccgtcgcctcctcctccgccgcagagaacgatttcccggggtccattgcgtttccgccgccgccgccgccgccgtggaggacgaactctcgccggccagtgctagttgggccacgagcgtgtggcccattgtaattaattgggccgtagcgttattcctgcggctgcgcgttccagccgttggattggattcttgagcaatctggacggagatcctctcgtttgatctgtctctcttccgctccaaatcccccaaacccttcgtctccgccgccgccggaatcgggcctcgccatcggagtggcggcgaggagttgaaggccaccgaccgccggcttcgaccacgccgcctcgtcctcgtcggatccgcgaccagaacgccgccacctcgtcgtcggttccttcgcgcagatcgccgccgcgtctcatactcttcggtatagcaagcaagctctcaacgcctctttttttgggttccctaatctcaatctgctgcttggattgctgaattagtgaataatgctgggcttcgatggtggattttctgtcggttgtcggctacggggctgatccagccccgttgccatccccggggagggacgcgccgagtagagcagcttgcgaagtggttgcggccttgcggggagggacaccgagcagagcgttcttgcttgctggttgggctgccaatctctggctatccgtgatctttgatccatgagattctgttgctattccttcacatggaggtttgtgttgtactttgggcgaattcggatggatgttggattaggcagggttttagagagcttgggttaagaatcctgcttactgatgcacaatagaattaaggtggggattagaatttgctaagctgaaggtttgagatcagggggccagcactgctccttggttagcttgttaatttgatgatgaactactagtgatcctgtagcatgcatctctgttttgctctgtatactcttgttagtgtgattgcaaggtggttttcttttgctactgggcagtgtactgttgattcaaaccaactcatgttcaggccacctttagctgctaccccgttgtttaagtcatcccctcctcatgtccaggttgctcccagtccgcagccacctcttcctcctcactgcattgtgttccctaggtgaccttaggccttccttgctgctacctccacctgtctctgatcccgagtcctgaccacccccttcctccttgcattgccatgacactcttttgagatcattggctgcatgtacatttctgtctttggctttggtgcagcttatcagtaaattcgcatgccaaacttggtggttgcatattgcagcactagagtcgatggaatgacctggtgacagtatggttaactatattttaaggtctaacaaaacggagtggtcctatatctagcagtttctttcagttagtaacccatttgttcaaccatgagtatttattgttttagaaattgttctgttgatgtgcctgttaagttcttcactggaaagtctgtaatcagcattgcttctcttacacatactatgcccaaagatcatagagttgttcgaccaacagctgaatagtatacaaatggatttttttttctgcttgttttttctgttagtgatggaccagcattgcttgtttctgatatatatttgcattctgctatggttccacaggttagcattcgacagccatggcaaagcatcatcctgatctcatcatgtgcaggaagcagcctggcattgctattggtcgtttgtgcgagaaatgtgatggcaagtgtgtcatctgtgactcgtatgtgcgcccatgtacgcttgtccgagtctgtgatgagtgcaactatggttccttccaggggaggtgtgtcatctgtgggggggtcggcatctcagatgcctactactgcaaggagtgcactcagcaggaaaaggaccgagatggatgtcccaagattgtcaatcttggaagcgccaagaccgatctcttctatgaacgaaagaagtatggttttaagaagagatgatcaggaagttggatttgtctggtccatttcctcgctgtgttttcagtcgcactgatatggttgttaaggacttaaggcggacatctttgtattctatggaatatggtctagattcttaaggctgcatgtgcagtacgtacctgatgttaatgaccatgattgttgacatgagatgtgaaccgagatacttttaagtcttataattatgtaagccactgattgtagggaataagtgaatgctttagctgttcgaacgacctgatatggttatcaactgggaagcaatgatacttatctaggagctgagatgcagctgaggttaggatacaggttgttgaagtcaggataaatgttgttgaagtcaggatacaggttgctaggaataccaacctaactcaaaatatatccttcagtcattatcctcgttggatggatgacagagttcttatctgaaacgtctcctgaaacactgatctaatccattttaaaacaacacgacgagacggtcaccagagtccatgattgagttcaagaacgaaaccgtcaggcacatgacctgcctccgtcacggacaagggtaacatggtaaacacgcaaagcgttgcctagaagatccggagaagtttttttttaaaagaataaaccgctaaactaagcagcccaaaatagcgcggaaagagagcagaaattacaaaaaaaaaaaagagagagagaaaagaaaagcaaatcgacgcgaagaaataagggcaaagccgccgacgcgagagccagcccatccgcctcaccacctcccgtccctcttccgctccaaatccaaccctcccctcggccgctccgcttgcgccgccgccgccgccaccggagcgacggcgagggagggagtggggagaagcaggaggaaaccccaaaccgtcccgatctcggggtcgggaacccgccgccggcttttccgctcgttcgtccgtccgtcgatcgcccgccccaccctatctagggtttcccgcgctgtagatcggatcggttcggattggttgcttgggtttggagagtaatgatggggtcgaggcgatccaggcgcgtttcatgggcctccggaggcaatctctgcaaggtactgtgataaaaacttgccaccgccacggcgaggagacggattcgcttatcctgtatctcccagttttgttgcggagatttgcatcgtctccgtgcagtgcattcgttggagattgttttgctctgctagctcgctttctacccttgatttgctttttgatttagtcgccttttgttcaaactccgcgaaaaatacgatcaaatacgatctctcaattttttttcagtggtaaatgtgtgaatgcttacaaaaaaaacgaacatgctattctcagtttgcaaatccatgagcagaagaatcgactgagatggatttcattctgccaatgatgcagaatttctatgctgaatttgcagcgaaaaaaagatgggggaacccccagcaaatatcagtaccgaaccacaattaatacgcagataatgaaacaaaaaggacgataacaacatgatacctggtgcatgtaaactatcattcttttggggaatatgtcccattggtgtatcattcttttggggacaaaatatgtcccatcggtgaagcaagatttagccatttgatcttcatctagaaaattatgtaccaaagaatcttttttttttcatattcttgagtggaaggactgcatgctttaagattctattcaaattgtatagccagataattttaaatggcatttgttcacaattttcgtcttaggttttttataatttttattccataggtctataccaacttctgttagtgttcacatgtaatgctgaattttatgccctagcaggcagcaagcactgccctaaatatgaatgaatttggggcttagattttcaatagacaccgaatgagtttggggcttagattttcaatagacaccgaatgagattggggcttagattttcaatagacacctgatgcaaagcaggtcatgtctctgacacatcagtatgcatgataggacgtgtatttgagaaatgtctcattatttaccctctataactcgaataccatgaattgtttagcttgcaaaaaatgctggattttttttacttttttttttacctttaattgactaggcattacatatatttcagaattgtcataattgggatgaaacacaagcaatgttaatttgaagcatgtgactgttgtctaggttcaaattgttaacttttatatattaaaacctaatctaaaggatgttctaatgtgttaatgggatacaaacaaaaataattcaaa

SEQ ID NO: 57047 - DNA, 3929 bp, Oryza sativa
ttcgtctcattttgaccatttcctgccattaatgactctaataaactttgatgattcaattcaaagtgtcctatagaacttaatgaccaatatatcatttttaacatattaagctatgtggagcttatatcacttgttaacacatgactttaaaggatgaaagtaagacatgaaacaaatattctatgagttatatgattcatctcaacctttttttgctttgaagtacaaagagtgatctctaattgattcagcaattcacaataatctctaatttattcagcaattcacaataagctcatgagatactaaagcatttatttcaccgaaaccaagtaatcagcatatgcagtaagcatccttcaaaggccacgtctatatatatgtaatcacacatgcatgttgcttccatgattgttatatcaccagtattttttttagtgatatcaataccatgctatgttgtgataagtccagagtccagagttggctccttgttccactcatccttatgctatgttgtgataagtccagagttgactccttgttccactcatatcctttttgtacgtatggacggataactgacaaccgtatgaaagtgcatccatatcaccaatacaacactccttttccccttgcacgtgcacctttctttcttcgtgctataatggtattcattgttgttttttaaatggatcaacaatgtgaacaaaatattcctactgccaatccagctaatgaacagctaaattggtattcatatcttaagtatcctgtttgtgagatgacatgttagttgcagatttacataggactgaatgaagtactttcctcgaatcttgattgctggtgcctggtagctgatatgttatggactgtgaaatctaagaagttaatatggatttgcatatacaacgtgtcaaatcatgtatatattatctgaaagttgattttagcacttcacattggccttgagtgtttaaattgtacagattgcgggaataaaatttggctgatggtttagtagtactttgaataaatgatcaatagtaagatggtattaattgtaagagatttttattggtgttctagaattttgaaggatggtcatagtcttctgttaagaaacatcttaaaactagtcagcaattgtgttttgtggattcatacaagctgcaatctgccggctgttagaatgtatgttaggaaaattaaaagaataaatagttgaactgctgaagtagccctgaaatggcattgaagaggaagggtttagttcttgtttcttttcatcttgtcttggataggcatataagatatataaaagtggcatgaaggtattaaacaatccttttattttactggataataaagaatggttttaactatcctggaggcaggtaggtgctaagcaagtgattgaacattggatggagttctttcaaaaaagaaaaaagaacattggatagaaactagctccttgctttgtttgaggttaatgtctgtcacaaactgttatcatgccttaacattgtgaaccctcctaaaaaaattattcttttttgagacttcattgaactatacattttggtagtcagcagaagattaaatttaatctgagctgaagtttttatcacccagcattatagcccttttgatgatacgatgaccaagttcttcaaatttgttatttggctcacagaatgcttcatgatagtgaatcatcttattgcccatgttcttcggacttgattgtctcgtttaatgtttcttgtgtcactaaagcattgtaataaattataaatactgaacaaccttgtatcatgtgtttgtgtcaggtaaggcttttcctgtcagaggattccccctctcaagctggattaagaccgcaggataatctccaagcaaaaggctcatggttactgcatgcagctggcccaagctcagatgattccttgcctccaggctttgagtcattgccgccaagcaatgacctcaaaattgacatgtctcaaatccccctaattaggtggaaatgccccccacatgtaaggctcacagttactgttgtgttggacaatagcaagacaagttcaaagattactgaaattcccaacactctcttgattgcagatagtattggagcaggattggcatattgttgctggagaagaaagtagggagattgaaattcaaaatgagagaataaatggagcgcttgaggcaatttacccacgtccatcgaacattccgccaaagtaagcaagctccttttttttcattacaagttcttcagatgtcacataccattttttataatgatttttttgtgtgccaatccagcccatttctttctcttgatgtgaaagatgcccattatgacgattccaaaaccctgttggttcctttgatccctcttgaagatgatgatgcatctgatcaattggaaggaccaacccttgatctaccaagccattacaacataacaggagtttcaaatactcctgtttccgctgagcaacaaccaccatgtggtggtgctataagttctggattcaccattgagcctcaggctgcagtctcagcaacagtcactgcaattatgcaaaccatacagagtaatcaaaatgggagcatggctgaccaaaacgggagcacgattgaccaggaactactcttcaaaatactaagtgatccttcacagcttcagaggttaatgaaagaatgtggcccagtcagacatgaacaatcagctagtagttctgttgttgccccattggtatcaatcccaccaccccaaataactgcaagctctcctgcccccttctctgatcatgtcggaacctttcatggcatgaatcctaccctgccgcctccaccaccaatgatgaatcggccaccttcaaccattccttcagttgctatgaatcatccaccaagttcaagcccagcaatgaactttggaagtgccctgccaagttcaagcccatcagtgaactttggaagtgttccagggaggggtgtcggctattataaaaccctcatccatcagcatggaggggagagactggaacaaccatttgagcagcatggaatgcagtttggtatgtaccgccaacctggtcctccacaaaatggcggtattgatgccatgaacggtgctgctgctatggtgagcagagatggcaaggtgaggccgatgaaaccgtgtgcatactttaacagcccgaagggttgtcgaaatggtgctagttgcacattcctacatgatgcgtcagccccaacaagaaaagatcatcagaagcaaaagggatcaaaaaggataaaattagacaacacaatgggcggtcgaaattgagctgaagccgccatttaatttttgactgttctttggttcatctatcatggatcagtaaatattactccgttagctcttccattagcctccttttttatgttcgtcgaggagaggagatgttctgaaagaaagcaaaatatttcatgattgattggtgctcaaatttttactgaatcaagttcgagctcgatatcttgttctgaattcactaattctgtctctagttgtgacagtcggtttgtcagtgaaacgtcgcactctgcaaatactagtgcacggatgaagcgtagtcttcttcgcattcattgtgccagtctattcttaggtgattcggtgatttttcgtgtattgctgcatgaattactaagtaatttttaatatatttttttacaaccaagatagaagtaaaaaagaaaaaataataaaatataaggtgtatcagtacttatcatgaaacaaacaaatgataacctaatatgaaacatattgataaatatatgttaaacattataaaaatgatagatagatttgttaaaatattatgcaaatgatgtgacgggtgatgatt

SEQ ID NO: 57048 - DNA, 3166 bp, Oryza sativa
tttccatatttcgctaacttgtagtaaatttatgataaaactatatcaacatctatataaaatgtgtgttgataatgtattttagttgtcgttataggtgttcataggtttttctataaatttagctaaaattagagagatttgacgtaggataaatcatatactcattccgtcccaaaacataagaaacttggactggaggagaggagatatttcctagttatacgaatcttgacatactgtagattcatactattatgaaatgtcttatccgatacttagttatattttgggacggatagagtatgacacaacattgcctgatcgaccaccattggcgcgccacctagtcaatcgtttgagctctctcatcgttgtcttcttaatttttcattggatcctcctcctttaataagaacgtgttttcgttggagggaattgttaattcgagggtaggggttcttaattacgttgtttggatggcgaagtttaagagtaaactctcactttttcaatacctaggtaggacatataactatgagggaatttcgtcgtaagtacgttaaagataaatctgagccggacatcatcataaaatttaattctcactcgaactttccgtgattctcatctctactaccaaataaaggatgatgagaaaaattgaaactttcatgaccaatctttccaccaactcttaacatgttgagcatactaaaaactcaagaattttggatagtttttttttttttgaaacagtagacggtaggagttctaccggataatttagaagagaattgaccctatttataaggaaaactagtcccaaaaaccatacaactgtacagtttgctaaagggaaaccgacaaaaccttacattgaaaacatgaaaaacctgtgacaaaactacaaaccacagtacacaccgagggaagagcaggaccttcaagacgaagcctccaaggaggtaaacaacgacagaatccgctgtcgacacccacccaactgagctgggttttcacccaaaggagagagagtccacaaggcaacacctccaaggagaaaacggcgcccgcaggtgtcgatgtcgccgatcttaggagaccagactaggctttcgtctaagacttcctcaaaaggtgtagagcctctagaaaatcagagctggagtgttgaatgttatcgttgttcggcccaatggctgaattcaatgcaacagctccgactccatcgaaacataaagactctagcatcgtagaggacaagaattttggatagtcaatggaggataacacggctttggagagaggggctaatacgcatgtgtccatgcacattaggcccgtgaacatgtcgtggcccaatccaagttcgaaagcccatgtgcattcagcctacaaccacacgagcattcgacttggttgaattttattttaaaatataaacttttagtatagaaattatatatataaaaactttatgtgtagaaacttcggtatagaaattttatacatagaacttagatgcaaaaactttgtacataaaagaatatttggtatagaagctttatacatgtatttatggatcaacccgagaaaggaaataggaatgaactaaaaccacacgctaaggaaggaaatgagcgcaagttgcgcaaccacctgacctaaggctatgatctataaatctttcccaacttctcaacggtgtaatttttaaaaagaatttaaaaaaatatttatagaaaagtttttaaaaaattatattaatttttaatttttaagctaagaatatttaattaattatgcgctaatccgtcacattgtttcgcatggggaggaatggatttgaacccgcgtttgcatgccgagcaccgtgtggtggtgttggcatttcgtgcattaggaattgggactgtctgtataactttgtgggccacatttggatcgttgatgtcagaaatttaaatggactttcctcgcaaaaaatgcttcagttcgtaactccatttgattttgttggccagacatgattgtgcgtctctttggactgggcctagcgggttcattggtttgtttttttttctttccctgcgcactgacacacgggagtagaagacaaaagatagagcaagtcaatttcttgtcgacagaacctcatacagcggtcaggcatttctcactccacaccaacatgaacatcaatattggcaaatataacagaccgctgttgcattacaagtcaagatatattacacacacaaatcattcattcattcattaccagtcaaataacaacaaaccaagaaccaacaaatgtacattataggaaagctgttgctgttcttctcccaagttccaaccataccgagtattccaacaaagaataaaaaaactgacgaattagatggtggtgtgcggtgggaaaacaagcacaaatctgagtcatctcatcaaatgcttctatggcacctcgctaaaaactcttgctaggcgcactcatcatatatgccatctcctatctgcaaaccagaagttcttgtttagatatatgtgcatcatggatggaaatacagtctatcgtattattctatactgttcaatagatggtaacacaaacatagcaacagcactggtagatgatcatactgagcaagcacaaaaccacactgaagagagtaaaaatataagtacatgataatattcagggattagtgcattaccatttatcagtaatatagccagtaataaactgaaaacaatgaacattacatataaaggacgaaaatgttctgaggcgacactaaaagcaccactgaagagatcacaggtcgctgggaatgttcagggaaggcggattaccggtaatgcccaaacactacatttctatgttcatcttaattttaatgttatgcagttccctgaaatagcttgtgtatgcaagtgggtgcttcacaaaagtggacctcacaaattagagtagagtttaatgacctaaactgcatatcgaggctacaagatatttgttgctacagtgatccagagaaaaacaggtaatcattacaaatcatcttcgtaaactaagctttcaagtgcaaactgatcatactaagatcataggatgatagtagcaactagcaaaggaatagacttgtgcgcacttagt

SEQ ID NO: 57049 - DNA, 8779 bp, Oryza sativa
  unsure (1)..(8779): unsure at all n locations
tgatacactagcagatgcctttgcccttgcagattctgtaaactgcatataacttggcaatggagtgctgttgcttatgcgaggttcttgatcaacatgatcagatttaaccttgcctgagctctctcgcctcccaagtctgtaatcctttgacagattatccatgctgctccgtcccacagaatcgctgcttggactagttagtgatctcttgcttacatgagacttgggccttttgctcttgctttttttggtgttaacagagacctcacttgatggtgtcccatgagattcagcaaaggtagttcggctcaagggagtaccttcaggtgtcttcacataagatcctacagatttttccagttcatcatgtaaatcaggcttttcctgtcccagatgtggttgttcaacaggcacaggatcaattgcattggcagcgatagcagtgtcatcagtttgtacttccttttctggctcgatagctcctccagaagtgttcacttcagaatgcaaaacactgttatccttttcagcattatcaccaacatggttcctatcttccagggatccaatctccagtacaatctcgccaccatcagcttctgatctatccggtgagtcaagtgtagaggagattgatatctcagttccacattctgaagcagcaactacgattttaggatcatgccccactgagctctctggtatgcttgtgtcattactttgcttgggtgagacattgtcttgtgaacgaggagtatgtacctttggtttgtttgccccatccagactgttggacctactgaccgtcaaattggaagtcaactcttcaaattttactgtgcagcagcaaatgcaggattgcatgactttctagccataaactttttaccttccatctccgaagtctgctcagttttatatgcatccatagtatcatcaaaggaagattcaggtttttcaggaagaggaatgggttcccttgatgtatcagtttgagtagattgttcaactgagacctccaaaggttgttccgcaacattctcagtctccggttcagtcaatttttcaacatcttccttgaacttttcaatcaaatctggttcaggaacatcttcaatttccattccagaagttctatctggaatgcatgcagaaacctccaggggatgagaatcagatggccttagtgtctcttccgcatcatcaggcaccaacttcaggaaagagatgtcagaatccaaaggaagggtattttcctcatgttgagcatctccttttattttctcatccaccgactcgttattctctctatcctctagcaagtgtcccccagtgtttggtggaatcatggatgtccatctctccatccatttccatgcaacatcaggttcagaaggatcacattttatgtgaatggattttgaagtcgacatgctgtccatgagctgacagaaggtaacaaacatgagaaaatccaaccaagaactaacgtatgataatcttagttaataagggttctttcatctaaccttcagagcaaatccattattgagtaatttctcacttgaagaacagatcaaagagtcctgcaaaaagaaatgtaaaatcatgaacaaacaagcaaaatgttcaagcaaggctactattcagtattgtcacacagaaacaagaattatatacgtgttaagtgcagcagataaggttttgatccaaaattaatgattgtgcgtgcatggaattcaacatcgagatgcgagatatccaatcaatgtagcaactaaagtggattgcctccgcacatactaaaccttaagatcaattgccaacaagaggttgacagctttcaggttactagaagaaggaacttggcgaaggaaggataagaagatcatagacttcacatagcatattaaacttatattgaataatattaaaccaagcttaactgactggcagcaaaagagtttatactgtctagatacaatgataccatacgtgtctaaatgagagtgccttgaatacctgaaactttcctccatattgctgtgcttgatgaacccggacaagtccttgcattttaacaatagcaagcaagcattgtaatgattctgcagcctgcctcctaacaagatgcccacgtatcacagcttgcagtttcacaaggtccttatcatttggtagttcttgctcttcctatagtcatgtaaatgacaataatgtaataacactaacagaaaaataattaataaatataaatagtgggaaatactgcaacatacagtgtgcactctgatgccagactgaatgacagcagcagcagtctccgcacaatcttcctgatggtcttcactgcttccatcaaagagagagacggtttcctcctgcttcacctcagttgatgaaacaaaaatactttcatccgtcttatcagtgtgttcctcaacatcattatcatttggctttactattggagtttcagttaccctttcagttggttcttggattggcacttcaattactctttcagctggctgctcaattgacctttcagttatctggtcagctgacttttcaattggttcatcagctggcttttcaattgattcatcacctggctgatcaattggcttctctatcagtttttcatcaggcatctcttcattcaaaggcccctcatctggtttatcttgctgcaaaattttctcgtccggtttctcttgctgcagaattttctcagctggttcgtcttgctgcagaattttctcatctgatttctcttgctgcagaattttctcatctggtttctcttgctgtagaggtttttctgaggcataggagtaagttgaagaatagatgttgcttggagcaatttcagcttttgctttgctcgaactaagagtttcaggttcagatatatcagaattcttcaaaacacgatgccttgtagacctcctacgaaagctccacctacttttatctgatatggccttgttctgtaaaagccaacatttaacagccattagcatgattcatctacttgatataaggaagagaagacagatattctgtggtagctttttcacccgagacgaactagaagagatgttacaagcaaaatgcaggtaatgagggctagtttcgtgtatctgaaatgtaggcaaccaacatacttctcatttaatgaagcaaaatgtcgttgaccaggaagggaaacaacacaaaaagaaaggaagtggcagataaactctattagttttgaaattaatgtaccagttcctaataaatctccccaaagttttcctcgcaaaaaaagacccaaagtttgttaatgccttactggcgtgatatatccatcaataatcaatttatttccaaaaataccagttcagtaaataaactataaaaggaggtaagctaacatgattcaggtaataccttggtgaaattatgcactacttaatcaggagtatttttaatttgccaacttctaataattgcaggtggaggcatagaatcctagcaaaaatacatttggtttgctgtcagctatcaccactgatccagcaagaaaaaatttgtccttttgcaattatatcaatgaaagagagctaactactctctcttttccctgaacatcaaaaagagctaactactctcagtcactcactatagttggtacagatcctctaggctgtcccgtgaaaattccagatcccatttcaccaacactatggtgcggctgtctcctacgattagaggatttttctcgattcaacatagagattttatacgatgagcgtccagccaattagtgaaaaatgagctgctccagagtccagtgaactcctccccacactgagattcttggtagggaaaaacagtaatcaacagcgcaacattacaaccaaagtgtcaaatcatgggggacaaggctagcaacactcagctccgaggaagagaatgacagatgccaatcatgcaacaagacgagagacaccatacacagtgagtagcactttgagcagcagataaacaccagatcccttcctgacatcttgcatggactcagggcggcaagagtagcagccataatattccagctgctgcagctagagccatgcagcaacagaagagaaggggtaaaaaaaaggaaggaaattgaaatcaaaattgagcctttgaatgaactcataggacgtgcgggaacagcacgggatcaccagccaaaaaaaaaaaaaagctctcattttgctggctgcgtcttgctcgccgccacgaatcaaccccagatctaactaaaacaacacgcgcccgcacctcgaccccacgcatcccactgagatctgctgaaaacaaacgcaccagctcgagagaacccccccaaaagaacaaaaaaaaacggcttcggcgagcaaggccggcgcggcggcgcattcaagcggaggtgcggcgcgcgagtacctcgtcgacgtggtcatccgcgtcgccgtcggagccggcggacgggtcggatccgccgccggcgcaggcgaggatcttgaggcagccgttcttgggcttcgtcatcggggtcgctttcgccgccgccgctgccgccgccgccgccgcgtcggcctcagtcagtgcagcgcgtgcgtgcgtgcgtctggagcggaacaggatagggagctgcgttcctctgacttgtttcttctctggctttgcgttggttttgctttgcgtttagctgcggctctgcttgtttgcttgcagtttttatattccggaggattcgggccctccgctatctctaccttgccgctgttcctttctcctccctttttttttccccttctccaatgcagctttatatgctttgtttatttcttttccttttattaattaaggttaattaattaatacgtaattgaggttttaaaaaagttttgcgagtgattttatatttgtttcttttacctttgcatttcatccgggagaagatacacacggaagacggtatacgcgcaagacggcgagacacatagttttcgtgattgtacatacgcaagagtactagacacatgatatacgtgggtataggatttataagcctctagtatattaagtcagtaaatgggttatcatatgagtgcttagatgttctatagcccaaccatattggatctttaaggccgtgttctagctttcgaaggggtcagaaacatcttccccgtgcacataaaacggagtgatatattaactcatgattaaataagtattagctataaaaaaacttaaaaatagattaatatgatttttttaagtaactttcctatagaattttttttataaaacgcgtaccgtttaatagtttgtaaagcgtgcgcgtggaaaataaagaagataagttgggaagaaaagtactcgtactaaataggccactcaggttttacattttctttttttcccatcgagaaggatgtgtatgggggttgggatcatttcctccctaagggcaagtataatgggaggttctaagtcggctaaatgctcaagtggaggagagatatgagaagcaggctgtaaacttacatctggcttggacacaagaaccaaaaaattttgtgagagaggcaagtgggccatatatattaattataaatagctaactattgtatgtgtagactaagagaaggctgtaaagaaccttatatgcaacaattcggctatattattagccttgctctaattgatctgcaccttgatttgagggttggcaagagaggagaagggaatcggtgagaaggtaattcatagatttaaaagatagcgagataaattcgacttgtttcttaaaaataacgctagcacgtgtgacacaccacatgacaatctaatttaattgtgacaaaattagtccctctaattccgtgggacagtgtctcgtcgctgcatagctcgatctattggaatataccgcaatatatgtggggagttagcatctctcattcgatcgttgtcttgtaccacatcactcgtaccgtccttggaccgaccattaacaagcctaggcctaggggtgcaaacaaatgttgttcttcttcatggcgctggtaccgtcccgtccggccacgatccggtcagttgtgattgcaagtccacggcgcctttaagttcgcaataacaaggccattaatgcaagcaacaatctaactccgacgagcctagccatggcaagagcgtactttggtggggcttccgtttctccggccgcggccagcctattgttaccaagtacagtacacaggtcagcacttgttcttcccatagtcgtttttactcctaaattctcagtactgatgctactattaattaattgtaaagccgatcctgaccctgtcactgttggtaaagagcgagaggccagccagctgcatgcatgcggcgaaggcgatacccctgcaattaagcggctggtaagtacagcgaccttcgtaaccaacaaacgatcgagatgacacggtaccggcactaaatcgcggcaaaaaacggtacgggcgtcgacgtgacggcccggcggaatgctcgcgcgcgcgcggccgcgcggggcgggggcgagcacgagaaagtgcgtggccgcatgcggccgcggttgctgcttgcattgggcggcgttgggttgttggtggtggcggtgtggcggtggtggcgcggtgatcgcgcgagctttgctcgctggccgcgcgccgcccaagcgcgggatggggcccgtggttcggttggttggttggcgtttcacgtgagacacagtgatcgcgttcgagaaaaacgggagagcggagcggagaattcatcgcctccacggcctttttcactgtgttaactctcacgagctgcaccggccagaccagtcactgacactactgagtttctggcacggtcgtttcggtccacacgcggtcaagcgctcgacagctagaccgtcaaatggggttagtaatttatggtggttaagtggtcaccacgcgagcggttttgcacgcaacaacggtgtggcaattaagctcgttacgagtgtttattaacggtggtgagtgagtgcatgtgaaaacaaagtggggccacgtgcgcaacgaggggtgtccgagccactacgagcagctgcgagtggggccaccccgagaccaccgggcacgtgccagcctttcgcacatggacacgtagcgcgctgctcgccacgttacagccacgtgcgatgccaccgtaaacgttatctcctacagctcctgcctttgttctactctctccccctctctctctctctcaggaccagaaagaaacaggcagaaagaattcaaaggaagcatcatctaatcacctagttaacaacggtgtcgtggcacagtaattaacggcctaagcaagcgtcagatgcataaaaccataataagagatactactatatccaaacaacaaggtgctttttggcagcgtgcaatgatgcttacactaaaggcatcctacgcgaaaagaacgaccggtagtgtggattagattagggcagagcatgagcatatatggagggatggaccaggatccaaaagcagccatgattcttcatgtagtggtggtgctaccttttgttttcattcttaatatcaattgttgtttccttcctactaccttgatcttaggttcttagcaggccaacatttgttctgaccatgagttgatgatcagtggtagagtcaccacctagctagatagtactatattctagcataatgccaatagcattgaggaagaattaatgctgaatttgatatgtgccatgaactatatgtagcagaataatttggtaggagtaagtagaggtgaaaaatacagttccagtgactgtgatcatagagaccaaatgtctagagctgtgatagtttctgaaattgtgatatgggatcagctaatgtgaggattaaactaagaaagaacgaaaggtcattgctctcttatttcctccccacttgttgaacttaacacaaagatgtgagaaactaaagcaagaaagcagcaagcacatcttatcccatggtccctggatagcccaaaagtcgtgcatgcccaacacaaagggggcacacacactacctttcttttttctctgctcactcactgaaacatatatatgggttgcatgtttcagaagtagacaagagtgattggaggcacacaaattggcctgcattgcaccagctcacatgtattaggtcagggtttgttgtgacagttcgtttattcttgttaatttgggaggtgattaattaggggccacatgaaaggtcactgtcagagagttgggaggcagtgacaggctactccatgttgcttgtggaggaaaaagagcaagtttgagggcacaggccatctgagaggactggagactactgccatctatctatctgaagatgaagacgagatccaacggggttctctgctttttattattgtctccaccagtttggacagtacatacacagattcagtatcaatcataaccttctttcatttctctctttattataactccggctaatgttttgtactatatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57050 - DNA, 16255 bp, Oryza sativa
  unsure (1)..(16255): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgatccttctgcaaatataattttcggggctgttgttgatgaccggtacactggtgagattcatgtgacgatcattgccacagggtttccacaatcctttcagaagtcccttttggccgatcccaagggtgcaagaataatggaggccaaagaaaaggcagcgaacctcacctataaagcagtggcagcggcgacggtacaaccagcgcccgccgccacttggtctcggaggctcttttcctgaacacggttcaataggaaaactagtagtttgtgtaccttagattctcatggaattactgagttggcgctccaatcaggcttctatgtgttattctttttggatatgtaaacacttaacagttacacatagtgattagcttcacttttattgtatgtatcatctagatgaggttgaggtcttcaggagttcagcagccgtcacgaatttttattgtatgttcaagacgacacttggtagttgttcgttgtaggcgcgacttgctggccaaatctattgagttgtagatgtggatgaatttgcacttgattgatcttgcatttttactcatacggagacgccacgtgactacatgatcgctctggtgtcttgagaaatccatttattcattcttgttggatacccagaggccagatgaagggcctgtttggtacatctcagagtttcagcttcatctaaaataggagcgaagctaggtagagctctctcacaaaataagcggagctggcagttggagctctaccaaacaggcgtaggcgtgaactattccacccagtgacttccacaggtgtgcttacccggcccagcacgtctgggctgcgtcaggccatgccgttttcttcactggcccatacataagccatagccacagaaaccagcgattagtaccataccgctgattcggatgcagaacgctctcccggaacagtataaaacaagtgccaaggcagctgttgaaaggcaggcagctgcgcagtgggcacaaagcgaactattctttcgccttttactaaagaataccgtgtgctcgctgcaaatagcagcatactctaattttttgaggggatttccagcatttggagaaccccaacaattctgaaattgaaattagaccttctaatttatatgattttcaccgtgatttgacctctctggcctagcacccctgaaccgaaagcagctcctttgtcccaggagagctcctttatatgattttagtttggatgacaacaggagagttcctttgtcccaggaacagggctcttctgcactctactctacagtgcagctgcagttcatatctcaatgaggtagattggtcctgacatctgatctcgacataggtaagcgatgcatataacgagttgttcatccaaatttgtgaaggtgaattgatctctagacgatttatagattagatagtgttggcaagagaaggtggtgatgaccaaaggggagacgattgaccttcaagctcaacgctgccgagtttattgttgcgtgcggcggcgccgtgagcccatgacagacgggaggcttggatgagtaatgagcgggaagcaagtgacggccagggtgcgcgcggcgcgccggcgaggcacgccatgatgcgctggcggcgtccttgctgtgaatgggggggggggggggggcttatcaagaaaaaccacgtttcgatcagtctttgtgcggtgcagatgatattttggggcgggaagttgtattgtattccatgtatcttctttgttactctgtacaagacaccattctaatgttctgttgaatttatgtgtggacgaacttgtattcgcttgattttactcgatgcagaaatgctagagaaatgatccttctgttatgtttgaacgcagatgagctttgcctgaacatccgtcatccggcccagcaccagtgggctacctggcagtgaatgtcttcacccatattggcccatcgccgctgatggcaaaggtagcagagcagccaccgattagtaccataccgctgctttgggtgcagaatacttccctcaaacagtataaaagaagtgccgaggcagccgttgagaagcaggcagctgcgcagtgggcacaaagcgaactattctttcgccttttactaaagaataccgtgtgcacgctgcaaatagcagcatactctaattttttgaggggatttcctatctaaggacaaaccccaacaattttgaaatagaaatttgatattttttttcaaggggtttcctgtctaaggagaaacctcaacaattatgtatgaaatagagaattgacgtcttacactctttctccatcttatatacagttgtttacttcgtcaaaatccacaagttgctgatagaatcctttgtgacgttacgctaaaaacacttcagcaaactgatctgttctttgagtactctggacggctgtcggccctactcgttttgggagataaacttttggattaaaatgacatgtttttcaaacggttaaagggtgtgtttcgtgcgaaaaatttctatatgaaagttgttctaaaatatcagattaatccatttttcaagtttgtaataattaaaactcaattaataacatgttattaacaccttattttacgtgaaatacttaatctttatcttcatttttagaacattcaaacaccaccaagatttgcatgctttagctgagatgacagcaagaggtatcctttgccccagcccccaggaacagggctcttctgcaccaacactaggcttcagttcacatctcaacgaggtagcttggacctggcttctcggttgttgagtatataactagttgttcatccagttttgtgaaggtgaatgaatctctagacgagttctagattggacaatgagctaacaaattcgcttcttccccatcgttgtcaggagaaggtgatggtcaatcacctaaggctgccaggattgttggatacttggatgcgtgtgacatccgggagtcttggaggaagaaggagcgggaagcaagtgacagccaggatgcggcggcgctccggcgaggcacgccgtgaggaggtggcggcgttcttgagacgagtgtgggagtcggagttttaaactccgagcccccttggatctctaacgaccgttcgatcaggcttctgcgccccagattaaccgaaaattattcaggggcttcatcgccaactaaacggaggcccattatcttgaggcggagtgggggcaaggcccacttcagtcggccgaaacgaggcccaaaattgtgtggcggaatatgaggaagagctctcgtggcaggtagaagcgattagtaccataccgctgctttgggcgcagaacacttcccagaacagtataaaacaagtgccaaggccaccgttgagaggcaggcagctgcgcagtgggcacaaagcgaactattctttcgccttttactaaagaataccgtgtgctcgctgcaattagcagcatactcaaattttttgaggggatttccaggatttggagaaccccaacaattctgaaacaagatttgattacctcctgttcatctgttcgtaggcatggtgatagatacgcttctaattttgcaggtcttaagatttcatcttattccctctctagtagagatacaactgtccattattcacaatccgatgtgctgctggcgatctgttccatagaaccgcaatgagagacgttgcaaaactaaaatcagaatcagaatctgctgtgacttcacacgtattcgctatactggttcatacaggtctagagcaaaccgatttgattggttgtaggttttagtactctgaaatttgcagctcaatgcttcagttaagatagcaacacaggtttctcctgtgtccaagtagcagggctcttctgcaacctacagctgcagttcacttctctctctctctggaaagatgattgcagttcacatttcaatgaggtagcttggtccatcttggcatgtgtaagtcaatgcgtacaactaatttttcatccagttttcgccgtgtttagttacaaagtttttttttcaaactttcaactttttcatcagatcaaaactttcctacacacaaacttccaacttttccgtcacactgttccaatttcaaccaaacttctaattttgatgtgaacaaaacacagcctttgtggatgtgaattgacaacttctagattagataatgtgaatccatttttaaagtttaaaataattaatattatatcaatatacgctaatggcccatctcgttttacgtatcttctcaatcttccaatattctcgctatgattcttggggaattagagagttggcgttccaatcgggcttctctgtgttatttcttttggacgtgtaaacgctgaacagttgcacataatggttagcttcatttttcttgtatgtagttatgtaccatctagacagggttcaggccttcgatcttcaggggttcaggttcagcacgttgtgctcaagatggcaccaggtggtagtagttgtattgttcgttgtaggatgggaattgctggctacctttcgtcgcatgagacataacactgttctatcgaattcatacgtgtcatccctgtattcgattaattttactcgatgtagaaacgctgcgtggagaaatgatcgttctgtttttctcgagacttctatatgtgttggatacgcgacaaagcccactagcgagcgagggaaaatattggcattttgcacttctctcttgggaataagttcacttagcgactctcaaaagtaatcaaaatctaatccgtgaccctaaactataaaaccggatatcccaacccccaaactcttaaaaccggtgtaatttgactcccttggcagtttcgaagggcgattttgctgacgtggcgcctacgtgacggtattgaccgggtctcctctacacgtggcattgacgtggcgtttagatgtcatttagaattaaaaaaatatatgcaggacccatttgtcattgacacccaaaagaaattgtgggacccacgtgtcctttctctctctcccctccctccagttccttctcctcgctgctccctctctctctctcccgcggcgggcggcgagcggcggaggcatggacgtggcgcggcggcctgcgagcagcaggaggacggcggtcggcgacagcgggaggcacacgcggtgcggttgacacgacgtcatccaccgtcaccgtcgccgcccaccgtcacgcgacctccttctccacctcctcgcttcatcgccatccgtattaacatcaaatagttactgctaactcgcacatttactggaaaaaaaactaatcttagcatagttgcatcacccctcatccaaaaccaaaatctactcctcacctttccatggacaaatcattcgcatgcataaaaaagagaaaaggaaagagaacaaaggaaagagatccccaaatgcaatgcatccaccaaaacctcccatttgcagcaagcaagattcagtgtatttgtgggacagaaagatttggcaagacgacagctactggcctaccgctgcgtgtagatgaccgccggatccaacgaagtagcagagcaagcttggaattgagaagaaaacatccttgtggtccagcaagggcgacgccgctgggcttgctcactgcctcttgctcgccgcggatcctgcttggtgcggcttggtcgggtcagtggcgaatctaggatgaaaatagaggtgatgctttatatttaaagtcataatacaaaataatcatatactccctcctttcatattataagactttctagcattgtctatattcatatagatgttaatgaaactagacatatcatctatatgaatgtggataatgatagaaagtcttataatatgaaatgaagagagtatctttgaactatatcaacaatattttaaaatcctgcgagggtagaaaatggaataaagaataaagaaaatggaataaagaataaagggagcaagttgattggaagatatatatataggtcatgggctgcagactgcaacagctactggaacacaagagtaaaaataatccacaatataattaatgattacaaatgatctattaaattttcgtgcacatcgtttctttcaccctgaacttctctagccaaagagccatcactgcttggccctttgctttttgctgtcaattttgctggcagtgtaaactcactaagcatagatatctagggtcgattcttggcagccagagcaggggctggagcccctaccagccccaacagtggattcgccagtgggtcgggtcacggatgacggctgttgcttgccaccgcctggctggcgtactgatgccgcagccgtcgccgctctagtgcttgccgccgccactcccgcgcctccgccgctcgcaggcggccgcgccatgcccgcaccttcgctactcaccgccgccgccgccgtcgccgcttgagagagagagggagcggcgaggagaaggaactggagggaggggagagagagaagggacacgtgggtcccacaatttcttttgtgtttcaatgacaaataggtcccacacatatttttaattctaaatgccacctaaacgccatgtcaacgccacgtgtaaaggagactcggtcaataccgccccataggtgccacgtcagcaaaaccgtcctctaaaaccgccaagggagtcaaattacaccggttttaagagtttgagggtcgagatatccggttttgtagtttagggttacggattagatttcgatcacttttgagggtcactaagtgaacttattcctctctcttgcccagcggcgtcaccagcccagcatcgttgggctgcctgggccatgcacgctgcgccgttttgtatcttgcctggcccgaatccacggatagcacacagcaccacgggaaagagtcgcgcaaccagtgattagtcccataccgctgccttggatgcggaacgatactgggaacagtataaaacaagagccaaggccgccgtttaaaaacaggcagctgcgcagtgggcacagagcgaactattctttcgccttttactaaagaataccgtgtgctcgctgcaaatagcagcatactctaattttttgaggggattttctatataaggagaaccccaacaattatcaaaatgaaattaaacttatttttatttttcctttttttttatgtctggtcacctaaattgaagcctacgaagggcctatgcagttgctcacgcatgttacgcagtactgtattgctgttttgctctcacgctgtcacgtgatatcagaattgttttactctcacgatatgtcgatcagaattgtatccaaattcacaactcgctgatggcatcccgatttgctggtgcagaggcgaatggaggttttgcttcgggtggtgatcagtcctcaaaacaagaccatctgtctgatggagtcagaatgaggcttgcaaaactgaaagtagacaaaaccgtctgtctgatggaatcagaatgaggcctgcaaaactgaagttagagtcaaaatccgctgtgactacactaatgttggctaatactgatccacagtccagagcaaactgatctgtttgtgggtagacagcgtagttttttagtagtaagtacaaagacatatgcagctcaatgcatgctttaagtcgagatgacaccaggagatcagtctccttgtcactgcaggaagtgggctcttctgcactcaaaaggtgcagttcatatctcaacgaggtaacttggtcctgacatagtgacatcttggttcacatcacgatgcatctaattaattattcatccacttttttttttttatctccagagtccagacaagggctacattagatcatctccaacaacctctacaaatagaactctctaaatacccatatagccaactctccatctaatttggctggctagtcaaactactattcacttcaacaatctctccatctatcctctctactttgactctatgacaccgggacccatatgtcagcctctcccttctttctccccttccttcccctcttcctcttttctcacgttggcaggatacaggcggcggcggcgaagcggcgaggggacagcggtggtgggcgcggtgggggccgacggctgcggcgaggggaggcggcgggccgcgccgcgcgggggccggcggccgcggcgagcggaggcggcgggccggcgaccgcgacgagtggatgcggcgagcagtcgcgcgggggccggcggccgcggcgagcggaggcggcgagcgtcgcgcggaggccggcggccgtggcgagcggaggcggcgggccgcgccgcgcgagggcccgcggccacggcgaccggaggcggcgggccgacgaccgcgacgagcggatgcggcgagcagtcgcgcgggggccggcggccgcggcgagcggaggcggcgagcgtcgcgcggagccggcggccgtggcgagcggaggcggctgccgtgctcttccctgtgctcgagctcctcccaatgcggccatgcctcctcgtgctcggttgccgtgtgggatggaggatgggctgtgtggggcccactattggtcagccaaatagactagccaaatttggctagtgaagggagagttttggccagagccatccggttagagaaacagttggagttagtttttttagttagaatggctaaattttgacttaaagagtggaatggagaggctgttggagatgctcttagataatgtgtcgatgaaattgcctcttccaccattgttgttacttgtcagaaggtgatggccaaagggaagaagattcatctggaatctgccgttggtgcgtgcagtggcgtcgtggctaaagaggaggaaggagcggggagctggggacggcgagcacgcggcggcgctccggcgaggctagccatgacgcggtggcggcgtttttgctacgaacgtggcgttcggagttaaaaaccccgaccccgtcggacctgttacgaccgttcgacatgtcttgcgcggtccagattagcttgaggcgagatggggctcggcgtgtcaaacagaaacggcccaagaaggcccaattttaggatctctcccatcgatctgatccgcccaactccgatcggacggtttaagatcgacctgaatcggatccctaccatttggtgcacgtttgggcataagtcacagtgctagggtctcttttgcaaaattctcgtggcacttcttttccggaccgatctgacccgtctaactgcgatcgtacggtcagctctgagcgtagaacgccgccgccggaggcggcatgtggcggccgcgctcctgccggagacggtgccgctgccgcgttctcgccacgccggccacgctatgcacggcggaggagcactcccagggtatccgcttcgtgcgtgccgttaacctcgacctccgactctccgactcatcggtaagtcattcctcccctacctctccccgctcaccagctgctcgacgaaatgctcccctacaaacactggagtcccgaacgcgcatgcgcataccatgacatagtacagtaatctgatctcaactcttccttccacctagcagtatgcatgatgatctggtctattcatctgcgggaacaattcctcaaaacaaatgcacataactagttaaaaactgtatacgattgctgctacagatttccgaatttgatcctagcagcctatagatagattggatggctatccattatatagcgccgtgtgctaggtccaataatgatccttatttcttaagtgatcagttactaaggtgcatgtgcaaggcagcgttctcttggtcaagaccaatctgttgtgacttgaagcccttatcatgatatataattggataacaacaaaaaacccaattaattaagctgccatggtgagactgtaagagtgaaaagaacgagaactagacaaatgggccaggctacgaatcgaagctatgattcatcaaatagatgctagtcaaggcagaaagatacaggtacatagagaattagatgtcagtcacccatgctgataaagaatgtctccatgttccctatatataggtgtgcaggagcaccaaccgaccgaatgcttattgtccatagaaatcctgatgcgttcaggcaaaaacatatcttgcctcgtaatgtgattggtgtcattggttcaatcaaacagattttgagccttgtttgattccctaacttgctggtcaatctggcgacacatattattggatgccatattcaggtctcagggcttgatcgtagtacaagtaatcacatgcaagctgcacgcagtttcatgtagcatgggcttcaaacttgtagaactacacaacatggcaccggggtccgggaacgacttgacctagctatgttaggcttgtgcatacactactaggctcgttttcatgtcgtcgctagcttgctagctaggccggctattagaccgtgaatcaaggtttaatatgatctattcattatgaaaatttgttattatagtcgtatcaaagattaatttaattacactcttttgacgagcacaacttatatgtgattagaagctacattttcttttctcccatgtgcaaaagattatcagacttctacaggaaattagggttgggatgggatgaaaccatccttgattttagggttgggatgattccactcgtgtgtttggtttgtagaatagtacgatcccagtttttttcttatttggttgaagggacgagagagggatgggatggacaccgtttgtaaccaccgatgacggccggccgggcgaaggagcgcgactatagcctggcaacaagaaggcggaggagaggcgtgagcaggcaaagcaaccatggccgccgtcgccgcctctgccctgacctccctctccaccaccgcagccgccgccagtggcaagcgcctcctcctctcctcccttggctccctctccctctccttcgcctcctgtggccgcgtcgccgttaggccccgtaggcgggcgtaggagcgcgacgacggacgggcgggcggatccgctgccaccgagtcccccgcctccagatctgccgccgcacccgtccccatcgccgaatccgccgccgccatccccaccacgggatccaccatcgccgaggcccccgctgccaccattgccgagcccgccgccatcgcccgagccgtttgcttcgctcgagcccgccgtctcctaagggcgagtcacgccgttcgctcatcccaggtgggacgagttcatccgccacatttggctggatcggttggtcccggatctgagagaaatattcttctccaggggactaacccatcccactcacctctaaactaaacacctctaaaagtgggttcgttccaacccatcccacccttgcaaccaaacactaaggagctaagcatgcatcatgcatcaatgagacaaacagtatagcttagccacctaacaaaatcagtatctcctgccttttcactggacaaaatgacaatcggccgttacttttggggtcacatggactctgattaataattaatcgaaaattgtgcaagggcataaagtaatgcgtgttagtcacttgtcgcatcgaatatcgttaaaaggtcgcattactgatagcaccatttttatatgcaatatgcttatcatcatcccatacttgatcagactaagcaaactaactgttaaacttcctgtataaatatgcatggagaccaccatgcttcacactccactccacactggcacactgcccatatccatctattctgaatagagcctctgcattgagttaagaactaatccgtttgactaattctgtttttgcacacaagtcgccataatcaccatgacaatggccatggcgtcaatgaagggagagaacgtcactgtatctgcagcagcagctcctcggatgaagaagctggcgagcatgctttgcatgaagggagggaacggcgatggcagctatctcaacaactcccaagctcaggtacgtacgacgtttccaaacacgagctttacagaaagcaggggcaaatcctgtgaaatgaatcactgggatcttaactagggaaactattctaatcgctcgaggggatgttccctcgtttgctcaaaaaccatctaaacggttatgaaaaattctaaaaaaatttgacaacattcatacaacacatatatacaacttcacaaaagtccaaactcaactcacacacgtcgagatataaaaaagacaaattcagcgtatgaatagtagcgtactgtttatatctaaatttgtcttttttgtttctcgatgtgtagatcgaatttgaacatgaattttggtggactagtaggtatcattatactttacattatcaattttttttttagaatttttcacaactattagcatcgaatttggaagaaaaatgtatacgagaggatatcccctcgaggtattagaatccactcctcttaactatacatttagcaaagaaaaagttaggatctgaactgaacccttgtgctctatgaaatgatcatgtggatgtttcaatcgtctaacacttgtgtttaatatattgaatatggctttcagttactgcaacaattttttttacaagtacaaaaactcaaaaattttctgaagatgtgtgcaaaacgacgagtgtttttgtcctgcacaagatatcagatgtagctagccatccaatatttagtcctactttactgtacaagtaaatgcatggtagttactataatacaggttaagaattgatagcgtcagtttttaactgtaaactggctataaataggctctgcacgcccggcgcatgcttcactttctggaggagacactggacgcgatgatggaacgttcgtccagcgacaagctcttcacggcggccgacctgggttgctcctgcggcagcaacagcctcttcatcgtcgacgtcatcgtccgccgcgtctccgaggcgtacgagtcccgcggccgcgacgcccccgagttccaggtcttcttctccgacctccccagcaacgacttcaacacgctgttccagctgctcccgccgctcctcgcgccggtggccggcagcctcgaggagtgcctcgccgcgggcgaaggcgcggcgacggcgacgcggccgtaccacgcggccggcgtccccgggacgttctacgggcgcctcttccccggcgagtccatcgacgtgttcacctccaccttctctttgcactggctctcgcaggtgccggaggaggtcggtgacagcgcgtcgccggcgtacaatggcgggcgggtgttcgtccaccgcgccacggaggccgtcgccgccgcgtacaagcgccagttccaggccgacctcgcccgcttcctgcgttcgcgggcgcgcgagatgaagcgcggcggcgccatgttcctcgcctgcctcggccggagctccggcgacccggccgaccaaggcggcgccggcctcctcttcggcacgcacttccaggacgcgtgggacgatctcgtccaggagggcgtggtcgagggggagaagagggacagcttcaacatcccggtgtacgcgccgagcctgcaggagttccgcgacgtcgtgcgcgcggacggcgcgttcgcgatcgacaggctcgagctggtgaggggagggagtccgctggtggtggaccggccggacgacgcggcggaggtcggccgcgccatggcgaacagctgcaaggccgtggccggggtgctcgtggacgcgcacatcggcgagcgccgcggcgcgcagctgttcgagcggctggagcggcgcgcggcgaggcacgcgagggagctcgtggagaagatgcacttcttccacgtggtttgctcgctctctctcgcgccataacagcatcgcaaacggatgcgtatagcagcatccgcatagtagtaggttcggtgaacccgttttgagtggttgcacacgaatttgctgcagctttctttcatttccttggcttccaatgaaacgagttctacgtgtacgtttgtaccgcacgtccacgtgcacagtgatttgtagttgtattccctctgttttatattatagctcgtttaattattttttagttaaatttgtttaagtttgatcaagtttttagagaaaaaaatatagtaacactttcaatataaaacaaacatattatctaaatatattcaatgttaaatttaataaaacttatttgatattatagatattgctattttttctataaacttcatcaaacctaaaagaaaacttagatcaagaaaaaaaatcgaacaacttataatatgaaacggagtactagtgagcatgcgtatttgaaacagatcgcttgattccatggttaaacgcaactacgcaaatatgattcacatagggaaattctggaagtgaaaaataaattcagcaaaaatattctacggaagaagcaattgctgtaccctctcgcagtcttgcttggcactgtacatgtattgtatggtgtgttggggagttctgtgactatacagcaaaatatgtgggtcaaagatccaggattatgcaatcgttctggaaataccatttatttgggaaatttggtcacgaccaaacagtaaattatcgtctcaaaccttacatttcacactgaacccggagaggcagagaattctctactgtttctaacttcacaagctaaaggaacatcaggaaataaaagtcatccgttcacgtgcttcagactaacatcttatcgcacatcggtcctctgtactgctcaaccaaataatgaccgacccttgtttcgttcaagccgagcctccctctgttaataataaaatacaaaggaaatgaagcatactcaactggaggaaatagtatgagaagtaaaatgttgtgatcattgatcaagcatatatagaactccttggtcattcttgtttatgatataaagaaagatttcgataggcattagtccagataaataaaaacattcttgcaaataaagctcatcccagcatctgaatatatttatgatatatagtcaagttaactttgctcgcaacttgcacgtaaagatcatataccagtttttacttgaatagatttgtcatgggcactgggaccagaggccgaggcccaagattatgtatcaaatatttaaacctgtacgccattatcgcttctctacataggtatttttcagactcaaatattactactgaatcagctaatgtgtttgagagagatgtaacaggagttcaattatcaactaacaattctgatgtagcagattgttgttcatgtgttctggcaaatattccatcacaaacaagaacacatcacagagaaattctaggtgaaagtgatgttttttatacaagcactaaaattgcacattgagggcgctttggaatcagaaaaaaaaaggtttaactcaggaagacggggaagatggagagactgaaggttcagatagacaggcataagatgacaaaatattcaggccacctagaggcaataattttatggtgagttcgtaatgggttcaataactgactactgtaaatatctacttctacggtgcaaacaattggttatacctgaggagaaaggaagtgtagatcaagtcaatagtgcttactagtctatggaaatcttatataatggcctcggatttttatcagcacatggaaggaggaaaattaacagacaagagcattggtaagataggataagaacaaaagcaatcacagtgataaaagagggccataaaattaaactctaaacagaaacagtttccaagcgtttttctggtgaaacaataactactaatgtttgtttgaaggattaacaatggtacacccatggagtcagggacgctcaacaatgtacttgttggtgaactgaatgaaggtgtggcacaccatgtcgcgctgccctttgggtaagcacatcctaattcttgctgtataccgagccattctacatctacacaatttcctgaatagttttgtttttttcaatatcatgtacagtggcggagtcagcgtgggggctggggg

SEQ ID NO: 57051 - DNA, 2170 bp, Oryza sativa
attagtgtccccattaagaccccctaaaatttaaatccatatatctattgcaagggggctaaaatagaccttgtctgagattgttagaaggtccaaaaggctgagtagcccccactataattttattctggctccgccactgatcatgtaggaacatgaagagcatatatagtcactaatattagcaccacatgacatgatgacagtagaggggaattatcatacacgaacaggacaatatggtgaatatgccaatgccactggtaaggtaatcagggtcatctttggccaaactgtgccaaaagttataatttaggatccaccaaaagtgcttaaggcatgtggccagacaaaaaaccgtcaacaagaacagaaaacaaaacatattgtcttgcacgatcgattggggtcgtaaatcatacagtaccatcactatttactttagacagattaggggaaaataggataatagcaatacctctctctttttgcacgccttgtagtcgtcgaactgctgctggcacttgctcttgtcttggttggcctccaaacctgaagaaccaacacgaacagaatcagagatcaaccacacacgcgtgaaaatccgagctctccacatagtatgatgactgcgaagggggtcaaggaggcggcgaggagatgggggtagttagatcaagattaggacggatgcatcatacacttgagggaggcggtgtactgggggaagcagtcggagtcggcgatcctggcggcgctggggtacggcggggacgccgccgccggcgacgacgcgcggtgggtggggggcgccgtggctgccttcgccgtcgccatgatgccttcttcctcttcctcttcctctctctgctcagcgttgcggggctttggatttttttttcttttttctttggcctgaatagagtccacatcggcagtaatgggcagaaatatctatagacgttgggccgtgcagcaactcgttttgggccggaatccagcccaacacttgcaagatgattttttatttcagggagttgctaaccgtatatatggggaaaacttgggttcatttgttactcctaaagtcctaaagaagtcatttggaagagtggaatcggccaaagttaaacaattcttggcatgatatcatggttggttggcatgatatttagcttcagaacaaaaccttgtacaatgagctaaatatcatgcaaaaatgtagtacacgatcaaatttaggcatacgcagttttcagaacaaaagaagaaaaaaatcaatgactgtatagtgtatacacttccaatagacatcttgtgcctacagatagaggccattagactgtgtacaagagctgagtcactgcgtcatagataactatttctttgttgattactgcagttgaaatttcgtcgaagtatacgagatgttgagttcctccgaagcaaactactcccgagttgctcagaatatcatctgattagctgccatctaatcgataaggtgtaagcacgaaatagaaaagacggagtgctatcatattgacaaagcaaagtcttctacaaaagtattaaactgacctggacggcaataattttgcagtctcgtgcaacttggtcaataaaaaaattgttttatgcaacttttggttcctatatataaacgtcattcgtccatagcaattcaaacttcaaagtctcgtcctgttcatcttctccaatgtgccctgtgaacggaaagctgcagctgcacgatggcagaactgcctaccacttccagcctgccaagttctggcagaatggtaatgtacaccttgcccttattgttctatcattgtctgcttgaatcatggcgaagttcataacttgtttgtcaaatcgtgtttggatctctgaatttggatggacactgccgctggcgaaactgaacagatccaaatggtacgatgccccttcttcctcctccatcattttcttttcttccattatattcagtcattcagaatgagtccatgcacgaactcttcactcttgtgagcttaaaaacctgtaatcgaaaggtattagtccacataattaagcatattttaccatacacaataaagtttggatgatcattgccaatcatcaggttgtcttggtcatgatcagcataattgcccagtaatgg

SEQ ID NO: 57052 - DNA, 2627 bp, Oryza sativa
gacagcaaggccgacgacgtcgccaagggctgggccggcgtccaggtcacctcccgctcgccaccatgcacgccggcgacgtcgccatcgatctgattcggcgacgaactgaatatcttgagctgccgtgcaggcgttcccgaggaaggtgtggctggacggcgacgggaagcagctgctgcagtggcccgtcgacgagatcgagacgctaaggacgaagcgtgtcgggctgcagggcacggaggtgaaggccggcggcctgcacgagatcgtcggcgtcgcgagctcccaggccgacgtcgaggtggtgttcgagatcccgaacctggaggacgaggccgagagcttcgatcccgactggctggatccccacaagctgtgcaaggacaagggcgccgcctccgcgcacggcggcgtcggcccgttcgggctcatcgtcatggcctccggcgacctgcaggagcaaaccgccgtcttcttcagagtgttcaaacaccatggaaagtacaaggtcttcatgtgcactgacctcacaaggtaattgaaagttgaaactcctccaagccaattaaaacttaaaatttgtgacccaaacgattaccaatttttgcacaattttcgctgaaattgcatacttgtaggtcatcgacaaaagcagatgtgtacaaggacgcttacggaggattcgttgatgtggacatacagaaggacaagagcatatcactcagaacactggtaaaattctgtcactaaaatcttagttcttcagtacgtaaaccatgcgcatgaactgaaatcgaacgaaaattcagattgaccactcgatgattgagagcttcggaggcggtggccgagcgtgcatcacaacccgggtataccctgagcacgcagcaacaagcagcagtcacctgtacgtgttcaacaatgggtcaggcacggtgaatgtgtccaagctcgaggcgtgggagatggccacggcgaccgtgaactctgcagatgcattggacgcaataacgcgtagctgaaacgtcttagtatgcatggcttggctaattcgatcaatggttactgtgctgtggccgatcgattttatcatttatcattcatcagtcacacgaccttcaaggccatagcctgcctgtctggaggtttattgccttattcccaggataaaataaaggttgtatgttacaaatgtttgatcggttctcaagttcacacagtgatggatgttgctattgcagattatattactcttaagtttttaaacgaaccgacactaacaccaatttcattgaatatagtaggagagaggatacttacccgtaaaaacaggaaaaagatgttatatacagagttttttccgtaggcttaccactctatttataaggataagccaagcgaagaattgttaatctttcatttggctctgaaaattctaatcacctgcaaaagaagccgcttgatcgatcgagtgcagcagaggcaaatggatctcttgtgaattgtgacagccaaggtttagtcaaaagacaatggtggtaggttgatgcaccgaagtaaacaaatattgaattactcagcagagctgatctgattagcaccgatcacaggttggtccgcatgcttacgtacaaatatcgtcgcattttatatgacctaatggtcatcagcgattaagaaaacattagtgcgcacatggtggcaggtgcttaattaacatgtattaaactcggagacttgtaagtcttctcaaatttgcaaactctactgttttgtttgatagttttgctagctgctgcttcactctactgttcggccatggcgttggctggattgcccctctccgtctttgccatcgctgtccatttttgccttgttttctcctcctcctcttctcctccggtttgccctgcaaacggccaccgtgaccgaacggcgtaccacttccaacccgccaagaactggcagaacggtgcgtatgcaattacctctctgagtttctgtgaattcttgcccaaaaatactatcaattcccgttctctgatagtgtatactgtattttcatttggatatatctggatgaactgaaccatgtgggaacggatgaaaccaattagatccgaatggtacgtgttttttttactgatactctgctcatatttctgtcttcttcaatccatggtaatttgtaccttaattagggcgtagtgaccattaggttgttcttaatatgatcagggcctgtgtactacaatggcatgtaccacctcttctaccagtacaacccgcacggcgcgctctgggacgtcggcaacctctcctgggggcactccgtctccggcgacctcgtgaactgggccgccctcgacaacgcgctcgatcccacagcgccattcgacgccaatggttgcgcgtcggggtcagtcaccatcctccccgacggcgtgcccgtcgtcatgtactccggcatcgacgcccgccgccggcaggtccagaacgtcgcgttccccaagaaccctcgcgacccgctcctccgcgagtggaccaagcccgggtacaacccggtcatccctgtccccgccgacgtctcgccggacaatttccgggaccccaccaccgcctgg

SEQ ID NO: 57053 - DNA, 23731 bp, Oryza sativa
  unsure (1)..(23731): unsure at all n locations
caccctcgaggactactacatggtcggacggtacgacgacgcggacgacacgttcaccgtgccgccggaggacctggaagcccacggcgatgactaccggcggggcggcggatcgaccacggccacctgtacgcgtccaagacgttctacgacgcgggcaagaaacggcgcgtgctgtgggcgtgggtgaacgagtccgacagcgaggccgacgacgtcaccaagggctggtccggccttcaggtcagcgcgcccgtcacgatcaacatatacaatggcaacgcaatcgcaaccctgtgtgctcagtgctcactggctcgatcgtgcgatctgttttatgcagtcgtttccgcgggcggtgtggctggacgagggcgggaggcagctggtgcagtggccggtggaggagatcgagacgctgaggcggaaacgcggcgttctgctcggcggaaacgaggtggaggcgggcgggctgcgcgagatcggcggcatcgcgggctcgcaggcggacgtggaggtagcgttcgagatcgcgagcctcgcgggcgccgaccgcctcgagcccgaccatttgcgtgaccccgacgcgctgtgcggggagaatggcgcggcggtgcacggcggaatcggcccgttcgggctgctcgtcatggcatccggcgacctgcgcgagcgcaccgccgttttcttcagggtgttcaggctctcgcacgggtacacggtcctcatgtgcacggacctgacacggtaagtgtaaaaaaactgacatcttactcgggctgggctaggagaaatccccgtattttgggccaggccgcctgaaggctgaaacgtttagtcgagatctcatgtctgttcttgggccaattttctatttgtacaggtcaacttcaagagcaggggtgtacaagccatcccacggaggattcgtggacatagacatagagaaggacagggctatatcgcttcgaaccctggtgagttcacttcacattttgagcgctcacctgacaaacatttggcactgataacatgctcgacctaacgaattgggcagatcgatcattcgatcgtggagagttttggcggtggggggcggacgtgcatgacggctcgagtgtaccctgaacatgtagcaacggggagcagccacctgtacgtgttcaacaatgcgtcagatgcggtgaaggtgtccaagctggaggcatgggagctcgcgacggctagtgtcaatgctggagacgacgggctgatttcgtatggtggtcctgtatgtgctgctcaagtgcagtaatagctgctggcatatgctctatagtactccctctatttcgaaatgtttgacactattgactttttagcacatgtttgaccgttcgtcttattcaaaaacttttatgagatatataaaattatatgcctacataaaaatatatttaacaatgaatcaaatgataggaaaagaattaataattacttaaattttttgaataagacgaacgatcaaacatgtgataaaaagttaacagcgtcaaatattttgaaacggagggagtactctgtttactccagcatgcacgatggccattcattctgaacttctgataggaaatagccatcgattggacgcagtgtgtttctaccgggcgcggatgaggtggacgcgcgcgagcggcctgctgtgagtagtgacttcaattgggaacaggataacaaataggtgttgggttgccggctgcgtttgatcgataggcggaatcgcaaggatgtgttgtgtacttgtgttggagatggcgagcattgatcgtgcctcggcgacctgtcaatcctcaccgggacggcgagaccgggtgcaatgtatgggctcatcgatctaaatcgggtagtaaaggaacaagttcatctaaggtcctttaacttgacaacgaatccgattttcattctttaaccaaaaacgtttttgatacaacggtccttgaaataccaaaaccaatacaatataggtcctaactcctaaggtagtatagtcggtggttttgtacgacgtggcaatttgacttgggtcagcgccgctgagtcagtgtagggcccacgtatcaattaagttcaccgtcttccctctcttctcatttctctccaggcctccaccttggtagccaacgggagaggtggccggcgacgagcaaccatttcggtgggagaggctcgcggcggtcgtcgagagaggacggtggagaggtgcacggcgggtgcaggctcgacggctgagggcggcagccagcggggagaacggtggggctgacgaaggaggctcacggcggttggcgggtagaggctcacggcaaccccttcctctttccctcatcgccacggccgtgcgctgctgtcggacgtctttatctgtgtgtagatctggaggtgaggaggacaataacgacgcagcaacttcccatcctgatttggtgtagatcttggacccagtcatcgccgcccctcgtcccgtcctgaccttgggcagcggcggaccttgggatgggagttgctgcgtgtgggtaaggcactgtcgccagtgtcccgctggatccctgttggtggattccgccagccgaccgtcctcctcaccacccgccgtcggccgccagcctcctcaccgcccatcgcgggccttctcctcaccactgtaacgccccgattttcgttcgggattaaaaagcaattaataatgcatttcaagaaattatattaaaagttaaatcaatttaatcaagtgaaattatagaggaaattaaaatttcctttaaaaatcattggccgagaatattttgtaatattctttgtgccctaaaatactctctggatttttttcgcaaattttcggagctcaagaaataattttaaagtaacaaagatcatttaaccaattaaataaaaagaaaacaaatttaattctccttccttcccttttgggcttgacccaagccttcccctcctctcccgcaggccgcgcgcctcctctctctctcggccggcccgcgccttgcgaaagtctactttacgtcccccggtttccttcctctctctccatccggccgacaggtgggaccggcggtcccacctgtcagctcctcctcctacctctcgccggccaaccccaaccgccattgccgcccacgtcgccgcaaaatgcggcgccctcccgcacccgagctcgcatccaaccacgtggacacaaccccctccacgtcctccaccttttcccccactcaccccgcaagaaacggcgccggtttgacctccccacgagctccacttcacctccccacgtcaccggccgatcccgcctctcccggccacgatctccatccccgagccctatataaagcaccctcgtgctcccctcctctgttttcccctctctcccaagctcccccatgcccggaaccccctcctccccgtgagcccaagcgccgccgctcaccggcggactccagccggccgctgccgccgctaccgccgtccccgtgccgcgccgcttgcatcgccggcctcgccgcgctttgccgcatcccgtccaccgctccgcttccgcaataaaccacccgggcaccgattccaccgtgaacccgagctccaccgccactttgccgactccggcagcgcgccaccgccgccctagccaccaccaagccacgccactgccaccgtcggcttcgccgcatcacgtagcaccccggcctctgcttcgttttcccgttccaccgcagcaacaccatctccaccgcgaagccgaggacgtcgccgcgtttgccgtcttcggcagcctcttaccgctgttccttgccacctcgcgccacaccaccgcctctactgcgttcgccgcgctcccccgtaccccggccgctccttcaccttcgttggagaccgccgaatcgccgccgtcgtcttcgccccgtggagcgccgccgcctccctccgcggccgctccctccgtcgccgcgcctctcggtgagccgcctccctcctccttttcctcttcgccggccgcctcccgtgccagcgccgcgttgcgccaccgccgccgccggttgtctggccgtctgcgcgccgcccggccatccccagccgtccgatctgccttggccgatctgggccgtccaacccgtggaccggcggtggaccgtccttgtggtcccggtccacggtggaccgccacctcgtctcgctgacatgtgggccccgcctgtcggcgccggccccctctcttgctgacgttagcggcagtccttttcctttgtgaaaatatttaataattgcgcaataaatcattaataattatagaaattcatttagtggctcaaaacttctaaaattcatatctaattcattcgaactccaaattgggccatttaaattgcaaaattcatctaaaattgagttctacatgtttgtttactttttaggtactgtgtccttcgtttttattaggtttttcctcgttttgcgtgctagcgtgtagaatccgtcgttttggaagatcgcggtcgcgaggaaaagagttcagaaaatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagcttgtgttactttgatgacctagctagaactatatgcttagccatgcttaattaccactagctcagtcgatgggataattgcagtattagacattctagtatcttgttgagctgcgtgctcgagacatctggccatgcttcatggtcgtaattatccaactaaaatgcgactgaatggtgggctgtgggtgcatggttttgctggtcgcacccatggcagttaaggactggttcgcgggatgccctggaagaacttatcgtacttaccacaagccagcgtgggcaacggctgggcttgtagtgtagctttcctctagtcaatgcatccaggcaagggtgggcgtgatggagcggggcgggccctgcgacggcctctgtcgcttccggattcacctaggcacgagaggggactgcccgttgcccgctggggacgggggtgtaacctaaggtgtggtgtgcttggctagagggggttatgcgaagggtcctgtcacggcctctttccggtatgtcgtggtggcatgtcggcgcacggaaacgtgtcgtggggatgtgtcttgtgggtacagttgtacacctctgatcagagtaaagctattcgaatagccgtgcccgcggttatgggcggtcgaccagattcaccgtgattagtcccatcttaataaatcgacccaatacactgtagttcaggtgggttggttggacctgttcaacgtggtgtagcgttgataagtggagatttaatgttactttaattactcaacagttttactgttttgctcaataaaatgttttacaactgcctttatgcaaatagccacaaaccatccttgtatccccttgcacatctgcattgttggtgtggcttgctgagtacggtggttgtactcagtcttgctattattcccccttttcaaaagtgtagtgcttctgagctgaagatggagttagaggaccaaggctcagaccccagttgagttttgcctgtggagtggagctgaagcctcactaggatcgcctttttccgctgctgtcgttctgtttcggtgtgaggactaagtgcctgttctgtaagtattttacgctttatttacgtttggaactgtatattacttgtcattttgtgtaccctggctggtcctggacagggatttaatacgcaaaatagtctggaaatttgggttaaatttctgggcgtgacaaccactctcccccttttctgcatcttccccatcgaagtaacggcggtggcttagggatggcgtggcgagcaccttctcgagctctacactaaccagcctcgtcgagctcccatgccgaagaagcattctcatatggagagctggttgctggagaggctctccaaggccgagtgcgaaatctcactgatggactagactgagaaggaagccaagaagatccaacaagaatacttcacagatgctatctctttcatgctccaaccacgatatgatcacctccgcctatcatgaaccccccaccgccagatgtcccaaccaccattggcgccgcagtcagcctcctccggctcctccaacaacgggactgtggtggccgttgagatgggaacaagggggaggaagggagataggtgacgaggccttgatatgtgggacccacactaactcaacactgttgatctgtgtcaaactgtcacgtcaaacaaaactaccaactatactgctttggggacaaaactaccatctatactgccttggatggtcaaagattaaaatatttgactcaagacaaacttagaacgatgagtaatttgaaacagaaaaggtagttctactctgtaaaaaaaaacaatcctagagcatctccaagagatgtcttgtattgggagtatcccaaaagatatcgggctaaaaaatcaccctcatctccaagagtatcccaatacgtgagtccaaaaaaaactttaaaatcttccatgtcatcactggtgggtcctcctaaattgatttttctttaattgggagtgcgtagagtacccaaaactagctcctatttggttggattttggatgtgcctaaatattggaacctcctttgggaacccgttgaagggttggttttacccttaattcccaaaatttaacttttaggaaacggattaggcctcccttatagatgttggtttttttattgggcggaagggtaccttgctatccagacttgcctacatcacatatgtatatgttgacaaaatattgataatgcttctataacttaattagattttggtgttaagaacattttgacaaactaacacaaacattttcttcaaccgtcacggcctatgggcttcaccaaccaacagcttgagacatgcaacctatccttggcctacatcaaatgatattttccaaataaaaacaggaggatctacccgaggcgctgcagattgacaggtgtttgcagatttttcgtgttgtagtttctctataaacgtccaggaagaattatggcgatcagcggcggagcttgaaacaaattcaagaaggggccaacttccatggaattctatggaatgaaacactaatactccctccgtttcaaaatgtttgacaccgttgactttttagtacgtgtttaaccattcgttttattcaaaaaatttaagtaattatttattcttttcatatcatttcattcattgttaaatatactttcatgtatacatatggttttacatatttcacaattttttttaataagacgaacggtcaaacacgngntaaaaagtcnncggtgtcaaacattttgaaacggagggagtattaattaattgaactacaagttctaaataaaggggaaaatataaaacaaaagtttttattataagagctataggaaattttgagaacagaagtgaaaaaaagtataaaacaaaggaaattttcaaaaggaggaaaaaatgggctctgtgtgatccgaacccaaacctgtagagtgaaaggttcacatgatgctaaccaactcaccaaagaaattcataatttcaaaggtgttttgctaacttatatatatgtctatgtgtgttgcattgtcagccaaccctgaaggggccaacaaccaggttggcctcccctaagctccgccactaaatccaataatttgattgatatgcctggtacagtgtcgttattacaacttgtacagtgtcgtgtattcgagtttttatgtttttgctacaaatatggataacgttagcactaaattttaaggatttgtggagtaaggtcaacatgtggctccatcagtactggttggtatagacgtttattttcttgtgttcattataggttgttttcaaaaggcgaaaaaggggcacccaaatctcagtattaaatattttctaacaattgtcaaaactggtggattcatactgctgaatatagagattttagctcctgttagtcttaaacattttcttcccacaaggataaatatcaacatttttgaaatttataatattaaattgacacataacatgtgtttattcacattggaaaaatataatatgataattttgtatattctttattatattagaatataaaagttagtggtaatattaaagttatatttcgagtagccaagtggtgtcgaaaacgacacctagagataggtcgaatgtctcttatccgcacaattgttcatactattaatacattaatacagtatacaccacctatatataatatattttatccatcagcttactggtggtctaacatgtaacgtgtagcactgtttttcctctgttgatgcagttcaccaacttccaagttccaaatcactggcgaatcgaggaagaggataaaaagggagtaaattgcattggtgatacatacacttgttagccgcgtgcaatttaatacatagacttgtaaaatgctcgttttagtacacaaacttttctagtttgggcgaacgagaaccaaaataacttggcaatgttaattttatgaagctgatgttgattaggatataacgtgcatacgtgcagtgagtatgtataagatatgcaatatttataaatttgatatctactttatctttcatcatggaaatgatgaatttcatatatttgtagcacttatatcattgctcagttttttctttatctttttctactatcactatatttgattcttttttttattgaagaggtgtatgtctcatagcaaccttttcagatatatatttacatagtatcctaattagcccctaatcaatcagactagccatgtagtatccttttcaccttcctccgcacgcaccagataagtcgttcatgtactaaaatgaacattttacaagtttgtgcactagattacacccacctgacaagttcgcgtaccggtgatacaatttactcgtaaaaagggctccaacttgcattgctagctgacttcttgttgtgcatactccatgtctagaaatattgctgcaatctactagctgcaattattattcctataaaaaatcaaagtgggtccacaccaatttgagccgatagatcgatttgatctcgatggttcgtgttcatcctcacatggtatttggtatactggactactctgtcttaaacaaatgaaacagaatttagttacgaacctggatacttatatgtctagcttcatagattggattaagaacttttttttagaacgaagggataggcatttgcaattctaaaatgtcacattacccttccaaagttcaaaagctgactttctaccagacgatgttgaacgaaatgacaccaattaccgtacgtgttcaaactgttttttttatatatatttcgattgaattcttgagtgttgcagtgacatgcgtgacgacaactcacctacctccgtacgtatattcatcgagctctctatatatgcctaatgcctctattatcagaagaaggggtgagccgcaaattataatcagcttgttgctaggtaatgccgtgccttacaagcatgcaagctgccaccattgtcattatttatctgggtagttctttcttcctccaaaaatataaggtgctcttagtttaaaaaaaattaacgttcatagcttttaactactattttagataatgtaagattttaactactactccttcatcccaaagtatcgaggattctatatgtagcactaagtcaaactatcctaaacaatactaatatttacaatcaaatgaacatcattagatctatcatgaaatatattttcataattacttctttaatgtggtatatattaatagggaaaattgtatatagtttgactttggacacctttatattttgggatgtcataggctggggatagatcatgcaggtttttttttttttaagaaaaggccagctgcccagcttttacagaaagccagataatgcagtagttaatcaacgacatggatcccatgtgatttatgggtattcacttgaattaattgcccaagaattttggtagaagaaatcatatatatactacctccatcccaggtgaaaaatggttgtgattggttgacataaaaaaatatacgatgaaaccaaatgagagatagttgaaatgaaaaaaagcaagtaattaattaaaaagtagttatattacgagaaaaatttaaatgttagaagtagctataatatgagacgggtagttctatgtctagtgtgcatgcatgtaataatataggtttacttaaaagccgagtgatcgcttgaagattaggagcgccacatcagcgatttttgcaaaaaaataccctgtgtttttgttaattacataccggttccctccaacatcgtccgttcgatctcacggtagagtccatctaaccgtccacgtgtctaacttggcggccctttttcagccgtgggatcgtcgaatcgcgaatgaacggcatagatttcgttcagccggaccaaatcctagttaggatgaaagatcaacgtatgcaacccaaagagataaaagaagccctttgtaaagtcacataagatcaaagctaatatagtaacgataaccagtggctccacgtcagcatgtttgccgcttattggctgcatgtgtacgtatttctgcgtgctatctactgacatcgtttaattttctattctcgattttttgattctatgattgattggtcgataggaagacatataacagcgttcacaactgggagaagctatctcctaatatcttctctttttttttcccattcccagttttggaccatctacgattggttggtaggagttcacacctaggagaaccggagaaggaaggctcagtgctgtctgccttgagagttgagagtatacaaatatctgatgtaataattactatagctcactgacgtaggtttattgtacctattctaattaaggcagctttcacctcattaagaccggtatctgttgagacttgagagtctagagtgagggtaatgctccacaattaataaattcccgtattatttaattcattcaaagtacacgtacgagaaaaccctagtccttgtactacaaaatgcgtgaacttttcttgtgatttacatagcggcaaaatcctgcagccgccatcaacagcacattagttggatcgatttttctctcttagaagacgaaaattctaacgctgcgattacagtatggagttatggacgttgacagtacaattgtacaaattgtggttgtggggatcagatctttcgtgtacccacatgcctagctatctcgtatgcacatccgtcccggccctctctcctctatataaagcattcgctacgactagctcattgtgccacaccacccaacacacatctgctaccatttttatcggaattactacgtacgcacgcacccgcctcagtagttcaagaacacatatacacacttcaaaaatcttgctagcttaaattactttgcattttaaccatacggatagattgatctaccgatcggctatgaagatcacggtgcattcatccaaggccggaagccggtgtacggcgacgccgtggccgctccgagcaccgccgacgttgtgccgctcagtgtgttcgacagggcgaactttgacacgtacgtctccgtcatatacgccttccgcccgccggctccggccaactccgtcctcgaggcgggcctcgccaaggcgctggccgagtaccgcgagtgggcgggccgcctcggcgtggatggcgacggcgaccgcgccatcctgctcaacgacgcgggcgcgcggttcgtcgaggcgacggccgacgtgacgctggacagcgtcgtgccgctggagccgacgcctcgggtgacgagcctccacccgagcgccgacgacgacggcgccgaggcggaggtgatgatggtccaggtcacgcggttcgcgtgcgggtccctcgccgtgggcttcaccgcgcaccacatggtgtccgacggccgcgccaccagcaacttcttcctcgcgtggagccaggccacccgcggcgtcgccatccaccccgtcccggtgcacgaccgcgcctccttcttcacgccgcgcgacccgccacgggtggactacgagcaccgcggcgtggagtttaagacttgcgaaaagctcgacagaaacgagaacaacgacgacggccatggacacggccacgacggcgaggtggtggtgacacacaaggtgcacttcagtagggagttcatctccaagctcaaggcgctcgcgtcggccggtggcggccagcgttcgtacagcaccctgcagtgcgtggtggcgcacctgtggcgctgcataacgatggctcgcgggctcgaggggagcgtggccacgagcgtgtccatcgccgtggacgggcgcgcgcggatgagcccgccggtgctggatggctacacgggcaacgtcgtgctctgggcacggccgaccgccaccgcgcgggagctcgtgaccatgccgctgcaccacgcgatgggtctcatcaaccgggcggtggcacggatcaacgacggctacttcaagtcgttcgacgacttccccaactccggcgcggtggaggaggaccggctggtggcgtcagccgacgcggcggacatggtgctgagcccgaacatagaggtggacagctggctgcggatcccgttctacgagcttgacttcggcagcggccagccattcctgttcacgcctagctacctgccggtggagggtcttctcatcctcctgccatctttttccggcgacggcagcgtcgacgcctacgtgccactcttcagccacgacatggacaccttcaagaactgctgctatgtactccctgaactcagctaattctgctggcggtcttggtcgttgactgcacgaagtgtcccatcttttttattgtgtctttcaaaacgtctattcatttctctaggggatgtcatcttgtttttccatgtcgcttaaaaaatcataaaagtttttaaaaaataagtaagaactaaaaaaattataagccgtaaaatccagcgtgggtttagaaagttttgatccctttgttatatggaaatagcttttcttcatatttgcggtgggtacattaggtatattagcgagtccatttcatcttagtgtctatccacctaaacgtccatgagattgttcgcttctgttggctgttgcagcggtagcggctgtggccattgaaaatggctgccagcggcagtagcttttggagctcccgcaactgcagtgggtgcgacaacaatcactaccgatcagcctctatataaaggattatgtatgggcaatattaaaactgtactttcaagtagtacattgttgtatttttcacagctttcgcagttaccggaactatatgtatgagtcaacaactactacaattgaattgtttgggcctactgccgtactcgttatcagtgggaaatcaatatgtggtatatcgttgtagaaacatgcaatgtttaaatttaacttatgcaagtagaaacaaatatactccatccgtcccaaaatataagcatttttagactctggcccagtcttcaagatgctacatagactaacaatatctataaaagtaggatgtttcaaataataaaagtcgtatattatgatagtttgtttattgataaatatagtaagatcagttttacatcattgacctttttttattttattgctatgaatagtcaaagttaaaaatctttgacttgacattattctaaaaatgtttatattttgggacgcagggagtaacaaattttgactttatataaaacttgtaattcgcagttaaatttattatttctgtttctgaagtataaatcgaatttaaacttctatgtttatgaaatgctatatcacatattgatctatattctttatttttttttcaaattcaaatttttcgatggttttttaaacgacatgtagttttgttcggtagatcccaaggggaagggattggaggggaacagagaggaatgaatagttcccctccaagtctccctcaatttgtttgtgggagggattaaccaaataagttctcaagagaaaaaaaaaccatctgatagtatcacagtagtgttcgatctaggtggctatctactcgtttgtaccaatccctgtcgtgataagtctattaagaggattgagtttgttattggccagaagggccttgagagtcattaaaatggagaagtttggataaaagaatgagttcacaatagagaattgtttggccgcggcacgttcacctcggcttatcaggaaacgagtacgccaaagtagcatgagcacacgtactggcgtacagcatatccaagagcagacatctcagccccagcccccaagtcccagcccaacaagcaagactgcaagataaaggtcaaaggctaacattatacacagctttagacccgaaaaactgttttaaacccgaaaaacgtacacccgttttttgcatgtcatctaaatagttatgaatttttttttaaaaaattaacatgataggttaatttttaatatatcacttcacaagcatgcaagttcaaattcgacttctataaattgtaacaaaaataacaaatttgactgtaaatatctgtatactagttagagtttaatttgttgtttttgttacaacttgtataagtcgaatttgaatttgcatgtttgtgaaataatatattacatattaacctatcttgtaattttttttataattatttaggtggtatgtaagaaacgggtgcacgtccacccgagatattagaatccatcctcctttagacccacaaggccacaacggcgcaattttttactttggttttcctttccttcagataaaatgaaccgcttgaaagctaccgatcgatcgtagtagtactacaatatttcaagtttttttttacagataactttatttattcaattcaactttcatcggcagaacatctcgcgtaattaattcaattcataataattgaatcaacaacatcaaacaaatactaattagctaactagtctcaatcaagtgatctagcattaactgcatgtcttgtttttcaataatatagttcatgcaaggctagtagtttggtctttgtcgaatgagtagcagcagttcttgaagacgtccatgtcgcggctgaagagtggcacgtacgcgtcaacgctcccgtcgccgaagaaagacggcagcaggatgagcaaaccttccaccggcaggtagctgggcatgaagaagaatggccgcccgccgccgaagtcgaggtcgtagaacgggatccgcagccagctgtccacctcgatgttcgggctcagcaccatctccgccgcgtcggccgacgccaccagccgctcctcctccaccgcaccggagttggcgaagtcgatgaacgacttgaagtagccgtcgttgatccggatcacctcccggttgatgagctccacggcgtgcttcagcggcctggtcaccagctcaccggccgtcgcggttggccgcgcccagagcacgacattgcccgtgtagccgtccggcaccggcgggctcatccgcgcgcgcccgtcgacggcgatgcacacgctggtggactcgcgcccgtcgagcccgcgtgccttcgtcatgcatcgccacaggtgcgccaccacgcactgcagcgtgctgtacggccggtgcgcgccagccgacgcctgcgacttgagcttcgagatgaattcccggctcaagtgcaccttgtttatcaccacctcgtcgtcgtcgccgccgccgccggacgcatggacatcctcgtcgtcgtcgtacggcttgaactccacgccacggtgctcgaactcgaccttgggagtgtcgcgcggcgcgaagaaggagacgcggtcgtgcacggggacagggtggaaggcggcgccgcgggtggcctggctccacgcgaggaagaagttgttggtggcgcggccgtctgccacgatgtgctgcgtggtgaagcccacgacgagggagccgcacgcgaaccgcgtgacctggatgagcatcagctccaccgcgtcgtcgccgctcgggtgcaggctcagcacctccgccgtcggcttcagcggcatcacgctgtccagcgtcacgtcggccgtcgcctcgacgaaccgcgcgcccccgtcgttgagcaggatggcgcggttgccgtcgccgtccacgccgaggcgccctgcccactcgcggtactcgatcagcgccttggcgagccccgcctcgagggcggcgttggccggagccggtgggcggtaggcgtatatcaccgagatgtacgtgtcaaagttcgccttgtcgaacactttgagcgggacgacgtcgccggtggtggtggggaactcgccggggccgtatgccggcttgacggccttggatgagtgcacggtgatcttcatgtgcagaatcaaatgtgctggtgaagtggtgagtatatacgttcttggactgcttaattaggccgacgtggtacgtgtccggcgaagtgtacaatcgtgtgtgcatttcctggatggtgttcagcctcatatatatatagcggtgttcaggaaattagggcactgttgctggagcctggaagcttaatgcacgtgtaaatcttcgcaagaggtcggtgaactttgcgaggctgaagctgaacagcaatacagcataattagtggcctagttaaaaaaagtactccgtactagttttggatatgcatgtgatttttctttgttgaccgttggagccttcttacaattttttaagcgatcgcaaaagaaaaatgtgttaattatatgcgcatgtgttcttacttggttggtgttctcggttcatcaaacctatacctacgtgatcttgctaataaagaagtattgataaatgataacaaggaataatttcttgtttaaaatgggttatatactatcacaaataccgtgacttcgttagaaggtagaagaatgtcactgactgagaaactactacaataaaataaaagacggagaaataaaaggagactaaggccttgtttggattttagtccctgtcatatcagacgtttggacactaattagaagtattaaatatagactaatgataaaaactcatttcataaccctagactaatttacgagacgaatctattgagcctaattaattcataattagcctatatgttgctacagtaaacatgtgctaattatagattaattaggcttttaaaaatttgtctcgcgaattagatctcatttatgcaattagttttattattaatttgtgtttaatacttctaattagtgtctaaacatctgatgtgacgtaaactaaaatttagtccctaatctaaacaccacttaaagataaaagatggagggaagaaatgaaataaatatcagacgttaaggcaatagtaaaggttcaccatatttcctttatagacataaaaagttattcaatccgtccctaatataagggattttggagaaatgtgacatttcatagtattagaaaatatcacatccctttaaaatcttttatattttgggacaaagggagtaagatgttagtcggaatatcatgcgtatacttttgaccaagttgagccagagctcaagattatactttcaatattgtttttttgacaataaattgtggaagtatattttctattatgcatatgagaaaattgtgtaatgacgttagtcgtgtaatctgcatgggtcactacactacttatatatacaacaaaatattagtgaagttattggaattagcatttttccgtgcaaaatcacagagctaaaaggtaaaattagatatgatatacaactgttagcttctaattttcataaatctagttgtactcactctgtatctaaaagattatagtgttcaaaattagatacagtcctaattagatatgaaaaatccactagttatacaattgctaagagcctatttgagggagcttctgacaactccatcatatcttagaatcaaaaactccctcaaatagtgtagttttttttatttagattataagaagttatagttagagaatctataaaataaactaaaaattcagattcaccagattctcagaagctgactaacagccaaatatttctcatgatcttaagtttcttcagaagggccatatatagtctccatggaataggtggtgattttaaaacagtgacggcgaatttgaagtaaactttcaaatatcattatccataggcctttaacaaagacagctaagcgagacgtggaaaattgaccggccggtctaagcatgggcgagcatatgagacagtaaatgtctaaattattgtgctaatagtgaattttcgctacgtctccaagtagatttgataagaacttctagcttttgtttttacagatacagttttatattgcatatgattgattccggaagtactgatatagtttggacccactacgatctaatggtgcaattttcttttatgtatcttaaattaatgtggtggtttttagtccgcacaagagtgaagatgaggacatctctcaataataatataactagtggatttttatgtgtagtttcgcatggggctacgctttcaatggttaactggattgatatacaactcttatacaatcattgatatacaaatcttatcgactttcaatggtgtgacatgctacgtcagtgatacgtagaatcctaaaggtgtcatgacaattttggacgggaatgacactataacaagtttggggatttaaaaatgttttttaagagtttagaaaccttattaataataactagctgggtggcccgcgcaattgcacggctagcacccatataaaattatatatttttaatatgattttacttaaaatttattaaatagttatttcgatgtcttaagattttgaaaaaccaaaccttatcatcctcgtatttctaattttatagtttttaaaagtcacaccagttactatcccttacttctatcatattattctttattagcttgcttgatctaccactgtttctatttattctccttggaacctttaaaaattggatctaaactatagagtttatcgtcctgttaggcttcatttttataatttctataagtcccatcaaacgttaccattatactcctctacaaccgtccactacataccttataattcttgtgtttctaatgctatagtttttaaaagtcacaccagttgctaccccttacttctgtcatattattctttattagcttactcgatctaccaatgtttctatttattctccttggagcttttaaaaattggatctaaaaactataaagtttattgtcatgttaggcttcttttttataatttctacaagtcccgtcaaaagctgccattatactcctctacaaccgtccactgcatcttctttttattgtcgttactatttttaaaatcgaacataattatcgtttaggttcatttttttactttctagaagttccgtcaaaacgtcagcgactttgtcactgtactcctatacggctcacccgctgccactcttatttaatgtcattgagatttaaaaatcaaacatgattattattgaggttttttatttttacattttgaagcccgaacctttaaaaatttaaccttatagtttttagagtttattgtctcgttgggtttcatgttttttttataatttttagaaatcccgtcaaacgctaccaccatactcctctacaacccgtccgccgcatactctttattgtaattgggattgtaaaaatctaacattactatcgttggaattcattttttttactttctaaaagacccaccaaccatcggcgggtctgccattgtactcctatacgaccctctcgccgcctctcatttttattgtaattaagattttaaaaatcaaatatgattatcattggggtttatttttttttactttcttgaagtcatcgccaaccgccttgaaccgattgcttcacgacctgcccgtcgtctttccttttaatcatcattacgattctatttggtgttttattaatagttttagatgtctcatcaaccgccaccactctgctcctctagaggcctgttacttaaataatcttgtcatttgttttagatggtcttttcttttaatagtttttttatcactaattttagttatttataaattgtattcctagttgaaatcttatttttatttttctaattttagaatttattttattttttgaattgtgttcttttgatatttttattttttattttcaatttcagttgtttcaaaactatattcctactttaactctatttttaatttgcctaattttggattttatattattttttattccgaattttaattaatctactattgggttcttatatgtagtcatgaaataatgcttatatttaaattccgaatttaagttgatgttaaattatattcctacttgaactcttattttcttttcttttttttaatttcaattttttattccgaattttaattaatcttgtattggattcttgtacggactcttctttcaatattccttatttttaattccgaatttcaattatttttaaattgtatttctactcgaactcttattttttactctttctattttcaaaatttattttatttttattccgaatttcaattaatcatgtattaggttcctatctggactgctctttcaatattgcatatttttaattccgaatttcagttatttttatattgtatttctacttggactcttcttttctttttctccgtattaattaaggaggcagtattgttctaatttttacatagacatgaattcgtttttaaggaacgcaagctgtggatcaatacattaattttaatatgagaaaaagttcaaatacttcatatagacaaaacgaatttaaatatcccggttagaaataaacttttccttttcagattggttagtttcacatatatgtacaggccgtttatttagtcgtattgatctcgaactctttttttactctgattcctaagtacgtttctcctttttactccgatttttactccgattcctatttctagtatgtttctttaagcttccgtggaaagatttccattagctgtacaactctgatatatttatctattagatctgaggcgctaaaatctagatatactatgatctaacggttaatatttttctacttttctccgattaatgtgggaatttttagcctccacagcgaacgtggtgccttcttttaaggctgttttaataatataatagatatgaccgcccatatactttatattttttagactaccatcttataggcagaatttacgtattcaacatatctaaaaagtacaattgtatgttatatataatactagcttctatttctaattatcagtatacaattatactttgtatatatacaactattatcaatcaatctccactgtcacaatctgacccatcatgatctaaccatgtaaatctttctctctttttctctggttaatatgaaatttctacacctcagtaccatgttttcaagcttaataatagataatagacaaggaatggatcgataaaaaaaatattgcaggaatttttgacgcaattatccattttatgcatgtccatgttcttagttactactcaattcgtttcatattatgatttgctttgattttttgagtcaaattttaagaagtttgatcaaatttataaaaaaacattttcaataaaattattggaatatatttaatgttagatttagtgaaactaatttagtgctataaatattactatatgtttctataaacttggtcaaactaaaaaaatcaaagtttcttatcatgtggattggagggagtttgagttttgtttttaaaccaaattcttagttactattttttttttcgaggacatatatgtttggacaaggtagtgaagtgtgtacttttcttatagtcaaatcgctctacaccaaccattccttagtcaaacttcttgcttccttgtaagaagtcaaatttctagcttggttttgccattcatacattgttgggttccatgtagtcgggcagttcagaattgctcacaagaattacgttcagaagtaagggcaaatcaacctacgtaaacggaaacagattaccgtggtaggtgcattgatccattgtccatagcaatatatagcatagtcaaagcataacagatcatcagcagaaggaggaaactgagttttcagtttctttctctaggcttcagtttgcatgattggtcaattgagacattcagtagtgctaagccgtggtagttgagtcttccaaaataattacaggtgagagcgactaacaggtgatgaagattgcgcgcggcgcgtagaatgtgttgcctgcacggtttcgtgctgcgcctgcgcgtgatgatttggtgaagtcttcaacaaagtttggtgagtcgcaactgccacggatattccagatcagcggggttgttggcctgagtaagcagacaaggcgacgtgacgaactcacgctacagttaacatgctgacgagcgaaaaatcgccggttgaatgtttggacttgtgatttcggttaacatgtccggatttggacgtttgaacttaaacagttgaacagatagacatgctcgtcgatatgatccgtgatttatattctgtaggtctccctgatagtaacatgtgagagaaaacgatgaggctgctagtgggatttgactaagacaataatacttgaacaagagatactatactgtactacgtacacaagtaacacaagtgctccatcgaatttcgaagggtgactgtgcaatatgcctgcaaggcccacatggcccaacttggatcaagccgccaaacaggcccaacaattgaggcccagtaaatcactaatctattatttgttcctcaatgccttttgccatgcgcagtcacagtgtcactcttccgttataaaactactagtaaagccatgtgagttcaaacaatgagttcataataataattgtttcttgatgtctagattatgcattatattttataataggagtaatagtataacgctattctaacttggaccaagttcgaatcagctattcagttgagctactttcttgtttccagtagagatattttcaaaaagataaatggtgtgtttttgtgcggaccttgtgtataagactttcctaaaatgttcagataaattaatttttaagtttgtaatacgttactagttaatagtattattagatcaattctcgtcctgtaaaaaacaacccaatactagatgtgaagacacattctagtacaaatgtgttatacacagtagtagtgcggctagtgccacaaggtgaaagtggcgatcatagtgg

SEQ ID NO: 57054 - DNA, 14308 bp, Oryza sativa
  unsure (1)..(14308): unsure at all n locations
caaacctacaaaggggtaatcgcactcttgcagcgacggcggacgatttatggcgcaaaccgataaagatagactaaactagggtaaagtagaaaacatagctgaaaagtaaaaggtaaaagaaaacgattcaattgtagagattgttgggggagagagattttcttaatcgaatcgaccttgccccttaaataggggttggtcttgcctactacaaatcctcctccacgtcaacttgggatagaaaccaatggaaactcgaaacatatatttttgagtaaggaaactcgagacctgatgaaaatagactcgggcttagactctgccggtctgaccggccacataccgccggttagaccggctttcaagccgcaatttgaccggccctgtagaggaaaccggcgactttcctaaatcttggcaaatttccttaatttgaacctacgtgttaaatttgagcgtaaacagttagacccgattttgcggttgagggagacgattcgatcaaagaccgagagagagaacgaggaaggccaaaattgacttttattcgtgtgccaaattttttttttatatacggatgcacatttgaagtattaaacgtagactaataataaaacaaattatagattccacctataaactgcgagatgaatctattaagcctaattaatccatcattagcaaatatttactgtagcatcacattgtcaaatcatggtgtaattatgcttaaaaaattcgtctcgcaatttacatgtaaactgtgcaattggttcttttttcatccacatttaatgtttaatacatatgtacaaatatttaatatgatggaaaagttagaagtttgatgagaaaattttgaatcaaaacacagcctttatcttcctcttttcttcctcgcttgtggccctgccagctcagtctggaccgtgagcagcagcttgtgctgcatgagacccccctccaaagcttcgcagcggcagcaagccaagccgaggagcgaggagctctgccgcatccacctcaatctctctcaccgaataactgatcaagccgccgccaacagcaaaagagacggccgcctccgcccaagagccgcacaacacttcgcctcctccaccgccgtcgcccgggcgcaaacgcggcgaataccctagctttcaccggctccaccaaatcccgagaattcgcccgcacccgagttccttggtccgaaattgaggtgaccatcgtcttctacccgcgataaatctcctttaccctctctttttactggcaagatcaccgtagctcgccggagcgactcccgcccacccgttcccccgccgccgggaagggaacggttggaatttcacagttaagatgcataaatgcattgttagatagattaactccaggggcaaagcttaggatagtactctattactttaactggtgatgcatgtactgaaattattctgaagactgtcaatggctcaagtagaagtagagctccaaaccaaagccaaaatccgaaaacaatgccaaaactcagagagtaaaataagaacttatcaagttcctgatggtcttcatttctcatccaatgtaggtccatggcaggctgttctcaaagagaagccacctgaaagctcaatgcataattaagtcaagggactcccaagatatagtaattgccaattctttctggaacacatgcgtgatagattattccctgacaagtttaaaaaccagaggccctgaaggtatgtcagctattttggggtttcaatgtaaagtgaaatgctttgtaaatcaatacctgtcattaaaccagctgttctctgtttcttcaggtcccttccaattacatttttcttactcttaatacaaaggaagcacatacttcatcatcagaaggttaaggaaacacagctacagatattgggcagtattccctcttgaaagaagttgattaatacaggacaccttctgcataaccttacgctgaatgtcatcaacaaagcagaaaacggcataccttaagttcccaattgaaaataacattccaaaccatagccaagacccaaaaaccactccagccatcacaaagtacgatagatactggtcctcgcatgttctacaatatctctcgtctgatgcaagtgcataatttgtgcatgagatgttcaacggaaggccacatagcccagaattgttgctgtagattgatgggtcagtgagggtttgaagttgattcccggtggatatcttgcctgatagatgattattcgagagattcagactgctaagggtagatataccggcaaggcttggaggaatggctcctgaaagttcgtttgatgataggtcaagagactcaagatttttcaaactaccaatgttctcaggtatgctgcgtgacagatagtttcttgacaagttcagaaattgaaggccttggaggttcattaattcatcagggatgcattgtgataatgagttacctgacaaactgatacccgtcactaattgaatatctattgcataagtctttatttcaaatatttgctccttccccttccagattgtattgattctatcatgattaaaagaccattgtaataattcccgactagatataagctttggattcttcatggaagtaagtttaccaaaagatctgggaatcaaccctgtcaaaccattgttggtcatgtctagcagttgaagttgagaaagctgtgacaactctgatggaatttcaccactgaagttgtttgatttaaggctaagaatcttcaatgatggaaggcctttcccaatccaaataggaatatcaccaaaaaaattgttattcccaatatctaaattgatcaacttcttgcatccctctaacgctgatggaaaaactccagtgaagtcattgctggaaagatgaatcgatataagggaacaactgtagcttgcctttgctgcagggatttcacctgagaatgcattgttggaaaggtccaagaactgcagattttgcaagtaccataggcagtcgggcagttttccagtcagctggttgttcgacaggatcagaatctgaagagagagcagtttgcagaaggctgcctgggggatccaacccgataaaaaattgctgctcaaatcaagtagggtctgcagctgaaccagattaccaagttcccttggtatcttccctgacaacctgttcttgctcaaatcaagaaatgtcagagcaccaagcttgccaagagcaactggtatcgtgccattaagcatgtttcctgacatatctattttctgtagcttagaattgttgcccaaacttgtcgggataggcccggaaaaggaattatggctcaggttgagattgaacaaaaggttgagatgacccaaatcaagtggaatacctcctgtcagattgtttccagccaagctgagaatctgcaatcttgtcatgctcccaaatgcttcaggaatgcggccggatatgcgattgccgtccatgctcaggagcgtgaggttggtacactgtccccagtcggaggacagctcaccagtaagcttgttgccggagatgtccaggtactccaggctggggtgcacgccgaaggcctccgagatgtcgccggtgaagtggttctcctctagccgaaccctgaacagccccgtgcagttcttcaggcacggtggcagcgtgccggtgaagttgttgtagttcaccgtgaagtgctccagcgcgaagccgtcgcagaggttccgtggcagctcgccagagaaactgttgttgctgaagctcacgtgctgcaaggctatgcccttgccgaggtccggcgggatggtgccgctcatgaagttgtcgaacacggcgaggtattggaggttcttgagggccgtgatggtggctggcagctcgccgtgcagaatgttggtgttgacgtcgaagctttgcaacgccgtcatgttgccaatctccggcgggattacgccggtgagattgttgaagaatagcgccaactttatgagctgcttgaggttgccgagcgagctggggatcggtccggtgagcgagttcaccgacaaatccagctctaccaggttctccaactcgccaagctctgccgggatggaaccgttaaggttgttcaggaataggtaaaggatttccagtttcctcgccttgccgagctccgatggaatcttgccggtgaacgagttgttctgcacttcgaaggatatgagctcgggccagctcgtgaacaacgccggtgggatctcaccagtgacattggtcgtggaaaggccgaactcctgcattgcccgcatccctgcaaacgtcggcggcaacccaccggagaactggttcaaggacaggtccagataagcgagattattaagattgcctagttgaggcggcaaagttgaaacaaggctagcgttcttgatgtcgagcctctgaagcatctggagctggccaagaaccgacgggattggaccgccgagctggttgtccccgagctcaagaatcctcaactgtgccatcgacccgaggaactccgggacgccgccggtgagattgttgccggccattcgcaggtcctggagcttcgtcaacctcccaagcgacgccggaatcgggccggagaacgcattgaaggacaggttgaggaacctcagattcgggagcatgtccggtattggcccgaacagagcattctgcgacaggtcgaggtaggtgatgctgccgctcctgaggacgaactccgggaagcttccattgaaggagttgaggtagagcgacatgaacgtgacggtgggcatcggcgagaacttgcggaagtcatggtcggtcaggtagtttgctcccagatcgaaatggacaatgttggggagacggcttaactggtgggggatggcgccgacgaggttgttgttgtagaggcgaagctcgacgaggccggagaggtcgccgagctgcggcggtatagagccatccaaccagttgctgccgagatcgagcaaagaaagggagcgcagccgcgagatgctggccgggatgggaccggtgaagttgttcctgttgaggtcaagctcggtcagcgccgggagcgccgcgaagtcgagcgtgtcgaggccgccgctgagaccggcgtcccggagccggagcgaagtgacgcggccggcggcgtcgcaggccacgccgcgccaggtgcagaccggcgcggcccgcgtccagccggacagcgcggccgcgtcgcccagcagcaggctggccttccacgccagcagcgcatcggtctgtgatgtcgctgcggtgaccgatgctggcatggcggcggccgccacgaagaggacgaggaagacgacgccggccatgcgagccggacggaggaaaacacacgatcgagctgatcggcacgacgtggcgatctcgcgttggtgtcgtctccaaagatgctggtcctggtcggtcaatattttgtaagtaaagattccgacttccgaggacagatctgataatagaatggctgactcatcttccgtccggtgtacctactagttcacggggatgactgatgagcaaatgatgctgtttgtttaacagccaacttgtgtgaacaaagtgtcttttcattattatttcatgacgaacaattagtatttgagataattgattttattatttagaaaagtggttcgatcaacccgggttttgtgtatcggttagacaaatattgtgaatagtgattgttgatgaacaagttttcggctgagtggagccggtcagaccggagttatgcgagcggacggtctgatcggctaaatttgtgtcggtttcagtttcggattatttatttgatattcatgattaatttatatttatgacttctaaatgtttattatatgtatataatactattgtgtactaatgttgagtcaagttggagagaacttgtgctcgaatatagtttcttgttgattcatgtgcagctgagtcttaatgcttcaggagagtgttgctggtgatggatcgggaatcaacttggaagaaaatgacgtccggacgattatgatattatgcaggatgcttaggctaaagaacaatgtacgtggttgataaaaattatttgtggcatatgatagggagattgtgtgtgtatgggataaggagtcgaatttggaaggagtccaaatttaatataattggagtttgtaaagtttgtgtcctgcatgtgaaggtttcatagtggattagaatttcttgtacaagttggttataaatagagagggggttgaggcctcccgatattgattttgacatagttgagtttagagaaaagttaatgtttcgagtttaattaaattttgtgggaggagtgatgttgttgcactttagaaacacgaatagacgtaataaagttcaatttacttttgagagatcttcaatttgtgtttgctcaggtttgacgatcataccggcgataagaccagtgacaccatggcgattggaccggcggcgatgacaggtgttggcggcgcggtaggcgatcagactagagcttcaacaccagttaggccggaggtcttcgattggtcagattggtgtatatactccggtcagaccgatctccatcagctacaaggataacttttaattttgctaaaagttttggtttttttgttactacaaccgttatcccatgtctgtttgggctcgattcttgctgtgcgatcctacaacttggtcatatcttagcgatcgattcagccaattatttggtttactactcattaaaatattctttgttttaaaaagacttagcttaatctaactactaccttcatattttaatgtatgacgccgtagacttttcgtccaacgtttgactattcgtcttattcaaaaaatttatgtaattatcatttattttattgtgacttgattcatcatcaaatgttctttaagcatgacataaatatttttatatttttacaaaaattttaaataaaacgaatggtcaaacgttgataaaaaaagtcaacgacgtcatacgttaaagtacggagagagtattaaacatcctatgtgtggcaatgactaatattggttgttatacttataaatatatgcagtgagttgtactcggattagctagcgcttaaatgcatgcatggtactactaactatcaggagaaggtccaattatttctttcttttttcttcagctcaggcatgtgtctagcagaacgggagaaatgcctgagctgtcacacatgtaacaattagtcaataatcagtctctcaagactcaaatagtatatagttatctcctgtacttaactactgctgcaaaagctagaaggtgacaaatggatggttcaacaccgatctgtctcaccctcaaaagaacatcgatctgtctctgaaataattaatctctttgcatgcatgtgactaactacattggttcgtcaaaactaattaatggtctagatagccagatcagtgaatgccaaggagaggaactgtgttcagtatcactagtcatcatgtgattaagtgatcattcggtggataattgaacactaaattatcaccgtttagatatacgcatatacttctcctgatatatagtataatgtattttttgtcactgtttattagatgagtctcatattagttgttgattgcttatggtactccctccgtttttaaattttaaatttttgacaccattgactttttagcaaatatttaactattcgtcttattaaaaaaattgtgaagtatgtaaaactatatgtatacatgaaagtatatttaacaatgaatcaaatgataaaaaaataattaatatttacttaatttttttaaataagacgaataaacaaacatgtttaaaaaagtcaatgacgttaaatatttagaaacggagggagtacattctaatagagtgaagtgtaccaatggttcttttattgaccggcagcgggcagaggtgagtggaggctggccagcgggggcgtcgttgtagcgagatgtcctcacactggtgggtgagactgtggcggtaactgtggtgggcggtcgggtggcagatgaaagcttggaccgagcttgttgacccagcaacttcaattatagaggtctgtttgatacagctctaactcctaagagttgggtttggagtagagnngtgnancngcntnnncccagctccacaactctagtttattttgtgagagagttccacccaactccacttccagtttttgtgaagctgaaactgtttagctgagctcaagctccagctccaaaagagatggaggtggaggtggaggtggaggtggagctgtgctaaacaggcccctagtgccaccctactccaccttcggcttccctactccaccttcggcttgacaagacccgccaagccaccaccgtagctcggagtcactgcatgccgccgaggactctaccaagcccgctgcttcctctgctgcaagctgctgctcctcaccgtagccatggagctatggagtattgtccttcatgtctgtcattctgagaccggaggaaggaggggataatgagcttctgatttttctttattttcttttttttctggctgtaccaccacgtcaatgtcatgttgttatatacttatatctcatgactcaacatggattgactagtcaacacgtcacaaacacgtcacatagtacgaaaccactctaagaaccatcaaaggacgtacattgatcagatattgatagttgagagggcattcatatctgattttatggtggaggattacgaattagattcatctactagttaagagagtcaaaatagatttttatttccttttgcttctcattgttgacctgttttttgctcagaaaagttcacttaccatccctcatctttatttcgagtttaatttgcttggcatgccttaatctcaataccaaaaatctatacacctaaattatacaaaaccgaacttgggtctcgtagtagtatagatcccaatttcccttgttttctcttacatgacagatgttcaggcccatttgtcatcctcaaaagagaaggagaccttgacgtccaaagggtgccgcctaggggaagaagcggaacacgcacagggaagaggcaccatggatcgaggacggtgaagctgtggaccatctagaggacaaagggacggtaggtccccatcttgacctcccggacattgaagtggaagtcgaggagggccttaaggagggagctcttcccatccgactagctgccgatggccacaatctctaaatcgggagcttctcgtcgaatgcgacagtcaccgcttacagccattgtacacctcaagccgcgctttcgagtcgaacatcgcggcgtcggcgacagtggcaaccaccgtcccctaacatttatcgtgttgtgagccctcgttgaaacacagcgactgcattggctgaaccagaggatggtgcgatgacacgtcaggcttgccaatggtctccttgtctacaaatacatgagcaacagcttcctcgtccaccagcggtcgaagccgtttcgcaacggcaaggcgcggttgcctgctgcactgaggacgaaggcagacgctattgctaagagggggagggcgccaaggagatggagttacacgctaggaaaaaaaagggggggggggggagggggctaccgccggcatcggttgtggtggggaagtaggagagatcgggaggcggagtagcggagcgatgacgagcgccaattttttttctctcggtgatatggtggtcgtagcttggttggttgacaagtgggcccagacatctacgatgtaataaaaaacaaggaaaaatgaggtttttactgtaattaatcggatctaaggctgcattcgtggtgaggtgatttagagtttgtttgtttcgttttccgcgtgtacgcttcccgaactactaaatggtgtgtttttttgcaaaaaaattttataggaaagttgctttaaaaaatcttattaatccaattttgaaatttaaaatagttaatactcaattaatcatgcgttaatgactcacctcgttttgcgtatcttcccaatcttctcaatcctcttctcgaactcaccctaagttacatggtttttttataatttaggagtgaaaagatatatggtgttgagaataagtgatatcaatcaacttaacgaaaagttagctgcgaacaagtcgacttgtcccccctccccccggggtgctgatacgcgatcagctgcgcgcgcgaggaggcgcgcggtcaatcgccccccctctagtctctcatatatactatatgcatcatatgtatatacgtgtgcatatatacataatatacatacatattatctacgtttgatgtcgcaattctggtatttgcatagtatggggatcgtcggtactagggtatacgcgagactgaggtaaaagagatggagacgaggatttttatacaggtttgggtccctgagcggtcaggtaataaccctacatcctgttggccgaagccggtattgctcttattcatgataatcacaccagtacaatgtttggggtaacctatctaactgttgtcgacatggcggtctgacgatctgactcgtagtcgacaacaggatagccttccacctcgaattcgtgctcggcgagatcaaagatagcactttcgtctctcctgacaatatccgaagacaccgtagggtactagccgtgcttatccttgaagtcgatatccggcggcgtgtcttggcgtatgtaggcttctgtgttgattgcgttgggtgttgatcctgtcaggtgttaatcccgttgggtgttgattgtcttgtcccccatggtggttgttgatcatgttgatcgtctcatatcatgggtgtccccctgtcctcctaggggggcttgtatttatacccacaggtttcctcttgtccaagtagaactagggaaaccaatatggatacaatccgagtagtccttgtcgtttccatgtagaactctggttgtctttccttatccagaactccctccatatctgaagtcagtttccgtataagacatggtatgtggtggatcctgcggagatttagtcaactactattaggtatgtggtatccataaccctgacagtagcccccaacttcgatgcaaatgaatgaattcatattctcaaccgcgcgcagacattagagtaactgttatcgagctcatgtgaccgttctcggtgagtttagagataacgttgtgtcggtgacatgggaccggggatatcttgactagaggtttggggcagccgcggtcacccacgtggcctgaccccctcgggggggtcgggcccgagggtgatgaggccgcccctccctctatctccccgaggggttgggccgctcccgtttcgtccccgagggctggggcgccccgaccccctgagggtttggcgccacgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacagaccggtcagatcgcgggttaggtggcaacaggcggcctttcgcacgcctcgccccgtcccgtcgaaatgatgagagcctctaggcactcgtccctagacggagccggcgtgggaactcctggagttagcacgtcggtcccggctagattcataccaggcttcatcgcaaccattacaaggaagtcattttatgaagaagggctgacgtgtggcatgctaaactgacacgtggtagacaagaatgaccggtttgtgactggtctgacgccggtcacgtcatcagcaaacaaccgtgcttccacgttgcacctgcttccggcggagtggaggttggtatgacccatcccatcggagggtcattcggacagcagccattgcaaatctccgcccattaatgagggaggacagggttatcccggtgtcaggcgaaggtacgagccaagttttggtcaaagtaggatgggtccccacccaaaagaagggtaggtagaaatggtgtatgtggtatccccttgagatataaaaggaggaccatgcctaccaagagggggactggagaaaagaggagtgagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaccattccacagatcaagggcttagaacctcacccagcgcccccggccgaaccggcaaaggggggcccgcgcggtctcccggtgaggagccccacgcttcgtcacgttggacttcctttgtcagcctcgtgcgggcaccgaaagggtttgtctaagtcaatctttgatgtcgaccgagaaaatatagagcgtacgactaagtctcacgtcttgctgtaatcgagaatttggattgaagtcaagaaattttatctcggcgggtacaccatttcttcattccgtattccttgtcgagatctagcaaccgttctcgagcgatcgagaaggcgtagagtctgcgatagaactttgtcgacatttgtcgcactcgccttagtcaatcttggtttagaaccatagagacatggagtcctcgataatgtcgaatagaattttcctaaaatcaatactcagaaaagaatattagatagaaatagcccccgagcgaattctcaaagggtgacatgttataatatgacagactagtgaattgaatgtacagactagtgttttgtatatgagcgtcttctctcttaccgactccgatcagtcagtttgtagagtcatacactctccttagcccccagccttgtcgtcggagaatcgttctcggatgtcaaggctcttggacctttgacctgcctcggttgaacaagcactgatcctagtccccagccatgaagttggaaaactcaatttccaattacacggcttggttaatacgcacggcgagaactcttacacgaccaggtcttacatggtctttcgtctctgaaggatccaacaaggccttatcggctctaggcgtccctagccgaagttccctcaggttcatcggaggccttgtcaagacggcgtaaagggacattaggataggtttcaacgttaggtgtcatctgggtaagggatctctgggtaaaacccttggcgatcttgtgcacctggtatcaactttgttgaagcaggggtagtgggagaaacaaacgtcgctggtcgaggaccagacagtagtcgtaactcgaccactgaaagtagaagtagtgggagaaacgctacatcgatggttgaggaccaggcagtagtcgtaactcgaccactgaaagtagaagtagtgggagaaacgctacatcgctagtcgaggaccaggcagtagtcgtaactcgaccacttaaagtgaggcgagagagatcactacattttgctggttcgagaaccaggagtaggagtctcttaatcacctataggggcgctaaagttggtttattacatgtgcatatcatgtggccagcatgactcacatacccaacttatagcatatccggatgtccgctcgcaatcatgtcgggtgatcaagccgacggtgttcgtgaggagttatccgttaacaaccttttctcgagtagtccagcgatggctagcgctatgagataggtcgtcggacttctttggtaggttgggcgcgacgactctgcatttgtcgagatcgttctcgataatgcggtgtactcgaccacaatatactcgagtgctcaattgttcctgaaaaatattttctagaagcaagatatatagcatgggatatcgagtatgtactcaaaaactgcatggatcttctagtattatcaggatataatgagcagatgtaaatgtcaggcattatgtaaaccgtaaacaagcatgatttatacagaagaaaatagagcgagccccctacgttagaccgtagtcgatttaacatcggggacactcgcgcaacagatattattgtataaagaacatgctctaggtaaacataataaatcatggatctgacaatgatgtatgatctgaataggtacgataaattgcagataaaatattgcgtacctttgtagatacatgccggatgtatttacgaaattagtagatcaatttga

SEQ ID NO: 57055 - DNA, 1283 bp, Oryza sativa
cgacgtttgatgtcgcaattctggtatttgcatagtatggggatcgtcggtgctagggtatacgcgagactgaggtaaaagagatggagatgaggatttttatacaggttcgggcccctgagcggtcaggtaataaccctacattctgttggccgaagccggtattgctcttattcatgataatcacaccagtacaatgtttggggtagcctatctaactgttgtcgacatggcggtctaacgatctgactcgtagtcgacaacagggtagccttccacctcgaatccgtgcccggcgagaacagagatagcgctttcgtctctcctgacagtatccgaagacaccgtagggtactagccgtgcttatccctgaagtcgatatccggcggcgtgtcttggcgtatgtaggcttctgtgttgattgtgttaggtgttgatcctgtcaggtgttaatcccgttgggtgttgattgtcttgtcccccatggtggttgttgatcgtgttgatcgtctcatatcatgggtgtccccctgtcctcctaggggggcttgtatttatacccacaggtgtccccttgtccaagtagaactagggaaactagtatggatacaatccgagtagtccttgtcgtttccatgtagaactctggttgtctttccttatccagaactccctccatatctgaagtcagtttccgtattagatatggtatgtggtggatcctgccaagatttagtcaactactattaggtatgtggtatccataaccctaacacacatatatatttttatgaatatatttcaatgcataaaaatatattcacacagacacaaagtttgtatacgcactaaaaaataaaaaaataaaaaaaaacatcacatatagaaagtttgtatacgcacatataaactttgtatatgtgtatacaaactttgtatacgtgtatagaaagtttgtatacgcgtatgaaaagtttgtacgcgcgtatagaaagttctatacgtacgaatacaaacttggtatacatacgaatacaaattttgtatttatacattaaaaaagaaaaaaaccaaacagaagagaaaccagaaaaaaacaaaccgaacgaaaaaaccggagaaaaaaccaaatagaaagaaaaaaccaaagaaaaaaaaccaaccgaacagaaacgataaaaaaggaaaagacaaaaaaaaaaaaagaagaagaaactcgctcctccctcgcggcgtgtccgccgccccctctccgcgcgagacaagtgcccaatcgtgtgcg

SEQ ID NO: 57056 - DNA, 13788 bp, Oryza sativa
  unsure (1)..(13788): unsure at all n locations
ctttaactggtgatgcatgtactgaaattattctgaagactgtcaatcacaaaagttatatccttcatcaactttgtattcctcgttgctacttgcttctgtccctgtctaatactccctccatctcaaaatgtttgacgctgttaatttttttaaatatttttgaccattcgtcttattcaaaattttttatgaaatatataaaactatatgtataaataaaagtatatttaacaatgaattaaatgataggaaaagaattaaaaaatacttaaattttttaaataagacgaacggtcaaacatgattaaaaaagtcaacggcgtcaaacattttggaacggagggagtattattatttttcccattggctaagcaataaacttgtaaatgcaagacagagaagagaaatgaaaattatgacaatgatatataattctgtcaaggaaaagcaacaggggtatattatttggttgctggtttgcatctgaagagtacttagtgcgtacatcttctgcaatttgcatagcttctttctatgtggtcaacaaaatgaaaaacaaaatctcttaatggcttaagtaaaattagagctccaaaccaaagccaaaatccgaaaacaatgccaacaactaaagagtaaaataagaacttatcaagttctttatgatcttcaattctctgatccaatctagatgcccggcaggctattctcaaagggaagccacaaaggcccaaattgttgctatatattgagggatccacaaatgtctgaagttgtcttccggtgggtatgcttccccataagcggttatttgagagatttaacacactgaggcatggtatatttgcaatggttgtagggataacacctgaaagctcattccatgataagtcaagggattccaagatattcaaattgccaattctttctggaatactgcctgaaagatcattccttgacaagtttagataccggaggccctgaaggtatgttagctcttttgggatttcaccgtaaagtgaattgcttgataaatcaattcctgtcattaacatagctgttccttgaaaagtttcttcatgtcccttccataatatgttaaatctgtctctagactgatcaagagggaacggataatcgtatcctcttgaaggggcacttttccaattaaaagtccctattgtggggaaggtttttgcttgtttcatggatgataagttggcaaaagttgttgggatgaatccagttaacccattgctggccaaatcaagaagttgaagctgagaaagttgggataattctgtgggaatctctccactgaaattatttgatcggaggagaagaattcttaggacaggaagactagttcctatccaagagggaatcttgccaaagaacttgttgctccacatatcaagcgtaacaagtgctctgcagttgcgaatggtggctgggaaaactacagagaaactattgttagcaagatgcagagattggagaggaagttcagggcttcttgatgctggcaattcacccgagaagccgttgccagagacgtccataaacagcaaagcttgcaactcccaccaacaccttgggagctcaccattgaatcggttatttgatagatccaaaaactgaagagatgacaatgtacaaaaggtcgaatcaaggttgccggatatgctgttaccgttgattgacagatatgtgaggttggtgcactgtccccagtcagacgatagccgaccggtgagcttgctcccggatatgtccaagtattccaagctggggtgtatgccgaaggcatctgagatgtcgccggtgaagtggttcccgtccagccgcacccggtataggcttgtgcagttcttcagacatggcggtagcgtgccgctgaagttgttgtggttcgccgtgaagcgctccagcgcgaagccgtcgcagatgtggcgcggcagctcaccggagaagctgttgttggtgaagctcacgtgctgcaaggctatgcccttgccgaggtccggcgggatggtgccactcatgtagttgttgaacacggagaggtactgaaggttcctgagggacgagatggtggcagggagctcgccttgcagacggttggtgttgacgtccaacctttgcaacgctgtcatgttgccaatctcaggtgggattacaccggtgagatcgttgaagaacaacgccaaagccgtaagctgcttgaggttgccgattgatctagggatcggtccggtcagcaagttgtttgacaaatccagctcttccagattctccaaatcgccgagttctgccgggatggatccgcaaaggttgttgctgaacaggtaaaggattttcagtttcctcgccatgccgacctcttttggaatcctgccagtgaagaagttgtactgtacttggaacgatatgagctcgggccagctcgtgaacaacaccgaagggatctcaccggtgagcccgttcatttcaagtccgaactcccgcattgcgcacatcccggcgaatgccgggggcaagccaccggagaggtggttcacggatatctctagaaaagtgagattcttaagatttcccagctccggcggcagagttgaaacaagcccagcgttctttatcttgagccgctgcagcatctggagctggccaagaaccggcgggatcgccccgccgagctggttgtcaccaagttcgagaatcctcaactgtgacatcgacccaaggaactctgggacgccgccggtgagattgttggcggcaatcagcaggtcctggagcttcgttaacctcctgagcgacgccggaatccggccagagaattcattgttggacaagttcaggtacatcagattcgggagcttctccggcagtgtgtccggcatcagcccgaacagagtattctgcgacaagtcgaggtaggtgatgttgccgctcttgaggatgaagtccgggaagctaccattgatggagttgtcgtaaagcgacatgaatgtcacggtgggcatcggcgagaacttggcgaagtcctggtcggtcaggtagtttgctcccaggtcgaagtgggcaatcttggggagtcggctgagctggtgcgggatggcgccaacgaggttgttgttgtagaggcagaggtcgacgaggccggagaggtggccgatctgcggcgggatggagccgttgaacccgttgtcgccgaggtcgagcgaggcaagggagcgcagttgcgagatgccggccgggatgtcgccggcgaagctgttcccgttgaggtcgagctcggtgagcgccgggaacgcggcgaagtcgagctcgagcgtgtggaggccgccgccgagtcccagtccccggaggcgcagcttcgtgacgcggccgccgccggcggcgtcgcagcccacgccgcgccaggtgcagaccggcgaagcccgcgtccagccggacagcgcgaccgggtcagcgaggctcgacttccatgccagtagcgcgtcggtctgctgggacgatgctgcggcattgactgatcctgggatggaagcgatcgccacgaggagggggaggaggaagaaagggtggacgacgggggccatgcggagtaaaacaccaacgcagtgatcctgcattgccgtcgtctccggctatgccttttcgggtccctctttcaaatatgaatatatgatggtgccaatagctaactatatataaatataagtgatttatttttttttagataatggaatataacattccggtctctactcagaacgagctacaaccaattattacaaagtagcactcaaagaaagagtgtagtttaaattaaaaagaacagaccaaacaaaagcagaggaaatatagccaaaataaggagaacacgtttattcaattctatttgtaaacatatttattcaagtttataagagtgatttattagttcgtaaatattttttggtgtgattatcctactgatgattacacactagaactagatccagtgatccaccggaatgcgcgcacacataccgcacgtaatgcctatagcataggcgcatatgggaacaaattttaacactaaagatctgagatttgaactgggtgttccaccacaggaaccttaaccaacttaactagcctttatttggtcgttgttggtaacgattctaattaacttccgatgatccaatagaatggtcacgatcaacccatttttgatcgggtgtaccgtgtacctatatcggttcacagggagtaggcttcaacgcggtagacgttttgttccgaatttttctatagcaaacctgatctaacgatacaatgaattttttctattcacgaagaaaaaatatttagaatcgcaatgctactattaggggtgaaaacggtacgaagatttccgagcttttcagctgccgtttccaatttgcactgtctgtttcagtcggtatcggtaaccaacggtgatagaaatggaaacggttatatctttcggaaatggtagcggaaatgggatggatgtttttccgaccgtttcatcggtaaccgtatttgtatggtaatttccgtcaaaattccgacagttcctcaacggctcaaccagcccaatctatctgaagcccataaatgaagaaagtctgataggcttgtcctataaaaatttcctaaatctaaggatagaatctaaagatagggaatagaataaaaaagctgttggtgatgctattagatgaataacttaaaatatataataacctcaagttagttgggtcactcaaccaaacaacccctaacaatatcaccagaatcccctatttgacttctgcttaattcgcagagcgggagtggctaaaacgtagcccgtgcggtggaggccaactattcaggccaccagcgagaaatgcccagaagttttctggctagcttcacaaggtggtgggctagaggatctggatttaaaggctcaccccttctaattatttgatattagattcttctctaatattcgagttttttttattcaggccaccagcggcaccgcacgacgtaacgaccccgcgtcgccgtcgtctccggcagtcgcatactcgcactggcgcactgctagtggactagtgtcgctgccaccagtggtgtgcagtcgttgctttgggtgctcgtcgtcagtgccttactcattacccccactgatccagttttgctatttaaaaaagatagattcttggggtgaatggccgggtgtaattttggtgcatgtatgtattaatttgtacgcttttcggcgtgcacatatattcattaggattcgctaaaattcatgcacttgtaaacggtggctgatgcaggatttctagcatgggtattcaaagttacaaagtagtattgtttaacacaactaaaaaaaatcagaatattgtacactaaactacacaataacataataatatttaagggacctatattggacgttgttctttcaagttctttttttgaataagttcacctgacgtccctcgactttatatcgagtttgtatcaggtcctcaatccccaataccagaaatctttatccttaaactattcaaaaccgtttaaagttaatcccaagactctataggccaaaaattcccctagttttgctgacgtggcatatgtcgggccccacatgtcagtgtgtcgtggcattacatgacgctacacgagtggttgtcaccgccggtcgccgcggcgaagaagcctaatgagatcgccgcaacaccgccacttgcggctgctccggtgacccggagcatgggaagggagcggcgcggaaaagaaggagaaggataagggctcggagaagaaagctacggtgttggagaagcaagccaaggcgccaccggccgcacccgtaccgtcgatgcccgttcggcgccagcgctgtcatcgccggagcaccctcacagggctactcgccgcatatttgagggcctgtcggtgctggtgcgggggcgccgctgtcgaggaacccccgacccggacttcacgctgttgcgggcggatcaagcggcccctcaccggctgtcgaccccgccgcctgatctgaaggatgagcgcgcggctgctggctccatctgtgctgcctggttcattgccaacaccgtcgttcggatcccggcgccgcccaggcttgccggccgcctccccctccccctcgaccatgctcatcgcactgtcctcgatgcccgcctccccacgccatgcctcgacctcgccggtcgtgccaaggttgtcaggtgcgggaagtggctacggtgacggtggtgcgcgtgagcgtcgttaggtgcggtggcagagctcagccggtctcaccggccgcctctaccccatctaccgccactggcctcccgtgaagagaagagaagagaagaaaacagtagagagaaaagaaaaaagacaagagaagaaagaaaagatgtggacctcacattttttcttctcacttatatgtgggccccataattttttaatttttatttgtgctgactaggataccgcgtcagcgaaactctcagagatccatactgttatcgactctagattgcacggttttgtaaagtttaggggtgaagatttctggtattagggattagggatgtcataaactcgatgtaaagttgagggagggatggtgaacttatttcttcttttttctggcccagtctggcccagagccaatccggccgaaattccctgccccctgcaggctgcagcctttgctcttgctttgctgcctactgggctgctggcccgctctgccttgttgatcgatcggctgctctccgtcgcctttgccgagtcacgcgccgcagcgcctgcgcatcgctcctcatcccctacacgcgacgaatctcccttttagcctctatttttcctggctagatcgccgccgtagctcgctcgccggagcgactcccggccaccgcaccccctctttgctcggttttagccgccgcccgcggccacacgccgctggcctccttccagcagtccccgttcaagcctaccttttctgaaccgttcacagctagtgatttgtaagatgcattgtcaagttaattccaagggcaatcttaggatagtataactggtgataataaatatataatgaaattattctgtaaactgaatcacaaaaatctatcgttcatccaacattgtattccttgtcgttactatccctgtggagtatttttatttttttcataggctaaataataaacttgtaaatgtaatcgccatataattccctcgtagaaaagcaatacttcttagggcaatagcagtgcgtctacggaaaatgccgatcctcaatacttcttagggcaatagcagtgcgtctacggaaaatgccgatcctcatgtgccacgtagactaggaaccctattagccacatactccacagtgcaggtcacatatcacagtattgtgggtcccacctttctctcctccccttttcatcttcccgttcgtctctctcctctcttcatccctcatcggcagaagaaacgaaccggcgacggcgacgagctgcgcggcggcggtggtcatggtctcaagcggcggcggcggcggcggcagcagttgtggtcgggagcagcgtcgagcggagcggcggcggtcgtagttgctgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgctcgctcgctcgcctcgcctggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgtgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcagcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgctgcccataatctcaacagttgcgagaggcgccgagcggcggggcggcggcggtcgtggtcgcaagcagcacggccgcggcggtcgtggtcgggagcagcgccgagcgtccggcagcggtcgagcggagcagcggcggcgccctatcctccatccccaacaacggtggcggcggcctggatcgacctcgagcttccgtccccgcttcatcccttccggtcctcgtccgcggtggctagctgcatcgccgtcgccggcaccctctcctccacccccaacgacggtggcggcggcgtggcccaagcggcggcgcggatcaacctcgagctcccctcccccctcccccttcttcatccctccgattctcgtccgcggcgccggcccggtcctcgtccacggtggctgcgtcgccgtcaccggtccggtcctcgcccgcggtggctgcatcgccgtcgccgtcgacggccggtggtgtggatgctctcctccttcggtccttctctcttcccggatgggcacggcatggcacacgaaattgtgtgggcccagaactgtggttttgatgaggaatgagtagcacgttttggctccccgttcttggtgaaccatccaaaagtgctgaggtgaaggggaatatctgagttggctagttgaggctgaatgacaccttattgtattgtaaatggccttagaaataaactgtatatatattccagcagtcctctttcttcttctatgaatgtaactaagcatattctgagaaatcagaacggacgacagataaatgtgtgtgatactgtaaatgaacgggcagtgctcctgcactttgatacaaaaacgaaaagaaaaagttccattttactcccttgaactatttcacgggagtacttaatctcctaaactatttttaactcattttacacccccgaactatttaaaacagtccacttcatcccctaacactatttatcttctttagttctcactatataagtcatattttgcattgaaattttggtagaatatagatgcatccataacttaagtctcaacattcttctttgattttttttctcactgtttacataggttgaaagcacttcaaactgatttaaacatcagaattttaaagttcaagcaaacgtcatgaaaaatttcaaaatatttttgaactttagtaattgtatcatctatggctctaataaatttcagcttaaaatataacgtgtataaagagtaaaaaaaagaaatgttattaaggagtaaaacgacatttctagtagtttaggggataaaacgagaaaaaatagttcaggggttaagatatccattgaattagtttaggagagtaaaatggactttttttttcaaaagaaaataaattatatgatgcatgaaaaaatcccttcaaaatagaaaggttgcggtctgcagacatcagacaaccacaaccagataggcatcaagtacatcatggtagaacgtagctgttctttttttaaaacaacccgctagtgcgacatttctattgataaagaaggaataaaatataagtctatagtcctgagagactatagtaaaaaaaaagaaaatatataaccacaccacgcatctgcgtctgatcctactgctaaatactgaacaaacacacaatacccctaaggaataagtcttctaaacgatggctccaaggaggaaaatgacgccaaaagcaccaccgccgcccatcctagagaaccaggatgtggttttcacttgaagaacctcttgggaaacgatagaaaacgcaacaacgtcccaaggtgaaaacggtgcctgtaggcgtcgccgttgccggcccgaaggctaggccttcgctccttgttctactctcccgcgctaaagagtgcatgccagattcaacagaaccaccagctaatccccttcgacgtgcagccaccgcgccgacgtctcgctgttggctggccatcaaagaagagtctcatccttcatcgcgcttcaatccatccacgtggttgggttggaaagggagagaatgagagagaagaatggatcccctctcccccgtactagcctgtccagcgtgaccatcttacggcggccgccatcctggctagctgctcggttctctagcggcgcgcttcggtggcggtgaggggagggagaggaggagagaggggcggtggcggcggtgctaggttttcccctgagccacccgcgcgtgggcgacgcggtagcacagagttgataaatgtttatgttctccataaagatgatggccctgtttagatccactgacaaattttttcaccctgtcacatcgaacgtttaggcacatgcatgaagtattaaatatagaaaaaaaaactaattacacagtatgcgtgtaaattgcgagacgaatcttttaagcctaattactccatgatttgacaatgtggtgctacattaaatatttgctaatgatggataaattgggcttaataaattcgtttcacagtttataggcttattatgtaattagtttttttattagtctatatttaatattttaaattagtgtccgtatatatgttgtgacccgctaaaactttacaccactggatctaaacaccctgatatttatcttttagtaaagatgcatctaacataccaagtttttatttggatagatagaatcggagttatttgttgcaaaaatgaccaaaacaaacatccctataaactgacagtggtatattacttggttgctgatttgcatctagcatatccactgatgtgatcacttatttatcactaatcacttagaatttattttggggtaaaataaaaaagatgctctaacttcaaaattaaaatatactaactacaccttgatgtgatctcctcctggcctggtcctctcgctctctctctctctctctctctctctctctctctctctctctactgaattctgatccaaattcgctgtctcctctgcagctctgctcggccgctctccatcgccttgccgagccacgcaatagtagctctgcctctgcttcatcccaagctttgccgcgccaacaaaccaagccgacgacaagctcgacctccattccatgcgctcgagctatgccgccaacggcaaaagagaccgcctccgccccgtctacctccgcccgagagccgcccagggcttcgcctcctccatcgccgtcgccggacgcaaacgcggcgaaaaccctagctttcaccggctccaccaaatcccgaaaattctcccgcacccgagttccttcgtccgaaattgaggtgaccatcgtccttctacacgcgatgaatctcctttaccctctcttttactggcaagatcgccatggctcgctggagcgactccaggtcacccgttgcgccgtcgggaacggttggaatttcacagctaagatgcattgttagattaacgccaggggcaagcttaggatagtactctattactggtgatacatgtactgaaattattctgaagactatcaatcacaaaagttctgtccttcatcaactttgtattcctcgttgctacttgcttctatccctgtgtaatattattatttttcccattggctaagcaaacttgtaaatgcaagacagagaagataaatgaaaatcatgacattgacatataattctgtcgaggaaaagcaacaggggcatattatttggttgctgatttgcatctgaagaatacttagtgcatacatcttctgcaatttgcatagcttctttctatgtggtcaacagaatgaaaaacaaaaactcttaatggcttaagtaaaattagaactccaaaccaaagccaaaacccgaaaacaatgccaagaattaaagagtaaaataaacatatatcaagttctttatgatcttcatttttctcatccaatctagatgcctggcaggctattatcaaagggaagccacaaaggcccaaattgttgctataaattgagggatccacaaatgtctgaagttgtcttcctgtgggtatgcttccccataagtggttgtttgagagatttaacacactgaggcatgacagatttgaaatgcttgcggggataacacctgaaagctcattccatgacaagtcaagggactccaagatattcaaattgccaattctttctggaatactgcctgatagatcgttccatgacaagttcaaaaaccggaggccccgaaggtatgttagctcttttgggatttcaccgtaaagtgaattgcctgataaatcaatgcctgtcattaacatagctgttctttgaaaagtttcttcatgtcccttccattgtatgctaactctgtctctagactgatcaagaggggactgatttttgggttctcttctgcggtgaggcttgggaacctggggtacttctggctgaaaaggactgctttccgcgttaaaatattctgtcgctggcaaggtttttgcttgtgtcatggatgataagttgccaaaacttgttgggatgaatccagttaacacgttgctggccaagtcaagaagttgaagctcagaaagttgggataattctgtaggaatctctccactgaaattatttgatcgaaggataagaattcttaggagaggaagactaattccaatccaagagggaatatggccaaagaacttgttgttccccatatctagggtaacaagcgctccacatttgcgaacaatatttgggaaaactccagagaaactattgttagcgagatgcatcgattgtagaggaagttcaaggctttctgttgctggcaattcaccataaaagtcgttgccggagatgtccataaacagtaaagcttgcaactcccaccaacaacttgggagctcaccattgaatcggttattcgatagatccaaaaactgaagagatgacaatttacaaaaggtcgaatcaaggttgccggatatgctgttaccattgatagacagataggtgaggttggtgcactgtccccagtcagaggacagctcaccggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57057 - DNA, 18027 bp, Oryza sativa
attcctgcagcccttatagggttatatttataatgttataatttcgataatacaacatattttcgagtatctatatttttttcaaaaataagcgtgaatattacgagtgtgaattattcgagaatagaggaaatattttattttgatgcatgatcttctgctacaggaaccgaggatcgaggagtaggatcaaagaatctatggtttctttctatttttttacatatttatagtatattattttgtccggagttgatgcatacgctagccctgtcgctgtctgccatctcgttatgctgatggtgagctcatgtgatcctatcttgcgacctttttcagtttgaagataagagctgtggattgataatcaatttctgaaaacaaactccacggttactgtcgaagaaacgtccatggttaataactagtactagcaaccagcaaatagtttggtctaagacggcaaaacagactgggtttgctgactaataaggaccaaaaaaggaaaattggcatcgatttcttgcctgtttttaagcactaaacggattaacgagggcgtaaggctacatgcagtcgctttcgctcaagaattccaacgcgtaaacaaacaactagtgcgccgcataatgcaagctgatcggtcaactagcggaagccccagtacctgagttcaaaacggattattgacacttgactgacagtatcattgtggagtacgtagtattaatcagagaacatagcagtatcattgttactgctatgttctctgtgttcgctcctctggggcaaaggaaaactgtaatcctccctttgaggtttctgcttctagtttttttctttttctgctattctccctctcctctcttgctctgtaagacacttattcccgtttctggtaatagaaatgggggcagtgatgccctagctctaaaaaaagagagtattgttatcaaagttagtcgatatagcggaatgacgactaaccctcccgatcgtttcagtcattgatcacccaagacatgccagatgacgacacaggaacacacgatatttgttaacgaggttcagccgaagcctacattcccagggctctgattatgggcgctcctccccaaccaatatatctcttagccgctacgagtccatggccaagccgccatcctctccctgcgtgtctatgctacactgtagtcgccatggttacattgtggtgtccccctctctatttaagagagttgccgggttatagagtccgactctaactccacccctaacacctattacaactccaagtccaactgtaaccaaataggactagtatattcgacacctattctaacaaactctaccttggcgaatatacgccacccagaagtagtagaatcaccatgccaatccatctgtcctccagacttgggttgtttccttttgcagcttcaccacgagccgcctgacgagcctgcgccagacccgccgccttgaagagactccgctatccctgcaatttcttcctcttgaatccacctgcaacagtgctccaccttcttacctatcatctcagtcgtcttgccaagcgaaattggatttcttcctagctgtcacatcatagactccccgaagaccatgttcacctccatcttccatcttaaatttgaattgatctaatccatggccagataacctatgtcatcaccaaatagataaatcaaactcaccagacttgaagagaaccatttcttccttgttgtcttatgaaccgagctaataaatccaacatcctcgctttcccgcatccgtagactgaacctatgatactttgagaaaattcactgttgccttgaatcccttgaagaaattaacaccatagcgcttgcttttcctcttcagtgacgcagatttccatatatcccccatcatgccgacctgcatatcctggatatatcctgtattgccaaacagtttcgttgaccccatcaacgatatttgacccgctgttgcccgggatcttttttttcccttcagttctggtctaactccatatatctcaactcctcgtcgagtcccatatatatcatgtctgccagataattccatatgcgacctgaccgacctgtcgccgccagtctattcgccattgtcacttgcaaactatccagaccgtagaacctttttgcccttcttctgaatccgctcacaagtttctgcaacgaaccaccggtccgttgaacccggtctaaccgtccaagctccgcagtctaaccagtccgtcggtctaaccaccctgccggcccagtttaaccagcctcgatcctctctggaccgaatgccacatgatgtaccatctcctaagtcaccgtagaccatacaagttccgtcttagttatcatggcagcaccacaccaattgcccctgcgcctgtgcatctctctactgaatcaccaccaccttaattatgccaaccaatgcgtcctagactcctggtagccttgcacgctttgatctccacgtttaattagcaccaccacacagctagcttattggtcttcctggctccctgccatacgtaaaccaatgttgcacagtagtataatgcatgcacgtactatggcagccaacatatgcttgcatacacatgtaaccctatcataattaacgtgaccagcaaaagactactactctctccttttttcttggtccaccgcctgactttgtggaggttaacaccggtccatgcactttttacacatgccactacaagaaacttgttaatccataacggattcttggtgacggattcataaaccgtcactgacagaggcaatccgtgacgataatttgttttccgtcatggacgtgcactagtggatattcttggcccgttaactcgtgacggttttatccagatcgtcacagtgtgtgattttaaaatcatcacggtgtgacgataatcaaaaggcatttcaaaacttgttttgcttgaaaaggatttgaatttgaggttcaaatgaatttaaaaaaatgaaaagctacactctctcttggaccatttctggctcactctctcctcttgggctcgggccagcctccctctcgcgctctgccccttcagctgggccagcggcccattttccacatgggcagccaagacaggctagccgcaggccaccctgcgccttgtaaaaaaacaagaaacaaaaaaatgtagccctctaggggactcgaacctacgacaacacgcacagtattcatgaggaaaccccactgagccactgaagcgttttgccaaacgacgtgcactgtattttatatatcaaactgtagcaggtaatggacctgccacctgctcgtggtgttcatcataaaattcacgagaatagctgcagatttttacttttaatgcgtgtataaaaatttaaattagtttatctccctcatactaacttcaactttaattattcttttttataaaattttctaaactcatgatctatccatttattgtgctattacaactattatttttgtcatactttcatgtgactttgttttatcaattgaagatttaaatttcaaaaagtggcaacttcaaacaacattttgaagcagtaaatgattgcaaaacaaatcaaacccaaaagacaaattttttttgaactaaattattttgttactaatttgttacttgtatatgttgcatatggtaaaactgaaaatatttgcatatatatagtgtgcgaacaaaaaatatttggagcttgtaggaatttaacctaacacctatagttatccagcaacattcatagctacttcttttagttgattatgtatgcactcacttatacttttcactacaggaaatatattaaaagttaaagcaatttaatcaagtgaattaatgaggaaactaaatttttcctttaaaaatcatggccggaaatatttttgtaaaattctaagtggtctaaattattctctaaaattttccgtgaattttcggagctcaataaatagttttaataccacaaagttcatttaacctattaaaataaatggaaaataaattaaaatatctctctgtccttgggccttttttggcccaagtgttactctctccctccctcagcccgcagcctttctctccgtcctgggccggcttcccattcccctccttcttcttcgggctgccagcctagcccatttgctcccccctcgccgagaagtccattttgcctccctcttctcaattaatttcaaaatataaaaaatccgagtcaaattttatcatactaaataaacttatgtgaaaaagttatcaaaaacaaagttgtataacttaattagatctatcaattttattttggttatttctccatctgactttgattgacctatataaaatttgaattttaaatataagaaaaatcaaataatttttctggtagtaaataatttgaaatgaaaaaaaaatgtcaacaacaaagttgtatgacttatcaagatctacaacttttgttttggtcattttgctatacgacttcatttcaataatttgaatttgaatttcaaattatgacaacttcaaacagcagtttcaaatactaaatgatttcaactgaaaaagtaatcaataacaaagttgtataaatcatcaatatctataacttttattttggtcatttcttcatccgacaaagtaataataacattatttataaaatttacatatctctctcatagtttataaactgtataagagatatgtacattttgtgaataatgttacaattcgctttaacggatgaagaaatgacccaaataaaagttatagatcttgatgagttataccactttgttattgatgacttttttagttgaaatcatttagtatttgaaaatgttgtttgaaattgtcataatttgaaattcaaattcatattgttcaaaccaagtcatatagaaaaatgaccaaaacaaaagttgtaaatattgatgagttgtacaactttattgttgatgactttttcagttgaaatcatttattatttgaaaatattgtttgaagttgtcataatttgaaattcaaattcaaatttttgatacaaagtcatatagcaaaatgaccaaaacaaaagttgtagatctcattaagttatataactttgtttttgacatctttttcacataaatttatttagtatgataaaattcgatttgaagttttaatattttgaaattaattgagaggagggaggaaaaacagacgctgggccggcggcccgaaggagcagcgggcgccaaactttcagtgtggcgggatgttgatcaaaatttcaacgtgaaatgaccattttgtccagatattttagtggtaacttcggatgcaccatgggtattttagtaaaatcgcattggttcctcaaccctagccgatccaaatcagataagccgccaccacacgcgaggcgctactgcagatgagaccgccggcctctgtctccgccgctgctgggcgccggcctccgtctccgccgccgccgggcgccgctcaccgcgccggcttcctcccccttcgccgcttgccgtgccggcatccgtctccaccgctgccaggcgcgggagcggtggatccgctgccgccggcgcctctcgggcccggagggggcgtgcagcgcagcatccggggcagccaccggtgacgtgaatcgaggtggaagaagcaccggcgagggagagctccgacgagtcctcctcctcctccttctccggcagcaggtcagggcgcagatcccctcccagtagcgcgcctgcttcctacatctcgcgagctccgtccatcgagaggctgctcgaggaggacgacgcactgctgcacgcgtgagcatagggagcacggcaggcgatcatggtgggcgaggacggtttgacacggatgaaaaagaagaggagaggcgccagtctttctatctttgtttcttgcattagttttcttggcgagttttgacgcatgtgcctcacccatgtgcaggagggcggaggcgggatctgctactgtgagagggactggtgattggtgaagcgccccaacttcgactgcgagcgaccgcatcccaactgtaaccaatctctctctatccgctgatgctagttgcttatcaaagttcctgaatctgatgaatgcagaaacctctaatttagttaagcaagtcaattcatgctgtaacaatatgatctctgacaaaaaactgaattccttgtttctgcaaatgcaagtgcagtcataaataagaaagaatattcgtgaaagtttcatagaaactagataaaaaaaagaaagtgttttagataaaaaaagaatgtgtttattttcagaaatccacagttgctatattttcagatatcttcaaaactgaataatgttttaatccatttgccaacaaaaagaaaaagaggtgcagaaaacagcttacttgggggataccatggatcatgcttgatttgatcagctcaacggtgatttgatgctatctagattcatcctttttttttaagttcaacactgtacacatttgctggacataatgcatatatgttgttttcagcgtgacaaatacaatgaagaagaacctaatgcatttgatttgttcaaggagttccactacagcaagaaaaaaaaatgctacaccactgctgtacaataggctattgtaagataagtttcaaactttgctctttgtaatgcttatttttaattctctcatcaacaacaatgtttgctccttgcttgctagactcaaatggaaaacaagctgtctacaagttcgatgaagaggactcaatctgagatggaagcggaaacttaatcttttgctcagtcaagttcgatcaagttaattcatgcatgatgctatatcttttgctactacatgcattttgctgctattgctaacttgtgtcaagtcaatttttgactaagctaagctatacatgcttgcattttgctgccgcagcattcattaagctcctagacttgtatgcattgcttggaatctctatttgttgttggcttgagccatggtaaactgcaaggttgtatgcactttgagggcccctttgattcgcaggataggaaaaacacaggaataggaaaaacacaggaattgaagtagtatgattcttcaatcccgcaggaatcaaaaacataggaaaaaatgaaaggtgccctttgatagtgctataggaaaaatacaggatttctcttccggtttgaatttgaacagatagccgttggcgttcaaagcaagtactagccgttgcatgtccttatatatattgctgtagctgcaactggacatcaacaaaactagctcacctcaccttcgattgtatcggccaagcatgacaagagctcaaacgtggcaattcatttggtaagtcataaatgaattttttttctttttggtatgtatgtaaggattagcaacttatttgcttgcttctgctctcctatatatattggtagaccaaaccatcagatttattatttgttgttgatttcccctgtgattgtcatggatccaagttatcgacgacggtcacagaatgaagatgagttcatgctttttgttctccctaccatcgaaggagattcgtcacaaccatcatctagtaggaaaccgatgcacacatcaaaactttcaggggcttgtcgtgttaatgaaatcttaacaggtcatcagagcctaagcaaaaggaattttcgcatggaagttaatgtttttcgagctttagtcgataagttgcgtgagaaacaactacttgctgatgcaagagatgtctcagtagaagaacaagttgctatattcttgtatgcactagcaaaaaatgcaagtaatgagaccttgcaagatcagtttcaacacagcgggcaaacaataagcaagtattttggggttgtgcttgatgcagttacacaacttacatgtgtatatatacggccacctttcctacacccccatcatatcttgagaagaccaaaatttcaccccttttttgaggtatgaacagattcatgttttgattttttttttactttgagttaaaccaatcattgtacataaaaagacttaatcaaggttatatttgtatttgtatagaattgtgttggctctattgacgggacacatgtaccaatgatacttccactagaccagcaagaaccataccggaatagaaagcaaacaatttctcagaatgttatggtagcttgcgacttcgatctgaaatttgtacatgtacatgccggctgggagggatcagcttcagacgcaagagttcttcaagatgcactaaaccatggttttgaagtacctcctggtaaattttttcttgtagatgctggttatgcaaatacaacacagtttctagcaccgtatcgtgggacaagatatcatttaaaggaacagggcagagctaatcaaaagccacaaaattataaggagttattcaatcttcggcatgcacaactcaaaaaccatatagagagagcaattggtgtattaaaaatgagatttcctatactaaagaccggctcacaccacccagctcgtaaacaagttgatatttcggttgcctgttgtgttctacacaacttcatacgcctgcataatggagatatggtgtggccaagtaattgtcgtttggagattgatccagatcatattgttgatgtgccaaatggagacgagaactataatggtgatgtacaagaatttaacaactctagagaagctgggaatagaaaacgagatgacatggcacaacggatgtggaaccattacgtagcacgaaggaaataatatattgcatttgaccaccatggcattcaaggtcaattactagtcttgtactccaagtttgtcacattctacttaatgaagtaactacttgcatgcactccctctaagcaaaagtatatcctactactatctgcttcacaaaagtaccccctttgtttcacaaaagtactatccttctatttgcatgccatctatttcacaaaagtactatcctactacttgcatgccatatgtttcacaaaagtactcactctaatgctgcgatttcctttctaatccaagccaggcgtaatgcatcacttgaaaaggacaagaaaacttccctattatccttacctttgaagatatcagctgccaccaatatatctcctatttgtagaccatgtaaaccttcaagcactgtgatacacttgttgatgctgtaaggatcctccaatttcttctcctcaattgcagcaaatcgatctatgtcttcttttttaagttttaggtatctctcatgaaatccatcatcaggactaacagatttgatcttttgtttcttcccaggtcgagattcaggaacctctgaaggtgtttgtgccgagctaggtgggacttttgtgagatggacaggggtaggtgaatgctgtgaaaagtccaaattggctgtctcaacctcttcaccaaaaggaaattgcaaacctgattcacctggagcatttgaattaggggatggtgactgatatgtatcaaccgcatttgcttcttgtgttgaatgagctggtgcattctttgtcttccttgcataatggtccataccatggcgagttctcccttcagcataacgacctgcacaattatattctcctcacgatcagcataacttgcctaaaacatttcaacaaaacaaacaaaccactgataaaaaaaatataaagctcaccatcataaagtggagctaaatcatcaaaatatgggaacgacttatctcgccaatgaattgcatctttgttcttgcgatcagcaaaagtgtcccaaacactttgtggtgcactcaccatcattctgtcactatcccacccaaaaccactttgatccaacaaatctttaacactgcgataatctttcttcaaatcctgctccttttgcttgacttggttggtcgtaaatgatgtaccgaattttgtattcaggcggcaaacaatatttgtccatgcttccttactccaagcattttgtgttcgaaaacctggcacgtcatgatctgttaggagctcaataaggaacatcttcatctggtgactccatctggctctctttgccgtccctaaatttgacaaacatttaacaatttcagtttcagcagcaatatgaaacaaaaaaggtttgatgcaaacaacaagtgaaactgaatttgcaaatattacctatttcttgacgctctgcagtcccatgctcactgtcaacatcaacataaacctgtgataaaaggtgctgggcttgcccaaccgaccaaatggggtgaattggccatggacatgtgagaagagcctttcgatggcattgctttcctaaccccccaaaaaaaagaaagaaaaaagaaatacacaatccttatcagagagggatttacacctacagtgccaatgaaacaaactagttccaagtagtcagcttaaaaattcactaatccatagatccaaagtacagaagcactaataagtcaataataagtcaagtatgaaagctcaaaagtgcagacaaataccaaatcgatggccctggctgctgccctcgatggcggacctgccgcacgcctccgcctagcggagcccaacctgcgcgccagatggatgctgtgcttggttgctgcgtgctgctagttgttgggccggcgtccccagcggaagccgcatacacgactgagccggcgagcctcgcctccgccttgcacccccagcggccggctcaagctgctgtctatctctatcacagttggctttcttggctgctaatatgtggtcctcggtgttctcgttcccatctttctctctctctctctttttttctggaagaagcgcgaagggccacggtttaccgccaaacacacaaaagtggcgccaacgacgacgtgcgcacgcgtgggcgcgcccttctttcgcgccaggaaagtttccaaagaggtcagacctctttcttattttcctgtgaaaatgaactaaaggaatgcaatcctaaggaacgtttcctttcatttcctatgaatcaaagacatactatggaaaaaatccataggattgtaaatcctacaaaagtcctatgccaatcctttgaatcaaaggagccctgaatgttgtaatctgatgttggatgaaaaatcatgtgatatgatattgaatggaaaaatgatatttctatttgatttgctgctgcaactattagttgcatgggctgtgtatatgggctttagttatgaaattaagctgtatatatgggctgtaagcgatgtagtagtgggctgaaaagggcaccaaaaaatggtgacaaaattgggctgcaaagctgctgaaatgggttgtaaagctattgaaaatgggctgccaaaatggctgaaaaggagctgcgaaaatggatggaattgggctaaaaattggcccatctttgattttggcctgttaataaataggttgaggtagtgtctacgtcatcatccacgtaagcaaccatgtaagcatccatgatgatgtggcattcaatccgtgacggttatttttcgtcataggaaatgaacttgggctgggctaactaggcctcgggctctatcgtgatggtttaaaaccgtcagcgattccattaatccgtgatggtttttggtaaaccgtcacagaggttaatccatgacgctcaatccgtgaccatctctgaaaccatcacaggtgctgcatagtgacggttttttgatgatccgtgacggaaatttttcatcatgcattaacagattccttgtagtgtgcctgccttcctacgagccaaaaaccaaaccccgactcaatctcggtatccgcttcctcctgctacaagccgcagcctatgcctcctctgagtcgtcgccgccgcctgcatcagacaccgaagccgaaacttccaccgctcggattagagaaacttcttcgctagagtccatagctactcctccacgatggagcccactgccacctctccctgcttaagtcgacgtctccgcaccgtatccgtcttggttctgctcttggaaaccacacctatgcatgtgtagatgtgcacaagtcatgcctccatacacgacgtccatgcccctgcacgcaccgcagtcgcagccctcgtattcaccgtccacgaccccgtcgtcatcggccctgcacgtccgccgcgccgcgccatgctcgccagcttcgcccttccgtcagtggcctccctgccgccgcggatccgcgttcgccacgtgcgtcgggcgcgccgtccatggcgctacccctccgatctctccgaacgccttcggccacgcccggcctcgtcttccggtcacgctccgccatcgtcagtctgatcgcgagtgaggtcgtcgcctccgcaacgtcctcgttgtcgccatcgatctcatcgccacgactgacgatctcctatcgatgcgcgatcccacctcgtgtttccttctccacatgtcttcttgatccaatgctgaaaccttctgctctgataccacttgttataaaagttagtcaatatagcggaaagacgactaaccctcccgatcgcttcagtcattgattactcaagacatgccagatgacgacacaggaacacacgatatttgttaacgaggttcagccgaagcctacatccccggggctctaattatgggcgcttctccccaaccaatatagttcctagccgctacgagtccatggccacgccgccatcctctccctgcgtgtgtatgctacattgtagtcgccatggttatattgtggtgtccccctctctatttaagagagttgccgggttacagagtccgactctaactccaccccctaacacctattacaactctaagtccaactgtaaccaaataaccaaataggaatagtatattcgacacctattctaacaattatttatatgactatacatacaagtcaaatgtcttgataaataagcttaataattagtttaaaacattaaataaacacacatattttaaaagacgtgaagcagataattcatggtgataaagaatgttcggcgtgagcggaaacagacatgggataataaatgctgctatctaatttcaaaaaaaaaattaatgttttcattagattagcaatatgcgtgaaaaattttcccaccactgcagggcgcgacggtgagcccgacagttgcactcccacgttcaataatccaggatcagaggaccttgggttagttatccaatcctagctaaaatgtctcattttaattaatacaccaactaataattagataattattactccatccatctaaaatataagtatttttagcatagtgataaatcaaacatttttaactttaattattaatagcaaaaaaataaaaaatatcaatcatgtaaaattgatattaatatatttatcattaaacaatttatcgtaattttatttaaaacatctcacttttataaatattattgatcaaaatagcatcacgaaaaccatatcagagtctaaaaatacttatattttaggatagagggagtgctatgtattgaatccctataatttttcttttatgttcgcctgaccagagcccggccggttgatcgattggccgtcggcattctgcgtttctttctcttctcgtgttccgacttccggctgtgaaccaagagtagccgacggctccgcgcgtggtcgcagctgcctcctttcgacgattggctcgattgcgccatgtgactggtcataaggccgtaatatcaaattttagttatttataaattatatatatttttatatggactctagactcgtcttttaatatatttttttattctgaattttttgtaaattgtatttctatataaactctatgctcttcttccactattatttatttttatttctgaatttttattatttctaattgtatttctatatagactctaaactcatctttcaatattctttaattattaatgaattttagttacttctaaattgtatccctatattgactttaaacttttcttcccatgtttttcttaattttaaattttagttatttgtaaattatatttttatacggactctaaactttacttttaattttattatgcttattccaaattttagttagttttaaattcctatatggactctacactctacttctaatattccttatttttttaattccgaatttctattgttttcttaattgtatttctatatagaatatatactctacttctaatattccttatttttaattccaagtttctattattttctaattgtatttctatatggactctatactctacttctaatattccttatttttaattccgaatttcagttattttctaattgtatttctatatggactctagtctcctcttcgaatattccttattttttaattccgaatttcaattatttctaaattgtatttctatatggactctagtctcctattataatattccttattttttaattccgaatttcagctatttctaaattgtatttctatatggactctgctttttctttttctccgattaatgtgagaatgtctaggccatgagagcgaacgtggaggctcctttttctattcctttaataatataatagatagattgcacataatctgagttctcaattttttgatccaatggtccaaatcaattgccactaggggtgagcaaaataagaccgggccgaagaaccgaactgaaaagaccgataccgagactgaaaagaccgagaccgaaacgaccaagaccgagaaattcggttagtaattcggtcttggccgttgaaagaccgaaatttatttgggcaattcggttattggtctcggttaaccgaattaaccgagaaaaccgaattgtggcctaatagatctaggaggcacgataagcccaataaactactaaaccctaaagggaaccactgacactccctcctctcccaccagcctcacgcagcgccgccaccaatcccctcgcgctcggcgctcgcgccgtgcggtcacgctgcctccgcctccaccctccatctccatcacgccggcgccgtctccgccttccgcctcatcgcgccggcgccgcctccgctctccgccctccgcgcgccgcctctgccggtcgtcgttgacctccaccgtgccggcaccgcctctgccctccgcctccacctccgccggtcgtcgtcgacctcgaccgcgcaggcgctgcctccgccctccgccggtcgtcctcgacctccatcgcgccggcgccgccttcgtcgcccgcctccgccctccgccggtccgccctccacctctgcctcaatgccgccatcacaccgcctccgtctccagctagccctctgtgaaagttcggtcagaccgagaccgaaaccaaaaaaaccgaaactgaatttgtcggtcttgagttttttgggaagaaattcggtcctcacttttcaaagaccgaaataaccgaaagaccgaagaccgagaccgaattttttggtcagaccgaacacccacccctaattgccacggtaaatcgaaactttactgtgccacaataaatcgctgcagtgttttgctactgtgtttagatacatctagatcacgcccgttttagatccgatggtgctcgtgtgactgtttcacactacccactgcacctgaactggatcaagcttaaaacacatgcacgggccggggccggtcactcggtcagtggcagatctactggtcatcgttaattgtgttagaatcttgctttacataccatattatatggttagcatccgactacgtctcattcactgattcttgtgctctatttctctccatgtgcagtggtggagctacagtaatctatgggatcagctgaccccacttgttttcgcgaaacagccaaaaaaaaactattgatatttgtgtcacaataatagaaaactaaaaataattttacagctttaaccccacaggttttagtcactgcctctgccgctgtttatgtgggcttagaaaaataatagatgtgtttatgcattggttgaatcgaacgtggatcatacctatactcatttcatattgtgttatgcatgctatctacaccatttgtaaagctatagagagagatctaggagcatatgtgtttatacccaaatttaacatctaagattaaaatagaaaaattaccaaagtttggacgttctaccgatttttctctgagagggtcgatctgatcgtcgtgtgtcgaccggttagaccaccgccagtagaccggtcataccagcgttgtgtggctggtatgaccagcagagtccaatcccgaatctgtctctacaatatatataaaaaaaaattgccaacaatatgcatcctcgcctaactcatgcaatatacaacaggcacacgatactcatagcactaatctgtgtctaaaggcgtacgtaatcaggtgatgacgccgtcacgtacgacgaacgaagcggacacatgatcgatggatggaatccattttaatttcttcggagtcacgtgtggctcaccgggcaatctagaagctggatgtgcgcccgtacgaagagtagtgtgtgagtgtgtgacactatcatgtcctcatgggtatatattggatccttctttagtggaaaagaggagtgaagggtcaaagttgatttctttgtcaatgtgtaatcggaggaggagatgcacagacacggttttcacaaagaagaagctgggagggaattgctgaatatggccatcaccgtccatggtttccacaggtggggagaaaaatggtggtgcttgtggagatagagaatggccaaatggaggtcgtttttattggagtggagatcctgagggaggagattgtgcggggacgatgaaaccacacgatctcctttctcgtggatcggatggcgttaccggttatgtcacatatgtgctctaaaattaatttgaattttgattgcggctgataccaacaagccaaatatattactaaacttcttgtgtcaaagataatcgtcgagtgagattagcatatcataggtctatccatgaaccatcattctcctttttttattatatgctgcaatcaaaatttaaatttcaaaacttacttttaagttaacactaaggtttttctttcattggtaaaagtatgctatgggatattcaaaatttatgattttttactcttggacactaaaaaacataaactcaattttaggacataaaaaaccgatgatttattaggggagactgctgttattattttatcatttaacatatctggaaccagatccaagccacatttcctctaccaatcccctctccaagaccttaagattggaggcggtgaaagacagggcccatgacagaggccattacaagcaattggcctagggggcaaactcatcttctctaaaagtttctttcctcattttcctgaaaatgataaaataatgactatagtgtctcttagtgaattaccagttttttttctacaaccatgtcacatttttaggtgttcaacaccaagaattataaactttagatgtcctatagcaaattttacttttacattatattttatcttccaagataatttaaaccgtaaaaaacacacatataaaacttgtatttataaattatttggattgcttaattcattattgtactgtagatcaaacattcatagcagtcagtcaagttctactcactccatcccaagatatggcattatctatattcgtagtatatgtttatatgcaatccaatattagattgccatattttatgattgagagtgtctcctgaaaaaaaaaaaggtaacaaatgggtcatttttaactctagacgagctgctacttatggtgagacgatatagggaatttgtaagcattgtggtttctaatttaacccacag

SEQ ID NO: 57058 - DNA, 18305 bp, Oryza sativa
  unsure (1)..(18305): unsure at all n locations
catcgcaggaggtgaggatagataggaggagtgtgctaggacccagtggcggatccagaaaatcgatttgttggtgtcagaacgcgtctatcgatgtcataatatgctaattatacttagatcatggtgttatagcatatgaataaacagtttagctataggttttgccaaaagtcgtcgttgtcgcctgacaccggtcctataactatagatccgcccctgctaggaccacgttgaggctgggtggttctacacgttggggagggggcatggtttgtggtgttcgcggtcggggaggatgtatcagcatcggcgctgggctccatcttcccaatagcggctctgtctccccctcctctcttttggttcagcttgggtagggcgggagaagcctcttacatatggacccaagggcatttcagtcttttggcatcattcgacacatcggatagaaaggaaaaaaaatacaaatgtaacaccaagtgaactagaaaagtaggaatagtgacacacgagagagttagactggatgacaaatggaaatgaaaatttcaaagagtgacatttgaacctataaggatggcaaacagtaaattcttgtcgacgtcattgcgagtatgggtgaaaacagtcagtaacgattagaattgggagcattcttctaaaacaatgctttcacgacataaaagaatagatagcaactggtctcgactctagtttttctagagagggttaaacccaccccagacagccgataattaaccatatttattatttaaactactcaatatcaacatcaatacgatgttgaaaaattagaaagaataatttttatatatagctaaaaagggtaaaggttgaaaacgttcggtcgattgggaatttttcgtcatcatttcacccctagtcgcccaggatgagccccggtcgactggccgccgggcttgtgcgtttaattttttttctcgtgctccgactttcgactgtgaacggatatatgttgacggcccgcggtcgcagctgcacacgcctcctttctcggatgacgaggagtcgacgattgtgcgatgtgtgactggtgagcaaaacggcacgactcgagctagtgattgtcaaactcgtcataacctcctgctccctccgttcgtcgctttgaatttctttcttctagtcaaatatttttttattttgtctatatttataaaaaaatttaataacatatataacacaaaattagttccgttaaaaactaacatttattatagtttgataatatgtttgttttgtgctaatgatgttactgtatttttttcatagatttaatcaaacttaaaaaaatatttaggaaaaattaaaacaatttataatgtaaaacaaaggagcatgcggtaattaagctaatcacacggtttggcagaacaatgcatggtagcattagcattttgaacacgaaaagtaaaacactgcatgcccggtcatctccgacgagtcatcggcgtgtgttatggtagctatctacgcatttgcaaagttcgcctaactctgcactaataaaaattagaaaaagaaacacacgatcgacaggaagctctcgcagagcactactgatctgtctaaagccgtatatgattcaagtggtcacgaacgacaaaacggccgcgatgaggggtggataacgagctaataaaatttagaattataaaattgaaataaactcgttaacatatttatttcacctctataattctaaatttatcattttattccatataaataataataaacactgactaataaaaaattcactaaactcaagtaggttggttggatgtagttaaggaactaaacatcattagctaagaagggctaagcatataaagataggtgatcttctgtactaaccagctaaacgagtagctcattaaattcacgagttaaaattctagcttggcttgacttattaaaactatgagtttgagtcgatctgaatcaagctcgttacaaaccgattcgagcgatgagcttcgagatttctgttcacccctagatcgatggatatggaatctgcctctttcggagtcccgtgcacggctcaccggcactctagaaacaggccggcacaatgagaagtgaatggtcaaagttgagctctttgcccatgtgtctaattggagaatgagatgcacacacacggtttctatagcgatgaataaaactggggtactgctgaatatggccatcgccatccacagtttcaggaggggagaaaatgttgttcagttcgatcagtcgtttgcattgggggtaggagatcgtgcggggaatgatgttgccaattgtgctgagtacatactccctcatttcgtagtataagttattttaactttgatcaaagttaaattactttaaatttaactaagtttataggaaaatatagtcaatgattaaagtcaatatttttataatttccccgaaaaaatatttttaatatatttatcttatattgaaaatgttactatttttttacaaacttaatcaaacttaaagcaatttaattttgacaaagtcaaaacaatttataatctagaacggaatgactaccggctttggccgtgatcctcgtggatgatgtacagtgtatccgtccgagtcagctgacaccgacaattaaccgctagcgaaagccattggtaagcttctcctttgttcttttttttattattttttttggcgcacaaagctaaaagcttcttacttgtcgacgatgaacatatgtctgtactgcgattcgttgtaagatcggccagtcagtcatttttctgagttcgtcaattattcttgtcttatcaaccgcaactaggactcaaattttataaattagtttaagggctgatattgagttttttttcttaattttattttttagcagtggtttttaaaacgctaaggacaaatattttaaattttcattaataatcattttctattgcttgagtttgtttttctacggctttatcagtagtagatcaaacaatcaaaacaatcaagttccaagtggagcgtgttttctaatgtttgagagaaagcaagtttatcccacgttcccactccaatagcaccgtaccaagatcggctcattttcaactctagatgagcatcttcctgtgatgagacgacattgggaatttgtggatctagttttactgacactgacaattagacagttgagcacctttgatttccttttttttaatgtggatacctctatattaatgattgacgtaatatgtttctgatagtggaaatggggctgtaggatcagagacaatggctgtgtttagttgagggaaagtttggattttggttgaaattgaagataatgtgactgaaaagttgtgtgtgtatgacaggttgatgtgatgaaaaaggactgaagtttggatccaaattttagataatattaacatcaccaaagtcaaacatacaaatgttcacacacatccagtacgcccgtggttcctaaattcctaggacacataggaccatgattatgattactgcccatctcaaaatataaaaatttagaatcacataatctctccatcccataaaaaacaatctaatactagatgtgacatatcctaatattacgagtctggacatacatctgtctagattcattatactagaatatgtcacatccagtactagaatgttatccgatactaagggactcatcttttcgcttatgcttatacttatctaccaaaatttaaatttttaacataaaaaatttaaagttgattttgaggttttttcaatcaaagtttatttttcagcctttacttctagattgctaaaaacacatatataaaaaatttatttaatttacaaatatatcgtttggcttatttcaccaataaaataaaggatatgacaaaaaaaaattattatatttgggggcgaatatggcatcccaccccacgtaccacacgacacactccggtttgggttttggactttcgaccgacccacgccatctggccaccacaaattgacactgggctggccgtacatcgcacggctataatcattccacgtcaacacaaacgtacgtggcccccacccgccgtcgaccccacccaacccccaccccacgtgttttggtcaaccccgccccgttgaccgccccccgcgccgcaagctcttaaaaaaaaaacgttccctccacgcgaactccggcgaccaaccaggctgcctccaaagcagccaaacccaagccactgacccgccgccgctagatctcgccaatgccgcggagacacgacgccctccgcctgctgctgctggtggtggtggtcgccgcggcggatgcggcgacggaggccgacgcgctgctgnntggaaggttggcttgtaggatggtgtggccgtgctgtttgggtggagccgtgccgtgccggtgtgtgtgtggtgcggtgtggcatggacgccgccgccggcggcgcccgcgtcacttcgctccggctcaggggcgccggccttggcggcggcctcgacgcgctcgacttcgcggcgctcccggcgctggccgagctcgacctcaacgggaacaacttcaccggcgccatcccggcgagcatctcgcggctccgctcgctggcctcgctcgacctcggcaacaatggcttcagcgactccatcccgccgcagctcggcgacctctccggcctcgtcgacctccgcctctacaacaacaacctcgtcggcgccatcccgcaccagctcagccgcctccccaaggttgcccacttcgacctgggagcaaactacctcaccgacgaggacttcgccaagttctcgccgatgcccaccgtcacgttcatgtcgctctacctcaactccttcaatggcagcttcccggagttcatcctcaaaagcggcaacgtcacctacctcgacctgtcgcagaacactctgttcgggaagataccggacacgctgccggagaagctcccgaatctgaggtacctcaacctgtccatcaatgcgttctccggcccgattccggcgtcgcttgggaagttgacgaagctgcaggacctgcggatggccgccaacaatctcaccggcggcgtcccggagttcctcgggtcgatgccgcagttgaggattcttgaactcggcgacaaccagctcggcgggccgatcccgccggttcttggccagctccagatgctgcagcggctcgacatcaagaactcggggctctcttcaactctgccgtcgcagctgggaaatctgaagaatctcattttcttcgagctgtccttgaaccagctctccggtggcttgccgccggagttcgccgggatgcgggcaatgcggtacttcggcatttccacgaacaacctcaccggtgagatcccgccggtgttgttcacgagctggccggagctcatatccttccaagtgcagaacaactcgttgacaggcaagattccgccggagctcggcaaggcgagcaaactgaacatcctctacctattcaccaacaagtttacgggctccattccggcagagctcggcgagctggagaacctgacagagctggatttgtcggtgaactcgctcaccggaccgatccccagctcgttcggcaacctcaagcagctcacaaagttggcgctattcttcaacaatctcaccggcgtaatcccgccggagattggcaacatgacggcgttgcaaagcctcgacgtcaacaccaacagtctgcacggcgagctgccagccaccatcacggccctgaggagcctccagtacctcgccgtgttcgacaaccacatgagcggcaccatcccggcggacctcggcaagggcctggccttgcagcacgtgagcttcaccaacaacagcttctccggcgagctgccgcgccacatctgcgacggcttcgcgctggaccacctcacggcgaactacaacaacttcaccggcgcgctgccgccgtgcctgaagaactgcacggcgctggtccgtgtccggctggaggagaaccacttcaccggcgacatctcggaggccttcggcgtgcaccccaagctggtgtacctggacgtctccgggaacaagctcaccggcgagctgtcgtctgcctggggacagtgcatcaacctcacactcctgcatctcgacggcaatcgcatatccggcggcattccggcggcatttgggagcatgacaagcttgaaggatctcaatttggctggaaataatctgacaggagggattccacctgtgttgggaaatatcagggtcttcaatctcaacctgagccataactccttttccgggccgattccggcgagcttgagcaacaattccaagcttcagaaagtcgatttctcagggaacatgcttgatgggacgataccagttgccattagcaagcttgatgctctgatattgcttgatttgagcaagaacaggttgtcaggggagataccaagtgagcttggtaatctggctcagctgcagatcctgcttgatttgagcagcaattctctatcaggcgcgatccctccaaatcttgagaagctgataactctgcagagactgaacttatcacacaatgagctcagtggttcgatcccggcagggttttctcgcatgtcaagcctcgaatcagttgatttctcttataatcgactcaccgggagtataccgtcagggaatgttttccagaatgcttcagcttctgcatatgttgggaattcggggctctgtggtgatgtgcaaggtctaactccttgtgacatcagttctaccggatcatcttctgggcatcacaagagagtagtcattgcaacagttgtgtcagtagttggagtggtgttactactagccgttgttacttgcatcatactgttatgcaggaggaggcctagagagaagaaagaggtggaatctaacaccaattattcatatgagtccacaatctgggaaaaggaaggcaagttcacattcttcgacatcgtgaacgccacggacaacttcaatgaaaccttctgcatcggcaaaggagggttcggaagtgtctaccgggctgagctctccagtgggcaggttgtggccgtcaaacgcttccatgtcgccgacacgggtgacataccggatgtgaacaagaagagcttcgagaacgagatcaaggcgctgacggaggtccgccaccgcaacattgtcaagctccatggcttctgcaccagtggtgactacatgtacctggtgtatgagtacttggaaaggggcagcttggggaagacattgtatggggaggaagggaagaagaagatggattggggcatgagggtgaaggtggtgcaggggctggctcatgccctggcttacttgcatcatgactgcaatccagccatcgttcatcgtgatattactgttaataatatcctgcttgagtcagactttgagccgcgcttgtgtgattttggcacggcgaagttgcttgggggtgcatcgacgaactggacttctgtggcaggatcatatggatacatggctccaggtacttttcttaaatttgaacatttttttccttaaaatgtcacatgtttcttatgcatacaatttttgaaatgtagcttataatatcaaatcctagttatacttcaaagtgcttcagtgagatccttatggtagcaccaaatagcatttgggatgtttcagtcataattaacgaaaaaccagatggctaaatttagttcgatactcccaggtagtaatgtagtgtatgataaactgtcaaacatttctgaccataaaagaacattttgtgcaagtaactaccaaatgaagagcagtagttatgaaatatagttgtcgaattgtctgttgtttaaaaaaggaaaaaatgagagaaagaaactcagatccgatctatttaagattgttttgcacattattgtgattcatgaaagtactgaagtcattactgtaagtagagtggtcattattgaatagattgccacatactcctgtcctgaagatttgcagaactttgaaagattgtcattgggaaaaggaactgctcaaattccgacaagtacggcaccgcaccattaacacttaccgacttcgattatttcttgcagaattcgcatacacgatgagggtgacggagaagtgcgatgtgtatagctttggcgtggttgcgctagaggtcatgatgggaaagcacccaggtgacctcttaacatccctgccagccatctcatcatcagaagaagatgatctactgctcaaggacatactagaccagcggctggatgctccaacagggcagctcgcagaagaggtcgtgttcatcgtgagaatcgcgcttggttgcacaagggtgaaccctgaatccaggccttccatgagatctgtagcgcaggagatttctgcgcatactcaagcctacctctctgaaccattcaaactgatcacaattagcaagctaacagactaccagaagtgaatatatatctgtgcagagatgtaaagcaccaggaggggaggaagggaacttcgcagttagtgatttgtaagatgcatcctcagattatattaatgccaagggtaagcttaggatagtatattacattaactgctgataaatatatagaaattattctgtacactgaatcacaaaacctgtctttcatcaactttgtacaattgtattgctcgttgttactatccctgtggtaatattattattttcccccataggctaaacaataaacttgtaaatgtaagacagagaagagaaatggagaaatttatgactttgccatataattctctgagagaaaatcaacatatcttagaaagaactgttcactgcagcagtcccttttccttctatgaatgtgaattagaagaatattcagtggatgacggaaatgtatgtgatgctgtaaatgagtggcaatgcttctgctctttcgttcaacatgatgtatgaaaaaaaaaaaactcaaatccaagcagcaccctccgtgtcgtccacgcctgggtggcgaatcctaccacccgccgccgccgctctcccctctccctctcctcgccgctgtcagagaaccgtgcggcaagtcgggatggcggcagcggggccgaaccctggcggcgcctcgccttcagcgtgacgaaggtggcttggcgcatggatcgctgggaagatgacgcagcgtgtaggccacagattcaatgctgccgtagccggatctagtcttccgtcaggtggatccgccgcctctgaaccagatctggttggagttgctggcacgatggagcatcaacggcgggagtcccacgcgggttcctgcgtggaaggccatgatggctagcgacagtgggatgccgcgacagctggtgtcgaggaggtcggcacgggcgacgatggtggaagcctacgcaggtgacggtggcggcccttgcctctcctcgcgaacggccgctcggctggccagtggtggcgacgatggggcctctccttgggcgcatggagatgcacaggggttgccaggcggagggttaacacgccttgaggacgactcgaccggagcaccagcgtgcatggcaacgacggaggtttgctgtttgccaacccgtgtggcggcgtagctggtgttgggtggagcagaagctggatctggggccccgagcccggatttggccacatagcaccgccatcacgggcagcgatgatggtgggtcgctctctatctatggtgccttcacatctccatggagctcctcaccttcttgataggtttacctggtcatggggagtcccatatggcaagacggtgaagatggcgacaggaaaggaaggtcgaggctgccaacatgtagcggttggtggcggtcacacctcctccctttcttggtgagctgatggaggtgatggcatgggaagaaggctaataattggtcgccatagtgcaacagtggttggtcgcaagattggtcatggttatggttgtggtcgtgtcggcagcatgacaaccgtatggaggacagccggcgaagcggcgttggtgctattgcagtcacgtgtcagcaagattggtgattggtgaggtagcaacaagaaaggtgcaagtttaactaatttgttccgacataggataataagctcatgaggttggtcttacttcaccctaaacgaaagaagacttccatatccaagtttagctcagacgtagctgccttctttttgggcgtgaagcagtgtcaaaccaaaatacccaataagcataagcattagctctccctgaaaaggaggtgatccagccgcacctcnnnnnnnncagtacggctaccttggttccgccaggcgaaagccagcccaatcttaagctgacagcggcaacgcctttaggcgccggaaccctcttgaaggtgttgtcgaggtgcctctcttcccctctttaataagatcttttaggcgaaaaccatatcttttgggatgggcgatggtggtgtttttaatgtcttaacctttttagaggcatccttttggaggttcttggtcgtggctgtgttttcttagggtgtggtggtggtgtgggacatgacgtagtgtatttctttttttttccctgagtatagcatttcagaattataatattgtaatacttcacttttttcaaagttttaatacaaaaatgcacaattttttgcgtattccagaaaacatgatgcatgaaaagttcaattcgaattggtgaggttgctggctgcagacatcggacaaccacaacaagaatagtagtaggaatgagtatagtacactagagtagctagaacacagctgttcattcaggtgaacacatgcatgccataaaaatgcatctaatatacttaatttttgaatgggaattaactatttcaaaaatggccaatataaactgaaaactgtatgattctttggttgctgatttgcaactgaagagtgcattaatgtctactgcttatgcacaacttctttctatctggtaaagtgaaaaatgaaaactcagtggcttaagtaaaaccagagctccaaactaaagccaaaacacacaaaaaaaaaggccaataatattacagaataaagtaatggcgcatagatttctttatggtcttcatttttttatccagtgtaggtgcatggagggaagccacaaagaagcagattgttgctatagactgatggatccacaattgactgaagttgacttacagtggttacctcaccctatttcagatacttaacataccaaagcataacgaatttgaaatgctcggaggaataacaccacaagggtttcaaactgcctatcttttctggaatactgccggatagagtatttccagaataaagccataagattttggataagataaagtagcattttaaattcctcttagtcttaatatacaaaggaaacatgccaattacagaacaacagaaagctaaatatacttcttcatcataaggtaacattacggaaacacagctgcacagatgctaagccgtatttcctctagaaagaaattgattaatataggacaccttctgcgtaaccttacactgtatggcatcaacaaagcagataatgacataccttaaggtctcgatggaaaagaacattccaaaccacagacaaagcccggaaaccactccagacatcacaaagtaggatagatattggtcctcgcatgttctacaatatctctcttcagatgcaagtgaagaatttgtgcacgaaatgttcaacggaaaaccacatagcctaggatttttgttgtatatcgatgggtcagtaagggtttgaagttgattcccaaagggtatcttgcccgatagattattattcgagagattcaaaatgctaagggtagatataccggcaaggcttggaggaatagctcctgaaagttcatttgacgagaggtcaagggactcgagatttttcaaactaccaatgtttccaggtatgctgcatgacagatggtttcttgacaagttcaaaaattgaaggccttggaggttcgttaactcatcagggatgcattgtgataatgagttacttgacaaatcgatacccgtaagtagttgaaaaaaatttaatccagaaatttttatttcaaaaatttgctcctgccccttccagattgtatcaattctttcatcggaactaagccattgtaataattcctgaggagatattaagttttttattcttcatggaagtgaggttactaaaagatctgggaatcgatcctgtcagaccattgttgctcatgtctagtagttgaagttgagaaagctgcgacaactccgaaggaatttcaccagtgaagttgtttgatttaaggataagaatcctcatcgaaggaaatcctttcccaatccaaggaggaatattaccgaagaacttgttattcccaaaatctaaggagaccagtgtcttacatccctctaaagttgatggaaaaactccagtgaaaccgttgccagcaagatataccgaatgaagagaacaattgtagcttgtcccgagtgcagagatttcacctgagaagtcgttgtgggagaggtccatgaactgcagattctgcaggttccaccagcagtcgggcagcttaccagtgagcttgttgtttgaaaggtctagattctcgagggagagcagcctgcagaatgctgagccagagctgcaattggaggaattccctgatgaaccaactccctgcagcttgaaattgtttcccaaatttcccataattggccccgaaatggagttatggctaagattgaggaattgcaaattgctgagatgacccaactcatatggaatgcctcctgtcagattattcgctgacagatcaagatacttcaagcttgtcaagctccccaatgccggaggaatgctgccggataatctattgtcgtacatggacagcatattcagtttccttgccttaccaagctctggtgggatatttccagtgaacatgttgctgtccacaccgaagaattcgagctcgggatatcacccgtgagattgttggatgagattctgaacaccctcattgcctgcagccgggcgaatgccagcggcaagttaccggagagcttgttataggcaaggttcaggacagagagattcataagatcggccaactgcaatggcagagttgaaacaagctcggcggccattacttggagctcctccagcatctggagctggccaagaaccggcgggatcggaccgccgagcgggttgttgccaagtacaagaactctcaactgccccatcgacccgaggaacttggggatgccaccggtgggattgttgtactcaattcgcagatgctagagcttcgtcaacctcctgagcgagtccggaattcggccggagaacgcattgatggacaagttgaggtgcgtcagattcgggagcttctctggcagcaagtctggtattgacccagagaaattgttcagcgacaggtcgaggtaggtgatgctgctgctcctgaggaagaactccgggaagctgccgttgagggagttggcaaagagcgacaggaacttgacggtgggcatcgtcgagaacttgcgataatccgggttggtcagccaattattccctaggtcgaagtgggtaatcttggggagccagctgagctggtgcgggatgttgccgacgaagttgttgttgtagaggcggagctcgacgaggccggagaggtcgccgatctgcgacgggatggagccgacgaacccgttgttgccgaggtcaagcgacgcgagggataccaaccgcgagatgctggccgggatggcgccggtgaagttattcccgttgaggtcgagttcggtgagcgccgggagcgccgcgaagtcgagctcatcgaggccgccgcggaggcccaagctcgggagccgcagcctcgcgacgaggccggcggcgtcgcaggccacgccacgccagccgcagaccggcgcggcgcgcgtccaggcggacagcgcggccacgtcggtcaggctggccttccatgccagcagcgcgtcggtctgcgacgacgctgcggcattggttgatgctggcatgacggcggccgccacgaagaggaggaggaggaggaaacggtggacgacgccggccatgcgggcagtcggttctttcatggcagaggcgtacgtagcgagcagacacacggaggaagacacgatcgatatatcgagctgatcgtctccggctgtgcaggtcggtgaattttttttttttgcatggattccatcttccgaggacagatctaatagaatggctgactcatgttccgtccggtatacctactacgagttcacggggagtacgtacgtgatgatgtttgtttaattaacagccaacttggtcatttatgtcttattgatcgatttatttggtttatcactactcattctttgttttaagaagactttgcttaatctaactagtcaccatcatgtgggtgcaaggactattattgttgttgttatacttataaactagcatggtggcctacacagattgcgcggttagcatcattatattttctctcatataatagcatatatgttttctcattatattattcaaatatattaaaatgacaacataattttaaattttgcaataactttacaaaactactaatgtgtagtaatattcatattgtattttatatacgtgttagttattaattatttttaatatcaaattttagttatttgtaaattatatatatttctatatggactctagactcgtattttaatattttttaattccgaattttttataaattatatttctatatagactctacgctcttcttccaatattatttatttttatttatgaatttttattatttctaattgtatttctatgtggactctaaactcatctttcaatattctttaatttttaatttcgaatttgagttacttttaaattgtattcctatattgactttaaactcttcttcccatgtttttattaattttgaattttagttatttgtaaattgtatttttatacggactctaaactctacttttaattttattatgtttattccaaattttagttagttttaaattcctgtatagactctattatgttctaatattccttatttttttaatttcgaatttcagctattttctaaattgtatttctatatggactctgcttttttttttctccgattaatgtgagaatttctaagccatgagagtgaacgtggaagcttctttttctatttctttaataatataatagatagatatattgcgtgtgtagaatatgctgcgagttgtactcggattagcgagctcataactgcaagcgtggtatgatagcaggaaaagctccaattatatcaatttttttcttcagctgaatcatgcgtgtccagcagaacgggagacatgcctgagctgtcacacatgtacttagagcaggtacagtaagacggtagatgctggcgataggatgaccatgtcagcgttgatgcttagctggaggtgaaaaaggtggtgagagagattaaacaggcgactaattagtcgctagctgctcactctatccaaggcaaagcatttaagtgctgttggctgcacgctatggcaacgcaagaagctgggtggggtcacctcattctaccgaatgcatttgttcatggttgatgggaactgtgtagcaatagaagatagtagatctctattgtatgcactagctattagcactaactataatttgctgatgtggttatttttatagcttttagctggctatactattgaccttgctctaacaattagtcaatcatcagtctaactatgggctataatgaagtagtccatccgttccaaaatataacaacttttagctctcaggatttatcctaaaatataacaacttctctaccaatattctcttctcaaccaatcacaactctccatcgttcatttttcccacctacctttactactaatccaattacaaccctccaccattcacttctacctagtaaccgtgtctaactttaaaacttattatattataggatggagggagtagtaattaactactgttgcaaaagctagcagaaggtgacaggatggttcaacatcgatctgtctctcagataattcatccgtcattctgaataacttagcagtttagcatagattaaagtttaagaaaaaattatactatccttaaatgatactccttctctcccactcactaagacacggtcaaacctgatgcactcttcaaaactaatctttgactttaaatttctcatatattataatgtttgtaacaacaaaatcataatcatataaaagtaaatatagatgacaatccaataatataattttcatcaaataaaatttaatttataataaagtatttgcagatcaaatatttaaagagttaaaatttaaaatatgtgtgcgccttagtgagtgggacggaggaagtacatggttaggagtgtagtggtagttgggggtagaatagagagaaatttaaatgaaatgtgatgggataaatcatacttaagagtgacatgtactttgatatggaggtaataattaatctctttgcatgcatgtgactactagatgggtttgtcaaaattaatgcaacaaatggccaaactaaagtcatctgtgccacttgctgagtgccggttgggatatccggtacctatgatcggttcccaagcggcacataagtgcttttatgtaatagtgaataccaaggagatggactgtgtttgtatatcagtagtcatgtggtaattaattgctcatttggtggataattgaatattactaatttatcatcgcttagagcaagtaagctacctagaaacaaatgtgaaggagagaggagaagatgaattaacgagctatacaggcacaagtccgagtggaggcatggcggcggcggcaaaggcgacggcgtcgactgcttcaccgcctacttcgtggaggcacggaagcggtggcggcaacggcgacggtgtcgactgcttcaccgtctacttcgtggaggcacagaagcttcagctgctccgccgcaacgagtccttcgagctcaccctcgagccgttcacctacgagctcttgttggagcggcggatcagcttcgtgcccatcggcctcgccaacatgctgaacgtcggcggcgccgtgcagggctttcagacagtgaagaaggacgacggcggcggcggtgatgtggtggcggaggtggcggtgaagggtgccaaggaggcatactcgtcggcgaggctgtgggcgggtgcgcgtggggaggcggccgaggagcggcatggatggagccgggcggaggatggtgagcttgatgtccccgctacggaatccggcctcggcaaagacgcggctgacgaccttgacggcggcgggagtctgggcggtggtggcctagtggtagaagtggaaggtggcctgggagcgcttgatggcggccatgaggaaggagtagaggggacattcccgtcaattcgaaatttctctcccctcttttagcccgaaaattataaaataatcccttcggtgtcctataactaattacacaacttttgtagtgtccatcggcagtgtcacattttttggtgtctctcagccaattacacgatttttgattgtcctgtatcaaattttgcctaaaagaaacggggaaaggaaaaaggaaaaaaataggagggtaaaatggtaatttcaaagttgatttaattaagtaattaggaatatctttcatgaactttattctagatgctttggttctaccatatttattttataagtttacacttctcccttatatctatttaattttattaatcaaatcaaaacttaattcctttaattattttatatagtttgatttggttttgaggactccatgaattaatttggttggcaccaataataactacaataaatgagaggtgtaccatcggtatgatgcaatttaataaaagttttcgacagtcgtcaactatggtccacagtttattagttgaatttttagagtgttacactggcttagggacgagaggtgatggaggacgtcaaggttaccaaatgtagactccgacgaggaggcggagagcagcgacaaagaaggcacccgtcttaggtatagccccattcataggcacta

SEQ ID NO: 57059 - DNA, 9619 bp, Oryza sativa
attatatactgtacacgtactattgtcttcttctatccagtatccatggcgcaagcccagtacggataatattttacaattgggacttgggagagtatattttaccacttcaaataatattttcacagtcctgaaaagtatttacaatcatgagataatgcatctggtaggaacgggcacttaccgtagaaaaataatcttacaggtgtcagccaaggaggcacttacccagaattttgtaaaatttactcattaattaactatttcttccgttccataatataagtatttttaatgtttaaattttttccctcgatatagcaactaatcaacctattttcaagtcaaattactttcttgtcttaaccaatcacaatctatcagttaatttgtttatatattttttttctgcttgaaccaatcataaccattctgctctacaatttgcttatattttgcaatgacacaagtatattatatggcacgacaacagtacactagccctgattacccaaattctgccacgatcagatagaaaattgtgtcttccagagaagaggaagagagattctacacttacccatcaaactccctggttatcaccattccatgggctaaaagaaacactagctagtaaccacatgcgcacaccctaatagtgactttgcgtaagttggtttcacaagtcatctttttctgatcttttttaagggtgatcgcgtgcacaaatcctagtaccatcaaaaggttggcacatagaaatttcagtgacaatatgtaaacatgttaggtcacagtcacattggaatgttatgtgcgtgtgtgataatctgattcctttctgaagaataataaacagtgtaattcctctttgcttatgtacattaatcagtgtcagtcttttcatcatcagaattaccggataggagtagggtattacttcttgaataagaaggcctgaacctgtataaaattccttgtcttcaaacccatccattttcctagcttgatagccacccccttttattattgccaaaatcttgtttcgatagttactgtggagattatggttaccccatatctacatggcggttatattccagctggatatacagtaccaaatatagatagaatatttttatgaggactcgggttagattctaaacttgtatgtcaagaaaatacctggtatcctagtcggttacgattgtgttttatctgtaatcccatattccgttaggatatgggttgtactttgtattacggatcccttcccctatataaggagggtccgtgtgcctcttggggcacgattcttttttcccaattatacaatcaataacacactcggcggaatcatctccggacaggagtagggtattacttcttgaataagaaggcctgaacctgtataaaattccttgtcttcaaacccatccactttcctaacttgatagccacccccttttattattgccgaaatcttgtttcgacagttggcgcgccaggtaggggtagcgtcaagttctcgcctactaagtgcgatgggtttcgtttctggcatcgacgacttcgccttccctcccgggcaggcgttccggttcggcagcctcgacttcatcaccaacaacttcggcaagatttctctccttgactcggattcagaccagtcggggagagaccaggtccccgtgccattcggtattctgaactcggccaaggcctactccaagataatctctctcgagtcggcttcaaaccactcggacgagatccaatctactcttccgcgaccagatcaagacgacgggtcctacccctcaatcttgatgaaacttcctgatgacttggccgccgttttcacagccaaaacatctcccactcggagatctaggcgagctccggcatcggccccgatccagtctagatccaggaaggtcggcgttatactccaacctcttgggacagtctcgacggaagaattggatggctccctctgctcccccggcgtcagttctcgaccaaccgagatcctcgactacgacgacttcggctaccactacgaccacggcgacctcgacaacttcgacgacagctatgaggataactacatgcccctcttcttcggcgtattcatggctgacaacgaaacggaagaacagcgccgagcccgagaagcggaccaagatcgcgcacggcaaggagctgaacgtcgctgactggaggaagtgcgacagcgacaggagcgagaacgactacagcgtgagcaacaagatcgcgaacggattgcaaaggaggctgaagatcgacggcaacgcgccttggaatctgggcgccgagcgagagagctcattgggcaacaagacgtcgacgggacatcggtcttccgcaccgcccagcagaacgcggttgcagcaatcactctcctcgacaccctcctcaaggaagacgcactcaaccaagccgatcatgttgtcaacatcttgaaccagacgaagaccatgatcgctgcctcggttccagccaactccgtaagcatccgcaccccgactggtagccgagcccctcacctctgatctcatgatcatcatcagccaagcctcagcatcaccggcacaggatccagtcgcaggagcaggggtcacgacgaacgatctgttcactcgcctcctgaacgtcacagggagcgccgagtcgaacggcctcgctctccacctcatcagcgccccgtcgatcttcgcgacatgatcaaccagcaccgtgcagcacgaggtcaccgccattcaccaaatcgctacgacgacgacgtggatagagtggctaccttcactaatgacctacgtcgagtggattggccagtcggctttaagccgactggaatcgagaagtataacggcaccactaatccggagtcttggctcaccgtctacggaatcgcgatccgtgcagcaggaggagacagcaaggccatggcaaactatctacctgtggccctagcggactccgcccgatcctggctccacggactaccccgtcgcacgatcggatcatgggcggaacttcgcgatcacttcatcgccaacttccagggcacctttgagcgccccggcacacaatttgacctctacaacatcgttcagaagtctggagaatcccttcgagattacatccgacgcttctctgaacaacgcaacaagatctccgacatcaccgacgacgtcatcatcgccgccttcactaaaggcattcgccacgaggacctagtcggcaagttcggacgtaaacctcccaggacggttaagcagatgttcgaaaaagccaacgagtatgccaaagccgaagatgcaatcaccgcgtccaaacagtcgggcaccacttggaagccaaagaaggacgcaccgactgcaggggggagtggaagtaacaaccacaaagatcgcaagcataagcccgaagaacttgtggcgaccacctctccatcttaccgacaacgtccccgcgtcaacaccttcgacaagataatgaactcccaatgtccgcatcatcccaactccaaccacgtggccaaagattgcttcgtctacaaatagttcacagaacaatacgtcaagaacgcacgtaaaccttcagacggagatcaaggcacatcaaagaagagatgatgaagacgatgccccgactggttttcaagatcatcgcaaagaacttaatcacatcttcggcggacccctggcttatgagtccaagagaaaacagaagctaatggaacgggagatcaatgcggttcagcctaacacgccccaatatcttcagtggtcagaaacagcaattaagttcgaccgctcggatcatcccgaccgagtggtccacccggggtggtaccccctggtactagacccagtggttcgcaatgtcaagctccgacggactctcatcgatggcggcagcgcactcaacatccttttcgctaaaaccctggacgatatgcagattcctcgcacggaattaaagccgagtaatgcacccttccatggcgttatcccaggattgtcagctacaccactcggccagatcactcttccagttaccttcggcactcgggagaattttcgcacagaaaatgtttgtttcgaagtcgctgatttcgagatagcatatcatgctatactcagacgaccggctctagccaagttcatggctgtcccgcactacacctacatgatgatgaagatgtctggtcctcgaggggtcatatcactacggagcgacatcaagcaagccgtcacatgtgacaaagaaagttgcgagatggctcaaacccacgagaccactctcgcccgcgaagagatccgactggctgcgaccacggcaagcgagggagaagtgcctgcaaccaagctgacgaagaccgaagaaagtgatgccaagacgaaaaagattcccttagatccctccgatcctgacaagactgctgtaataggcgctgagttagattgtaaataggaaagcgcgctcatcacctttcttcagaataataaagatatttttgcgtggaaaccatccgatatgcctggtatccccagagaagtgattgagcactctttacatgttaaggaagacgccaaacccatcaagcaacgactccgccgttttgcacaggacaggaaggatgcgatcaaggaggaattaaccaagctgttagcagcaggcttcattaaggaagtccttcatcccgactggctggctaacccagtcctggttcggaaaaagacggggcaatggcgcatgtgtgtcgactatatcgacctcaataaatcttgtcccaaagacccttttgggttacctcgcattgaccaggtggttgattcaacggccggctgcgagttactcagcttcttggactgttactcgggatatcatcagatccgactaaaagaatccgactgcttgaagacctcgtttattacgccctttggggcctactgctacatcaccatgccctttggattgaagaacgcaggagcaacctatcaacgcatgattcaaaagtgtttttcaactcagatcggtcgcaatgttgaagcctatgttgatgatgtagtcgtcaagaccaagcagaaggatgacctgattgcggatttagaagaaacttttacaagcattcgtgctttcaagatgaaactaaacccggaaaagtgcatcttcggagtaccgtcagggaagttgctcggatttatggtatctcaaagaggcatacaggccaacccagagaaaatcaatgccatcctcaacatgaaaccgccaagctcccaaaaagacgtccaaaagctgactggttgcatggcggcgctcagccggttcgtctcacgactcggtgagcgggggatgccttttttcaagctgctgaagaagactgacgatttctagtggggacccgaagcacagaaagcctttgaagacttcaagaaactcctcactactccaccagttttggcctcgccacatccgcaagagccgctactgttatatgtgtcagcgacctcccaggttgtgagtacggtcctggttgtcgagcgtgaagaggaaggccatattcaaaaagtccaacaaccgatctattttgtcagcgaggttttagccgactccaagacaaggtatcctcaggttcaaaagttattatatggtgtcttaattaccgttaggaaattatctcactactttcaaagtcactcgatcacggtggtcacatcgtttccactcggggatatacttcataatcgcgaagcaaatggacggattgcgaagtgggccttagaattgatgtctttggacatatctttcaaaccacgaacttcgatcaagtcacaagctttagctgatttccttgctgagtggaccgagtgccaagaagacatgccagaggaaaagatggaatattggactatgcatttttgatgggtcgaagaggcttacaggcactggagctggggtcgtcttaatttccccgactggagaaagattgagcgacgtattgtggatacatttttctgcgtcccataacgtggcggaatacgaggcgctactccatggattaaggattgcaatctctttaggcatccgccgattaatcgtccgtggagactctcagttggttgtcaatcaagtcatgaaagagtggtcttgtctagatgataatatgaccgcttatcgacaagaggtacgcaagttggaagacaaattcgatggacttgagctcacccatgtcctccgacataacaatgaggcagccgacagactggccaattttggttcaaaacgggaagcagctccttcagatgtgttcgtcgaacatctttacgaaccgaccgtgcccagaaaagagacaactgaagccatggatactcaaggcgtaagcatgattgaagccgactggagagaacctctcataaaatttttgaccaaacaagaactccctcaagacaaaaatgaagccgagcggatttccaggcgcagcaggctttacattattcacgaagctgaactgtacaagaaaagtccatcaggaatactgcagcgttgtgtatctttggaggaagggagacaattgctgaaggatatacattctggtatttgtggtaatcatgctgttgcacggaccatcgtcggcaaagcttaccggcaaggttttttctggcctacagctgtgtccgatgcggacaagattgtgcggacatgcgaaggttgtcaattttttgccagacaaactcatttgccagcccaagagttgcaaaccatcccgttgtcctggccatttgcggtctaggggcttgacatggtcggcccatttaaaagggcagtcggtggttacacgcatctctttgtggctatcgacaaattctccaagtggattgaggctaaaccggtcatcacgatcacagcagataaagttagagattttttcatcaacattgtgcatcggtttggggtacctaatcggatcatcactgataatggcactcaattcactggcggagcatttaaagatttttgtgaagacttcggcattaaaatttgttatgcctccgtggcacaccctatgagtaacggacaagttgagcgcgctaacggcatgatactgcaagggatcaaagcacgagttttcgaccgattacgcccctatgctggcaagtgggtagatcagctgccgtccgtactttggtctttacgcactactcctagtcgggctaccggccagtcgccgttctttttggtttatggcgcagaagcaatgttgccgagtgaagtggaatttgaatcactacgattttggaacttcaacgaggagggctatgaagaaggccgagtagacgacatcaaccgactagaagaagcccgagaagcagctttaattcagtcgactcgatatttgcaagggttgcgccgttatcataatcggaatgttcgatcgcgagcctttttagtcggtgacctggttctaaggaaaattcaaaaaacacaggatcggcataaattatctcccttatgggaaggaccgttcataattgctgaagtcactcggccgggttcttatcgactcaagcgcgaagatggtactatcatcaataattcttggaacattgaacaccttcgtcaattttatgcttaggcatttcgtttgtatctttcctctttgactgctaacttcaagttttttcttgaagttttcagttagggggctactataataataatggagtgtgatttttatcaattcaatttgcctacttgatgtatcattgccctgtttgatttcttggcttagtcaatgaggactgaaagttttttaacaacttttgcgggttttaggctcaacaaggtttgacaaaaacttttaagaaatcaggagcaaagttaagatatcaagcacagcataaattcatcagtattgtacaaattgtgcctccatcatcattaatcatcaaaattatcggtacattaatcagtctcagtcttttcatcatcagaattaccaggaccagtcggtcgaagatcggtgtcctgaaatctctcaactacatcagcagcaattttgtcagccgctttctgcgcatcactgatgaggtcaagagcagcttcttcgctcgtcccgtctgcaaagccatcaatgacgtcaatatcaactctcggataaagggatttagtcatcgccaacgccatacttactcccatacttccagcttctttgatgttcttgaaatatatatccggagcaactctcagcttgtcgaaaatttcggaagcatcaagtgcactcgggccgttgttatttaagaacatcgcttgaacaattggggcagcagcgttatcaacctcatcccgggctccttcaagttttttgatcttgctaaccaggacgtcgaattgagcttgagatttaatcttgcggtctgcatcaacagattcacattaataagtcagcatatggaggataatggcttttgagatattgattgttgataccttcaacttcctttaaagccaggtctctttgtcttgccagctctgccttgtcgttttccagaatttgaatctgcttctccaactgagatatcttggcagtttgcactacattgactacggttaatcaagattgcaaagataacaatatgagtcagttaagtagggtttgtacgtaccttttgatgagccactcagttcaaaatttgattcctggagctcagcaattcgattcctcagatcatgctcattcttcctggcaagctcttttgtctcgtgcagcagactcctggtggcttcgagggtcccgagatgagggactagcctctctaaggtttccgttttagcttcgttcctaagatgaatcctctgcaagacagtttaattagcgcctgaattaaatggcaaacaagatggttgagatcaggtaccagagggcttacatttacaatgtgggttgcctgaccaagtgccttcttcagtaggcataactcttcgtcctctttttgcttatttatcacggtcccttgaggctgcatgttgtcatcccaccacttgaccagaatcggagggcgtgaatcctcagctgcttgtatgcggggaatttcttcttcatcactgatcattggccctaatgtatctactaacagaggttagacaattggtcagagttatttgggttgacatggtttcagacaaagtgttttacccataatgatttctggatgaggatgagtggattcggatgcctttaaaggagatctagatctctggttattgctggcgtcttgactgcgaaggctatctgcttgagctccaacctctggaatctcttggcttggccttgcgtccgactggtttctagtcgggggctcctgattaaccccggcttcggcttcggccgactggtttccaatcgggggttgatcaccggattctacattatcggttgccggctgattgtcacttggacggtcctcggcagttgtcccgatttctttggaagaatttgcgtccacgctagtcgggtcagagtctttccctgacggatctatatcagatggtttcctgcaaatttgattattagtattattgctgcaat

SEQ ID NO: 57060 - DNA, 17348 bp, Oryza sativa
  unsure (1)..(17348): unsure at all n locations
ttggatcatgcttgccgtcgaactcaaaagctgtgcgggatctttctttgactggagctacccgacacttgatgaagtgctgggtgatctgctcttcttgaagaccctgttctttcagctttatcatcctctccatcagttctactgcctgagcagcttcatctcccataggcaatgagttccatgtgtcctggtaaaccggaggaagacagtttgcgtgctcaggagtgcgggctcaggattctgaacatagaaccagtttgcgtgccagcctttatttgaggtcttgaagggcatggagaagtatttttggcttagtgttcccctgagttggaaaccagcacccccaactacgcatggtttgctcttatttggctggggcttgaggaagaagatgcggcggaacaaggcaaaatgaggcctaatgcccagaaaagcttcgcaggcgtggataaaattggcaatatgcactatggagtttggattcagatgatgcaagctaatcccgtagaagttcagaatgccccggaaaaatcttgaggttggaagagaaaatccgccatagaagaagtgagcaaataccacgatttcatgcgtatcgggagtcgggaatgcttcgccaaatgccggtcgccacccgatgatctccttcgctggaagaacgccgtgcgccaccatctccttcagattatcttctgtcacatcggagggcgcccactgactctcgaagctttctctttcttccaccatgaatgtgaactggatggtttgatttggttcgagatacggatggaaagggatgggggaatcggtgcggtggacgcgtggagaagattcgtgggatttttgagaatggattggggcggattgatgaaccctagctccgtcggcgtagtcttgtactgtagcgaggaatggggaaatggcgagagtcttggcggggaagacgaagcgtcgcttggacttcggtgttttttagggtatcgtgagtactaatgggcctgggcctgtacagtacttcagcccaattttatttccagcgtggcccgttgtgattcttagggacttaggcactttttgctttggcaatttgtactcacaatgttgtggcccaatgctgattaaatcctttttaatgcggtttgctaattctttagaattaacacgatgcaaacaaaaggtgcctgacagaaaggtgttatgccgtttttgtaagctttattaggctacaaaagctgtttgggttgatttgagatgactggtttattcatagttattctcttagcatgttatatgcttattttgattatggtaaaggttatagcctaggctaatgaacttcttaattaccatgatctttatcatatttggtggatcattttaagagtttcttgctcggattcctaccaaatatatatatttttagaccttttgagtgtttatcactcggcccttctgtattttttgtccttgatatattcaagattgagaagcagtcggttgggtatcttactaagtaccatgcgtgcttcactataaaaccactcggttcttgactatatgtttagtttttcaactaatcacatagtcaggggctacacctaattaggtgcatctactcgatgcaccatgttttattttcgccctttacagtcttttagcactcggcaagccggagcaagttgaattaaagcactcggattattgtttttgtttcgagaagactattttggtcaactgtgaaggtctcgggggctactgtggagattatggttaccccatatctacatggcggttatattccagctggatatacggtaccaaatatagataaaatatttttacgaggactcgggttagattctaaacttgtatgtcaagaaaatacccgggatcctagtcggttacgattgtgttttatctgtaatcccatattccgttaggatatgggttgtactttgtattacggatcccttcccctgtataaggagggtccgtgtgcctcttggggcacgattcttttttcccaattatacaatcaataacacactcggcggaatcatccccggacaggagtagggtattacttcttgaataagaaggcctgaacctgtataaaattccttgtcttcaaacccatccactttcctagcttgatagccacccccttttattattgccgaaatcttgtttcgacacagtgtaattcctctttgcttatgtactttttcttcacttaggcagcgttcgtttggaggacattgagggagaaagcacctcgttttccgcacgcacgcttcccaaactattaaacggtgtgttttttgtaaaaattttctataagaaagttgctttaaaaaatcatattaatccatttttgaaatttaaaatagttaatactcaattaatcatgagctaatggctcacctcgttttgcgtatcttcccaatctcctcaaacacacccttattgtttatcggacatttaactgagcatatatacagtgccaaacagcgggaattggcatcccctgtttctcctttcttcagctttgtcagcacactgaactgtacaaaatcagttcatcttttcccacctaattctgaaaatgacatcaatagcaaaatgatcaaacaatcaaaattttcatagaaataaaatattttccttatcgcaattggcaccttacatttagatttattctaagttactcggcaaaaagaagaaggattaaattagtccatcgcttgcactgtttcatctgctagtgccagctccaacattttgaagagtttactattatagcttctcaacatctcaagcttgatgtaccaacctgtcgtagaaagcgtcctaccagtaagagcaatgatgcaagatcaactgcatataaacaaacaagcaaattaaacaaacacggtttgcaagtataaaaaacttatgtcaccttaattacatgcagtgcaatccagccagcagcaacaacaattaattgcacttggttgacctctataacattaaaaaatccctaagaaaattgctgacataatgttctagtcaattggtgttgcaactacccgtacatggtcagcagctgaagcaaggacgagagctcaactaaggaggtcattatctaaaaaaactagggatatgagggaaataattagaggattaaacagttcaattttgtactggtccacgcaatggaagagctaatagaatgttgtaattgcgtgtcaaatagattatacattgttgtgtagcttttggaactttcttttttcgctgaaatgtggcttttggaactcaagcatatcggatagataggcttgcacaagttgtccactagatcactactactgttgtatatgcactgggatgactatgaaagtacacaatggttggtaaccgtacactcaaaggaatacccagttttttaaaagaatttagggtatcaacttcaaacgagaaaaataattcatgaggggattctctattctccagccaaggtttacagaaccgattgccttaagacaaccgtgataatcaagcggttattatcgaaaaccagcaaaacttgttgaaaaaattgtatgctttttaaagttatctactttatcgagcgattcgtaaatacggctacggctagatagataagattgataaccacgataaccaaatggttattgccacatttgaaacggttatctaaagttttttttttttttgcaaatataagattgcttcaagatttgtgctctgacccacttcactcacttagtctctagctctatgcagaatgtttgtgtcctttcacccatctctttgccaccaatgcttaacggtaccttggaacacaggaaaaataataagatttcaaaggatttaaatcttatagtaaaattttctattaggtcttttggaacgaatcaggtcccagcccatataattcttttgaaatttgtgtggaatggcatgtttcatgggaattttgaaggattcctggcatgagctctctaatctctttggaatttccatttatgcctacctctctctgccatatcctgtgcttttcttgtattccatcccacgtagttttcctgtattttttgttccttacaattcaaggtgttactgacattctatttttatgttttttatattcctaagttccaaagagagtattggacccatgatcttgtatctttaagtgcctaccaagccagcatcgtgtcatagccggagcatcaatctccatatgaatccaatcgtgacctcatggtttgaatttttcaaattttcataatttttggacgccaaaagtctagcaatcctattttttgatagagatatatttactcatcacatatagagaaatcatatctcgaacaaacagtgcgcttgatggcgcccgcccaaccaccgccggctcagtcgctctaacacctctcgatcacctccttgcaagcaatgctagccatggccgccgccgcgctctcgccggagcgcgtccagtcgtcgtagcccctactcgccggcgccgctccaatcaccgtggttcagccacccgcggcggagtatgaagcgccacgacgcgggaacgccgccgcggcgcgcgcgcgaccatgcacgcggcgtgcttgtgctccacctgctgctcgtgtcggcctcgctgcgcggcgcgacggccgcgccgggcgaggcggaggcgctgctcgcgtggaaggacaccctgccgcgctcggcggcggcggcggccggcgtcctcgggtcgtgggcgacgccgtcgccgcagcagccgaacgcgaaccccgccgtcgcggcgtgcgcgtggcgcggcgtggcgtgcgacgcgtcgggcgtcgtggtgggcgtcgacgtggccggcgcgggggtcgccgggacgctcgacgccctcgacctctcgtcgctgccgggcctcgccgcgctcaacctcagcctcaactcgctcacgggctccttcccgtcgaacgtgtcgtcgccgctgctcagcctccggtccatcgatctgtcgagcaacaacctctccggcccgatcccggcggcgctgccggcgctcatgcccaacctcgagcacctcaacctctcgtccaaccagttctccggcgagataccggcgtccctcgcgaagctgacgaagctccagagcgtcgttcttggctccaacctcctccacggcggcgtgccgccggtgatcggcaacatctccggcctgcgaacgctcgagctctccggtaacccgttgggcggcgcgatccctaccactctcggcaagctccggtcgctggaacacatcaacgtcagcctcgccgggctggagtccaccattcccgacgagctcagcctctgcgccaacctcaccgtcattggcctcgccgggaacaagctcaccggcaagctgccggtagcgctggcgaggctgacgagagtgcgggagttcaacgtctccaagaacatgctctccggcgaggtcttgcccgactacttcaccgcctggaccaacctcgaggtgttccaggcggacggcaaccggttcaccggcgagatccccacggcgatcaccatggcgtcgaggctggagttcctctccttggcgaccaacaacctctccggcgcgatcccgccggtgatcggaacgctcgccaacctcaagctcctcgacctcgccgagaacaagctcgccggtgcgatcccccgcacgatcggcaacctcacgagcctcgagacgctgcggctgtacaccaacaagctcaccggccggctccccgacgagctcggcgacatggcggcgctgcagaggctgtccgtaagcagcaacatgctggagggcgagctcccggcggggctcgcgcggctgccgaggctcgtcggcctcgtcgccttcgacaacctcctctccggggccatcccgccggagttcggccggaacggccagctctccatcgtcagcatggcgaacaaccgcttctccggcgagctgcctcgtggcgtgtgcgcgagcgcgccgcggctccggtggctcggcctcgacgacaaccaattctccggcaccgtgccggcgtgctaccgcaacctgaccaaccttgtgcgcctccggatggcacggaacaagctcgccggcgacgtgtcggagatcctcgcgtcgcaccccgacctttactaccttgacctgtccggcaactcgttcgacggcgagctccccgagcactgggcgcagttcaagagcctctcgttcctccacttgagcggcaacaagatcgccggagcgattccggcgagctacggcgccatgtccctgcaagatttggacctctcgtcgaaccgtctcgccggcgagatcccgccggagctcgggagcttgccgttgaccaagctgaacctgcgccgcaacgccttgtcgggacgtgtccctgcgacgctcgggaacgccgcgagaatggagatgctcgacctgtccgggaacgcgctcgacggcggcgtgccggtggagctgacgaagctggccgagatgtggtacctcaacctgagcagcaacaacctctccggcgaggtgccgcccctgctcggcaagatgaggtcgctgacgacgctggatctcagcggcaaccccggcctgtgcggccacgacattgccgggctgaactcttgcagctcgaacaccaccaccggcgacggccactccggtaagacgaggctggtgctcgccgtcacgctctccgtcgccgccgcgctgctggtgtccatggtggccgtggtttgcgcggtgtcacgcaaggcgaggcgagccgccgtcgtcgtagagaaggcggagacgtcggcgagcggaggcggcgggagctcgacggcggcggcggtgcaggcctcgatatggagcaaggacacgacgttctccttcggcgacatcctggcggcgacggagcacttcaacgacgcgtactgcatcggcaaggggagcttcgggaccgtgtaccgcgccgacctcggcggcgggcgcgccgtcgccgtgaagcggctcgacgcgtcggagaccggcgacgcgtgctggggcgtcagcgagaggagcttcgagaacgaggtgagggcgctgacgcgggtccgccaccgcaacatcgtcaagctccacggcttctgcgccatgggcgggtacatgtacctcgtgtacgagctcgccgagcggggcagcctcggcgcggtgctgtacggcggcggcggcggcggcggctgcaggttcgactggccggcgaggatgagggcgatcaggggcgtcgcgcacgcgctcgcctacctccaccacgactgctcgccgccgatgatccaccgcgacgtctccgtcaacaacgtcctcctcgacccggactacgagccgcgggtgtcggacttcggcacggcgaggttcctcgtccccggccgctccacctgcgacagcatcgccggctcctacggctacatggcaccaggtacaaactgtccgtacatccatagccacacagggtgaaaacggtcggaatctaacgacgctgctagttgattatatttatcatttaaactactcagtacgatattaatgtgatgcataaagaaattagaaaaaacaaattttatatctatgatatttaaaatcttaatagtggtggtgtccattcgcacgcaatctctaccattgacatatgggtctcataatctatactattacctttcagcaaatcttcaatttcaccattagctctcccaaatttcaaaatcacctacttgttgaaataagaaaaactatagtattacttagactaaatagggtcttattattaactagctgggtgacccgcgcaattacgcggctagcacccaaacaaaatcatatattattttagtatgattcatttaaaatttattaaataactagctcattgtcttaagactttgaaagaccaaaccttatcatcctcgtgtttctaattatatagtttttaaaagtcacaccagttgctaccccttatgtcatctccttctttatttgcttgctcgatctatcactatttctattcatttttcttggaacatttaaaaattggattttatagtttttagagtttattgttatgttgggtttcatttttataatatctagatgtcccgtcaaacgttgccattatactcctctatggcccgtccactgtctcttctctttattgtcattgagatttttaaaatcgaacataattatcatttgtgttcattttttactttctagaagtcccgccaaaccatcagcggctttgccattgtactcctctacggttcgcccgctgcctcccttctttattgtcattgagattttaaaatcaaacatgattattattgttttttttttactttttagaagttccaaacctttaaaaattaaacttgtagttttattttttataatttttagaagtcccttcaaacgatgccactatgcccctctacagcccgtccgccgcctactctttatcgtcattgtgattctaaaaatcgaacataactatcgttagaatttattttttattttctagaagtcccgtcaaccgtcggcggctctgcaactatactcttatacaccctgcccactgtttttcctttttattgtcattgagattttaaaaatcgaatatgattatcaatggtgttttttttttactttctagaagtctcggcaaccgccttacttgtttgcttcacggcctacttgacgtccctccttttaatcgtcattaggattctatttggtgttttattaacaatttttatatgtcgtatcaaccgccactactctactcctttatatgcatggtacttaatttatctcgtcatgtgttttagatggttttctttcaatagtctttatttttatcacaaattttatacattgtattcctaattgaaatcttatttttctttttctattttcagaatttaattttttttagaaaaattagttaataccgtattgtgtttttttaatgtttttattttctattttcaattttagttgtttcaaaattgtattcctacttgaactctcttttaatttttctaattttggatattattttattttttattcaaaatttttattaatctcgtattaggttcttatatggattcttcgttcaatattgcctatttttaatttcgaatttcatctaattttaaattgtattcatacttgaactcttcttttattttcttttgctaatttcggatttatttttattccgaattttaattaatctcatattgggttcttgtatgtactctttttttaatattccttatttttaattccgactttcagttatttttaaattgtattcctacttggactctcctttccttttctaattttggattttattttatttttatttcgaattttgattaatctcgtattgggttcttatatggaaacttctttcaatattgcttatttttaattccgaatttcagctatttttaaactgtatttctacttggactctcctttccttttctaattttggatattattttatttttattttgaattttgattaatctcgtattgggttcttatatggaaacttatttcaatattgcttatttttaattctgaattttagatatttttaaattgtacttctacttggactcttcttttctttttttttttctttttctctgattaatgtgggaatttctagcccccacagcgaacatggtgcctcctttcaatgctgttttaataatataatagattgattgattgattcaataagctagaaatttaatttgttttctgttgcaatgcacggactctaagctagtatagccaaaaaaaaaaaggaaaaccgttgaaaacagtgccccttaaacataaacggcgcccaattgattgagaattttcgtgaccattttcaccccttatacacaccgaatccgccattgacgctgataccatgtttatcttgcggtcttgccgcagagctggcgtacatgagggtgacgaccaagtgcgacgtgtacagcttcggcgtcgtggcgatggagatgctcatgggcaagtaccccggcgggctcatcagctcgctgcaacactcgccgcagtcactgtcagccgaggggcacgacggcagcggcggcggcggcggcgaggaggcgtcggcgtcggcgtcgcgccggctgctgctcaaggacgtggtggatcagaggctggacgccccggcggggaagctggccgggcaggtcgtgttcgccttcgtcgtggcgctgtcttgcgtccggacgagccccgacgcccggccgacgatgcgcgccgtcgcgcaggagctcgccgctcgccggcgaccgatcctggacaggccgttcgagatgatcaagataggcgacctgacaaattctcacagatgagagagaaaatttgtgacaaattatcgattgctttgtgcttatgtgattccgttagtagattctcattagcatctgtatagtttttgtacagtgatatttagtcccgtttgagaacagatgatgaagagtgttgattgactttttttaaaaaagaaattaaaaattggatttatctatctatgttttaaaacaagttttatggagaaagttatttcatgaaacacgtcgtttagaagtttgaaagtactaacgaaaggcgaggtaaaatctacatgtaaattaccgaacgtttgggctgaattgatgccttcctacgggctgaatttatgcacagttatcggctgaatttgcactcacataagggccgaattcacgccagcttttgggctcaatcgacgtaaacttgtcggccagattgaccagcatttctgggtcagatttacctgcatatatgggctaaatatgcgcaaaccaacggaccattgagcagaaagcattgggctgaaattacgtcaaataatggccgaatttatcctcattgggtccaactaacgctcactgttgggccaaatttacgggcctaatgggctaaatttgcgctcattttcggtccgcactaacgctcaaataaggggccaattttacgaccttttcggccgaactatggactgaatttactcccaaaaatcttaaaagaaaattcaaaaacaattgttcttaaattcgagtataatctccacctcagttcttacaaattttacccccaaaacacttttatcccactcacaaaaacttgtacatgaacaagtcaaaatactccatacaacaagaatcatccatccggtcatccctcttgcaaaatgcagagacacagagaagtagcagcagcagctcagcacgagaccccgcatggcttgaggacggggcccttgggcttggggatgaaggggtcgatcctgacccagacgagggagaagatggaggcgaggaggatggaccagagcacgacaatggtgggcgtccggttctgcctccccatgagccccttgaggaaggggtagaggtggaggatgacccagaaggagaagaagagcttcccgaacagcgggccccacgacccgtacccgttgttcacggcgtccgacacgccggcgacgatccccaccatgttgatgatgatcagcgtcgtcggcggcaccagcagcgtcgtccacttgaacaggtagagctcgccgaacgcgtcggtctcgtcggcggcggccttggacgtcaccgtgaaagtggtgtccacgccgncgagcaccttgaggaggccctggaacacggcgaacaggtgcgccgacacgccgccgatcacccagaactgctcgttcctccaccagtcctcgatgctcaccccgctccaccgcagctccagcacccccgtcgcgatgatcgacaggaaaagcgctatgaaccatatgctcgccaaattgttaagctacacgtacaccaagatcgcgatcgatcggtcagtgcaagatcatttggagcttgaaattttagcggaaattttgatgttcttggttggttctttaccgtggggatgatgaacttgccggtgaggaggcagacggcggggatggtgcagtaggcgaggaggggaatggaggtgaaggggtagacgatggtgttggtgtaggcgaagcgctcgagccacttgaggcggccgccataggcgtaccagagcgggcaatggcggctcatgaagatctcgacggagccgagcgcccaccggagcacctggtgcagacgatccgacaggttgatgggcgccgaccccttgaatgccgccctcgccggcgtgcagtacaccgacttccacccacggcaatgcatcttgaaccccgttaagatgtcctccgtcaccgacccgtagatccacccaatctgcaagaattttgatttttggttagcttcgatcatcttcctcgagcttgaaaatggtggagattttttgatggattacctccttgccccactcggtcttctcctcgtagccgcagctgatgacgtggatggcctccttgatgagggcggcggggtcggcggcggcgccctgggggaggccgccgtcctcgacgagggtggaggcgatgaacaccggcgactggccgaaccgcttctcgaagctcttctgcgacatgagcgacgagcgctccagctcgtcgtacccctcgaggccctcctcgatctcctccagctcgaacccgcgctggtgcttccggtaccctttcttccctccggcgagcgacgccgcgccgccgccgagcttgtccttcttgctcctcttcttgtagaacccgagcagcccgcggcgcggctcgtcgaggccgccgccctcgccgccgccgccgcccttcttgttcttgtgcgacttgccgcgcttccccccgccgaagcagcagcagcagcagcaccacgacggccagcagtcgcacgtcatcttcggcctcttctccggccgcggcgggtcgtatccgtacagcgcctgcctgttgaacaccgtccccgtccccacgtacaccggcccctgtatcccgtccagccccttcatgttgatctgcacatcaaacgacaccatcgttagctcacgtcacggcgcgacgcacgcacgccggagaagaaggcagtgctcacgtcgaagaagacggtgttgcggttggcgtagcgatcgtggcggtcgatgccgtcgaagcgctgggggaactggacgtagcacagcttcttgccgagctgcttgtccatgaggaagcacatggcctcgcggacggccttgctgttgttgacgtagtggtcgcagtcgaggttgaggatgaagggggcgttggtaagcacggcggagacgcgaacgagggagttcatggcgccggccttcttgtggtggttgtagccgggccgcttctcgcgggacacgtacaccagccgcggcagctcgctgccctcgacgtcgagcgcgccctggctgcccaggtacacctggatcatccccgggtggtccctcgtgttgttccccggccatggcgtcccgtcctgcatcacccacccttcctccggcttcttctgcgccttcgccaccagcgcgtttatcctcaccttgaactcctcatactctctctgtcacatcaagagtaggtgttaaaaaacttatagacgatctaaactggatgacaacatcgagaagggatatatcggtaacgaagtttagccatagcctacatctccaaaaacagactgatcacgagatgctccaattgaatgagggttcaaaattacataacataatttttgacatttcagttctattggacaacctgatatgatattatttcggacgaaacttttaaatgtttttcaaatttttgtgaatttgataatatttattcaaattttaatcattttttttcaaaataaaataaaataattttggatcgaaataaccggctatatcggtccccccaacacaaatgcctaaaacaatatattaaacccttgaatccggtatatccacgacactcaacccgcagatggagtggagaaggtttaccttcatggcgcggcgttctttgacgaaggtgggctggaccttgtccttgaggtagtcgatcttctgggagaagtagaactcgggggcgcggggctcgatggtgaacttcttgcagaaggggacccaccggcgggcgaactcggcggtctcggagagcgtgtcgaagagcagcatggacgcgccgtcgtcggagacgtagcaggagacgcggtcgacggggtagtcgacggcgaggatggacagcacggtgttggcggtgatgatgggcggctccttgagcgggtccaccgtgctgacgaagaaatcgatcggggccaggcggcacggctcgccgtcgcgctcgtaccggagggccagccggtccaggtacgtctccctcgtcaccggcgaccacttgggcagctggtcgaggatccacgacagcgcgaaccacagctcgcagatcaccgaggccagccacagcggcaccgcgtccatcgccggcgtcgtgatccggaacttgaggaagaagcagagcaccaccagccggagcacgatcacgatccggtacgggttgatcttgctcgacgggatcggcaccttcctccacagcggctgcctcgcctccgcgagcctgcatgcagaaattcgatcatcacgatcatgccaaagttcacaagatttgaaaaatctgaggtcgatcgatagatagatctttggagagctaagcttacagcatgtactcgtcgtcgttcttgtcgtcgtcgtcgtcgctgtcgtcgcggttgagcttgccccgcttctcctgcttcgtcttccacttgtcgatcctgtccttccactccatgccaccctccatctccctctcctgctccagatccttcccagccactgcaatttcacagcaatccacacacacatcttcagatgaattgttacaccaagaaacgcaatttcttgcgggatttgagtaccgaccgcttccggtgaaggaagagagcgccgggcctccagggcgccacttctgtgccggctgctcgccgttctcctgcaagacaaaggttgtatacaggtttcgcatcagtttacaagcacttgattgcagagcaattgcagtgagaaatcaatggcgatggatcgatcgagtcgagttgagctctcaccgagtagacgtcgaagttgacgggctcgtgggggggtttctgcttggtggggctcttgatctggaactcctcctcgaagtcgtccatgtcgccgccgtcgtcctcgtcgccttccacccgtgggcaccctgcgaccgatcgatcgagacagacagacagacattcttgtcaagctcgatcttgtgaactaaattgcgattgatcacatggacacaacacatgatgttacctttgtggcgcttgtagcgggtgttgcactgggggcagcactgggtgccctcgctgcgctcgtactcgtagcagggcttgcacaccgggaagccgcactcggcgcacgccacgaacggcttcccgtcctccctcgccgccacctcctcgccgcacacccggcacgtcttctccttccccttgtgctcgccaccggtgacggaggcggtgtccatggtgaggtgccggggaagcgacgttggtgggcgaggaggaggcggcggctagctaggtgatatagcagctggttgatgatcagatgcagggaggcgggggcggtaaggtggcggggtggcgtcccgcaccaaccgtgagttggggcgtcccggtttgattagagcgcaagccaaggcacgcacgcacgcggccgcgcgcgccatgcattgctcgcttcggaagcaagccgccgctgccgatgctgctgctgctggaacgagatcgtcgtaaggtgagatcgcaacgagacgcgagggaaatgtgttggaggggtcgtagtgcagctgaagcaaaatcgaaggccaacggtgaagggacgtggatgtgtttggtgggtgggttgcggtgacgcctcaccgtttttctggtgagatggtgcaggggggagatccgggccatccggctcgtgtaagcgttaagtcactgcgtgtataaatggcagacggtaggaggaaggccatctgaacctgtcaagtgagatgaaatcctgcgatgctggcgttaacacgcattgcgattcagggaggctctggtgtagcagcacgccgacacacacacacacacactctttctcggttcaaacgtgagcgtgaccaacacatatcaggttagccatctaggacaaactagactcgaggccccgagagccaacatcagctagatttttgtttttttttatgtttcacgttttcagtacgaatcaggtgtgcagtgagaaaagcaatggattgatgcttgcattaaaaagggtaagtagtgtacaccatccagtaagaatatgccgtgtaagcagatcgcaatgccatggctcctcttgattgtcaatgtatgttacgagcaaaattaagtggcgtacaaactcctcaacatctttgtatcttttaccataagctatcagagaggaaagcaacacaataggtcggaaaaattgcctcggacaacaacactagctgaggctgtaaagaacaggcgccggtatcggcacaccactcgatggccactatccaagctgcaacgttttgcggtgacttacacgttgtaccgtccacctctgcttggtttctccctcttggcgtcatcctgcattgaagttgaagcaccatccaaatagaatgagctatggacgtatttgatctattctacaggtgactaaaaaataatatgttattgagacaacaaaaatagtctaaacacatacatggaagctgtagaccatcttatcattgtagtcaacaatctccttccatttcttgccaatgtttacctgcaaagcaaaggcatgttagttttctctagttatcattggtctatggttgaagccatgtttcaaaaggtaatgctcaaatctcaaaaaaaaacacatatagagatgtcctttgaatgcacagacctgtggtaacaatgaaaaatttatgaagtgcagaaaaaagagacaggatggttgaagagttagggaattacaaagcgattgcttcattgcaaaatgtgaaacgttttagtactattatggtgctcatcaatgcaaaccagcattgatgttgtgtttatgtttttgttatcataccaatgcaatatatcactatatcagaaacaaaatagatggcaatcataatggatgcatcaaccatcaatagtattgcatgatgtgggcaccagatgactttaagagtcttgagtctctttgacacggc

SEQ ID NO: 57061 - DNA, 936 bp, Oryza sativa
atgtaaagtctagcctaccatcaaatacttgtcaactgtatcccaaataaattgagcaaaattagtgaagtggacaaatttgatgaacagaatactaaagagaacatggcagctttgaacaacatgtttaatgttgactatagaggtggtgggaaaacaatgtactacagattaaattgcttgctacatcaaatatatgagcaaatacactcatattgttatactacagtatttttcaaaaaaccaacctgaacggcttcattgctggcagtcctagtccacaatgcaagcttgtctcctctctggcggacactagcaacaactccacaaatttcctcactttcatcaaactgctctccaatcagagccatcagctgcatgttcgaaaagtttgtcagcagaaatgatagaaactttagaagataggtcaagcaacagatgttatatccaaagcacttcagagcctccgaccaaactaagcaatgattttagaggaaatgtaccgtttcaagccacatgttctcaagggtggtcttcctgctacatggcacagtccatttgcccccatttgcacactctgggtcttcccactttggttctacaccagccttgaataaatgaaaatcagcatttactgtcaccttgcttggacggaaaatctgatcatacaagctgcagcaagaaataaggggatttaaatgaaaggaagatcatgcctgcacatataggataaaaggacaatcaaattcaaaagtatccgataataggcaggaatacctacagtaagaacttgccaaaacatagaaaaaatacaacagagtaattaatacctacgcctccatgtgcccacaatattgaatgtcattctagttgtaagtctcaaaaggtataactatttttcttatctttagacacaaaaaaaaaagtcgcatgcaa

SEQ ID NO: 57062 - DNA, 1223 bp, Oryza sativa
  unsure (1)..(1223): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttcttctcctccaaacagcgcgcgctttttgtgtactccccgagagttgacagccgtcgtcgtcgtcaccatgtgcaactccggcaccagctcctcgccgtcggcgcctgcgccgccgccgccgccgctcacctcgttcaagcactcctcccacctcctccgcctcgtggacgatgacgccgacgacggccatgcgctgctgctctccaaggtaaaacacgcggtacatatgctgtagtaatacttacccgcggcttggtaattttgatggcgtgaacagaacatgtaggccattatatcaaagagctaatgcaagaagcacgcatagcgacatagctggctggctggctggttgtttaatgcttatttactagtagctaggcatcactggcagtaacagtaacgagaaagaaaaggaaagctccagctgttgggaaatggcagagctgatcaatacgtccatgcacacgaacagctgatcgagacgacgacgacgttgctttgcttgttggtttctaacatgcgtgagtgcgtgtctcccaggtggccggcgaggcgcaggcgatcgggcgggtgtcggtgccgatggcggtgacggggctcgtcatgtactcgcgggcgctcatctcgatgctgttccttggccggctcggcgagctggccctcgccggagggtcgctggcgctcggcttcgccaacatcaccggctactcggtgctctccgggctggcgctcgggatggagcccatctgcggccaggcgttcggcgcgcgccgcgggaagctgctggcgctggcgctccaccgcaccgtgctgctgctgctcgccgtcgcgctgcccatctccctcctgtgggtgacgtccacggggtacatactgaagcagctcggccaggacgagggcgtggcggacgcggcgcagacgttcgcggcgtacgcgtcggccgacctggcggtgctcgccgtgctgcacccgctcc

SEQ ID NO: 57063 - DNA, 7194 bp, Oryza sativa
cggtccgcagccactggggccgcatgttcacgtcggacggcgagatcctccgcctcacggccgtggcgctccccatcgcggggctctgcgagctcggcaactgcccgcagacggccgggtgcggcgtcctccgcggcagcgcccgcccggccagcggcgcgcgcatcaacctcgcctccttctacctggtcggcatgccggtcggcgtggcgctggcattcggcgcccgcctaggcttcgccgggctgtggctgggcctccttgccgcgcaggctgcctgcgcggtgtggatggcgcgcgccgtggccgccaccgactgggacgtcgaggtggcgcgtgccaaggagctgaccaaggcgtccactacaggcagcggcaccaaccaccagcacgagtgcaacaacagcaacaccaacaccgccaacgcaaaggctaacaccaaaacgacaacgtctcccgccgccaataacatcaatgccggtggcggcggcagcagcgacaaccgcggttacgtgcccatcagcgagagcggccacaacgacggcagcgacgacctggagaagctggaggaagggctcatggtggccacgagtggcggctgctgcggctgcggcgacgcgttaggcgtcgacacgaaggctggggacaagcagcagtgcagcaacggtggtgccggtacggcggagggaaatgcggggcagaggaggggctcggcgtcgtcggagagggccccgctgatcagtgtgggggacgacgaggaggccggggaggagaacgacggcgacggcggtggaggtggccacgtctagctagctgctaatcaaccagcgtggtcgatccatccatcgattaattctggagaggttttgatcgtacgtacgtaggctatgtttgacactgatcggccggtctccatttcatctttctctccatcttgatttgggggtgaggtttagttttgtctgtataaccaagctgagcagctaattaatgagagtattcaggaaaaaaaaagagggagaaaaaaacatatatattcttcccttatttttcttaattaattatacttctatgtacaaatactaattagtttgggtgtaaattataattaaatcaattgatggtgattaattaagaattgacaagtgcatgcatgttgctgtttggcatgatgtggcagtactgtttgttgtgttgagagtgggggtgtgtgtggctttgggacctgtatatatcgctgttcccctagtggttacatacgtgacaaccaatggtggtgccccatttcggccatttcccaactgttccaacatcgctaagagaaaaaactcgcattggccctcctttaagttttctccgagatggctagcacagctacctagctagctacctttcttccttttgataaagtcgcaaccatttgatatctacaagcacttgggcgaaaaaaaggcacccttggtgttttgcgatttttaaatattactactgcatatgcacctttttatttatttctggctcctcgtgcaaaggaaagatggtgcgtgtgactcagtttctcatgtcttctatattgagataaaccttttgatcaaaaggctcttgccacaaatattaatttgccattgctcaccacacaagaagtgctctctcgagggtaaaaggatcacactagctagcatgaatttatactttctgtgcagatgtagaaatgtggaatataacccttatgtgggaagaaaggatctatatcataaccaaaatttgatgatgcttgccttagtgtccgtagcttataagatgagagagagagagagagagagagagagagagagagagagagagagagagagagagagagagagagagagagaaacctagagtgctagaaattcttgaacttaaacaaatcgtatggcaagctcttaatttggtgagccccggattgcgactagcatgcaactgttggggacatctaaatgtgttccagccctgctctatcataaaacaattattgttaaggtgtttattcctcggcccgctctttctatgagtggttcaaaaacatacttttgttcacaaatagatgtcatttgaggaatatttttccctagatatataggccctcttataagttgtcgagactcgagacttgtaatagaactagtgggcgtgtggggctattaattgcagttaacaatattagtttgaaagtggtaaatttgtcaaaataatatgatttgattgacgaccgcttcatatgcccgaaactaatatgacgttcaagaagaacggtgcgaatattagatcgcatttttcttaagactataagcgtacgtggtccaacatatcttttatcctttagtgttttcttatctatatttaactagttgatacccacactttgctatgagatatgtggataaatgcatgttatacattatagaaataatagatatatatatttaaagaatgtaaaaaataatgtgaagataatgatttgacattatttgcatattgagttataaaaatatagcaaaatcgtgaatgatatgtcatgtttgcatcatatttaaaactctagataataattgctagtggtgataatgtgatacacttgcatgttgagttttagaagttagtggacatatatatgtctaggttcgtatataaaagttgatttttttttcaataacaaagggaatggccacataggagcgttaaggaaactattcactaattttgtactcatatactagtataagacccttgctggactaaaaatcacacatagcagtaaagtttgccgtccaaggatacctgcaaaagcaccatttgcacattcatctccctcatttgcacctgctgaccagaattccctttttcaaaaaaagaaaagaaaacaaaagtcccctgatgagactcctgcctacagtttttatccgagaagacttggggtgtttagatacaggggtggtttagcgtgtcacgtcggatattatatatgtgtcgcatggggtgttcgggtaataaaaaaactaattatataatccattaataaattgcgagatgaatttattaagcctaattaatctatcattagtaaatatttaatgtagcaccacattgcgaaatcatggagcaattagatttaaaagatttgtctcgtaaattagttgtaatatgtgtaattagttatctttttagcttatatttaatactttatacaggtgttcagacgttcgatgtgacatggtgtaaactttttaggagggatctaaataggccttaaaacaaaaaaaaaaacaattggaatactaccgtgtttgagagtaccatggatttcagtagcagcagcagtcaatccacggacaggccaggaggcaggcaggagtgcagggcagagaagcagagtctgcagagagaaaatagattactcctacttgacaaggcgttgccaaaagacgaatcagaggctgcccaatcgccacgccgatcagatcagttgcgacgagacgcttcgggcacggcatggagagacagccgatcacaagcgcgaccaccatgcatgtcaattttgtcatgcatatgcttgcgccgatccattagaccatttacagtccgttctcctcattcgaggtgcatcagagtatcacgtagactaaggttatgggtctaaaatcttaattcttcacagtgcaaatggctttagttctaatatttttgtttcagttctaatatttttcataatttgtgtggatgtccaaaatttacactgaacaccctagaatctagaaaaaaaaataaacccctcctcacccctctctctcctcctctctccctactatggcagtttggcatcctccttcggctaccccgccgccggtgcccctctccccctcccctcctctctccaccgacgtcgacgccggtccgagcgtggttggcaaggggcaagcagccggcgagctccaagctacgtggtcggcgagctccgaccgacagagcgggctccgggtggcgtgctcggcgaggggcaagcggccggtgaccctgtctcctcccatagccggcgcccctctccccctcccctcctctctccgctgacgtcgacgccggtccgggcatggtcggcgagggacaggtggctggcgagctccaactgacacgacaagctttgggtggtgtggtcggcgaggggcaggcggccggcgaccctgtctcttcccacggccggcgctcatcatcttctcccctggtcggcaccctctgagctcggcggcgcggatcgaacgcctcgtcaatggctaagaaatcggcaccggatctagcggctcaccaacggtgtggttgagtggcctcagcggcgagcgggcggcggtaggcaggccctggtagcctcctcttctcccccggtgcttgttctcgcttccgacgccatcttgtgttgctgctctcgttctcctttccgctgctcttgcacgagagaaaggagagcgcgggaggggaaaaggagcgcggccgcttgtcgaagccacgagcggcgaggccctgacctccacaacacggagctgcgcccctctcccgcgccgcgcgcccttggtcaggccgaagaacgggtgaccagttttggctccgcgttcttcacgggacaacgctggtagatgatgtggcggcaaatattctgttcctcacgctcgggccgaacgacacgtccgcgcattgtgaatggccttatgtcacagagttgcaccagctgattgtgaaaattcggttatttttacaattaaatttagcttgtgtcaccattgaaaaacattttcgattatatgtacaaacaatcgataagaaatcatgctcataaaaaatcatgggtaaatatttaggaccatctgtgaaaattgttttaaaaggatcatctattaaaatagagttattttatagggatctctttagaaatcgtctatagaagtcactattctcacacaaacccctaagggaacatatattttcacaaatggttccttataatggatggctatgaaaattgtttgactacattaaaatatgatgggccgaataagcgggtaagtcctccctcccttcccgcaattccctcctagccttcatgcttatcgtcctcctttctaccatccgggagtggcggatcgacgataactgtggggctcgggagcgcatatcgatggtggcagggccaagaagagtggattcgacatcgatagatctaagtagcagtggatcgatggcagcgagtcttggggctgccaaatttagcggcgtcggcctcgggaccactagatatagcggtggtgatcctcaatatggcttcatttcagttacagcaatgatgaccgcaacagggtctaagactcgacaataacatcatgatgatgaccgtagtaaggacgtcgtctcggctgttgctaccacttttgcaaagggattatgaagagggacttgggaaatttgatcatgacctatgtagaactgcgattcgatgtagttttcatatttttttttacaaatatatttgcaagtaaagactactgtctatgaggcaggtaatttatcagaggcgagcgagtcacccaaccgcccacctgtacaaaccaaaattagtcacctgtatacaatggtagactggtagtgctttcgtaatagtgtgctaatcaaacaggaatacgatgaaacttgtgtactagaattgtcagataaagcaccctgatcttcttagatttctttggttatctttcgctttgcatggtagtattatcaaacccaacccactagataggtggcgaactggccaagtttatttatgtcaccactcaccgagcatggcccaaaggcaatatgggtccacaagacaagtcctaacacatatattcatctgcatattgtagagaaaaaaaataaatgtgcactttgcacatcactatatatcttttccttcttttattttttcgtaagtagatagcctaagttgactaaagtgttatttaatagtatcttgccgataggacatatgacttggtgtcttgcagattggactagtgtctaatgcatttataggatcatgtcatggtgtcaacgctttagtgatactatgttcattatttatgttttccgaccatagtgaaaaattaaaggtccacattattctaaaaaaattgctggggaatacgagtcatcaaattaactgtttgctttatatatcatacaggaaggaggaagacaaatgggtgtttgtaacaatatactcactcgggtcacagtctcacagataagtgaatactacgtaattaatttgacgctttcacacaaacacgacattgacacgaccgatctaggcctcctttgaaacacatgaagtaatgtcaatgtcctgtcattaacgcatcaataggtcagatattatggcttattaaaccctacaggaagtgaatcctcatgaatttgtaaaaaaaagtgttattcagtagcactacagaaaaaacatatgaattttgagatacaataagagaaaacatgaaatcttgtctctggctaactttcctctaaaatttatatgaaatgagctattctataggaattccaaaggatttttttgaaggtcatttatttcaatccttcatgattcctccatttttttcctttgttccaaagaagcctttatttcttatattctccttcttacataacctagcaaaattttagtatcataaaaaatatttctgagactaatttacttaaaccattttaacattttctttacaatgaaaatgttacacatagctagacgttggcaacaaggatacgaccacaaagttctgttttaaagaaatagagaaaatacgcaaaatgaggtgagctattagtatatgattaattaagtattaattattttaaacttcagaaatagattaatatgattttctaaaacaaatttcatattttttttaaaaaaaacacatcgtttagtagttcgggaagcgtgcgtgcggaaaacgaaagaaacaaactcactttcatctccaaacgaccaccggtgaagaagtgatttttactcccggttcgtaatcccccagtagtcctggtttgaggaaggggagaggaggtggaggagaggggaggggatgaggaaggggaggaggtagaggggatggttcgggg

SEQ ID NO: 57064 - DNA, 2561 bp, Oryza sativa
ttagttccggtggactaaagatcctcggcccctgacattaatttgacaggggatgaaccgggactaaagatgatttttagtcccggttgataacaaccgggactaaagatcatagaatggctctgaggttttcaaccgggactaaagatcatttttagtcccggttctttttggaaccgggattattgtggttttgggtcgacccagcaaagatcatttctccaccagtggacgtgggacaaatcaatccctagctccttcactaaaaagtggccagctgaattaattcagctaacaaaaatcacaaagattggcaattaattctagatgtactatgccattcaatacggagcaaaagactcttagctagtactaccaattttatagtttagcctgctcccgtgaagcaagctatcaaacataaagataaccttgtattcccaccgtactataaaaaaaccaacctagtaccgatgtgacacatacaagtactacgaattcagacatacctctgtctagattcattgtactagaatatgtcacatctagtactagattcctttttttttgggacggaggaagtataggataagacaattttttatatttttaaaaactttatcattttgataataccaaattgaccagactaatacactaactctaaatattttttttattagcactctccttcaccaattttctcaaaaatatttttatattttcgataataaaaatattatttttggttttttatcaaccaggttgtgcaaccgtacaatcatttatatatatgtacaataatctacatactcatggtacatatcaacggctaagtacatgtttgattacatatatacatcacaaaacctagctaattaattaggtttcactatatgcaacatccaaaacattattcatatttacccaagaaaatagtacagctatatgaatcacaaaaggtagtatttctttctttttacaggagggagcactacattaatcaaatgatgaagggattgatatcctgccattattgacgactcagctgtctacttctcagatggcaaacagcagaggcattgagcagtagctggacgacgaaaattaacaaaaagttagtacttgcccactatcagcagcagcaacccccacaaaattttggccattcaccctttgcagttttgcactacgccattcccctaccgatcatccccatccgtggccctacccggcctgcctcctcctatatcgcttcagcagttcaccctttcctctcagcacaatgctagctttgtcatgatatacacattttcacccccttttgttctacatactgcaatttagcgagagtgcttctccggccgtggcactgcagttgcacaattggctgcatttactttgcaataggtaccctcaagaaaactttttgttgcatcatttttaggtaggtaggtatgctagatgcgccagcccccaataggcaataacacagaagtacatcctctgtgcaagaagaaaattctagtagtaattctcttagtcaatcgataggagcagagtatagaatataccatgtcatactatctttttttcatctaaactatactaccttcgtctcaaaaggaatctaccaatctaaataacactatatccagctttgtaaccaggagttgatttattttaagacgaagggtataggctatagtgctgaagattgatttttgaacacaagagttcaatataatcttataagatgtttatagtatacactgaattttccagcataattttctgcagtgatagacattattaaatatataattgaatttgatacacaaccttgcttctatttttataaatactaccgtagttcgtacataattaaaaaatatacctctttgtaatctgggcccatcacaaactcatgatagaacggtgcaactttgtttattataatctttaatttaattttataaagtctttaaaactagactttgagacttaatttctcatctttatctttatctttacttacttaaaaaaataaaatatgcttccaacaaaagaaattagtttgtccgtaaaatatttccatatgtcatgagtacgtgtccgatccgatccgatcccgcgctccctccccctcccgtggccttctcccttgcgccttccctcccagtgcccctttcctcccctacctcctctctagcagccctctccttccaacgccactcttatccctgactctcctcccttctccccggtgcatcctcgtgaagcacgtcggcttcaccgttagggaagacgatgaatagtgttagttgatttttctccgtctttcgttcctcctgcgcattaagaaaaatggaacccactcattggggaatgcgttttgacacaatcacctgaccgttttcaccatcagaacatgttgttgtttgtctctcagtcagagccatgtcattgccatccgtgctcggtgctcttgttgttctagttttctttgttgccttacgcagcatgttcaaggaaaatggacccccctcatcagggaacgg

SEQ ID NO: 57065 - DNA, 11098 bp, Oryza sativa
  unsure (1)..(11098): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttggttttcatcattgccaaccgtagcgtgttcaagtaaaacggaaccccctcatccgggaacgtgtttggacgcactcacccggtcgtgttcaccactagagctagcttttgccgtttctctctctattgggtccacatcgttgttggccacattttcgttgttctggttttcttcgttgccaaccgtcgtcatctatggatgagtcacatcatatggcacatctagccaccagccttgtcgtcgtttggtgaattgaaaaattttaatatatgttgaagaaatgggtacccgtccagaactaatggatctaattttatttatgggctaaaataagttttcttttttttaaaaaatatctagctaattttcaattgttttttcatttacactattagttttactatttgatccactaaaaaattgttgaaacttacaattttccttcatattgaattatttatagctaaatgaaaaaatgaggactttagcactatattgaattatccttccggccaaagttatttatagtttcatgcttatttctatgattatatttccttcgtcatttatgtcccgttgtaacatatggtttaagattttaatgtatatcgtcggtgaatgttatttagaacccgttgcaaggcacgtgcattacgctagttgaatagttgaaatataattcggatagctacgaaaccaatattgcagggcttatatcgatcggccagccggtcggtcgatacgtggtgtagttacgtgcatgatccaacgctcgatcgatctctcgtgatcgagactacgctgcttgctgatcgatcaatgtcgaaccagtcgatgagaaatcaagaaaatccccaaactagcacacgacgtatcggacctgtaaaattgatttggaccgaaccgaaattgattggcaaatcggctcggatccatgcgcggagagccagttttactgacgtgttatcttcggcaaattaaagcagaaacctagctaataaagtaagtgtagtacttgactaaccggctgttacttgttgcccctgcacgtttagcttaatgtcgacattgtcttgtacacttgctcttgtgtgatcagattgattcgtgatatgctgataagtagaattaaacgtgtgtacatgcttcgctgcagggtaaggattacagaaccggcaaaagacgtgttctagcgtaaatgtgcaatcgatgatcaggagttctcgaagcagagagaggtgttttttttttccttcgagaggaagtcccctcaatgcaaattgcttatcaatttgtcgcaagatgtgagctaggaggatgcacaacagagatatttggttgacaggtagttttaccattctagaaaatatactaagaggtaccaggtatcatattttaatttgtagtgtaaaacttgtgtctttagctactaggtatcttgaggcatcagcaatgtaaaattttgatatctacatgtacttttttcagtaccgtaaaatttctatttgttgacaagttaggctagctccggtaacaatttgacgctctatgatttaaacctggcattcacacgtacaaatcggtctacttcaataaagaaaagttgtgagatttattaaatttatccatgcttcgtttgttaagatcgagtacatactagctagggttaacaaaaccgataaaaactggttggttttcatgaaagctggactatttggacaagctcaagaatacaaattgccaggctttttggtcaagttctaaagaaactagattttaaattttttataacatttgacaatattttattgggagtaaatggttttcaagtggtttccacgaaaactgagaaaactgttgacatctggattttggcacggaatggtttagtcaatgttatattgccatgttgcccatatgttagacaacttgggccaagcatgtgggaaaaatattagaaaaaaaatttaactatattttctaaaaataatcatattaattataacggtttggtggtacactttgaaaaaccctggtcccaatggacttttctgggaggatagcagctagaatttaaggtttgtgttatttctcctttgtttcttccatggacgttcacttctatgtaagagttggtttatgtattgctctataatattcgtcgatgcgatggctcccacttttacggtgtgtaacctattactccagtatttttttatttgacgtgagatacttttagggtttcgtgaaaataaaatcttagtaattccctgatattaaggaagcgcgtgcaagcaatcgagtgtgagctgatctttcatgtaatagaaaaaaaatggttactcttatgtttgatactatgcccccatatttttttccctcaagataaagcattattaacaagttgttgtgaactgacttgtcatcacatcacaagctagcttgatctttttagcaggataacgagataaagaaaaactcaatagaaaaatctctctctttcactactcgaggggaaaaagatagaggcgcatcatggagtaaaagcttttgttatcgaacggatggcttgagatgaactgaaggtcaaatgatatactaaaggtatgtacgtcacatgcatggatcgtatataaaaactatacatactgtagtggttagactaccgttcattgtcgcatgagccatcacaggctacaaagctaatatactagtgttagactgcgtagatagatatagctgggttattatcataatcacggccaaaccttgtgattaagatgttaaaacggtcctttacgtttccaccactttacgtgttaggccaaaacgaaattaaagcttgggaaaacacatacggaacaagaaggtaaattttgaaccgtagacctaagtaagtatcagatgcaaagagtacatctagaagccatgaaataaaaatctaatgaaaatgattttcatttgaaaaagctctaaatgcttatctggccggccaggggatgcatgcgtaccctttaatttattcctttttgcatgccctttcattttcaagcatgtaccgaggaattccgccacaaaaataaaataaaatagggaatatgtcttgacctcccaccatgcaaatttgcaaaagctttctgtctgagaaaaggaagcaaatgaagagcatatagtatctttttgtcaggccatcacttttcctctcaagttgacacaatgtgcaccatccaaatgcaaaggaggaagaaaaaaaatatatattctcctgatatatatttccctcctgccaacttgtttatgccgttggaattatgcctgcgccagagattctcccatcacaaaaacaaggagcatccgctgcctgaaacatctctctccatctctctttaaatttttttaaaaaataattttcaatccagatgctatacctgagaatgaattgcaggtgtgccagaatttacaaaatggattgaccaaaagcctaattaattgtactacgtcgacatgtctcctcctcgccgtcacctcgatcggcccgtcaatctgttctctcaatccagaaagaataatatatataggagcagcacccgaattctgatcatgcaagaattcaccatcagcaagttggtgctaatcaagaataaaatgttcggtatacggcaagttgaaatcgatcactgatcacgacgatgacgacgagacaaagggaaaaaaggaaaatggagaagaagaattaagcatgctactactgccacagcagactggctagtaattactactccctccgtttcaaaaatatttgacagcgttgactttttagtgcgtatttgactattcgtcttatttaaaaagtttaagtaattatttattcttttcatatcatttgattcattgttaaatatactttcatgtacacgtatagttttacatatttcacaaatttttttgaataagacgaacggtcaaatatgtgctaaaagtcaatggtgtcaaatattttgaaacggaggagtaatttataactgctgaattcactgaatctctcgcaggctcttagttcacgtaacagtagctagatagctctccacttttgcatggatccgattccgtgcacaaggtaattaagagcttatcgtaatgtagaatttacacttgctgaaacatatgcacaaactaaagctgtcgtgcatctgaagccatcaagagaatgttacggtagtaataaagttgagatagtgagtttggcgtcagatgcacattctcattgaaaagtaaatagtcgttcggttgactcgttgtaaatgtgttatatatatatatatatatatatatatatatatatatatatatatagagagagagagagagagagagagagagagagaggggggggtatatatgtgtgtgatctctcatctctgtgtgtgtagcatcaagactcaagagactaggtagatgtagcctagaaaaaagacgatcgtacgtgcagaaaagcatgagactgacaagtcaagcttgggaggataaaccagagagataaggcaaaactaaccatacagaaatatactcctttaattaatttgtagtttggcattaagttttatcttatagcaccgactttatggatgtggaataatggaaatatataggacgtacggggcactagctagcagcagcagctggatcttatactaagtaccattaatattgcatatataatgtatttgcacttaatggcatcgttagttagggtggcatgtgcatgcaccactagtggtagtactgccatccaattcagcaggctatcccccactatacatatggttgctgtatagagcgaatacaatagcacgttataagtcagctatatatatatgcacatgtggagaagataaaagaagagagaataacagagggctatagatttgtagttagctgtagcatggactccaaaacattgcgtgtttataagaggtaggatcatatattaattatgtagtatatatttataagtaactattgtatggatgaactattaaaatagctatatagtatttgaagctaatagttggctatactagtattaaacttgctcttagcttagcatgaaggactaattaatgagtagttatggacgtagtttaattaacgcacaactgccattatctctataatgatgatggattgtacttttcgtgtcatgttgacagttggatttttgtcaaagctggttctaaggttaagtagagcaaggggcttaacaaagactgggaatttacaaaaggtaaattgcaaggggcactatcaaatagaacacactttgggctccatttcgcattattgcagttgatttttttttcattattgcagcggatacgataatatatattaatccatttaaaatattagcatattcaaaaatctatatgataatattaacattttttatctaatttctcatctcaatcaatcatagtcatattcaatttctccacctaatcactcatcttgacccatcacaatattttttttaactcaaccttaacttctgctaaaactcttgaatgcttctacacattaatttcctttcatatttcaacgcacatggtaagtgtgtcaggaatacatttcttcagcagataaattaccggcccaagcacgtttgtacgtacggtttacattgtgctaaatattgtgcgtacatatattcaaatagaatcaatataaaaaagtaattgagttttttagatatatcaaacaaaaatatataatggaataagttccgctcttctacattataagatgcacacatttataattaacataaaattgagtaattaattgaatggcacaagaataatgtgtttagagcatatattgtactgtttgaaatcaatttaacacaaaacaaaaggttagcaaaattattggaaaaaaagttatctttccatctcataaaggcgttatgccattagaaacaccccaccagtacaaataatttatgttaggggtgctttagacattattaacaattatttagcttaatttaataattaataggatcaaattaccgaccaaactgttagtatagttttcaatatctcttacattagcttccacgcttttaaaagaaaaggaattaactagctcagctcagcacagtacatgagactagggagcatgtggccaaaaggataaacaggacaatcgaacacaaatattattaaaaaagtatcgtcatcatcgccatgataaaacatatattgatcaccacaaccctgcatgttattgcaatacacgcgcatgaactttttactaagacagccactaaactagtttggagataatgccatggacgataggtgtggtgccacgtgtcacactgcaccaaccataaaagtgcagcggattaaaaaagttactagcatcatgtagtcagatgcaaccatgggccgctattggtggaagaatggcaaatggtgagtactagtgcttgtcgggacaaagggagatggagaatgcaactgtaaaatagtactggacaaatagtccatgatatgaaaaaacaattagtggagaaattaggagtaagagcctaattaaccaaacaaacgtcggtccatttgtacggcggcaagccaagagctagctggctatatacaagcatagcaagagtgtgttgctaccactccactagtagtagtgtgctaggagtacttatcatctcttcatcttttatgtaccaaatgtcatgtcaagagccctaggtaggctactgattgatccttatcttcacccaccccatcaaactcttcccacaaaaagagagataatgatccttatatatagggtcaatgtagtttccaaacaaaatttttcatactgtcacgttaaatgtttagacacatgtatggagtattaaatgtaaaaaaaaaccaattacacagttcgctaggaaattacgagacgaatattttaagcctaattacgctatgatttaacaatgtggtgctatagtaaatatttgctaatgatggactaattaggcttaataaattcatctcacagtttcctggtggaatctataatttgttttgttattagattacgtttaatacttcaagtgtgtttccgtatatccgatgtgacatgcagaagcaaatttttttgccaactaaacatgcccatagtctatactagtattaattaattacaacaaatgacatgatcaatattgtcatattgaggattcaaaggaattatgctttgcttcccatcaataagggtgacctatacataggttttagggtttgaagcaccatgcattgcgttacatgtgttcatgagcataccgacaaagtaacagtggttagaaggcggccttcacaagtattctttacacttgtgagctcttatcataaaccggccacttcatgtctccacgaggctaggagaaccttagagcttatgacaagtcaatgcaactttgtatatatacacaccaaccaagccaattatgtaaagccttgaggccagtgggctccatttgtctataggcttcacagcccacgtttgtatccatatgtagatgtgttggaaatccaagcatttctgagcaaggttagctaggctccaatactttgcttggaaaatcaagtgtgttttttgcactgctcgatgcatgcacgtacgtcctcttgaaagggaaattctctgtgaatgtttgctgatcactcgatctctatcatgcatgcgtgcgtggacagtgaacatgtactaaaagttgtctgaaaatttggcatagaatatctaggccatgtgtcaagtccaaaagcaaaagggcctagccacatctctggctcctagatacttggatactcgtgcaacacactcagttgacacgttgtttatatgtatggcccccacatggtcgagatctacacacttatcatttgcaaaagctggccaaaactttctccgatagttagttggatatgcaagcatatgggtacaatccacacattacggacgatattcacatcagcatactgcctcattacgctactaataattacctttcattgacccaataacgcatatccaactcccaagtaattttatatgggcaaagcatctacccaaccacccactacatacacgacgcacaagtgtcaatcttggtcgtaagatctccaatgcattgacaaaaccgatcaaattctccctttctcccgtcagtgtgtggcgctatcgacgaacgatcgatcgatctgcaccgaaatgaaaacggtggcgaaaagaaaaacatatccgtttcttgatgaagcaaagctagggtttagaaagatgtaaaggacggccggacattgctcctttttcaagctccttttgatctctgctgctgcaagctacaaatagcatgagatcatagcacatcgatcgctttggagtttgaacactgaaagtcgcagcaggccaaaagatggccggcttggagcagaccgaccaacagtaatgtgattgggataagttaagctgatcgtttagggcatcgatgcgccatccatatgactttcttttttaccatttttggcaacgtgtgtgcaggctgcaggggcgtcgtcgttggtgagctaattaaggtctttgggctgtatctgaagattctgaacgtccatgctttgtttaacatgtgtgcaacccctgctttcggtttggtttgtcctaattggtggctgtctttgtttcagagaaataaaaaggaaaggaactaaaggaagaagaggatgcttagtatgaagcaattaagcagatgctctgttacaagcttacgtggttggtttaggaaatcacacaccaaaaatagaataacatcagacatatagaatttagctttcatatattcagctatatatatatatgcatgttgattttgatagaaaaatgttgtgcccttgattttacataatattaatagcatataagtatataaccaactagttagtacataagcttgagcattgataagaaaaagtaaacaattcaccgatatacttcaacattccactttgaaccaattttatacgtactccaccctgaacaattctcctccaattagattaaagtactaatgctcgtttcaggatttatacgactgcaacttggttttttttagaacagagaggcactgtctcgcttggtttcgatatctttttcatctttggaaaaggtgcttaaagggcttgtagggcttgatcttctactaatccatcattgcttccgtaatagtaatatgatatacatagttctctctttgttgtcgtgtggccggaagggagggaaagactggctagggacagtacagtcggtctcaccatgatgttcatgcacttgctggtggttcaagttcccaaaccatcagccaaaagctaggaattgaacagtttaattagaagtttgcaagcttaagctcacgtactcctgcatatcttaaagtcgatttgagttgttaagcatgttctaaatcatgcctttctgatcgatgcatgtaaagcttgatgtgtgtcaaccaagaatcaatcttttttgctaaccataaattaatattatcatttctgtttacagatggggatcaaagttggctccgagtcagatccacccgggatctgtctgtacctcaacattttggttcgggacctaattcagagttcgttcagtgtcataggcctggtttctgaaggaattcaccgaggatcgcactttgacagtagcttccatggcacgagaaagaatttcgattagctttgctttgcatatgaatcaatgcctcccatggtggctggcattgtgtggaactaacaaaaaacgtggatggacaattactttcacctagccatcacagatgtcagattcattgcaagacgtatatttcaaggatgagcatatatgtagtaggtcaaagaaaacaacaccaccacagtactgcaactccagagctctgaagctctcgatactgctacgaggaaacagacatacagagcttcctgtatttgactacctggagaaaagaaaaaacagacacacagcgcacattccatcgagaccaatggaataattaaccagtttcgcgcaatgcgctcgcgccactttgggctctttttttggcaagaagttggtcaaaatcaaacacggaaaggcgagagaagagggggggaatgaaggaatggaatggtggtcgccgaagcgaccgaatccacacaagccatagaccatgcatgtgcatgcgccgcaatggggaaaaagaatctcctctccttgcagcttaccggcatgcatgcaagtgagtagcaagcaatagtggccatttcaaactagtgcttggactagcccactcacactaactcccgggccgagatcgatcaggacggcgggcgcagtggggatcgaagaagaagggcaatgcaaaggcgggaccggcctttttctctgaattatgatgtggatcgatggatcaaccacgcagcggctgaccgtccgtccagccgtccggcctcctccgggctctgggtgcgagcccgtcggcgtcagccagccgacagtggcgcaattcggaccgtctcgatcgggaaacatcaaacatgtctccgaaagcaactgctacagatacaatttgtgacacaaaggtagtagacgtatgaagactatagatccttttcttatgcagcatatgccacacattgttgaaaatagtggtgtcgaacaagaggtgtccg

SEQ ID NO: 57066 - DNA, 8568 bp, Oryza sativa
  unsure (1)..(8568): unsure at all n locations
aataaattataattacgtaaattttttgaataagaacgaatggtcaaacatgtgagaaaaaagtcaacggcgtcatctattaaaaaacggagggagtattttttttcaatatttactgggttgtcccacttgagaacagatagcacctggacctgggaagagatcggtggcacctgctgggtcagatttgctggctttcggcatgtgccataaaccgtatttcaagctacacacttgaaacactagtgcagcaatatgatattttaataagtagcttaacctcattgatggggtcgagttaaaacaatggtggattcgtcctctttttcttcttcttcaggttagctgtcctggaacagttgttcgtatttgtactttgatctgaaccctctttcttgggatttgctttttgtaatctaaagcttgctgattcatcataaagaatgcagcaccattttcacatgtatccctaaacaattgtagaagtataaagtaatagcatgcaaactgctgacgaagttcacaaactgcgtagtgtggacttacgtccaacaaaaaatgtacacatccgtccaaaaacatcaccatccagctacctactgtaccatccgatttggttcgatgcagccagtacatatccatgtacgaattgcacaactcagctgcaaggatcgaatttttgagtgctttcgtttcgtcgtcagatgagcacactatctaacaaagtgtcactgtcgtcgaacctactgaatcttcagacaggtcttgctgaggtctgctcgaagagttgtttgaactattcttttataagatcgcatatttctgggagaaagagttgtttgaactcttcttcagatcgcatatttctggtcgagagagaaaaaaaagataccagaagataacaacagatctcccgagatcaatgccgtgatgtcaacatggaaccagactacacctgaaaaggcactgaaaaagaaattgaaacgcgtgtgcagagccaaacgtgcaaatatttgctgggtgctcagtactcgcctcaactacaccttatctcccgaatgcaacaaggagcacgtggacgccttattcggaacagcaatgcccataggttcagacttcagactgtttcagtagttcacacggccggttggcctgtatataaatcacgagaggatcgatcggaagtcaagaggagataggagacagcgaaagcaaattcaacgggcaagaagtacgtgtatttgccttcgagttcttcaggattcagagtttcagacgacaccaaggcccaagctaacattaggcgatggacgagcaaaaccagtggctcacggagccggcaagtacatccagtccttccatgtaagctctgaaatcttcgagcaaagcgtatgacgaaatgattattgcattgttaatgtcaggagcctgaagagttaacctacatgtatcatcaagaagagcacgccaggatgcaagagcaattcgctgggacgccgctcgtcgagcaaccagttcgatttgatcagttctacccagcatccatggcgccaaaccagttccatccgtctcactgctccagcttcccggccttcggtggctcgtcggcattgccaagcttggcgttcggagcggtggcgacgaccaagaaggagcaggtgcagcagccgtcgccttcgtcctcgaacgtcctctccttcgccggtcaggttcagggtagtaccaccacgctcgacttctccggaaggggatggcagcaagacgacggcgtcggcgtgttccagcagccgccggagaggaggagcaggccgcccgcgaacgcgcaggagcacgtcatcgcggagcggaagcggcgggagaagctgcagcagcagttcgtggcgttggccaccattgtccccggcctcaagaaggtgtgtgtacatgtgccccgatcatggcgtgcattgattccttggcaaatgcggcattaacacggttgtccatttctctctcagacagacaagatctccctcctggggagcaccatcgactacgtgaagcagctggaggagaaggtgaaggccctggaggaaggctcgcggagaacggccgagcccaccaccgccttcgagagcaagtgccgcatcaccgtcgacgacgacgatggcggcagcgcctcctccggtaccgacgatgggtccagctccagctccagcccgaccgtggaggcgagcatccatggcaacaccgtcctcctgaaaatctgctgcaaggagaggagagggttgctggtgatgatcctctccgagctcgagaagcagggactgtccatcataaacaccagcgtcgtgccgttcacggattcctgcctcaacatcaccatcactgcaaaggcaaggctagctttacctgtctactactcctagatcatttgggtttcgcatctgtgtaaatgtggctgtaaaattgtaattagatggttgttgttatagctggttttgacaggtttcagttttgtgcagatcgaagagggtttttcgacagcggttgagcttgtaaagaacctgaccgtggctgtcagaggtttcaaatgaaggcagaaaaaaaaaaggaaactggtgtacagaggacaagtgactagtataagtattatgcagtggcggatccaggaaaaaattatagcggggctaaaccaaaatgatcaagagcaactaagagagatttagggttggttttaggacttttttagcctttttagccttttaagcattttaacaacctcaaacaaagtctatattagcccctcatatatgaatatatagattataattttagggggtattatgggggctctaatggtatattagggggtaggggggtctaaagaccctccgcccccacgctgtctccgcccctggtattatgtacgtaaaaaatgtacaattggcattatatgaagagaccaaagatgtattgattcattcgaagaagtacgtagcgtataaattgttcggatctcatgttagatgattagtgcgtggctgaccgctccataaactctgctgagtgggagttggaggagttctctagcattaggctgcgttcgtttgttcgggttaggaacccatctcctccgcacagaaaacggagtgttccattagcacgtaattaattaagtattaactttctttcaaagttggatcaatatgattttttaaacaactttcggatagaaacttttttaaaaaacgcaccgtttagtagtttgaaaagcgtgtatgcgaaatacaagggagaggggttgtgaacacagaccaaagaacacagccttaggagctttagggacagtggaaagcaatgaaggtaggaggggcataaataacgccagagaaagagaaaatggtagaatgggaggaaccataaggggggaatgagactcccctataactttataactttatgcagtttacagttgcgatactgacatgtgggccatacattggtaaggtccacatgtcagtgccataactgtaaactacacaaagtcaggggatccgtttccacacgggggagataggctagctttaagggaaaagaaaaatagagtcggaggggtggaggtcttgggctagctagcgggcctcgccgatgcaaggcagagggtcgcagagtgcctctgactgcatgtggctagcggcaaatcaagaaagtgaagaaggtggtggagaagataaaagaggaaattagggagcttcgtgtatcgctatatttgatctaatggtaaagaattcgtaagattagaggcctgcctggaaacattgaaaaaaattataagtgtaaaaactttacacttgtattttcaagtgccccaagaaaataatccttgtgatctttccagctgtattgtaaatacacctcgatttttttttcttgtttgggtaaacgctacccctgaaaactcagcactgtcatgaactgatgaattgaacaacatgctgcatctgggcatgttggtatacacaccattatccatgttagagtactatattgcagaacacattcatatcaaagtaatatattgcaaactacatgcatgtcaaaataataacgtggaatactagcagttttcctttcggtatatatgacaagaattgagcaccaaattctaaactcctgccgaatacataggagaagaaagaaacacaacggtttaactattataaggatgacaagttctcttgtagtttgtgtcacttggccatttgttcaataattgttctagcaagactattttcatgttatgaactattataaggatgacaagttctcttgtagtttgtgttgcttggccatttgttcaaccagtacaacatgctttcctcattacaaaatggccatgtgttgcagatgtgaaatcttcatatattcattgtgtaggatcgtaaagggcatttcccaccccaaaaactagacattgaggtgaggggctccccacttatatcttaggtcatttgcccttttacaaccaaaagctagccattgaggtgaggggctcccccacttatatcttaggtcctttgccctttcacaaccaatatcggactattcaacagtctcccccttcacacattggtgtccctcagcccttcaccgccccttcaccgtatacgggccccacacccacggtccatcaggtatacggactccgcaggcacccacggtccatcaggccttcacacactgtgtccatcgggccagagatgttaacctagccaggctctgatactaattgtaggatcgtaaagagcatttcccaccccaaaagctagccattgaggtgaggggctccccccacttatatcttaggtcctttgcccttccacaaccaatgtgagactattcaacacattgcagnnnnnnnnnnnnnnnnnnnnntgcaaattttagtgttaaaagtgaatgaaagtcgggcaaaaaaatatgaactgcaaaggaagcagaaagcagaaagttacaatcatccagtcaggctacaagcgattagcattttaatttttcaacaactcatgaaggaccaagatccaattagcaatatttgatatgtactataaataaatatctcatattaaggagcctaaatttgagcattagctcagttttagcataggcaatgttagcatcacagggttgtcatcacatgccgcctatctctacgactcatggagtcctagcctctagcctaacaccgtgtctatgctatttattactacctttatcttgctatgaactaaaaactaaggtactctatctaagcagagcgatgcacacacaacaatgagaatatatcttacttaaataaaaaaataacaactaaaggagatcatgaatacacttataaaagaagcattcgtcgaggtacaagatcggagagagtgacaacatctccggaactcccctcactcaattcctactctactagagcaatgcctaagtatctacatatgtgaaagcaacaagctctctccaacaaggatgagccacgtcacctgaataacaatagccctaggatgatagtgggaagaaaagtggaccgttagatcatcgggataatacaccaatcagctatcaggatagttccagatgaaaggtcatataacagtgttagtcaaagtagcttagtcaaacaaatatttaaaaaaaccatccggaagatagcagaaaaaggcagggataaaaaaccatcgagattctctcatataaaaatgagaagaagactacccaaattaaatctacttatagtttatcattaaattattatatgatttatatattgcacaactttttcactgaagaaaactctctggtttacataactcttacatctgatcggagggcaacaaaaacctaactaccaactaaggtacaataaccttctaaatttttaaacttaacacattataatgcgtcaaaccttttataatttgaaaataaaaggatggtttgaatataatatgttcattattcctctgcaactcaaatcaatattttgaatggtgccactttctatcactaatacttttggttagtatgaatcatgaataccatgcatatgttcttctactaaggtaagtgccacgtttacatgccaaatttctttatggacaaattatagatcttttatagtaattgtattataaatttgtacaaggagtagtaaaagtataacagctaaaatatagaacacattatgtaaaactttaggaccatcaatatgtgttgttagacttcttaaagcatttaatcaccagcataattttgaaataaatcataaagcatttaatctactgaacataaatcttatgttcaatctattctataactaggtggtgtttttggaatatatgaagcacaggttctacctcctagcaacaactatcaaactattatacctcttgtcaggtgatatattattaataaactatttactttcattcttttatttcataatgttcagcacttatactttacgaatttatggaagacaaattccatctcattgcccacaattatcaaactattatacttctatccaactaacataatatggaaatgaaataaaatatttgactgctatccttctaaatcatacactttagtatggacattatgtctatatttttataaattacacctatcattgcacgactactcaacctttctatatatgtactattcatatatttaaattatcatcagatatttctttcagctttaccattttaataatcaatctatttacatgtatacaggtgcaacaatatgctccagtaacaagttcttcatatgaacgaagaaatattaccaatcaacttatgatagactttagcaagctatatataccttaatattttgttatgaacactactgttagtacatgtcttccaaattatattatacatggttgtccaactacaaatgcataatgatgggacatcaagtttatatatattcacaatctgcagttcatacaatgatttcaggcttataattacttcaggcacatatttgttttgatggtctgctggtgctgggtgtgtgtattaattattattacctgatgcgtgtatattgctgacctacaggattaaaatttgcgtggactacaaaggcagttcatcttaaccgcttatctctatagtgtatcatgctcacttgcagaggtgcttccatgaggagcataatacttcaacatattaatgatttcaggctttgacaattgctcttcctgttgctacacacttcaacagtgttttaatatggtcaatggtcatggctatgctactgttcggagtcacctatgtgattctaaggtttcataaagtttcataaattatttgtgattcaaggcaacaaagtatcattgtcattaacagaaactcaacttatcgtttcatcttgcagaacatcgtcatcttacaagggctataagcatcaggaatcttctaaacatgattggtttgggcaaatgaaaaatacaaaattggactcagaggtattgcctccaaatagttgttactacttggactcagaggtattgcctccaaatagttgttactacttttaactagctatacaagaccaagttttgatgtcttctaagctttcctgtatatatgttactgttgtgcttgttagggaatcttggaaaactaaactctatagttatgcctaggggaaaacagcgtgggggcggggcctctttagacccctacccctaatataccattatagcccccataatacacctaaaattctaatccatatgtttatagatgaggggctaatatagactttgtttgaggttgttagaaggcctaaaaggctaaggcccaaaaaaatcctaatccaaccctaaatgtctcttagttactcttggtaattttggtttaacccccgctaatcctaacccaaccttaaatgtctcttaattactcttgttaattttggtttaaaccccgctataatttttatgctggctccgccactggttatgcccaaatgcttgtagtgcctaatcagcttagatggccctatacttgatcttgaacatctacactttttcagacaaccaattttactatttgttttgctttttaatagttgacatagttagccggtaagcaatccatccatgatcccagagtgctttatcttttcccatgctgtcattctcgatttattctactgccagctgccatttgacatgttattgctttatcttttcccatgctgtcatcctcaatttattctactgccaactgcccttcgacatgttattggtggtgcacttgctatagcattacattggtgatgaagtgatgaaccagggggttaaaatccaagttgtgatgtggcgatgaatcaacgatgagaattggacaagaacccaagcagacaagtaagatatgaaagtgatgcaagtaattatgatagcaatcatgtccgatcaggcttctcaatataatccttttaggaaagggatgagattggcagcattttttttactcttttgattgagattttgct

SEQ ID NO: 57067 - DNA, 18181 bp, Oryza sativa
tcatgcgaagcgcgactaggtggctagtataagtgagttgtactctacttgttggtgcaaaatggaagagaggagtggacgagctatttatagcgttagatgacttgagagagtggatgttcttaagggaatattctcctccaactcctttcaagcctccatatgtcctccaaccatcattagatgttggtttcttgccttgggaactgtgccaccgtcgtcgccacatggaagctgggcgcgaggggagccacccctggttcggccaaaccttggccaagctatctcgcaccaccttcacatgggtcactgcccggtgggccctcatgacggtacacagtggttggcctcaaatatgttgattttactctggtttgtgcccccccccaaaaaaaaaaaatccattaactcgtatctgattgtctggaggtgtattttgtcgcatgttgggtgtgttttctcaataattcacctgcatacgaatattcaccaagacttgtagaaatggttagtaataaccacaacctctaagtttggtaggtattccatttttattttctttcatttgcttttatgcatgaagtgacggtcaaatttggtatttaaggaccgtcaacaaggcgctcctcagctatgttatttgttgttgccatgtctttgcccttgaggttgacatggttggatgtactagaggtaaagcctatccttcaacatattgacatgttacactaagttaatatatgtcataaaataagtattttaagatcaaaatatcaaatagagaaaaaggtatgtcctaccttcatacaattgatccaagcactcaaacaatgggaaacttttgttctcatgcctcttcaacttctgatcttcctatatatttatagaagggtcaagattactgatgcacaagattaaattctgaattcaaaataagtacaatctagcctcgatgatcgcttcccatttttcaaatgtggttttaatcatcgacacattttggtcccaagaaaagccaccacgactttgaatggatttaattgctttgaagtctttcttcggttgggtttatttgtcctgtatttgagcctctcggtaaatttagcttcttggaataacttgttgaaatccatcactattttattcaagccctctatacaccaactattttgccctcgataatgagagacgttgtactccataagtagatccaccaatgcattctcatatttcaatgttcaccttgctctttgagccatctgatctataacagatcacaagaaatgttgaacgaagatattgttcatgatataataacatattcaaataatctagaacatcaacacattcaaaataattcaaaacatcaagatatattcaaataatgtggaacatatccaaacatgtttgctttattacaaataataaaaagttcaacatgaaaagaaaatcacactacgcttgagatgttcaagtgttatgagaattcaagaagctcttctttgcaccctacgctctctcattcttcggtggtcagcccacatattctttgcaatcttgtcccttagcttatttcccaagtgtctttgactattcattggtgctacatcatctccatataagtccactcatgtactggaacaagtttcttctgaactaaccacttatcatcacctttttggctcctgattatgttatggaggactattgcaactgcaaggattatcacttgggttgcgattggataaaatgttgcaacttctaggattggaaatcacatcttcaggattccaataacacgctctatgtggttgcgtaacttgaggccggagttgaaggctgagtggattgagctcgatatttacccccaaaaaatgtgacatctctagcccacattaccttttcgtcggaatgggccgaaaacgcctggaaatataataggttacggcccatccaagcagcgttttgagtttatccttggaaaaaaattatgggcctgtaacttataccggttttgggccaaatacaggccttccaagcaggcccttggagtaagacatttttttaggactagtaatgcacgtgcaaggcacgtttttacaatgtatattttaaaaagtaaaagtatggggaaaaacagtgccatattcatacacttaactccagaaacatgacacactgaattcagatacattccatgtagttcataaaaaaaagatacattccatgttcaaccttaaatggtaataggagtatattccatgttcagacactaaacccacacaaatcttacatcgactggtgaatttctaaacttccagtacttgagctataagaaattcataacattaattagctcacagcaaattaaaacattgaacaatatttagatgtttgtcgaagttcagattcttaattcagatactcctacatcataaggacaagtcgaaaactaatatgccaaatgctcagaaaataatataagaaatgttcaaacactaacctggcaaatgttcgacatctatagtgcacacgtttgaggtatatataaagaatttgtcatcagcacgacagaaaattagaactttttttttggaggacacaacatgagatgtgattgacaattttttgctcccaggaaatttgtactgaaattgttaaaaataaaagtgttccacatttctaaaggctgtcaggaattattaactcagtacataaccaatagttcacagggaaactatgcatgtttatgttgaatagaaacaatacattacactacacaggatgccatataatgcgaggccaatttcagaatgttgtcaaccaagttcttgagcaatgcaagcccaagttcagaccatgtaaaactaaattcaaattcatatataaagttgtatggcacacaaagaccataaagcctcctgattttggttggagcaacaacaaacatggttgggtagagttcagcgagcagacaaaatgaacttgttacagtaatcgcttcagtaaaatgttcaggttggggttatagcacattttgtgcttcaaaataaaatatattttttatctttaacaaaagttcatctgtttggagaatatatttgtccttggatctacccaaaacaaaatttgaagcattaggacaaaatcaccaaaacttgtcaaatcaccagcagctgctagctaggagcatataagccttggtaatgaaaaagtaaacactcaaattcctagcccagaaaaaggaagaagttattcctattcagaatcagagttgttccatgcctttacccttgcatacactaagctgagtttctctaataagtttatagtacacaaaaatatatgcatgtacccttatctgaccagtgaccaataagtagtaaccatagtaaaaatagtaaaaacttaaagcaaagaaataattctgcatatattaatattacctttttgttgtgcctatggagtatattaattcatatatatcaaccaaaggccaatcaatgaaaaataaaataacaaaatccccttgaccttcctcatagagcatcttaaagccaaaagccatctgacaagggcctataaaaatgccttccatcctgttcacctatcttcagcatatctgtataagcttgtatcatggccgttttatagtatgcctagctaaagaaatcaaatggtggattgcagtatcacattaaatcagaaattaagatttgctttttattaggctaagaaaaataaaatataaacatttcatgttcccaggaataatcaatgaaaccaacttttcaacttcaaccgcatccttgagtagcaaaaatgttgtatcctccatttttgtgcaaattagctttctttgccagaggtaaaaaagaatggtttgttataacaaggaaaattgaaccaaatgggagaaagaattaaaaccggcaaatacccattatactgatcagctgcacactggctcttgcctagcacccgtccggccagccaccgcctgatgcatcaccgtctaaccagtcatgcattgatctaaattagacaacagaaaaaaggaaggtaacacacatgaactgctatatcacagagtactcaggttagataatcactttgtgaatgactgaacatatatataatttattcatggatgaaggctcacaataatctgtgctcaagaactaaagtactaaacaaatgaatctatgaattctcaaaagtgagtcgatccccttaatctgatcgaacttgaacaattctcaaacctgtacaataaaatttctgtataaaataatctggaagagattcagcatggcaactacaagtctacaatgttagtctgtatggagcaacaccaatcaccttgataggatatagcctgcaatgatgcacatatggatcgataagaaccgaatcacaccattaagaggagagatttaatatatgtgcatacccttcagctgaataagaaaatccacacagaagactaatggggattcagaagagtcaatttgagtgtctcactcgatctcaggagcagaagaaattttgacttacagctagaagtacctgcggtctactatgcccctcgtgtcagcggcaagaccggaggtgcgaccgaaggctggaccagcggagagcaatggagcagcggcgctggcggaaggctggaccaccggtcagcgacggggctgtggcaccaacgaaaccctagaccagcgggcccgattgcggtggcgacgacggagccgccccggaggcagcgacacctacggagccctcggccgctggtgcgctgattgcaacggcgtggggctacctggcttataaaggagggaacgcgaacctcggcgctagtccggcggtgcagtggtgcgtcctcgctgttccgttgcgaggatgagggaggtccggcattgcgatggtgcatcgtcgctggcctggcggtgcgggacgcgtcggccctggcccggcggtccgtcgtcgctgggccgtcgcgaggagaggatgagggaggatgcgcgcggggagcgaggcacggagagagtaggcagagtcatcgcggtggggattttcacggcggagtcagcgcgtgggggcaaaatcgccggtgggttttgcgtggaggagatagagctacggtgtacagcggacggatgagattagatgagacgtggatgaacggtaaagattgattcggatgatttcacctgtaggattgcaaggagacaactcctgctttttatattagtatagaaatatggtatgcatgggtgattacctgcagatgaagatcctttaccataaatacaaagtattgtgtgtatggtaaaatgattttttaagtgcaaaatgagtcttatgctttagtgttttgcatcaaaattatatttgaacggccgagattacccacaatgccacacccgctatatctatttggatctcgtttccactcaagtacaagaacaagcggttgacatgttgaactccacaaatgaattttgtggtccattgatgtggaagagcacgtattgatgtgtccccgttggcaagtgcatatatggtagaactctgaaattgatcaaaagatatagtagttctaaaaatatagcaacctaatataatatagaagaaatatgagtaccatgagccgtcatgtactaaattttatattttaggatgaaaggggttataattcataatagtactgtaggagcacagacgttgttgaccgatgttcagcaagttacctacctctccaccgaattagccaactctgtcttctaccaaattatttgatgcttatatcagtggtatatttatgtcccagttacaactcctttaactcctacccataggtttggatgagggcagttcatagttcatacatgtcttgcaatatgggcctcatctggtcaaacagtagatgggcctcatacgtgtcttgcaatatgggcctcatctaggatggacgcgctgcacaaggaaacaaacacggccctccgacaggtgagcgtccggcactccggcccacgagaagtgctgaaatgatcgcgctacgcttccttgatacgcgcggtccgtgcgcgtgcggtgttgcggtttggcagaaaatattttgtgccacgaacggaggagcctatccctgcagaccaatgcgcaggtaaaaacgttcgatgggcgagcccgagtttgtcgatcaatgaaaaaagcacgataggtttgacccaaattaataacgccataggtgtaaaattaaattaatgatatggtttgaccttcggtttcgatttgcatgtagatttcttctctggattagcaactgggttttagcacaatcgattgacctgtcgatgatcccccgggtaatcaggggtcctggggctttgggcctgtgtgtgtccgtgctcctgctccaagcgtactacgtccaaaacctaagcactcccggaagacaaggaggaagtaactcgagatgtcccgagcttatatatcgtagctagctagtggtgtttgacgaaccgtccatcgatcgtggctgcgtctgtatttgtaaactgcagggtacgcgtcatatactcttacctagctagttactccagttattagtcccaccaactagaccaagttcggcagttcgctcgtttataattgttgagctggtactattaggcgcggagagaacaaaataattgcaatgtcgtttatcttaagtttacaatatatgtactcttatactggttaatggaacgttggctatacttaactagtactcctccattagaggacaaatggccatgctggtcaccattttagtagttgtacgtgctgtggtaggtactccaggttatttagcagctacggctaccagagtagagatcgaccaggcgctgctacagtaacgacaaaattaagcacgaaataaggaaaaagataagctactttactaggaacaacgaagatctctagactgcacgaggcgcctcaccttcactagtgtagtcactactatactctgatcgcaagacctgccctctgttaatgcgcgcattgctttgtgctcaacgacgcacctcgcctcaagctaagttagcactccatcaaatcacgcaacgaggttacgattttcacggatactgtgcaggagcggaacgctggaacgagacgaacgggaagtgcaagaaaaataattcagaaaaaacgcaacagtgcagttctatagtactactactactactactactgctgctgctgctgctgctgctgctgctgcagaagtagacttgtagtgggctgccactttaagttttgtagagcccaacccatccccacatcgccgcaccacgcttcctcctcggcggccgcgccgaatgagcggtcggtcgcggcactgatcggcgacaaatatttcgcaccgttttggggggccgaatcatgggcaccgcatcatgatccaccatgaatagaatcgcctcgtctcccggctgcccgctgttccagcttgctcgcttccacagcccccccacacacaccgacctgccaatttacgcatcatggatgtcccgcttcgatcgagcgagcgagcgaaggtggcgaccacgacgctgccagtacagtgcgaatatacgcgagtgcgcggttcacagggtcaggagttcactgtgtgccgcgcgggtgcgacacagcgacatcgtgatcccagaatccggggtttgctcgatcgtgggtccgattgctcgtgaggctggcccggctgtttgtttgttgttgcgcgcacggtcgtaaccccatgcttgcgcagcacttcacgtccggttttttcttcttttttttttgccgtcgcgtgggttaaattaaacaaagacgttgcttagctttggctgggatgagaaccgcagccggagcgtgaggagaaagttttctccaacttttctctctctctcttttttttttttacagcacggacgatctgcgtgccgtgctggattgctggtagcgcggtataggacaagacagaaaaaaacgcctacggtaccgtgcttctcctacccaagcccaccggcaaaaaatccggttcaccagtgccgtgcactagttttaccatgtttgatgtactgtagctgaccggtggaacccacttccagaacaggcgctactagtgttttgctccgcgttcttccatgatacggaaagctgcgtagtttatcctttgcatctactgtactgcagatattgcacggttttcctgaaatcgcagaatcacagtagtgcagtacgcgggccctatatgtcagtgttaaaaacggttttaggaagggttgatatgattatcagtccagctcttaattgcagacattgctaagctctacattcagcgtactacttccccttccctcgatggaaaaatctctccatatacacttgttatccttttggctggttagttggtgtggatcagccgccgtagatttccccaaaagacattgttaagctaggcatttaaaattgatgcactcctctttaagcatgtgtgaggccaggcactcgtgaattttatacgtacatagcgacacatgtgcatgttcgtagtcgtagtagctatcttttctattgccatacgatcgcaccgattggaactatctgatgagggcatatgtaacggtaaaagctacactatcatataagcgacactagatttttctcaatttattgccgagaggttagtcgcttccactttagctcacctcattttttttttctgaaccacatttttccgtgttattggcgcgcgctctctctctcttcatcgtaaaaaactacttgtagtcaatgcctacaaggtttccttcaatcacccgaatggatttctctcagtattcttagtcgattcctaatacttaagtatagctacgagctaaataatcatcggtgcataaccttaattttaaaggtgtacccatatgatggtagctttaaacctaaaagtaaccattgatgatggattctatgtccgtttgccatagaggctagagaagagggagagagagcaaaatcaatgttagcacaagcattgacctatgccaccatgtaaggttccacgttagaaagttgttgtgagcctatgacaagcattttttctttggccatggagtcgatataagaagtagagacatgcatttatttatttgttttttcttgaaaaatcaaggctttgatattctctagctccatggctccattaaagagccaccgctcatcatataataatctagcatcgggttgtctaaaaagtctaaaacttaagctttttggaatataaagagtgaatagcagttttaattttggaccaccatttgtctcaacttttcactttggaccaggtaatttatttttgtcctaatatagaccatcccatatatattttttagcacatcaatgaccccaagcacattaatttcatacttccagtgcgccagtaaactccattactcatgcgcaagccatatctttactggaggagtggtttgacaaggctagataatagagttggcgtggtccaaaggaaaaaaaaatgtaacattaactaatccaagtgaaaacaacagttaaagatatggtctaaagtgaattttagctatataggtcgcccaaactgtaattctcaaaaattagaataaaatcccacaagatttattttacaaataaaagtcgtacattaatcagaatagattggataaattggggtgtagtgggtttggataaagtgtaaactttgataacatatgaagttgaggttaaattatctggtataaatccagtgctgtaatgtactagggggggggggggctcacttctccccttcctcctccccttcttttcctactacagtataccaaaaaaaatttaaaaaaaacaaaaagttagaaaatttatctataaaaaatttgaattcaaatttaaatttgaatcgggtatgtaaacttttgacttataaactttgtgtctataaactttagatgtatagaaatactatatatagaaaatatttgaattcaaattcaattttgaatcggatataattcaaatttgaatcgggtatataaactttagatgtatagaaatactatatatgaaaaatatttgaattcaaattcaaatttgaatcggatataattcaaattcaaatttgaatcggatatataaactttaggtgtatagaaatactatatataaaaaaacaattgaatttaaattcaaatttgaatcggatatataaacttttggtctgaggtgtataaactttagttgtataaatgtaataaaataggaaaataacgcggtgtcaaaaaaagtaaggtagagggagggggaggcctacccgatcgctctgggctagcatttccggtactacagtgcatttctcgtttccctgtacagctcattcttccattcagtaaggtggtgacaggcaatactgggccacaatcatcctcgggccttcactaaatcctcctacatgtacacaaatatgagtttgtttttgtacatccctgtaccaccaatgattcggtgaacccgtgccccatgcgttgtttctgtaccacgcgagaaaccgatgttggctcagctactcacctctctctttctcacttttgatgaaagtgtgaaacacacacaaagagatgatgaactgacggagaatgaaaatgaacacttgtatttcacgctgcaaaccagcgcgcacaacataaacactgggggctgttcactttgatgaaaaaaaaaccttattaaattttggtattattaaaattttggtatagttgccaaaattttcgcaacttaccaaaattttggtatgatttcttatatagttgtcaaattttggcaacaaactaaatatagcaactttttgataattttatcaaaatttggtaagattgaaaataacatcacagtgaacaggctcttgtatttcacttttggcaccacaccacatacaccaccactccgtcctgttcggctgcacgacccggccaagacggtctgcaaccatgtcttcaccctcatgcgaggcaaatattactgcatgaagagctccactaactgacgcgcatacaggcaagattttctccaattaatcctgcttgactgctcttatctgatgaccacgcacaacacctgctagttgatccactcttcacgccatgcatccgtgcttcacttggccacagtgtcaagccaacgtgcacctacgggctgccggcatgcactctaatcaaactaacttatgcacacacgtacactacggaataactcacacagtaaacaacaagattaagtctaacaaccgaaacagaaagaacacgcccatatatcccacgccgcccaccgaaactcggacacccactccgccaccgccaccgcctcatccatggcactggctggctccatggccgccgccgccgccacctccacccttctcctcctcctcctcctcctcctcctcgccaccgccacccatggcgccgcggccgacacagtctcgtcccccgcctcccctgaagcggccgcactcctcaacctctccgccgcgctcggtgatccctcgggctacctctccacgcactggacgcacgacaccgcgttctgctcgtggccgcgcctctcctgcgacgccgacggctcccgcgtcctctcgctcgacctctccggcctcaacctctccggcccgatccccgccgcggcgctctcctccctctcgcacctccagtcactcaacctctccaacaacatcctcaactccaccttcccggagggcctcatcgccagcctcaagaaccttcgcgttctcgatttctacaacaacaacctcaccggcgctctcccggccgcgctccccaacctcaccaaccttgttcacctccacctcggcggcaatttcttcttcggcagcatccccaggtcgtacgggcagtggagccggatcaagtacctggctctctccggcaatgagctcaccggggagataccgccggagctcggcaacctgacgacgctcagggaactgtacctcggctacttcaacagcttcaccggcgggataccgccggagctcgggaggctgaaggagctcgtgcggctcgacatggcgaactgcgggatctccggtgtggtcccgccggaggtggcgaacctgacgtcgctcgacactctgtttcttcagatcaacgctctctccgggcggctgccgccggagattggcgcaatgggggcgctgaaatcgctcgacctgtcgaacaacctgttcgtcggggagatccccgcgagcttcgcgtcgctcaagaacctgacgctgctgaacctcttccggaatcgcctcgccggcgagattcccgagtttgtcggcgacctgccgaacctcgaggtgctgcagctgtgggagaacaacttcaccggtggagtgccggctcagctcggcgtggcagccaccaggctgaggatcgtcgatgtgagcacgaacaggctaaccggcgttctaccaacagagctctgcgccggcaagcggctggagacgttcattgcgctggggaactcactgttcggcagcattcccgacgggctcgccgggtgcccgtcgttgacgaggcttcgtcttggagagaattatctgaacgggacgataccggcgaagatgtttacattgcagaacctgacgcagatcgagctgcacgataatttgctctccggcgagctccggctggacgccggcgtggtgtcaccatcaataggagagctgagcttgtataacaatcggttgtccggtccggtgccggtggggatcggtggtctcgtcgggctgcagaagttgctggtcgccgggaaccggttgtccggcgaactccctcgtgagattgggaagctgcaacagctttcaaaggcggacttatctgggaacctgatctccggggagatacctccggcgatcgccggatgccggctgctcaccttcctcgacctctctggcaacaggctctccggcagaatcccgccggcgctcgccgggctacgaatcctcaactatctcaatctgtcccacaacgcgctcgacggggagattccacctgctatcgccggaatgcagagcctaacagccgtcgacttctccgacaacaatctctccggcgaggtcccggcgaccggccagttcgcctacttcaacgccacgtcgttcgccggtaacccaggcctctgcggcgccttcctctccccgtgccgctcccacggcgtcgccacgacgtcgaccttcggctccctctcgtcggcgtcgaagctgctcctcgtgctcggcctcctcgcgctgtccatcgtgttcgccggcgcggcggtgctgaaggcgcggtcgctgaagcggtccgccgaggcgcgcgcgtggcggctcacggcgttccagcgcctcgacttcgccgtggacgacgtgctggactgcctcaaggaggagaacgtgatcggcaagggcgggtcagggatcgtgtacaagggcgcgatgcccggcggcgcggtggtggccgtgaagcggctcccggccatggggcgctccggcgcggcgcacgacgactacggcttctcggcggagatacagacgctggggcgcatccggcaccgacacatcgtgcgcctgctcgggttcgccgccaaccgggagacgaacctgctggtgtacgagtacatgccgaacggcagcctcggcgaggtgctccacggcaagaagggcggccacctgcagtgggcgacgcggtacaagatcgccgtggaggccgccaagggcctctgctacctgcaccacgactgctcgccgccgatcctgcaccgcgacgtcaagtccaacaacatcctcctcgacgccgagttcgaggcgcacgtcgccgacttcggcctcgccaagttcctccgcggcaatgccggtggctccgagtgcatgtccgcgatcgccggctcctacggctacattgctcccggtatgtatgagtgtaccccctctgccccctacaaattttcagctcattctgttgactgtacccggttgctactagtactactatccaccatcatttccagtgttgaaaaaatcatgcatcacaaagtgcagaaaaggcccaaaattgctagtactagtcctgtcctgctcatggcaaatgttacaatggggccttcatatttttcaaactcactatcacattgaaatttggaagaaaatggttggttttggtatgctctgatttgttttttactgtgcccccacactatcgagttgtacatatgctggatgttgtgcctctcgtcactttgtcgttttaatgaatcatcattgggaattgatggcctgcgatcttatgtggtctgagctgtgtgtttgccctgtgcatccgcagagtacgcctacacgctcaaggtggacgagaagagcgacgtgtacagcttcggggtagtgctactggagctcatcgctgggcggaagccggtgggagagttcggcgacggcgtggacatcgtgcactgggtgcggatggtgaccgggtcgagcaaggagggcgtcacgaagatcgccgacccacggctctcgacggtgcccctccacgagctgacgcacgtcttctacgtcgccatgctgtgcgtcgccgagcagagcgtcgagcggccgacgatgcgggaggtcgtgcagatcttgaccgacctgcccggtacggcggcggcgacggccatggacgcgccgtcgcacgggtcggggaaagagcaagaccggagcgcggagatgcagcagcaggacgggtcacgcgagtccccgccacagcaggatctccttagcatctagaagcgtgcgtgcatgtccccgttgtaccggtactccgtagcatcatcccctgtacgtcttggcgtactcctggactgtgctggtgtcctggactgtgctggtgtccgggtccgagtccaagtagaggcaaatctccaatatttgcggtagtattgttagctagattaagattatattgttacataatggtggttgataaaatctactactagtagtatgtaatctgtctcctctcgtgtacaaagcaactactcctactccagtccagtatatgcctctccaaccaattggattgagatcgtatcgatctcgcaacaaaaaaaacacggacacacatggcctattggccagtgcgtcatactgtcatccctggccgctactggaagcactggtcaatactactagtacacccgtatggtgctgtccctacccctgctaaaaaatgtcgcaatacagatcacccgtggagacgtacgtacctttggtcgctgctgtatccccagcgtgctgtgccgatgggcgacatgcacacgcaggcactcccagctcgtcgtcgtggttcgggttgggaaggggataggacacgcacggttttgctcctgccgcgcggtgctcaggcgttcctggctccagcagcaagcagcaagcgcggggcgcgcggagacgtagtacgggcagagcggcgactggggagtgcgtgcacgtgagtggtcaattccatcgcggtagtacactgatgcactgccatgctcctctcgcctgaagatggcaggcggggcagcgagccggccaggacaatgcatgcacggcgccattgcccaccaccttgctgtcatcacccaagcaaagctttttgtgacagtgtaagtggttcgtttgattttggagccctgccatgccttcggcactgtgccgcgcatcataggatatgctgcagattgctgcggcctaatgatactgttggagctagcgttcacgcagggatgaatgagaatcgatcgagagctcccatgctcattttagtaccttctgataaaaaaagcgtgcgtggtggaagtgggactgatcagagtgcggtttggcgtgggcgatggacttggcttcgctggctgtgactactgactcaacacgtagtcgggagctttcgctgcatgcagagattggcgaggctgctgtgatggccgtgaccgcgaggcgcgagagtgcgcgctgccgctgttgctatcctgcggggattggggagagatgtccgtgctgtgtgagggtgtatggtcagatcatttgtcaattgtcacaggtcacaccacggttgtaatcggcgaagccactaggagaatcttctcgatcattttgtcgtggaaatctgagcatctatcggctcatcccttttgatccactgttcattatcttttctcgactatgatgtacatccctcgtttttcaatatagagtactctctctgcctcattataagtttatttttgctagtactatttattctaaagaaaattcatatttaaaataattattgtataggagtttataaagtagaaaataattactccctccgccctaaaatatagttatctttttggagttcaaattttatcccataatacttgccacttgttagtattatctgtcacatcagttatctccaattcaaattttcacccattctgtccccaccaaatctcttgtttctattcaaataagaggtaatatattctttacttttcaaatcttaatttgtgctaaacgacctagaaagacaagtattatgagacggaggaagtacattgagagtagataaattagggaataattatattgagatttatgggttctagtccttttattttttgttggtacgggtgggatgggtgaaaaatgaatttatcttgggacgaaggagtatctgtaagattttcttttcaaatatagttatctctaacatttaaattatacttctaagtttactatgttcatctgaaaaaattatcccaaaatatatcgattcctaccttcatatttactctcggtccacgaatcaagatgttttatcccttaataaataaatagttcttactcgattataactaaccaccaataccattttgttattaataacgggtactatatatttttgctcaccactaaatcttaatttgactcgggatgtttcatcgggatactttacacgaaaagatacgacaatcctctcgctagaaaaagactgcgtaatctgatttaaagacaaactttttcacctatgtctcatatttaacatcattgagttctatttagaaaatagaatataattgtataaatataaaaactatctaagaggagagggtatcaaattttaagttatagatatccacatgtcacaatcttcatgccaacttgaaatgcatcccggtggaactcacggctagccgttgtatattccatcgagattagttgtgtacactagactaaggacatgtcatttaattattattattattattattattattattattattattattattattattattattattattattattattattattattattattacattttgcaaatcatgccatatatacttatcctaccagttcatggcatactctcgtgtcatgccacactttgcttagagaggagtatttttacccggcatctacatccaatcgaatatatgcagttttacataattttaaatgattgttcatttaaaatttctataggattgttcattctaaaggaatttagaatgataggatatgattaatcatatccttatttgtttcaaaaaccttcgtagaaataattttataagattaaaattcttacgtttttcttacaaatcagattgacctaggagtaagtgtttgcaaaccaaggatgtacgtatatactagcaaagtggcaaaattatcaaagcttatgcaacgcaaaggtctactcgtacccgtggacgtatgcccagcccggagagtccatgcatgtaagacgatgtgatatgggatcaacatgcatgtatgcaatgagtcgtcggctcgccaagttaattatcatcacatggggagaaggggcaaacatgcacgtacgggtaaagggtgaaaaggaccgtgatggcgatgagattcttgtagtcctgacgcggaagagaagcggcaaggaaaagatgaatggatcgatggaccggaccggacgggggcttgtgcctgtggcgctagctagccgcatcgcgtggctttgccatctgtgtgtgttctcccctcgtgtagtcgagtcgtttcgctg

SEQ ID NO: 57068 - DNA, 8898 bp, Oryza sativa
tttatactctcgacctatctatcaccaatactactacttttttttaataatgagaaatactttttttaataatgaggaacactttgggtatttttactcctcgctaattttacattgggatgctaggattcgtctttttttagaacggagagggagtatattctaaccgaaactcctaatgggctatcgatcgcccctagtcacccccctcctccacgtggttttcttttctggcaccgcattactttcctattttagtaaatttatgcacctaaagtttatacacctcaagtttatacatctaaagtttagagacccaaagtttataaatcaaaagtttatatgtccgattcaaatttaaatttgaattcaaatattttttatatatagtatttctatacatctaaagtttatacacctaaagtttatagacccaaagtttatatacccgattcaaatttgaatttgaattatatcggattcaaatttgaatttgaattcaaatatttttatatatagtatttctatacatctaaagtttatacacctaaagtttatagacccaaagtttataagtcaaaagtttacatacccgattcaattttgaatttgaattcaaatattagtttataaacccaaagtttataactcaaaagtttacatacccgattcaattttgaatttgaattcaaatattagtttatagacccaaagtttataagtcaagagtttacatacccatttcaaatttgaatttgaattcaaatattttttttatatatagtatttctatacataaatttttcaactttgcttttttattttttaaaaatttatggtgtagtaggaagagatgaaggagaggaggaaggaagagagtagcgtatagggggatggggggtgatcgcccggagcagtcacccgcccattagccacaccctattctaacaccatatgcgtacgtttacaagatgatgtataattacttcatcttgaggaagtatcaaagttgtggtggagtggattatttcacttaaaagggttaaaattctgatatccacgtgcccataatgttaaaaaattgaagtttagtacacgataagaatttactcgtggtggtctcttgatcatgtattaagtattaaggtggtattttcatgaacgtgtatatatgtataggtctttaattaatgtaacaaaaacgaactacacgaatattcttcttatgtttttgtatataggatttaagggccctgattcaaatgattgaagcttttcaaatcctatgaaattcctatggaatggcacattgcatgtggattttaaaggaaatttagcaagaggtctaacttcttgaaaaatttcctttgagtctacctctttcatccgattcctgcgtttttcatgcgctccaatcaaatgaccatttctatgtttttcctgtgttttgcaatcctctgttttacacttcaattcctgtcagaatccttttgttttactattcctccgttttttctaacctgcgattcaaaggggtcctaaatggttctatgaagtgggtccccatgttcgaaaagttaccgattctttgggaaagctggcgagaccaagccgttacggccccatggggccgttcctggcgaatgttaagctccctggctaaatttaacacgtcccatcccatcaccacacattgcatgaggctgttttcttgagagctcacctgaacagtcgaatctactgtatgcagcttttgtaacacctttctcctcacgaccgactccgtgctattgggtgttggccaccacggatccatcggcgatcgagtctccattcgtacgccagaccgagcccatgatctacacgtactactattactaccaccagaccctgtgtagtttccgcacaaaaaaaatttacaccttatcacacctttctcctcacgatagactctgtgctgttgggtgttgccaccacggatccatcggcgatcgagtctccgttcgtacgccagaccgagcccatgatctacacgtactactattactaccaccaggccctgtgtacttcccgtgcaaaaattttacatcttgtcacatcgaacgtttagacacttacatgaaatattaaatataggctaaaaaaataactaattacagagattacaactaatttgcgagatgaatcttttaagcctaattgcttcatgatttaataatgtagtgctacagtaaacatttgctaatgatggattaattaggcttaataaattcatctcgtagtttacggacggattttgtaattgttttttttgttagtgtccgaacatcctatacgatatcctatataatatctgatgtgacacgttaaaactttgagcattgctccagtccagcatattgtacctcgaggtaccagtaccttcaggtaccaatttaaatccaaccgttcattcacggagggtaagattgaaaatctcacacgctaaacagctcatgatcgtgatgctccttctctctgactgagtgactgtgtcaacgaagactccaagagcaactgagcaagtccaaaccaagagcaaggacgtggtgggagcgcgacaaggggtggtcggcgccggtggtgccgggggcgtcggcggcggggtgttggacggcagcgtgttgggcgccggcggtgtctgcacggcggcgaggtaacgaggagcaggaggggtggtcggcaccggtggtgttggacggcggcgcctgcgtcgaaggctgctacgcggcggcgaaggcgacgaggacctgcgtcgcttgccgatgtgcttgaatccagcagcgagattaggggaagggccgcggtagacgtatgtcaccggcgagcttgggggaagtggtgcacggaggctcgtcggccccctccacctccactccggctagcctgtccatccctggtgagagccatcgatcgatgcaggcatgcagcatcttttggagagagaaaagacaggaggaagatgaagaagatacacgcgaaattacttaactacccttgcttctttagtactccatccattccaaaatataaggcataaccaccctaacccaaagaccaagaaataattattattattatcttgtagtttggatcatcctaataaatacaatgcatgcatccaatagaattagaaagcatgagagtgaaggatctaaaaaagtaatattttattggagaagtggtcatagttaattctctacatgtatgcatgccttataatatggaacatctaaaaaaagtggttgtgacttatattatggaatggagggagtacctttctatgctctataaaatcacgtggacagtactactaggtacaactctttctcacccgttagatcaaacgaaatcgatggttcaaattacatgtacgggcaggtaccaagtacctgctggaccgtaaaaattctctaaaactttagtgtcttaacaccccatgtatcggtggccggggcccgggagccccagagcgcgcgaccaatgatgcgcacgagtacacaacagcgaaagcgaagcatgcatgccacgcgcgcgccggcgagcacccaccaccgcagtgatccctcgtcgaattcactctgatccagccgctgccgcacccgccgacccgcgggcgctgctgcctgcacaccagcacgtaaaagcgcgcacggctcgatcgtcgcgatggcctttccctccagtctcgtgcgtgcgtctggccgaaagaggagagatatatcgaccacggcagcgacgcacgcagcgtgctgcttgcatcggcgcacgatgcaccgtctcgtggttgccgctcagcgggagccacactcggatgcgtgtattacgtatgtgtcgctgtgcgcgtctcgtgtgttgctgtgcggtccgcggtggcgtggaccacacgctccacgcgcgcgcaggccatgggcgctagtataccatctttctgttctgttccgctcttccaggtggctagtggcaaagcctgtttgtcttggacccattttcgaaacgctccagatcatcagtgtgagtttgtgaccgtgacgtcccagagtggccacgtcaatatatagtactccctccggcccattttaaacaccactacgagttttcatatctaactttaattgttcgtcttatttaaaacttttctattaatatttctattgtattatatgataataaaacatgaatagtacttgatgtttttttttaaaaataagacaaacgattaaaattggacattgaaactcatatgcgcttaaaatgagacggaggccgcacacaaaaatcttgttggaagtccatatgcatgtacgtaatattcacgaggatttgaaccctagtgggttgagtctaggagtgggtattcggtctgaccaaaaatttcggtttcggtcttcgatcttttggtcatttcactctttggaaagtgaagaccgaatttcaaggcaaaatgtcagaaccgacaaattcggtctctgtcttttcggtctcggtctcggtcctaaccgaaattcaacaatattttcatatatgcaaacaaataatgaaaaatttcaacacaaaaatcacaaaaaatttcgtaagcacgtattagtaaagactcttattaggttgcatgcctaaaagaagtagggatgtgaaaaatagagtttaatcctattgaacttagtgggttttaggttgcatttagatatttttgctaattcggtctattcggttaaccgaggagactaaccgaattgagagaacaaatttcggtttttcactgcctaggatcgaattgatgaccgaatttttggtctcggtctttttctacctacccctaattgagtcatgcacccacgagtccatgacttcatcaccacaccgctggtgcttcctaatagtactactattagtatatctctcctccatgtgtctgccttctttgtgaccccatcgatcgatcgatcgatagctttagagtgtgtttaagaaggaggggattgaggagattggaaagatacgtaaaatgaggtgatccattagcacatgattaattgagtattaattattttaaactttaaaaatggattaatatgattatttaaagcaactttcctatagaaatattttgcaaaaaacacaccgtttagtagttcgggaagcgtgcgcgcgaaaaacaaaactatttttctctctttctcatgcgctcgaacgcagcctaatagttgtgcttcagaaaagtttgtttgaaaaaactagcactactgctactttagcaggactgtgcgtttattggtacggggtgactggatgattgccgatttgccttaaacttcctagtttcctacttctgttgtcgatgagcgattaaccttggccactgaggcactgtaaattgccctagctagatcaggctttcggtttcaaccaataagtttgtcactgcatgcgttcttggcgactcattggtccgttgctaccttttgtcatttcgatagcctttttcatgtcaccgaagagtcaaaggcagtgatcaaacgctgatgatctgatccacatccaagtaaatactacaggtagtagaactcttgcagtagatcagccaaacctacaggtaattttcactgattagtgattacaactctacgcactgatctagctcgactttagttggcaactgtttcctcaagcttctgtacaattaatgaaactaaaatgtgatcctatagcacgatatgactaaacaaagtcaaacgacaaaacggtatgggctggtttggtttgtgctttgtggcctaaatttagccttaattaccaatattggtaattttaatagtgtttagtatcattttgtttgatgctaaattttgacatgcttagaaaaatataccatttcaatagcaaacttaagctattttggctttaatccaaacacaatattgccttgtcaaaattagtgatgctaaaacttgccaaaattcagacattgtttgttattttttataagactctttttgtctgttgggctttctttcaaagccgggtcaatataattaatctgtttcaaaaaacaaaaacttgccaaaattttacattgataaaaattggtagatcaattttggccataaaccaaaccttccctgtatacgctcaaggaatattgctcgatcttcgcgtagtaaacacatcattcgttcctaccaagagtgttcggttaaccgccctatcatcctcttctcattgtcactcgacacaaggcgcacatatacgcacactcgcacatgcaacgcatgaatgttactagcttagtacctttcaacctgtacgcctgcagtaacaataatcttagccaaaaactaaatcccaaaacgagataagagcctggtcatggccacaccgacgacgtccatcccctgaaacggccaactgatagcgtccaaattaagcacacacatgtaaggattactgcactggctagacatgccacaccaccagagacagagacgcaaggatggcgactgtaccagcagcagcagctagctagctagctgcaggcctgagcttagcattcatggcatgaacaataaaatggaacaagtgaggcacacggactgtgcacagcgtgcaaggcaaatgtacttaacagagatggacaccggcccgggtcacagtgtaactgcccagatttcttcttggtgatgtacgagagatgtgtttgttgtgctgcatgactgcatctctccctgtgcatggctaatgggtgccattttccatgtgcatatgcctcaataatgaatgcaggtgcaattccatggggtccatgagatggtactatatatccgatgttatgtttaatttctctctcccggtcttcctcttttccctgtttacctgcaacacctttccctttcctgcgatttgtttacttgcaattagttgggcaatttgtttattttattactcctacctgtgcacttgcttgtgtaccaggcaaggagtggcctggctggctagccgggtcacttttttaggtgctgatgtgaaattggctggtgtcttggcatgaaggagacaaggacatcagacattccatgacttcataccttcccaaacttccaaacaaataccccaatcagtgtccgtctgtgttctaagcaggcaggcacctttttttgctggtcatgtggcttatctgtttgattagtataaacaaatgcagtcttgatcgagtactggggagtagctttctcacgaactttggctggaggatgaaccgtgggtcctcatgttagtggggctcatctgtcattggaatgtaatggcaatgggctctctcatctctcttcacattagcccagaaaccttagctagaagctcgtgcatcagtggctgcagctccaggtttatgataagtttccagagagaatatacttcaatcacactgtccgaagtctgataattcacacaacattttgaaaggaaaagttaacggagtctgggggaatagaactagctactgtgtactgctttacatgccctgtttatctcttctcctactgctactctgtattcggtcgatcgatccattcatcatactgttaccttcagaaaaaaatgaaaagtgagtagtcgttgtactgctactgttttgagattccgaatcaaataattccaaaatggacagcataagtccattgagtcctcgatctcacagcagcttaaagaattatagcagtgtactatattggctctactatttttatatgttctccgagggacctgttttgcgcgtctgtgcagtcatatgaatgcattcgaatgccacattttctgccatcaagcaaagctgtaaggcccaacccggccaattatttcacgtccacggtacacacatcgcaatctttcttcttggaagatatctgcaagaaaacttttagtctgaatcaatcaatcagtagccattcttacccagccaaaggccatggcttcagctcaatgctgtccctctgaagcttgcataaagaaaaattacagtaaacaagaggacatcgcttgcaagattagtactaaaaacgaatcaaacgggccccgtatcaaactgaatcgcctctcatggaatacagttccgttgcgtggatgcacgaaagtaagaacaaattaatggcttgctcattccgtcatgtagtacgattgtacgaacgtacaaaccggcagctaattgacaagggaaaaacatcacctacattatatacacatacataatcacgcggggacagctgtcgctaacatgaacagctggtgaacagacatagcatgatgttcaggaaagagtggttcttcagtcttcaccgatgtgtaaagaactatagctagagactaaagacaaagagagacatacatacctatacatatatactctcttcttgtccattgcaatgctagacacacgtacggacacaacatagtttacgtcgaaatcatccatctcggagacgaagctccgggcatttctgcttggtccaagaggtgatcatcgacagtgctctcgttcatccattggctgcttcctgacttgtgatcaggacccgtccaagacgatgcagcagatgcaatgatccaggcaacggtgaaatgccaatgccatgagcgttgccgcaggctatcttgcaatacacactcgatgcccctgtcgtcgcttgcacacatacgcaacaaggtactataatttgaggtttgacaagcagctttcagctccatttccctggagaaacaggaaaaattggtagcaatgtcagctcatgcatgatggtggaatataaatccagcaactttgaattcaacatgcatgcatgcagtacaaaaaagtacagtatgttcttc

SEQ ID NO: 57069 - DNA, 1271 bp, Oryza sativa
aaacgagagccacgtcacgcacaggaagccctgtctcctgcttgattattcgtaggcatcctccctgaccagtcgagggtgtactgtttgtcgttgtagcaagtagcagaagatgaggatcaatgatgcatttgatcgtgctgtattcgagtgagctctgaaattttcatctctgatgagacatgggttttggttcgctgctgtttcatggatgaacatgtagaattgagttgagttcaaacaatcaaacgcctgcaaaattgtactgcgacggacttgtttcaaattttgaatggaccatttctgctatatagctgtagtcctgttgattcgcactcgatgtattgttcaaaccatccagggaaaaaagaacttgccattgtctttttataattttgttccaagccgccgtatgatgcccaggacatactgatatgtgatgtggttcatactttaattatgatccatgtcgacagggtcaccttttttccttgttaagtgcagcaatgctttgaccaattgacgtcaccaaaaccatcacttaggccagctttagcagacagggcaatcttaattgtatactagtatattatgcctgtattgtactggaggaaccatgccatatgattctgtcatatgtaaggctatgttgctgcaagctccctgccaattctgaaatatttaaaaatttcccagtttcaggatggagattctgatgtctgaaatctgaatccttgaattctcattgcccaggagttgatgggcctcaaatgcatcctggaagctcagcctcagcatagcccatgggctatataaactctctttgcaggctttcaacaataggcgaacctgatacagagtgtcagagtcacaggaagcacaaactgaagatcacgctcagaaagaatccagtgaggtactgatcgcttaaatgcccatttgttccctcataaataagaggctgaagctaggagcaacatgaactcatcccaatcatatcggtttcatgattcaatattcaaatgaacccctcgagcagcaaatgtaaactaaatcatttttcttagtgttgacaagaaacatcacagatcacaccacaatagaagattgcaggatgttaaccaaacccaggaggcacatcaggatcctcctcatcatcatccccagggcagctaacggcgttgggctcaccttcatttggtttcacttggttatgattctcagtatttgacgactgctgctgctgagttgccatgatgttgctgcgctga

SEQ ID NO: 57070 - DNA, 1903 bp, Oryza sativa
gcttaggcttattggcctagacttttaagtcagcttattggcttatatgatttataagccggtggatttaatgtcctaggtttagtggttgagtcatacatctacctcacataaactaaaaaagcttctccaacctagtttttggcttaatagtgttagagtggcttatggcttcaaaaaagctaaacggaaaagctgcttgtttgtttaggcttagacttttcgacttataagttggcttataagcctaaacaaagagggcctaagcttggttaaccatgtatgctggctgtacatataatacacacaaacttatggaactacacaacattaggacttatctggctcatacctgtatgctattgggccatagtatgtaaatcagagtgatacgtactaaactttcagccttgtttgcaggcaaatcagtatgaagccaagactattataaaaaacaaattctatactctaggatacaactcttttttgcagtcatgggatgcatttacaagtttacagttgtgggatattagtatatatcatgggaacacgtttacagtcacagcggtggggtgctacaaacgtcttgggtactagttacctcttccacataaataacaatgaaggcatgccaaatttatggcataaaatgagactatcttcaaccttcaatggggttatggggcgcttgattcttcaatccattcactgtatccctttcgacacagctctacagcacatttatcttttatttatctataataatccttactatctatataagtacaatccactaattgcagttaacttaggccattcccaacccaatgactaggatgttgtccatagcattaaataagctaccacctaggatgaaagatgatgtgccaagtgaataaatgaggaaagagaagaaaaccaggtcttgcatgagacatggtttctacacaacatccaagatatcatgtgagataagtagcattaaatttaagtatgaaaaagtggtgtttgcattgaaatctagtactagtttcttgatgatgtagagtttatgaaaactatgactagtgtcttgggttggaaatggccttatggctatgaagaagccctcacgttgagccaggtcatcataattgtttcagccattagatgtctgacagcccaacggccacaccatctttaaccaatacttgcaaatttccttgtttttttacacaattagtcggttcaaattcctgcagcaacgccttggttaacccaccagtataatagaaagatatgtcaacaatgtgtaattgtgtatgcttcccaattcccaacaccaaaactagaaaacacaatgctactacaagaaaatttccaactttactactcacatggacaaagtaaaatgactattgaggacgcaatggtttcattggacaatgtaagaatatatggacctgaaacacaatttccgatgatatgaataagctggtaatcaatatgactcatttatgacgaacaaaggcgcaaccctactcacattcatatgtcaatagatgactgtataagatatgcaaggttaccaaacaatgtagtaatgaagtaaagcacacaaacagaagctgcaaaattttcttacgttccaaatttcctccgaatatattatcaagttctaaatgcgttgctacagcaacatacgattggttacattcctgataaaacttgaatcacgtagttctggtaattcatgagaacagacctgctcagagcatatacattcacacccaatgtctaaaacttaacacaagaaggcacattgcagttcgcctgaagttgagataatgcaggatgatctatgctaaatccactgtccccatggatgacttcaggaaaatcgaacccacccaatcgcggctat

SEQ ID NO: 57071 - DNA, 4157 bp, Oryza sativa
acctgattcaccggcgtacgccgccgccgccgcccttcgagttcgttgcagattggggagggaggggactccgtgcgccgccgcttgcttccctcagaaaattttggggtttcgtcggagagagcgagaggcgagaggacgagaaaaaaaagaaaagaaaagaggaaaatactcacgcggtacgtactcaagcctagtccctcggtcacatcaaaacccaacctaatcaaaatttacagtagaataatatgttatattcaatactaaattggttatttaaggtacagaggcagtacgactcaattcgtcccggtgataaaattgtctacctcgtcctggtgataaaactgtctagcgaaacaacccgtagaatttttcagtttcattggttgacaacattccctaataaatcaaaacagtttattaggaaataaaaaaaattatagataaaacttttatatgtttattcgtagtgacttaaaagccaacgctaaagagaaatggcgttgaaaacatcttaaaatcaactttaaaaattcaaattttgacttttattttggtttattaagtcaaccaatggagctctgagaacaaaagacaatggtggtgtttgaatctcttgaaaatgaagataaagataaagataaagtgtttcacgtaaaacgaggtagtaataacatgtgattaattaagttttaattattacgaacttgaaaaatggattaatctaatattttagaataaatttcatatataaagtttttgcatgaaacagaccgtttagcagtttgaaatgcgtgtcaccaaaatcttcatcttcatcttcatccaacacttgttggagaaacgataaatgcatcagacatcgaattcagaagaaaacacaacgccttcgcaattttccaagaacaacattctatcaaaaacagcacagatatcatcagccgaaggagaaacaggctagtatgatttttcttgtctaggagacacgatgcctcaactggcaatcggcaagcaaaccagatagtactgaagaattcacgtttcaggtcacatattcaatttcatgcgggatacacagagatattcacgatggctacaagctctcatattcatgtcaaatggtagatgctcgcgacttgagagaatcgcaacgcgactggagaaaaatgcaatctgatttcttctgctcacgcattcaaagtttctgtccataacatgagtgaagctctcacggctcaacggctgaaacgctctgaaatcgacttcggtatgaggctggttgtgtttgactgtttctccagcctgcgtcaagaaacgaatactgttaggattacatgtaaacatgcacgcaacatgtgcaaggggaaggcagcaggaagtaagaaccttgcaatctcttcgacagatctcattatttgctctgaacttgtttcaatcacttgtcccccaagtatcatttcatctaaaattgtatgcagctgcatttgatatttcaattagcctaataaaaatagtgattacctttaagcagtaacaatcatcactatgacacttccgttaaaaaaaacaatcatcactatgacacgagcaaagacagttgagatgaattgttgtaatgtttggtattgacgactgagggcagcattaccaaaggtgtgggcttagcccctagctctctctctctctctccgcaacaaaatttccagtgttactttttttttaccatttgtgtactaacaaaacaaactaacttactagcaaaacaatattggtcctctcttgtaaaggaccataagcatgctttatgaacttgacccttttatattcttcaagcccagcctcaatggagcatattcaaagtaaaaggatcaaaacatgagaatcactttaccttgttgaagttaaatacgatgtcaagctcacacacattcttgaagcatctgtccaatgtttcaacaaaaactgtgcacaagataaagttttctacagattaattgatctgctgcaatcatggctgataaaacggggagttaaagtgaacttaacagaagtgaaaagagctgagtagttcagcagctacccagcattggacgaacaaacagtgcatgtttggggttgggatttgaggagtagcaaaccatcaattattgagagaatgctaaatactagtaaatagtaatgtatgaacactgaaactgaaataagtgccacagtcatcagctatgagtttgaatctaaaagaggaattgatataaagaagcgcaagtgacattacaataaacatgtaaaataaggcaggtcaaacaactgaacaagcatgtagtaagatcgaacatgaacataacaattatttttggcatgggagcgtaaaccatgactgtatggttgttgccttgttggcatgtcacatgagtcaaacaattgcagtaactaataaacagtttcatcaataaggcactagattaccttgtacaagatcaagcaccgcaagttcattttcagagctatcaaagacaaaaacaaagtacaatgtggccaaatgtttgtagaccaatttcgctccctgaaagtgcaaaagaaaaggttgaccatcatgctatcatatacaaatcgctaaaaaagttgtttgtttccttgctacagtttgactgacatatagaagagaaacagacaaacagtaaatttcatgaggaagcatgaacttgtacagacgtcagttttttttcctttacttttttttttttgaagaaagtgtttgcaattgcatacagattgactaaaagtctaagatagtggcaggttacataacaaacgagagaaatcaactgacattagagcaaggagctttcaaaaattcctatgtcagttccagcatatgcttgtattttagcaagatttattacaagatcagtcttggagagggttcattaccggtccaaagattgcatcaaccttgacgaaattgctgacactgtccggccttgcagacaacactgcaaaacgtgcttcacaaatcaagcatactacgtataatcgtatacaaaaggtgaagagcaggaaagtagactgtgggtgatacatacactggaagacgccgcggacgaggtcctgatgcttctcggggggctgcatccaataaccaatccatgaagcagagaatagatagaaggggagagcaaagtggtcaaaagcatttcgtcaatcacgtaagctgctattggtcttgggtggggaaattgacccagcacttgtcgggtgggcgaagattggaggggtgggtgaacggggtagaatcgaaacctggtagctgtagaacttgaggaggcgcggcttgccctgcgtgctcatcaccatcacggcctggatcatggctgatggggatgaggaagaggcgagcgaaatcagtcgggtggtgtttggttagagtctgtaaacgcaaatggtaactgaatcaaataaaactgttaatggaatcagattcaagcaatcctaaactttgtttggcttgatggtgtaatgaaagccatttcctttattgtgttttgaatgaatacatttaacggtagtaagattgcatagcatacaaaatcttcctacaaagttttttttttttttgatctcaggcaaatttcattacccggctttagagaaaagcccaaaacagacagagtcttcctacaaagtttgggtatcaagattatgtgcatgtacatttttagatttgagcgaatacaaatgtgagatttatctacaatgatgtacagaatacaaatatgtagatacgcaagaacagaaaacatgaaaaacatcaacagataaagagaagaaattacaccagcaaaccaaacaaagtcagtaaaacagacggtttttagtcagtaaacctgcgtgatccagtcgtcaggcaggaactccgcggaggcggcggcggacggcccacctcacccccccccccctccccccggctcgccgaaaccctagcggaagctccggcgatggacgagtgcggcggaggcggcgctgctgcaaatgtggtgcccggcggctgtgcagcacaacagccgcagcacgcgctccgccacgaggacaatcttccgcgcgcgggggtggggggagcggcgccggcgaagcggagagcttctctttagatcgta

SEQ ID NO: 57072 - DNA, 8427 bp, Oryza sativa
cctggcgcgtattgtttcgttaaccaattttattttttttattgttttgtaatatatgcgcgtattgtttcgttaaccaattttttttattgttttgtaatatatgccaaagactaccttcgatgttaaataattttagtttgtattttcctagtacaagatttcatctattttgatttggtccaacacattgaacaatgtacagaacatggccatctaggtgttagcaatttcatcatttgttgattacgagtcatggcgcttattaggaaaaaaaatgtgtaaaacttttatattttttttacttaaaaactacttggaaaataaactgagataaaaagaattatcattttttttgcgagggagaattatcaaaattaattgtagtgtaagttttaaagtttaactagctgggtgacccgcgcaattgcgcggctagcacacatacaaaatttatatatttttaatctgattttacttcaaatttattaaatagctatctcattgtcttaagattttaaaaaaccaaaccttatcatccccgtgttttctaattttatagttctaaaagtcacaccagttgttatcccttacttatgtcatctcattttttatttgcttgctcgatctaccacggtttctattcattttccttggaatctataaaagttggattgtatagtttttagagtttattatctcgttgggttttatttttataatttctagaagtctcgttaaacgccgctattatacttctctacggtccgtccacttcctcttctctttattgtcattgagattttaaaaatcgaacataattatcgtttgtgttcagtttttttactttctagaagtcttgccaaaccatcagcggctttgccactgcactcctctacggctcgcccgctgcatgcactcctcaacggatcgcctgctgcatcccttctttattgtcattgagattttaaaattgaacatgattatcattggggtttactcaccttgtagttttaagagtttattgtctcgctgggtttcatttttctctaatttttagaagtctgatcaaacgttgacactatactcctctaaggttcgtccaacaccaactctttattatcattgggattctaaaaattcaaacataactatcgttaaaattcattttttactttctaaaagtcccgccaaccgtcgacggctctgccactgtactcatgtacgactcgtccgctacctgtcctttttattgtcattgagattttaaaaatagaatatgattatcattggagtttattttttttactttctagaagtcccgccaaccgccttgatcggttgcttcacggcctgcccgtcgttaatccttttaatcgtcattaggattctatttggtgttttattaatagttttagatgtcccatcaaatgccaccactctactcctttatagatctgttacttaattaatctcgttatatgttttagatgatcttttttttcaatagtctttattttttatcaccaattttagttatttataagttgtcttatttttctttttctaatttcagaatttattttatttgtatatcgaattttaattaatattgtattgtgttcttttaatatttttatttttattttcaaatcaagttgtttcaaaattgtattcgtacttgaactttctttttaatttgtctaattttggattttttttattttatacttaattcaattaatctcgtattagattcttatatggactcttctttcaatatactttatttttaatttcgaatttaagttaattttaaattatatttctacttaaactcttattttcttttcttttttctaatttccaattttaatttactttttattcctaattttaattaatctcttattgggtttttatatcgactcttctttcaatattgtttaattttaattctgaatttcaattatttttaatttttttttctacttgaactcttcttttcttttttgctaattttggattttattttattttttattttgaatattaattaatctcgtatcgagttattatatggactcttctttcaatagtgcttatttttaatcccgaatttcagttatttttaaattgtatttctacttagactctcattttgtttttcttcgattaatgtgggaatttctagtccccacaacgaacatggtgtctcctttgaaagagataataaaatatgaatagtattttatgtttgacttatttttttaatattttttgaaaactcatgtttgcgcttaaaataggatgatcaaagttggacaccaaaactcatgtttacgcttaaaataggatggagggagtaaggactaaatatggccctgtttacattccaacttttttcttcaaacttccaacttttctgtcacattaaacttttctacacacacaaacttccaacttttccatcacatcaaactttcctacatacacaaacttccaacttttccgtcacatcgttccaattttttcaaactttacacaacatatattgaagaataattgtattggtagtctagatgtggtgtttttttttccatctgcggccagttttatggtatgctagcttctggattttatttggctgcaagtctgaatgcatcaattaaattgggtttgcagtggacagatctagtgatagttcaattcctttttcacttcaaaatccaaatctacgtatgtattgaagccatccgtttgatttatttttttctatttggaatccatatggtattcaatttttttctttcccccaatcggacaacatcctagccaaatacaataaggaatcagacatgcatgcatgcatatttgtgatgtacctcaaagatcagagttactttcctatttgtatcgaatagagtttgattcatactgagagaacttttttctgataaatctacaccctttaatttaatccattacaatctaatggtatagattttttctctttttctccgattaatatgggaatttttagcccccacggcgaatgtggtgccttcttttcgagctgtcttaataatataatagatagatttttagttatggatgataaactaaggagcagaccgatgcatgtttacagtctcattttgcttattggagaatcagaagcagtaatagattttttgtttcccgagatatggcggagatcttacatatcactatcaacaaaattgttatatgtggcaggaaacagttgatggagactagtaagactaccattaccaagttcaagatcttaaacactaggctatacttcgtttgttaccagccacctaaattcatgtctttgtagtttgtaacatgaatgctactggatacattttcagccactttgcaaaaatgatatcgacatgtcagaaacacaaaccacaaaaaaacagagaaacaacaaaatacacaagtggtttcatgtcctttgtgtgtgcataggtggctgtaaacgaaatacgtatgtgaagctaaataatagctgagatgttggattcgatgttttgccactatttagattgggcaattgaacgcacgttaaaaggccccaatcagttacatatgggcatctgttcacagttacacattgagaaattaaataaaaaattgccatcaaaagcaatttccattttccttcatggacaactatatattttattatttccttttactttttcgaatggcaactttatatttttttttcttctgggctgccaaaagtaccaaacggaattatgcagtcatgcatgaagaggtgttttttggactttcgtgtgcaatgtgtgaggtgtcagttgagggatttacggggctcaattccttggagaaataaattcgtataattgagaggaaagcctcttttcaggactactagtccactgttcgtctcttccttagcatactgtgtgcataagtgaagaggggaagggggagccaggcatcttcgagcctaggagctcaatctggtaaggaattatgtccttgcttagctctgtgctcttcgatactgttcatggaaacactacgcaggattccttgtttgggagatgcttcaggtgttcagtgttaagtcagaaactggaaatcaaatttcttgttctctgattccccaaaatcttatactctgtgcaagtggggatcatgattatgattacattatgattttatcatcctcttcttccccgttccatcttatgcaggagtatgaaagaactatcaaattattcagcagtacttcatccttagtttagaaaatcaaaggggatttctaaaaggaaccttaacactgcatcctaataagttcttgagttgtttgcgagtttgatttgcttttgttaaataatttctagttatgattcttatcattggggaaaaaaattcttccatttatgtcctgtatgcagaattcatcgtagttcttgagaagtatccggtatctgtatgtatttcatattcagaatttagcaaggtgttcgtccaagaatctatcttctgctcctatgttttgtatgaataggtcataggttttcattttcatccgtcatgtcctatgtagaattcataatacatgagcagtatcagtgtcaatgacttgcacagttgtgctcggctgaaaaatttgtcatatggtgcagttcatcacagatgcctaaaatccttccattttaacaccttttctttagtttttgattgttgcagatggaatacccaaggacactcacttcctgaccgctcaaatatcccatccattccatgctctgatgtgagcaactcggttccaagaatcttggaaacatggggaaaattcccggatcagcagtcgccatggccacgccgccggagccgtcgtcttggctgagcctcaaggtgttcttcctgagggtgagcaggtgcgaggtgaacgagtccatgctggattctgtgaccgtcacccacgccccgctcaccccggacaccgtgctcgaggtgagcggcggcagcgtcgccagcaacggccacgtgtcgctccgcctggaccgcgccggcggcgtcggcgccgccgccacggagggcggcgactcctgcaccttcgtcagcacggcggacgtcagggtgtccgggagcgcgcggttcgacgtccagtgcagaggcgagcggctcgtcgtcgggatcctggacacgcgcgacgccggcgctggcggcggcggctgggtgatgaagtgccaggtcgcggcgcagcgcgggtcgggcctcgtgaggcgcggtagcaaggaggcgaagccgccggtggtggaggtgtacgtcgccggcctggcccgcggcgcgccggtcgtcttcacgagggcgatgcagctgcggttcaggaggcggcgccacgtcaaggccttcatggagcccatcccggagcacggcgagccggcggaggactccaaagaaacgctgcctccgaagcatgaaaccgaggtaaaaaaatcccagcattttctttctctccgatgaatctccgtttattttatcatcgtcgatttcttgaactgaaatgcttgagctgcaccgtcaatgtaggtgtcggagtacaggtgctacaagccggagcaggacgccggcgacgccgactacgacggcttctacgtgaagcctgcaggcgaggaagacgacgacggcgatttctcgtggttcaccgccggcgtcagagtcggcgtcggcatcagcgtaggcatctgcctcggcatcggcatcggcgccggcctcctggcccgttcgtaccactctacgtcgaggagcctgagaagccggctgatctcgagtctgttctgaacatcaacattgcatcaagatcactgtccatctcaaaattcagatatccctctgttggagatggactagtccagtgtgtgtgtatatatccttgttagtatagttgttactaccgtcgtagatagatgagatgtgctatctttggcactgttggttcactggtttatacttatatgatcaggcattgtcaaattgagaccctttcatatctacccagatcgatcaatcgatgtcattgatcactagtgcatctagtctagagccctatgttgttagactaatttcatttgaagattgcacaagtctattccgcacggttattacttgatgcggctattcttgaagattgtggcgggcatcgccggccggcggccatggcggtctgatagtcacatcgctggggagggacccaacaggaatagcgggaaactcaaggggctccaccggaaaactcatccgaattggtaatttggtatggatcgggcgatgccgtcgctagcaatggtagcgacccaacacggatgggacaagacacggcccatcgttgtttgcggacggcaaggggggaggcgcgccatgttattgggctcgtattcggacactaatacgaaggaaaagtacaccgaaggtccctcaacttgttgtcgagttacaaaatcatcccccaaccgcaaaaccagatatccgacgcccttaactaatcaaaaccggtgacaataagtctttcagtagttttaaccccggttttatcccacatgtcggaatgccacgtcatctctctcccctgttctcttcctctctctccgcctgttgagcgcgagcgtgaggctctccagtactgagctgcaggcgagcaaaagtgggggaagacgtcggcgccgcgggggaagcaaccgctcctggagcaccttgagggaggatggtagctcgacggcctcaagctcaccggcagagtcggaggagagcggcacctccgtactccgatggcggcgcggccgccttcgaggaaactgccacataagcgccacgtagtatgccacataattgaggagactgcacactgaaactagcccatacgactctttgtgggccgaaactgcccagttacgcagcccatgccgtcgagctgtcggcaaattgaaaacagttttgctagcattgaaaactataataaatttgtagtggcaaatttagacttttcctcagcggtcaagcgggcccacatgcagtgacggagagctcgtattagtggcctccctcaatctctgtgttcacgcatgacagccgcatcagttgccgcgctccaacgtatataaaaccatcacggatcgttcaagttgtacagcaccgtcatcgtggatggcaacgcgcgtcgaggacgaggaggaggcggcggcggaggagagagcgcccgccgcggcgttgctccgccggatcatggcgcccatcgcatggagggcggcgcccacggcggcgtcggcgtcgtcgtcgtcgtacctggtcgccgccgaggccggcggggtggagaagatatccatgctgtccggatacgagcgacttccgagcgtgtatggcacggcgttccacgacgacgacggcggcggcgcgtggtcgtcgtcgtcgtcgccgccggcgtgccctccccgcgcggccaggctgctctggggggcgctcacccgcgccgtccagaggcctgggaggtgcaggtgccccggagacgaggaggcgggggtgacgacgaccaaggagcggaggcggtcgtcgtcgtcgtcgtggcggccggaccccgacaggcggtggccggtgcagggctggagctagccgtatttgaatgtatttcttggggaaatttgaatgtattttctgttggtttgatgactgttcaacgaaattcagttgcaaatatgaacataaattacgtcgcaaccgagactgtggttagaccggaacagaggccgaatctacattctgttcgagcccatctcttccatttggaagcccatttcagaggattgatctgctcaagcaaattgcgcgggtagatttctgcagctcgatcagcgaaatgcttcccatctactcgtcccgtgaatcttaccacgcaagttggcatgtgtacatgtaaatgttcagatgctatgctttaccttgtgacaaagaccactgctactcctgcgcaatagcgcaagcttcgctttgaggcgtgagttacagacttacagtaatacagtgcacatcgagagcaagtgttgccatctcaaagagaaataaaaggaggtgtttacacttcacagtgtcaggtaaggtatatctcaatcagaacattgctatgcttttcattttcttagctacaatctccctgttcttttccgagtgttactacatgataagaatatgcagctaatagcaaagttacaaaaagaaagaaaagttacaagcttcaattttgtactacctacagtaagcagagacctgtacatcatgaattgattatatgagtgttagtactaatcaaatgacactgccaaaatgtactgacacccacagtcacaagcttgagtattctatagt

SEQ ID NO: 57073 - DNA, 1713 bp, Oryza sativa
ccccacgcattcctcccacccgcggcgctccctgatctggtcaagcccaccagaatccgctctccagagttggtgggggcggagggggaagggaggggcggcggatgcagacggaggcgagagtggggatggccgccgcaacgatggacagcggcgccgccgccgcggccgctcggaggtactcgacgcagcagcagcagcagcagccgccgccgccgcagctgcaccaccaccagccgcagctcgggacggtgccccacctccttgccggcggcgtcgcgggcgccgtcagcaagacttgtaccgcgcctctcgcccgcctcactattctattccaggttcgtcttagctgctgaccgggtagtttaacttcttctgagcatgtgtagacaactatgaatccatgcgatatttgggtttgtataactaagaaaaggtgagacatttgtttctactatttagctgagctgcgaggactaatcctgcttcagataggtggaataagggggaatatttttggcattttgttttcccgagcaactattaagtattttgcacaacttaactgtgaagagaaaactcaacgcacaagatcttttgttgagaaatcttgatctggtttgatgtgtgaaacgaggcacaaactcatttctttttctttataagcaatgaaagcacatttcttacaatattttacttaaaatactgtggctgttaatccaatttatgtattctatgtgcaggtgcaaggaatgcattcagatgtggctaccatgcggaagactagcatatggcgtgaggcatcccgcattgtctacgaagaaggcttccgagcattctggaaaggaaatcttgtaactattgcacaccggttaccttactcctcaattagcttttacacatatgagaggtacaagaacgtaagtacagatttcttcagatgaacttgcatgctcattctctatcacaattattatatggctaatttcttaattaaatttggactgtgcagctgctacaaatgatacctggtcttgacaggaatggtggatttggtgcagatgttggtgttagattgataggtggtggtttgtctggaataacagcagcttcgatgacatatcccttggacttagtacggactcgtcttgctgctcaggtaagcctattgtcaccagtctgcatatcactggcttcctgtgttgattctcatccacttgaaaagccactatttgaaaaagtttccctgcaattagaccaaacaacatctatttccatgtgaaggacatagataactcaaaatcccctgttgattcccttctttatcagtttcacgttcagggtagaaggcatattgcatttatgctctctgctttgggcattattgaactgtaggcctttttccattgaagctttgcatttttaatatgtaatcttcactaataatgaagccttttcatcaaatgtttgcagacgaacactgcttactacaggggcatatctcatgctctttacgccatctgcagagacgagggtgtcaaggggctctacaagggccttggtgccactttgctggtaagaatgttcgacactgccattctctcccatctttttgagcattctacctttcgttatccaattgatatttatctaaaatacagggagtaggtcccagcatagcaataagcttgcatgcctgcaggtcaactctaa

SEQ ID NO: 57074 - DNA, 19742 bp, Oryza sativa
ttaatgtacagatctgtcctggatagctatgcaaatcaacatggtgaagttgcacctactgaactagaatggcagaaagttgaatcaatttgtgcttttcttaaagcttttgaagaagccacattatcagcgttagcagataggaaaccaacatcacgtaggttcttgcccttggtgctacaaattcgtcatgcattgaatgaccctgattggcagactagtgatattttaaaggtattggctgcagctatgctctcaaagtttgtcaaatattgggacagtgggtttaactctgcacttgtcattgccacaatgttagatccaagaagaaaaggagattatttgaatttcttttatgagaaaacatctaacagtgtgacagagattgtcgaaaaagtgggttctgctgaagattggttgaaggattattatgaaaaatacgaagggtttgtaagaagaaatgatgaacacatgctttcacattctcgtgaaggcagcagcagtgttggatcacctgttcttgggaaaagaaaactcgaggaagagtttgctttatacaagtctcgaaggaggactgcacggcaaacgaaatcagaatttgccatatatttagaagaagatgttgaggaggatagtgagagtttcgatgttttggactagtggaagagacatgctaaaaaattcccggtattgtcatctatggccggagatttcctagaaatacccctcagcactgtatcttccgaatcagcattcagttgtgggggcaggatacttggtgacacacgaagttcgttaacacctgaaatgcttgaagctctcatttgtgcgaaagattggttaattaaagccaacgatcctttgatcaatattccaggtgctgaaggtataatagtgataaatgattcctccataaatgttctgtgtatttcaatcatgaagtagtgatcataaatccacccgtggattgtgttgaatttggactgagcaactttgtgggttgggttgggtggggttagctcaaggaattcttggtctggattggagtgacaattttgctatagtcactttgggttgggttaacccattggcaggcttagagccaagccaggcggaacattgcgaagcgctctggagtcgggtgaagctgttgagtccaagattgcgatcggcctatggaacagatgacaaaggccaccctaaaatgccttccgagaaaggactgtcccagtaggcgacctatacataacccactaaaaataaaaaatatatctgtaaatatttctatcaaagggattgaaatataaaagcctatgtaagccaaaccctaggattagctgtttgagctataaatttataaatatcccaaaaaaaaaacactgtaagacattggaaaaaataatacatatcttgctgttccttcatcccaacaattactactattattatcaatcatctaaaacccgtaacggcacactttcgtccatgactgatgctgatgaagttctccgtaatgatatgtcatggagttgtttgtttctaactatcaacacgctacacgcagtggcggagctaccacagggtctctggggtctcgagaacccactaccgtactataaccatgggagatcccatgaaaaccccactaaaattttctgtcatacatctattagaagagggggctataattttatatagtttgttcaaaccctccagttaatcttttctggatccatccctggctacacgtggttgtcatgttaggttgtgtggcttgcgaactgtgttttcctcgtgtctcctttggaatggagggaaattaaagcatttgagttcgtatgggttacttatttgaattctaagttcaaaccggtacttcatgcgagaatcacgtcaggaatatgaaaggctcaaagaggggaaaaaaacatgcagcacgaaccgaggcccaccggaccgggcacatgcgcggccactggcaggcgggggctaccgctggctgcgggggctgcgggccagagtctaggctggactggccggacgggaatcgcctccccgtctcgcacctggcaatcagcatcggccggcgaccacacacacgagtacacgacacatccgatccccatccgtcctccgtacgtgccaatgaaatattcggccggtggggcggaggcacgctgtctgcagccagacgcagaccaccggcgagtgcgatccgagtggccgagcccgagagaaaaaccacggccacaccaaacccgccgtgcgggggaagaaaaaaagcacaatattctccctctcggcctctcctcgccgtagtgccccctcggacctcggttgattttttggttcgcgcacgtcaccaccgagagtccaccaccgcggcgcacgggaggaggcccgattcgattccactcgcccgttcgttcgctcgtcctatttttttcttccccccaccacggcaattttttctctcccacggccgccacgccactgccagtcaacagctgcacctgggctcctcctctcctcgtcgccgtcaccgtcgcgcgccgtcgtgttggtggtggtggtggtgtgcgggcgggcgggcgccgctcgcgtccccgtgacgctgcttcccagcgccgctgcctccgccttccacgccgcgtgggcgcgaaggcggggcttgggagttggaggaggaaggatagggggcacggcacgggtggcagtagtgcaaggcaagcaggtccccgtgtataattcgggcggcggcggcggcgggttggatcggggaatcggcgacgcgggccagaggaggaggaggatggggcagcaggcggcggaggcgcagccgctactgctgcagggggaccaggtggacgccgagtggggctgcaggccgcaccgcattgtacttttcgtcgagccgtcgcccttcgcgtcagtgctctctctcctcgtagtcctactagtcagatcatcgtactagcttagatcagatcgagatgtcaaacctgccgctctttcgatctattgaactgcaaagtcaatagtttttgctcgttgctgtttcgcagttacatctctgggtacaagaatcgcttccagaacttcatcaagcatctgcgagagatgggcgatgaggtatatgatctttttacttcatctggctgctggctgcttgtgtgtgtagggcgtgtatataccttggaattgacgtgtgctctttcgaaacagatgttggtggtgaccacgcacaagggagctcccgaggagttccatggagctaaagtcattggttcgtggaggtaatccaatacaaactagaaactacttttaccttccatttagcattcggtctacctgaggagcaccaaacacagaatacaagaattactttcctgaaagcacaaaacttgctctcactgcgaaatagggccttactcgcatgctgaagcaaaaggaaacaatgcaagcgaagtgtcatctagtcaactagcatgctgatttggaacatgtgcttgttgtgaggtgaaattggtgatgttgcacttgttttccaatattttgtctggtcaagtcgtcaagtatatatattttagaggacactagaattcttcttgttgaaatttcttctatctgcatgcacttaattgcctaaatttctatttctcagttttccatgtccgttataccaaaatgttccactctcgctggcgttgagccctaggatattttcggcggtggctaaatttaagccggacataatccatgctacttcacctggagttatggtaatcattaaaaacccaataggtatcattgtcctttctttttgtagtttctcactatatattgtgatttcaggtttttggtgctcgctttatcgcaaagatgctttcagtcccaatggtgatgtcatatcatacccaccttccagcgtgagtttctcttcttaaaatcatgaatacttctgcgatatgagtcctgcatgcataatattgttacgagcagatcttacagcctctaaattagggaccagatatagtactgtagggcaagaccatcatagtccagtgatttccctggcagagatatttactttcgaaattttgggaaaaaaaaacacattactatgtcatgctattggaggattaaaaaaaaacttggatgcatatgcatggaatcaacaggcaaaagtgttgcctccccaatgttgattaaagcatccaaccgaggcacatcattacaacactaattctttctgttgcaaattataatacctggtgttgattcttgagctgaattcttgtcatgactttcaggtatataccaagatacaatttaaattggttacttggacccacatggagtcttataagtaagcataacatcacctctcagtttgttcttcataaaagaaataatctgacagcaaaaatacaactgttctttctcattaaatttgtactgacactcttattttgttttgaaggatgtcttcataggtctgcagatcttactctagttccgtcagtagctattgccgaggactttgaaactgcgaaagtagtatcaggttaaacaattaagataaatctatatttcttcatttcattccttcatccatcataaccgtagtttccttgtctcttcagcaaatagagttcggctttggaacaaaggtgttgattctgaaagtttccatcctaaatttcggaagcatgaaatgcgcattaaattgaggtttgacctatttctttaatattcaatagcagtatgtgaaaaaaaattgtgcatagctaacttattttcctttttctctcttgttagtggtggtgaaccagaaaaaccactcataatacatgtgggtcgtttcgggcgtgaaaagaatttggattttctgaaaaggtaatctttttggcttgtacatatcactgtttgtcagtgtaaaatcaactccaaacaaaatttgaagaatatagatgggggaaaaatggaaagagaaagctcctcaactaacaatggattatttcatagtacatccgtcccaaaatataacaacctagaaccgaatgtgatatttcctagtactatgaatctggacaactacagtgaaaacatctgtggcatgttgttttctctggcatggccattttcattagttgtccctgagttagcataacttgcaatcgtcttagccttttagcttgaatcatgcttgtaatatgacttacatggtcctgtttatgactttaaccaagcagccatttcaaattcgtcacatgtatcatagatcacttatctgtatgtcacatgttcactacatggttgttattttgtcatgtcatcagaactttgcttattttggtgacaatacagggttatggaaaggctcccaggagtaagaattgcttttgttggtgacggaccatacaggtgcattccttaatgttaaatatttttcgttatcaacaagactcatacatgataacatatatattgaaatgacactatttggagcacttcagttttatcttttgcgtatgactggtattatatgcacaactgtaggtgcctagccatctgtttgatccctatagtttcatcttgaatttggagaaacttatgcggcctgtttaatctttggcagggctgagctggaaagaatgtttactggcatgcctgcagtattcactggaatgctccaaggcgaggagctctcacaagcatatgccagtggcgacttgtttgcaatgccttcagaatctgagacacttggtcaagtagtgctggagtccatggcttctggagtcccagttgtcgctgctcgtgctggaggtatacctgatataatacccaaggacaaggagggtaaaaccagtttcttgtttacacccggggatctcgacgagtgtgtgaggaagatcgaacagctcctttcgtcgaaggttctaagagaatccattggaagggctgctagggaggagatggagaagtgtgactggagagcagcctcgaagacaatacgcaatgagcactactgtaccgcaacgttgtactggaggaagaaaatgggcagaactaactaggtttcgcttatcgattcaggaatcgttcaccgccgtctccacctagttactgttaataccaaagagtttgtacattgtatccaacagcagctcgcgagtttgtgcggctagctgcattcatgtgttcacaaatcacaatcatgggatggccactgaccaaaagcttgtatgcgagtcatgtacattagacagctctttgagattggcgattactatcgaagtgctaactgctaatttagaatactggaggagttgcctgctgtagtgctgtctctagagtgaaagttgaattgtgtgttgttactgtgagctgctactgccaactttctgcctttctggtagctttgctacatttgcgttttgaacattgccatagcgtaaaacctcgagactacggctgtgttcagatccaaactttggatctaaactttcaactttttccatcacatcaaccttacatacacacaacttttcagttacatcgtaccaatttcaacccaaactttcaactttggaaggaactaaacacagcctactgcattttttcatgccgactgcgagcttggcagagtgttgagtctgttccaccagcagaagtgtgatctgtaaccctgtatcggccggcagttaagctgcaggtctaaacagcacatttcacgcatacctatcttatcataatatttatgtatacaggaatattattaacttatataagcacaaaagcgaagatgaagtcaaacagcaagaaatacgtcctgatgtaaatatgtactacttattgtccaactccaccaaaggctgcagtacttaaaaacaaagctacaacttaggaagaaagggtcaaacagcaagaaatacgtcctgttgtaaaaatgtaatgtccaactccgacaaaaggctgcagaacttaaaaacaaagctacaactttatacttcacaagatgaatcaacaaattgaatgagcgcggaaaaatgtggacttaatatggttttccacagaacatatacaactattgcagcaaaactaacactacttaaaacaaagctacaactttccattttacaagatgaatcaacaaattgtatgagtgccccaaaatgcggacttaatgtggttttccacataacatatacaactattgcagcaaaactacactatctctatcaacacaatcccctccgccccaaaaaaaaaggtgatatccatgcaaacagcacaagcaacatgttttcattgacaattgattaacaccacaatattactccctccgccaagaaaaaaggtggttttcatgcactatggcataagaaacatgtaattgtgcacagtcgatgtctcagcaagcaggttttctgtctctgctcattacttgtttgcatttgacttgctgaacaattaaacagaaaggccatggaccgtgacagtagtagaaaatcatcagctgtacgtttggagaattggaccttccatgtactgaatggccctatccattatgctcaccaacaaaatggtaagttttcagaggaattgcagctgcagatgcatctcactacaaaatcagtcctgaagtatgtacgggtaacaacaagtaacaactgcaagtcacatatgagaagcttcaagctattgctgtagacttttggcatttgaagcagcattgttattcatcttgcagcactatcatgacttctccaccttgactgagaatgctgtctagaaatgcaataagtttttctttgtcctgaaactccttgggtgcagaaaaatcactatccaaattaaaccaagtgccattaatgcttcgaattgccacccaatgccggccagtccaaagccctctgaacctcctgacgggtacattgatcatcagaccaaacaatgcatctgcatccagatcgattgaagaagcccctttccgatgatcatgccagattaccttcttctttctagcttctaatgctgtgatgagtacatttacatcatagttcccggtgaatacgttgtggtggggcttaaaaatcaatgacataggagtccagtgctccttatttggatcaatctggacgagatttccagcaatcccatctaactcagctcgggtgaaagattccttttcctgaaccatacaaagcataattgacagttaaaaatcggtacacccatgctgtttctggtaggatcacactaccttttctgatttggtcataaacggttaagcaggcaggaattgaaaaacacttgtttgtaatgctcatgcaatcatatagactccttgcttgcaagtacaaaattactctcagattcacataagcagcaatttcacatgtcgtgaagaaaatcaacaggacataaagatttatctctactaagctatcagctgaaattcatgattgacgagagctttaattatgattgaacaaaagcgtgctagacgaatgtgaaatagatataaatgtgatgcgcggttgatgaattcatggaaaacattgtccaatccgccgaaccgttccaacaaataacactgagagtgaccgacttaagtatgctgtagctttcagatgcgaaagaacactattccagttttcctgcgtccaatatcgtgagatatttcaccagcacacaagttttgatgacatcgattcacatggaaaaaaaaatgcacatcatggacaacagaattggagtacaacgttcaactgctaacaatttcctcactaatatcgattagtgacataagccacgcaaaataaggaaatcatacgaaaaaggaacggaagttatgtgaaactctcgagagaaaaaaaagtagagacggtagatagaacttcttttgtttagaacacaacaggataacaccggaggggagagagacgacagacgagctacctgcataaggttgttgagggcgtggaggagacagaactgcagccgttgcctctcgtgatacaccttgctgcttctgctgctgccgccgccgccgcccatcgcactcgatccctcctcgtcttgttttgcttccgatttgggccccgattccatgcggagatggtgcagggaggagaaggagggttcgggttcgaaggaaagattacagcggcccaagattccccctctttcttctcgccgccgcccgacggccgccgcgccgctacccccggcaggaacttctgggtcgtccttcccttctttaccaaacgcaacagcacacaggacaggagattcaccgagtcccggactcaggacacgtcgcgtgttgtggtcattgctatttcgcgaatacaatttcgaaaagaattctctccatctcgcttcctataacttttttgctaccgaaaacttatatactaccggtcactgaaattaggaaaaacttcagccgacaaaactataacattgcaaaatcacgagttaaaaacacatgttgaaaaatattatcttatgtgtcattgatacatctgtttagacttcacatattatgatactttactactcgcttatttttatgatggcaatttttaaaaaatttctcaattagaaactccaattagaattgctgaaacaacatcacttttacagctttaccctcttttctagggtagggaactgtttacactaaaattgtctgtgctctaaatattcgtagtttcaaaagtaaacatatataataaagaactctaggtttttaaccataccagcaacctcaaattctcgcttcatcgcataagcatgggtttggttaaatgattggaatcggttgggtcgggataaacctattttttagggtgtttgatttggatgtaagtgagatggaatgttccttgaaaataaatattccccctaaattcgaattagcactatacttagagcatctccaacagatgcctaaacaggtcccaaaaattaaattttaggattttagttcaaaggaaagctccaacagctgcccaaacttgctcccaaaaatcccccacgcccaatccagtcccaaaaccgagtcagatttggggcagccctgggcgttcccaatcgcagcgatcacacgtagatttctttgctcgcgccaatttcttcctcctccctcctctcctcgccgtgccctgctgccgtcgctcagtcccctctcctagctcgcatcagatgccgccaccctgccggtatcgggctttctccgttccattcgtctctgtccagaccggcacctccatccacgccgtcgtggccgttgtcgtccacgccgctagggccatctgtctgcatactatcggcaggtcatcctgatccacccgccgatctgtaagctgctcaagccctagtactgaatgaacctaacggcctgtttggttggagggagtttttaggagggattgggagtttagagggatgaggctattaagagttttgtttggttgggagacatgagaattttggtaggatggagatagggaattgaggaaggaactcccttcttttcaatacctgggtaggggcaggtaattgggagggaattcctcctttactttttctaagcaaatctcagccatccctttttattaatgacataatctccaactaaactccttatcaatttccatcacctctaccaaacaagatattaggattaaaaatcaaattcccatcttaatctcatcatcaattccctcgtgtaaactcccaatccccttccctcgagttaccaaacaagccgtaaagaaagttttgacgatgtgtatcgttgtactttttctagagcaaattgaatctgaatattgtttggtggatgtctatttgctattttgcttgcacacaatgacaaatatggtgttaagttttggttgattgagaaatcattattttgaggttaaattgtcggatgagggcaacactgcacttggttttcagtttgctcaatgtttttcaatttgcaacactacactgcactgcctgtcatgaagcaattgcatactgaagcttcaagagattctgcaagctatcaagtctttgatgctgaataatttggcgttggtagtactgacattgctgaactgaataatctggtttagaatgtagtctgaaaatctaaaccatattatgcgtgtggtacagtcaaaatttcagtaaataataatatgtttatgcctttttacataactcaggaaaaggagagggcatgacctagccttattcttgtgatgatttgtgacaccaaatcagggaaggagagggctagaaatggtaatgtttgttggcaatcataattggacttcagaaattcaatgtatttgttaggaattcacctagatatattcacgggtattatgaattcaagggatttgttttgtagcgatttcagggatccctgtttatggttatactttttttagataatggaagctttattaatctcaataaaactctatcaagtgatacaattattctgagagcacctccggcttctgcacccaaagagtgcacacaaccaacaagaaagaaacaaaagataaactcatcatccaaatagcatggacaaaaagaacttcaggagccctctaaccgtagcctagaacaccacccatgcgccggagtagaaaactccatggccactagctccaattgttgacaagccgcaatgatagtaccccgcaaattgaccttctgaaggatagcccatgagcggagccaatgtgtaataaaaaagataacctgcaaaggagaagatatgttttttctttcaaaaaccacatcatttctgcaaagccaaatagaccaaatagtggtagttgcccctaataagaccaaagatctcaaattgcgtggttgtcttcttatccaatgcccaaacatatgagttgtactattaggtaaactaatattcgaagcaaactggattaaagaccaaactgcgcgggcaaaacgacaatcaaagaacaaatgattaatagtttcatctttgtggcagaaagaacaagacttgtttcctctccaattccttttaataagattatcttttgttaagactactccatgacgtaagtaccataagaagatcttaatctttaggggggctttgatcatccagattcttttgtttatattgggaacatcggtctgcaccaacgaaagataaagagatttaaccaagattctgtcatcagtggttagattccatttaaactcatcttggtcatgagataatataatattagcgatgcgtgagagaaggtgattctacgccactaacttagagcgagtaaggtccctgcgccaagaaagtttatggttatactatgtcctcattttcaatttcaagtaaagcttgtaagcatttgccaattatagtcatcccaagatccatgattgttggagagctcagtttcagcacatatgtttcgtcaaaccagaactttgtcatagtgtaatctttacttgacctagatccccgatatagtgtcataatgcaaggcttactagctgctggcaccctcaccgtgccgcaggctggccgcgcattgcccgggctaccggctcccagctgcaatgccccgatcgcctaaccgtcatgtctctatggtgattgcctgctagcctgctaacgactactccctccgtcccaaaaaaaggcaaatcgtgggttcccgtgccaacgtttgactgtccgtcttatatgaaatttttttataattagtattttcattgttgttagatgataaaacatgattaacactttatgcgtgacttatctttttaatttttttataattttttcaaataagatggacggtcaaacgttggacacggaaatcagggtttgtctttttttgggacggagggagtatgtggccgcgatcggcctgccatgccctgatcttgccaacgatcagcctagtagcgacatactccctccgttttttaatagatgacgccgttgactttttctcacatgttttactattcgtcttatttaaaaaatttatgcaaatgtataagatataaatcacacttaaagtactatgagtgataaaacaactcataacaaaataaattataattatgtaaattttttgaataagacgaatgatcaaacatgtgagaaaaagtcaacgatgtcatctattaaaaaatggaggtagtacaagagaaaccagattgctagaaatagttgaagaggacccaccagcgatgatgtggcataattcaatgcttttgggaactaaaaatagggaagctcgtggacaagggggtgatttttgggctcaaattattttgggatgaccccaatctgagatttttgggagttaaattttaggcatctattggaaatgctcttaacaactagtggaccaattcaacccacttcctctcattgattgtggaccacaccctccgattccttaaaaaaaaatcatcacatccctcacgccaaaatacatacaaatggtccctttgaatcacatgagtggaaaacggaggaataggaaaaacataggattataacagaaatgcaaatgtaaaataaatgattacaaaacacaataaaaacatgtgaatgaccgtttgattgatccacaagaaaaatacatgaatttgaggagagacaaaaactcaaaggaatttttccatgaagttctacctcatgttaaactttctcaaaaacttatatgagaagaaacattccataggaatttcattggatctcatggggtattcaaagagcgaaatcctctaaaatttctataaattccctttgaatcaaatggagccatcccattccaaaacaagggatggacctaagtacctaacatatcccacctcatgccaaatcaaatacatgagtgttgttttgaacacaatctaagatgagaatttgttttcgccgctcattgaaatcatatctattgcgccatcgacaattttgagatcctcccgtttgtcattacttagttggcgctctactgctcatccctatttatcttctgtcattcctctctatcaatagtgcttggtcaacaaatttgccccgaaagacgattaaataaattttatagtgggagaaaacacatgttttttttaaaaaaaaacttcaaaaaaaaatcagcattacaattgtcataagaatgggaaaacctgcaacgtcccaaacaaggccttgcaaaggatcataaggtcttcccagcgctgatgactgatgagtgatgagaacgatgggcgatccaacgagaaatcaagggcagcagcatattccaagggttcgacttaccgccggtaaccgcgtgtttaccgtgattaccggctttatcgcgggggtacggtaatataaataccgcggtaacctccttaaattcaaataaatttaaaaaataatttgaatttttgataaattttgcaccatttcgtacggttttttgcggtaaccgtgcttactgccggggcacggtaaccccgcccccggcggtttgggaaacctgggggcggtttgggaaacctgattccaactcgcaggaactcaagtatactcaacgcagcagtacagcgcgagaaaaccatgttaacagtaaatctatttatacatcgctgtccagtcttctcctatgaagtgtacagactgcgccatctccacaacacgccaagccgtgagatattctgcaatatccctctgttcccttttcatctgaactaaaaacctgaagggaaaaaaaaaaggcccactgtttcacggttgaagaactcgtcgatttaattttgtcaaatctaatctttaaattttaactattcgtgtaggagtaccctccatctctgtcgaattaaaccgtgtttttaacgtaagacgaccaatttaaaaagagtcgaagtggtctgaagtctgaactctgaattttgttgggggaagaaccgaagaggcagtgccgtaaaggcaaaagaaacaagaaacacggcccgagtctagtcgaccacgccccgcgtccgtcttcccccccaaaacttcagcaaaagcaaacgaagtcttctcagattaattctcgcgtcgtgtcagaccacgctgccgcgggggatctgccgggtggcgaggctgcggagatgtcggacgcgctgatcaacggcgtcgccggcgccggcggcgggatcatcgcccagctcctcacctacccgctccaaaccgtacgcgccacctctcctccatccttggattgctagattgtttgggtcaattgcttggttgtttaataacggagggtttgggggtgggtgcgcaggtgaacgcgcggcagcagacggagcgcgacccctccaagccggcgttcaaggacggcgccgtccgccagatgtgcctggtgcttctcctcctcctcctccccaaattcccttctcgtgttcatgcgagctgacgagcaatctaacccgacccgagtctaatgctaccgcgatctctttgttcttctgttcttctgtggtaggtggtgaagcatgaagggtgggagcggctgtacggcggcctcatgccctcgcttgttggcactgcggcctcccaggttgctttcgttttgctgatcgattttcaccagcttccctgccttgttggaggattagctgtaccagcttctgaatcgaatcattgtgtctgtagggtgtctactattacttctaccagatattccggagcagggcggaggccgcggctctccagcgatccaggagaggaatcggcgatggatccgtcgggatgctccaatccctcactgtcgctgcgctttctgggtaatcctattttgcttgtgcgtctgccattggcttatgctgttatgcattgtgttgtctttttctcggtatgatagttgtaagctcattcttgttcttaatggtttacttatgatgaacaaccttcggtgctgttgttttgtttgcgcagatgtgttaatgtacttctcacaaacccaatttgggtaattgttacacgaatgcaagtaagtaatgcacattattgcagtattatttcccaactgactacttttagtgtaataagaaattcagtggcacatcctgaagtataattcattcttgtctgcagactcaccggaaggcaaacaaacagcagagtcctctggatttgacgtgtgttcttgacaaggccctacaagctcccgctgttgaaaacatacctcacaagactatccatgttgtatgtaactttgatcatttctctttcaggatgagatactctattcttgcaattacatgctgctgattactggatccaagactaacagctgttcttatatggaaaaaaggcctcatttagtttttcctaggcctcatcccagttcctaaactgttagctcagctttttttttttgtccctaaactgcggataaaacccatccttcatctctgaaaaccaagtaaaacttgtcctcctaagtacttcatatagtcaatatgcaagtgctaatgattcagactttgtttggggcatggttgattgactccgtttggctgcagattcaggacctttacaaagaagctggatttttgggcttctggaaaggtgtagttccagctcttattatggtaagtcttatgtcgcattttcttttgctaagttatttcttttttacaagttattgtttccatgtttcatctgtcatcaggttagcaaccctgcaatccaattcatgttgtacgagactcttttgaagaagttgaaaaagagacgtgcctctaatttgaagggagctgatggactgactgctcttgaagtaagcttttggcttttggcttttctggtgactgggatcattgtacagatttattaggatataaccaatttgcatcatgctaacttgctgcattggggcctgaatctacccgtaacgctgacttgaaagtttgttcttctagtaacgatgtttcatgtccagtaattatatgttgcatgtcttaacttcatttaccatgatgatttgctgaaaacactagtatttcttatatgctcctaatactactatttctttgttagttagctatgttatagaccgtcttcatctcacgctgtaaaatccttgttcagattttccttcttggtgctgttgccaaactgggtgcgactgttgttacatatcctcttctagttgtgaaggtgattatttgaacaccagttacagcagcagccgtttctgtgcacaattgagcagacatgtcaagttaaaccatgttttttttttctacaggcaagacttcaggtgaagcaaataattgatgatgacaagaggcaccgctacaaaggtacatcgctggcctttattctttaaacttcattttattatttagagtgaattattatttaatgagtgatgttgctccatatcctgtttctgatagtctttacttctcttctggtaataatatttgctgttctctgactttgttaccaaatacgctatgcaaattttattgcttgcaggcacatttgatgcgatcacaaagatgatacgttatgaaggtttgtcagggctttataaaggaatgagcacaaaaatcgtacaaagtgtttttgcttctgctctcctttttatgattaaggaggaactggtgaagggcgctcgattattggtaaccggcaacaccagccttgttaagaagttaccatcgaagccattaagatgatctaggttgtacaagagttagttccctacttataccacaattgtttccataaagcgatggacagagttgccaagcgcccctgttaggagatatcaagttatctgtgagactctgatcgactgtaggctctccaaaaaaaggagattaaagatgtagtacaattaccactgtgattcttgtaggaaccaataatgatggtatatattgggtaggctatctctgttgctcgtgtaaagtatactgttatggaagattgaaacactagaaaataagttggcaatgagaatcgcaagcgctagtcatctgttcagattacttgagtttctttagcttgtttgttagagctaaccgagaagaggatcgcaatcgtgaaaacttcgcaagtgttcagaacaaaagtagaagtagaaaatttggagttcctgtccatttttagcataactgtgtctatggtgcgccccatctgtcaatgtggttctcaggcaactgttctgatacacaagtgctaatgagcaatctgacccgacaaaaaggaaatgaaatttaatttgattatttcaaactcattttggtgaaactaagcctccttctttactaagatgcaaattcttcctaacacattttttaaactgctaaatggtatgtttcatatgaattttttacataaaaatattttaaaatatcaaataaatcaatttcaagtttaaaataatcaaaacttaattaaacataagctaatgggccgttttcattttgctttcctattttatttcatctttattagaaaaaaaacaccatctaatagactaatactgcctcgagggtttttctttaacaatatctaagtttttttaatgaagagatgcttcttctaaaatccaaacacatagtagtgtgtgtatcttactggtctggcgcgaccgactaagctgacactcgcgagagtgtggccggtccggtcgggtgggggtggataaggagatagagaagcggccgctccgcagctgcagcggcaaagcctccccgtcgtccagcccacgcagcgcaccgcagcgagcgaagccgccgcaatggccgcctcctccgtggcctcgactctcctcctctcgctctcctcttcctcctcgcccttcctctcccccacctcggtctccttcctcccatccgccgccgccgccgcctcctcctccccgcgcgtcgccgtcgccgccggcaagcagaaggcggctatctccgtcctccgcgcccttcgcgccgaggcggccaccctcccggttctctccttcaccggggagaaggtcggggaggtcgccctcgacctcaagtcggcgccgccctccaccgcgcgcgccgtcgtgcaccgcgccatcatcaccgaccgccagaacaagcgccgcggcacggcctccacgctcacccgcggcgaggtcaggggaggcggcaggaagccctaccagcagaagaagacggggaaggcgcggcgcgggtcgatgcgcacgccgctccgccccggcggcggcgtcatattcgggcccaagccccgcgactggtccatcaagatcaaccgcaaggagaagcgcctcgccatctccaccgcgctcgccagtgccgccgtggccgacgatgcattcgtcgtggaggagttcgacgaggagttcgccgcgggtcccaagaccagggacttcgtggccgcgcttcagcggtgggggctcgaccccaaggagaaggccatgttcttcgccacggattttgcagacaatgtgcggctcagcggaaggaacattggctccctcaagatgctaacccccaggactctcaacctatacgacatcctcgatgcccgcaagctcttcttcaccccggccgccattaactatctcaactccaggtatggtgccaccgtttttgatgaatatgaggatgataccaatggccaggatgatggtgaggaggaagcagaggagttgcaagaaggagaagggagcgcagaggaggctgctcaaggt

SEQ ID NO: 57075 - DNA, 3637 bp, Oryza sativa
taaaaaataagaagaaatgagactgcatggaatccatgaacacccctgaaccagaactctggggatactggtacactccttataatagtgtcacaatctgctgtgccacacagctacccctatcacctatcacttgaaacattgtcagccattggcactgtcatcattcacttcaaagatgttctgttagaccttagaaccatcttaataaagtagttagctgtgaatatgctggtttaagttgctttagaggtaaaacctagttaaacacatgttttctccatcactcaagcacttccttttcgtaaatactatgcatagctacaggactaagttattattaattgacattcagttctctgttacattttggtgctgcatattataactttctcttattttgagcatttctcaggaacttctttttgtatgactttcagatgaggctgcagagactgaggctgatagcaattcctagggaaggaggtgtagatcgcgtgtttttcgtttgttggtctggtaattgcttccctgatgcagaagctttttggcttacttttgttgtaagtttataatgtttttttttcactgatgcagtatattagatcttcaaactgcacatatattttcaaatacaatgtcgtgtcaaccactgcatatttttcttccaattttatacagaaagtgcttcccaatcttgcttcaaaaaaccagtgttgacctgctggttaccactaattttctactccctccgtttcatattataaatcattttgacttttttttcctagtcaaacttatttaattttgaccaaaatgatagaaaaaataataacatttttaacacaaaacaaacatgttatcaaaaatatattcaaagttacatttaataaaactagtttggtattataaatgttaccattttttttctatatacttagtcaaacgtacagaagtttgactccgaaaaaagtcaaaacgacttataatataaaatggagagagtaacatcttgagtaggggtatgattacaaaatcttgtctccttaaattgttgaattgttccttgttatgactaactttttcgctgggtgagctctaacaagtaacaactaacaagtcttttcagaggacttgctgcattttacaatgtggaaagtagcctagctcaacttggacatggagcactggagcagcatagcccgggttagatgctgatcttgaaactctaagcccagatcagtcgtaaacaacagaccattttgctcaggtttacttgtagatcacctgagggtttagtgaaccaaccctctgcttatgcctaaccataatgattccatcatttttctttcttacctgggtcatgcaagaagagttgttgggccatccttaagtccacccagacaactttggaccagatcatcacctttctaattgttctgacattgcactacaagtggattatgggcttatgggcaaagctgcgtctgtactttagaaaggtgcaagatctggtcttttgctatgtctagtattttatgtcatttttagctggtgctatcggtagaatttacttatagtttgctctgtcttactctgctttcaacaatatctaaagaaatcatttgtgagattgtgactgacataatagtgctgtatctatgaaccgaaaagggaagagtcttgcttaggttgagccagcttctttggcactatcttttaaactttttggtgggcaaaaagctatccatattatactagcccactatgcataaaaggcatacaaattatggggatggacctgagcacataatttcactctcttttttttttcttgagactggccattgattggttctagtttggaatattggatcgattgactataactgtttccgtccctacatgttaggtctgcattatgctccttggaaggaatcattagaaagaaaacttaccactacactaaatgtcactcaccgtattaagttctgtgcaaatatgcagcagaattctattgtgccactggctgctgttgtgcaactgaatttactgggtgggattcttaaactaaaaatataccagatcatctcagagtctccggaagtaacaggaaaaacggttgattcatccttcaggctactgttaggacacgaaaacaccagtggaagaaataagttagcatgatggtataaatcttagacattatcgtcgttgtcggttgcttttcggcgtgttggtctgatctccttcggagctcttttatcatccgtgtcgtaaagtttgcacacgtcgctgtcgattagtccatccacagctttgtggccaatgggccaagttactttgctccgattcatagtgctttgtggttgtttgacccaaaagctttacagtccatcttttcatttatatttatacttattagctaaaatttaaatttttaactttaaatttaaagttgatttaaaggtatttttatcgtagtttattttccagactttgcttttagatcgttaagaacacatctataaaagttgtattcacaaattaatttttgttacaaatatgtcgtttcttttttttcctccaatgtaccaaacgatgggtctattagtttatatgtcttttgactgttgtcgcatttccgtgaaattttcctcggaaaggcatctggtatggttggacccaggcctttatatcctatctcccaatcgaatgtgcatgcaacttatggctctgccgtctatacgtgttctgctcagctgctctccatgctctgcatttgtagtgtggaaaataagaatttagggccctttgaattataggaatgaaaaaatagaggaatagaaaaaacataggattctgacagaaatgtaagtgtaaaacagaggattgcaaaacacaggaataacgtaggaatgaccgtttgattggaccacaggaaaaacacagaaatttgaggagagataaagactcaaacgattttttccatgaggttctacctcttgttaaaattcctccaaaacttatatgggaagaggcattccataggaattttataggattccatagggttcatttctttaatttaaagggcttggtaggaaaaattactataggaacgaaatcctctaaaatttctatgaatttcctttgaatcaaagggtacaagtagtctatacgtgttctgctcagctgctctccatgctctgcatttgtagtgtggaaaataagaatttactaggtacaagtagtttgagggtaattgaaaaggatatatttagattgatatgattttaaaccatactattgaaagtggctatacattaaacaagcctgtagatctagatatatcgatttatacaactagaaatatctagttttacaaaatcttggatccgaaagtgtgttaaataagatgttaggaaattcataggaattttaggcccctttgaatcaaaggatttatatagaaatttcataggatttaaattctataggaaatttttcctatttggccctttgattcaaaggattgaagctttccaaatcctatgaaattcctatagaatggcacattgcatatggattttggaggaaatttagcaagagctccaacctcttggaaaatttcctt

SEQ ID NO: 57076 - DNA, 10568 bp, Oryza sativa
  unsure (1)..(10568): unsure at all n locations
tgaataaaaggaataatcctatggaatcctatgaaactcctatggaatgcctcctctaatgcaagtttcagaggaattttaacaagaggtagaacctcatggaagaaatcctttgagtctttatctctcctcaaattcctgcgtttttcctgtggtccaatcaaacggtcattcctatatttttcctgtgttttgcaatcctctgttttatacttacattcatgtcagaatcctatgtttttttctattatttcatttttttcattcctatgattcaaaggggcccttagtgaatcctatgttttttctattattttatttttttttattcctatgattcaaagggacccttattgacctagcgagacaacgtatggttctgtaaaataaaaactgtaaacacacagcatgagcagccgagcagggagcggtgtagtgggccaaggcagccaccgtttcttcccatttccccccaagacaaaccaaatgaatcgctagttgctatgcctattagcgatgtctgttatctttatgtctttcgattgactctaattttgatctttgagcaaaagggcatttagctgagtagttacaaagagtctcagtacatcttaggtccagagtttgattttttgtgggagcgaattttccaacatttaacggctttgtgcttttaatggtagacgacgtatctctaggatggatttgccgacccagtcttcgaagatgcttataggggtagggtctgcatgcgtgcgttcatagtggtgtgagtgtgcgtgtgttgtgaatgtctgcgttgtaatatgtaatcgggtagctaagggtcttattccaccatgggtgacatagttacattagaattgctagctaaaaaatcttcgtggttagtcaataataaatgagagttgaggatttgtcccatctttatttcttattctgacttatttttatctttactattttttcaacaaacttataattgtgcgtctcatgacagaagccaaagatacaatccatttttattacctaaaaattagtgataccctaattcaatcaagaccgaaggatcccaaggctcccagctgcccattccagatggacggcacggatgtacgctgatgacatctgcgctttactggttacaaatatagaggatctgcgcccctcgcgtcctgcctggccttttccgtgacgagacgacgcagaacagaccgatcgcccgccagccatgtgaccatctgccgtcgcggtcgcgccggaagcccggaaatcgcacccgcgcgggcacgtcgtcgtagctttccgccgaaagcaccggtcgatccatccatccgcccccaaccaactgccgtttctcgctggctcgctgcctctctctcctcctcggccgctcggcgtcgcgcacgcccggaagcgcgacaccaccacgtatgcacgctgaaccggccactccgcgtccgcgagcgttgatgagctgacacgcgaggagggcgttgccgttcgttaacgacaagatcgattctggatagcgtcatggtctcatggagtcttaaattaaataaaaatgatagcgtcatggcgccgaaaggtgttgcccattgcccattggttgccggcccgagtacagctgcggaatgattgaccgggatcgagctgaactcggctatactctcgtatttgccggtgcggccggttgctatgtgcggataagagcaagtttaatgagcaattctactgtgtttgaggagtcctcataattcctaggtatcaagaggtataaaaaaaatggtacctctgatatctcctcaaggacataaaattactcaagtttaatagtatagccaactactaactccaaatcatcaatagtcaatttaatagccaacttatacaatagttacatataaacatatactacacttttaatagcatagccaactgctgactccaaattatctatagtcaacttaatagccaattcataacaatagttacaattaatactagtcccacatgtcatacgcacatgtatcttggagttcgtgctgcagctggctataaatctgtagcccgctgctattctttcttctcttttatcttctcgaaatgtgtttatagcttgcttatagtctgttgttgtatctgctcttatacaagggacaacctccacacaatctccaataaaaatacaagatgatgtgagagtaaactaatattagagtatttgttacctattaattaataggaagatgatataaatagtttaaattagatgtgtcactcgtcttcactataaaacttgccgttttagacgccgaaatttaatgacgcgctcggtcaaaaaattttattgttggtactgctattcttagggcgtatgctaaataaagaacccccatgcgtgcgcacgtgagtattgtaaatctcttcggatgagagggaaaaacggaagaatatgccaatggtacccactcgttcgagcaatctagaaggataactcaactcacctgccctcgtctctcgggtcatgagaatatgccggtaacaaatggcaacgtgctaatataacttcctccccttcttacccctcggttcctgatgcccaacatatatatatccctccttcctccatatccaaggttagttctacatttcacatctcttcattttctttggctcttcagagttttgtccatctctatcttcagagttcttcagagtttgcttaccatatgatcgtgatcaggtttgtagccagccaaatcttaattcataagaatgcaagatattcatgccttgacatgtgatttctttatttgtctatccttttcaggtatcggaattctctttatttataactacaatgcaatcgctcattttacccgtaacaattaccaagagcttgtttagttgacaatagagatatcaagtcaaataaggttgtttgtgttacacaagataccgatgaattttgtagtgttgcccttctattgggaattcataaatgttgccttgatgagatactacagtaccaataagttttttttaatgcctagaggttaatgaaacgtatagcatatggtccgcaaggctaaccaacagtggatcatcccaaacgaaaaaaaaaaactatgcatgtctctcccacgcgcattatttttcaaggtaacatacatgagccttttatgcacaagtgcatagaattgcaactataagatttttttataatagctttgatatatttaaaattttattacacatgtcctatgctaagtttcaaatgtaagttgaaaaagttggtagataaattcatggcctaataatgatacctacatgaagaggaacacttctacaagcgtcatcaatgttatatctagctatctgcaagttgagggttttcgtcaaagtatggcatcactcaagtcacacctacttaattcaagcatggcgaaccaatgaaataggactaaaaccataaatgctagataaatcatgctagaaactcctatcataatatattgctactaaatcacttattaccatcattagaaagagaatatcattggtactagctattaagagccatgtcagccaagtcacgttctacttgtgacggggcaatgaaggacaagtataaaggtgtgtgtgttgtgtgtgtttggggggttgggggggggggcaatggaccaacatccggtacttttacatgtaaaaactaataaatatttcatattagtgttagctatgtccgatctcattcgagacaacttgttgatacttgctaccccaagtctacatatagattgttgacatgtcagatcaaaactatcattattaaaagctcttctaaatgcaatttgagcttaactcagtttttttcagcctattccttttatccctcatgcctaaaattgtacaatggttagccctactgcaaacgaccttgcacaataaaaaaatcatgcataattgcatattcgagtgtaaattctttttgcatatgtcttttggacagtacacctgatatgtactcactccatttttaagaaagactaatttttaactataaatatggatataaactatctttagatttgtgttaaatggtgtgaagttaaaaataaatgtggcatcctaaatcgatccatacacactattttgtctattggatgtgcacttctgattttttttcttaaaagtttaacttgtctagtactatcgtaaaactatgttgttaaaagttaccattgtatatacattaaataacttgccctcacgtctttacaatgatgcttttgtagctttccctcatttttaagattgaaggtttttatgttggattaattttgccatcggatatcaattgacagcgtattacattgatgcaatttttcttttagctatttcttatcataccctacaggtaattctcaaaatcggagagatttacaaggacacaatagcgatataagtatgactccctcggagctctaattatatagcacaaggatgattcaggactcatccaccatataactataactctctcagggctccaatcatatagcacaaaaaggattcagaactcatccataaacagtgacgatgacccgcaaccactgcgagaaaaccttgaccacggacaacgtcagagattttagccacaggataacaaactcacaggaaatggaaggaaagtgagaaatatctgcagccgccgtcagcctcaggcctcagccgctggcaaacgcaccgcatcagcagcagcagcagcagcagccatcccaagcgagagagctttgctttcgcgagtcgcgcgactccgccaggacaggaaaaaaccggaaaaaaaaaaccccgcaataaaatttccccaacttccgctttttccttgcctctccccaccacaccacaccaccccatctcccatctcaccatccccctttcccaccctcccgtgcgaacacacccgcggcgcggagcccagatcgggatcgcgacggatcggcggcggcggcggcgatgggaggcgaggcgggggagcggcggctggggagggcgatgagcttcgggatcccggacgtggcgctggggctggtgatggggttcgtggaggacccctgggaccgggacgccatctcgctcgtgtgccgccactggtgcagggtcgacgcgctcagccgcaagcacgtcaccgtcgccatggcgtactccaccacgcccgaccggctgttcaggcggttcccctgcctcgagtcgctcaagctcaaggccaagccccgggcggccatgttcaacctcatccccgaggactggggcggctccgcctcgccgtggatccgccagctctcggcctcgttccacttcctcaaggcgctccacctccgcaggatgatcgtgtccgacgacgacctcgacgtcctcgtccgcgccaaggcgcacatgctctcctcgttcaagcttgaccgctgctctggcttctcaacatcctccctcgccctcgtcgcccgcacctgcaagtaattattttttacccttacaaaatattactcgagtgagtcatttaaggttctcctttgttcgcttaaaaagtgttgttgtaaaagggatttgggtatggtttgcttacggaagggaatactacgtcttaggagttctctcttgctttggtcactataaaaacatcttagttctagaattcaactttggagataattgtagctcataggtattaaggaaatggtgtgctttaactgtcacaccctaattttctagtgaggtgcgaggatttagcttagatccaaggctacttagtggaaatggataagtagaaataggttactgcaagagtgcggtggatttctagataattgaccagccatatgttgtcatttgcaggaaacttgaaacgttattcctggaggatagcataattgctgagaaagaaaatgacgaatggattcgggagcttgctaccaacaatagtgtccttgagacactgaatttctttttgacagatctcagggcatccccagcatatcttaccctccttgtgcgcaattgtcgaaggctgaaagttttgaagattagtgagtgcttcatgcttgacctggttgatttgttccgtacagcagaaatattacaagactttgccggtggttcctttgatgatcagggtcaagttgaagagagtagaaattatgaaaactactatttccctccttcattgctccgcttgagtttgctctacatgggaacaaaagagatgcaagtgctatttccatatggtgctgcactcaagaagttggatcttcaattcacattcctttccacagaggatcactgtcagctggtccagcgctgcccaaatctggaaatcttagaggtatttcctggtagattagttgcatgtctttttgttatgtttcttgctttgaggttttataggaatattcaacatgggctgataatcctttttctcatgtcaatccaacaggtgagggatgtcataggggatcgtgggttagaagttgttgcacaaacctgcaagaaattacagagacttcgagtagagagaggagatgatgatcaaggaggtcttgaggatgaacatggtatggttacacaggtggggttgatggctgtagctcaaggctgccctcatttagaatactgggcagtgcatgtcactgacattacaaatgctgctctagaagccatcggtacatacagcagcagtcttaacgatttccggcttgtcctgcttgatagagaagcaaatataacagaatcaccccttgacaatggggtgcgtgctttactgagaggctgcaccaagctccggaggttcgcattttatgtaagacctggggctctatcagatgttggccttgggtacattggtgaatttagtaagacaatccgttacatgttacttgggaatgttggggagtctgaccaaggactgcttcaactctcaacaggatgcccaagcttgcagaaattggagctgaggggttgtttcttcagtgaacgtgcattggctgttgctgttttacaacttaaatcactgagatacctatgggtgcaaggatacaaggcatctcccaatggcactgatctaatggcaatggtgcgacccttctggaacattgagattattgccccgaatcaagatgaagtttgcccggacggtcaggcacagattcttgcatattactcacttgcaggaatgagatcagattaccctcactcagtaattcccctctatccttcggtttgagtgtatatgtctgataccaggttgcgaaactcacactctagtataggccgatattgttccaaattctacagtttgctgctcttattctgtttagcaatgagcacagaacaaatgacaaataaaagcaggatagctgttagttcgaggaacatattataacatcttgggactaagaattttattgcatatctgaggggtatcacttctgcgaaagctcagctcaattggccagcacggatatgtaaacttctccattttgattaggatcggacacacaattttgtaataatgttccttgttcaatgtttagtagtattatttgactctttagctttgtgtcacattgtctcttggaagatcgccgcactgtgttctaataagtcattcgctgtacaatatttttatcatccacagatcacactactggctgtattcttgctgtgacttttctatttcttctctctttggttgtgtaacgccccttgattggtctgtatgatggcgcgctgcttcttactttatcttgtttggtggaaatgtggaatcatgcatatcgatatgtaattacatatttcaataagagaaacaatagccaacctcacttttctaatctatctatgtttactcctaaatcctaatagatttgttgataggttctatgcgtttttggtgcctattcattttgtttggtttgggagtgccggtttgtaattgtgtatgcacatgctcctcctttacgtcctgtccacccttttttatttcgagtatggtgttgtcggtttacaaatttatgaggtgaggtggatgcaatctacttcctccatctcacaaagactttatttttagattttcgtatctaacatttaaccgtatatcttatttgaaaaaaaaatgaaaaaaattaaagaaaatagtcacacataaaatactatttatattttatcatctaatactaataaaaatattaatcataaaaaatagttaaataaaacgaagagaaacattatatctaaaaactgaaaaataaagtctctgggagacgaagggagtagcctataaacttgattcggtaacttgatttgcccacagtagcacaaaacccagcctgactgcctgaaccaactgtgtctgcctgcgaaaatgacagcataacagaacctgatacaacacacagtaagtatcaatatgctacagattgtagatctggacaccataacgaaccaccaataatatctgcctacgaaagtaagcataaacatatagaagtatccgatacaatacgacacaaatattatggtacacggtttctaagttggaaacaggtgcaaagtaagcttcacgagatacagacatacacttaggcatagagagctttattgatctctagaacatcaaggttcaattcatttntgagcgctccctggagacagaccttgagtaggaactgcggctgtgaaagtagctctccntagaatgcctcttacccgacgacctgttggcgcgggtttctttcactgtatcttttccttgganaatanctccctgncctttgagaatccggggaacagctatgggagtagctcctctaggtgatacactgcgagaatagctccgtcctctagcacttggagaatagcaccttctatagtatggtgaaacagaatggtcataggaacatgacctctctcttctgtaacggtatggagatcttgaacggtagcgggaaccacggtaagatgagtatgaccgacgccgtgaaccacgtgtgtcatagggagagtatgatcgccgtctaccataaggagaaggggatctgccatacggagagtaggactgtctcctttcatgtggagagtaggatctacgcctctcatagggggagtatgatcttcgcctgttgtatggagaatatgatcgccttctaccataaggagaataagaccgttctcgctcaggtgagtagcgtgaactgtagcggtctctttcaacaggcgagtagcttggggaatacctccgtgctggtgtcactgtataataaaaaatattcagcaatcagttgtattatatcaggaaaggctagcaatgcttcctattttccagagaaatgagaccaaaccatccagacacagcagcagttaaatcaaacttaccacatgatgattttgtgcctagataccttccgggcgttggtgttcgaccacgtcttctcttggcctgtggaaaggattcaaataagccttttcgccatattagcattaaagagtgatgcaacaaattgggaatctgaacgacatgattaatatggagactatataatgtagggcatacaaccctttggttgaggtagcatgtttggctgttaggttgtaaatcttttgaatttgacgtagagcagcaacggacatctaccctgctgctgtcaacaaaagcttcaaacggaagagcactcaaatattcagctcagcaagctaaatgagcatataaatttcactccaagtagaagtgaagaaattcagtaaatatattgtgattataccttctctacagttatcacacgaccttccaacactgagcggtctagatatttgatgcaaagatcagcctccttaacagtagccatggtaacaaatccaaatccccgggattcccttgtccatggatcaagtactatgctagcatcaataacctgtaatacggtgagcttaaaaagttgtacactattttggtatccctttgcagatactctataaaggttacctctccctcagcagaaaagtgtttctccagatctcgatctgtcacacgagcagataagccagtaacatacaggttgttcccagggttttcaacatcacttgagtccacacttctaaagacatcaaaaggatatcacatactcatcagaattacagtaggcaaaaatgttcaccctcgaatatagagtgaaggcagaaacatactaagcgctaagataaataccatacctagaacgactcctataccttgaacggctgctccgtctgggcgatgtagaatatgagtcggactcatatctatcagtaggagccaatcaataatcacaagacagggcttcaaaaaatgtggaaaaaaattaagtttggtaatgcgtaccttgatcctctggagtacgacatctgcaagatagacatatgattgcatcaatatccactagagaaacaaatatatacaaaaacatgagatgccacttgaaaatgtaattataacaaacagtgggttcatagccttttgaagttgtaactga

SEQ ID NO: 57077 - DNA, 10099 bp, Oryza sativa
atttatctttatatagattaagaataacaaaaataaataaatataaacggatgtttttatacagatcagaggggcaaaccatcgccatactggaacagagaacgaacggattcaccgtctttagcagagataaaacatgaggagaatcagaggcagcaataataccttccttcgtcgcgacgatccgtgccctagccgagagcgtctctctgtgccggcctctcttgttctcagtcacggcgctgcctttctgcgcgtcggagcgcgtgcggttgggagaataaatggaagtgtggaatggggaaggttctggacggaggcggacgcgaaagtttctcaaatctggttgatgaatcggttgcgcgcacgaactccgccttcctcttcacgccttcacacatggcgcttcttggagccattggtttttctttcggtttgcagtaaataaaagtttcccttcagggtttggtttactttccaactttttcttcaaacttccaattttttcattacatcaaaaatttttacaaatataaacttttaattttttttctttaaactttcagttttaaccaaacttctaattttagtgtagaactaaacacacagcctagacctcttttggtcctatagaaaattagagcattttaattataatgataattctaacgagttttttttaaacaaataattcaatcctatactcccctgtaaaatttctataaaatggacacccccaacagagattttaatgaaaatataagagttacaatccttatgtgtcttacaattgtattgttcatctatgttacaaatattagggcatgtttagttcgcggaatgaaattttttgggtgtcacgtcggacgtttgaccggatgtcgaaaggggttttcggacatgaatgaaaaaactaatttcataactcgcttggaaatcgcgagacgaatcttttgagtctaattaatccaccattagcacatgtgggttactgtagcacttatggctaatcatggactaattagactcaaaagattcatctcacgatttcccccctaactgtgtaattagtttttcttttaatctacatttaatgctccatacatgtgtccaaatattcgatttgatatttttggaactaaacggggcctaagggtgtgtttggttcttccctttcccaacttcaaatctttgttttatgtgcgcacgctttccgaactgttaaatggtgtgtccttttacaaatgaaaaattctatgtgtgaacctcaacataggaaaataataataataaaaagaatggttgattgattttgctttagctgttctatttgtcagagtaattatcgagttatgaaatgctatctccatccaaatcgcacccccattggttggcttattcttggaataagccaaacgacacatttacaaacaataagtaatttgtgaataaagcatttatatacgtgttcttagcgacctaaaagtaaatgctgaaaaataaacttcaataaaaaactctaaaactagcttcaaatttaaggttgaaaattcaaattttagctgataagcataagcataagagaaaagatgaagccgcatatggcgtatccaattaaactacaaaacatattgctaggtttaatgcaagtaggacatgatataaagtagaataactatatttacttttagtcactttattacggtggttcttgcaatcagtactcccgcattcaaattagtgtcaccgagcgctatttgtactttttaaaaaaccgctatttgtttttgggttaattggatccatgccattgcaactttgtgaaattaaaaaaaataccactactattcgtcatatcggctatatgccactagaaatttctaaaattgaaaccataccactcgcgtctcttttttcgtcttctctctcacaccgtctctgttcctgtcctcatcccctccctccttcctcatctccgttcccgacttcatcctcctctctgcgtgagcagtagaacttgatgagggagttggtgacgacggggtcccgctcccgcgtgcgccttccctttccctcttcgtcgctgacacggtctcctcctccccgccactacatatttctcttgccggcgaacttccaccgcacgcgcacaagcacaatcatcacagactccggcgatctccatggctccattcagtggggtgatgacgggtgcgcgagcgcgtcgtacttgaatgcctgcgcgtgggtgaggcacgcggcggcgaggcacgcgaagcctgcggacggggaagggggcggggaagacaacgacgcgagggcggcaaggaggagggagagggtggacggggtgggcggcgaggcctcacagatgcgggagtagagggcaagggtggcagccgcgggggcacagcggcaggccagcgcagcgtggagcgggcagccttgggagggcgccgacgagaaggcggcagctctgcggagaaggaggaaggtggggtccagagccaggggaggaggcagcagaggcggcgtgagagcgcgggcatggcaggagggcttgggagccgccgccgccgtcgctgtcctcgatcccctctatggccgttgcctccatcctcgacgcaatttggagctcgggagtcgccaccgccgccgctgtcctcgatcatcgacgggaggtctcgggagctgccgccgccgccgtcctcgatgccatccgcggtgggagtgctcgggagccgccgctgccaccgtcctcgatgccatccgcggtgggagtgctcgggagccgctgccgctgtcgtcaccgctgtcctctttgcaatcgcagggatggaggaaaagatggagaagaaagaggagggagatggaaacgattaaatagggaagaacgagacggcgtgggagaggagacaaaaaaaaaagggatgggactcaggaatggcatggtttcaattttagaaatttccagtgaacatgtagccgatatgacgaatagtagtgatatttttttaatttcgcaaagttgtagtgcattgatccaattaactctttgtttttagcatttgaccattcatacttaagagagaaaatgtgaaaccatatataaagttctctagattcataaaaaaaactaaatataatataggcacgacacacattcacataaaatctcatctataaactcaactttgttcgaggtaataaaaaagatagatttcatgtgaatagttatgtgttattgttcatcaaaaaattgtcatttttgttactaccaaataaaattgagtttgaacttgagatttggtgtggatatatttcatgtctacgtcaatctccaataattatttttctcagatttattaaacttttagccctggtttttaggggtttttttcttatttgatgattttcaatgaatatgtaccttgcttaaaatagtggcggctggtgtggcagcagtcatttggactatgtggaaagctagaaatgcagcatgtttcaatgataagaaaatttaagatgatctcgttgaactaattcatgaagtatgttattggatcgaatcttggtccattttgcagatacaggaggacgagcgaaagaagactacaactgagggtagtgctgctaaggagaatagccgctgagctatacaactctgtaaatggatggaagctgcaaacgttgaggctgaaatgaagaaagatcatgttttgtcgtgtttcgtcgtatatgtctgttgcaagtcctttggggattcaaatttgataatggaagtctattatctattttagtttagcatgcagttactgggtatgttgagttacagacttaagttcggcacctgaggttggcaactaatcactgttgcatggaaaacagagcggtccatcagtgcatgattagttaaatattagttttttttttaaagttgatcgatatgaattgtttaaacaacttttgtatagaaaaattttataaaaacgcactatttagcagttttaaaaggtgtgcgcgtgaaaaaaagagggaagtgagctgggaactttggctaccgaactcagccttacaggtcatataaactctgttaaaagactttgctatatgcgtttcgataaagaaatgggagacgaaccctctctttcttaaaaaaaggtaccctgcttaaaaacacattatatattattaattgtaaaatgcatgatgtaatgtatatgcacatgaaacccccattagtcgtttcatagtagttcaaacattacaataattattgatcaaaggctacattatttaagaacatatggagtaaccgcatataacaagagagaaacctgtttagtgcctttcaaacttccaactcttccatcacatcaaatatttggatatatgcataaagcattaaatatggacgataaaaaaaccaattgcacagtttacatgtaaattgtgaaacaaatcttttgaacctaattacaccatgatttgataatgtggtgctacaatagacacttgctaatgatggattaattatgtttaatggattcgttttgcaatttacaggtgaaaactgtaatttattttgttattagtctacgtttaatacttaaaatgtgtgtccgtatacgttaattttttttaccaaaacaactaaacacggtccttgtcgtgaaaaaattatatatttaaacatagcagtaataggtagatggaggcaaaccgaacatgtaaataagcatacatgtttatattatgttttgcaaaaagaaaaaaaaagaaatagacagagggagcatgctatgtcgatcataataagtatttatatataggatctgttcagattgtagccaaaacaaatattatcaaattttagcaatcgacaatttggcaatatcatcgttttggcatgatttcttatgtatttcctagagtttggtaaaaaactaaatgatgcatatatttgataacttttttaaaaaggtatggtttgaaataaaattaatctgaataacgccatactagttaatttgaatttgaaagctgagtggaggaatttgaatatttgatcggcgtgaaggtcgtctttccttcgcaattcacaaaatcggtccgggtcgaaccaatcaaccaaagcccagacagtacaccaaatccaaattggcggttggatcgagccagcgccgcggccacggcacttcagtgctccatttgccccaacctgacaaaaccaacccgacccgcaaaaatccctcgacacagcagcacacaagaaaagcctctttgctcgccggagagagatctcactcccgcggcggccatggcctccgggcaggactcgtccagcacgacgctgatggatctcatcacctcggatccgtctgccgtgccggccggcggggcgtcgtcgcaccagcagtcgtcgtcgtcggcggcggcggcggcggcgggtggcgccctggggaggcccgcgccggcgccggcggatcgcaagtcgaagagggggaccctgagccagatccagaacgagaccatctccgccgccaaggcgctcaacaaggccctcccgcagcgcaacaggaagaagaaggctagtctcccgttgccccaacccccggccgctgccatctccgcaccccgcttccagttctgactctgttgcctctctgctttctcgtgcagcccgtctcgtacgcgcagctggcgcggagcatccacgagctcgcggccacgtgcgaccaggttcgttctgctacttcggttggatcgaattgcgtggtttgagcttggatctgtaggctttagctgctcttgtacctccctttctgcagaaaagttctcagaggcagcttgtgaatagtgtattccccaagcttgcggtgtacaattctgtggatccttcggtggctccatctcttctcatggtaagtatgccgtcctctactgttttagctctttttatggcttcatctttcacgtagacagcgtaattacttggtaaaagcagtaactagggtaattctcagaaaattcgactatgttagcaccacaatgcattgtcactatggtttgagtctctgaggagatcaatgacaaccttttcatgtttaaaacagaggaaaaaaagtacgagtacttaaatatgtgttgcaacttggaactgaaactgcacacatcgcataattcactgttagattaacctaacgagatcttgtttacttcagttaacttttctcttaatcgaatctggttctgtatttacagcttcatcagcaatgcgaggatagaaatgttctgcgctatgtatactattatctggctcgcatattgtcagataatggtgcccaaggtttaagcgctgctggtggcatacctaccccaaattgggatgctcttgcagacattgatgctgttggtggagtgacacgagcagatgttgtaccaagaatagttgatcagctctcagctgaatcaaccagcgatgatgttgagtgtatgcttttatactgtgctctcaatatacgttgaagttgtattatgcaaaacttgtattccaaaccaacctcttgtcactgttttacattttttcctcattggtactgctccccttttgcactgatcacacctcatgattagttctaccatattctaagcatgctatctcattttggtgaaataagtattatgttattttcttctgttttgcatcttagtgagaattatatttctagtaaacatctaattctgcataaatgataccatatgaccaaataagaatgatcacaatattattatgcatggctgagctaaaacaagatgctctttaatttcttgaaccaagcatgcttaattcttattaagttgcattgggtggttcttcatagtgctaaactatggattctggtctttgaagttcatgctaggagacttgctgctctgaaggcccttacctcctcctccacaagcaattctgagatgttggaaaaactctacgaaattgtgtttggcattttggagaaggttgataattgatatgcttttcatattcagattagttcctcaaagttttattgccctaagttcctttttggtatcccttgtttttggctataaaattgacgcttttcttctgtccatgatgtattctgaatcctttcaggtggctgatactaaacagaaacgaaagaaaggtatatttactaagcaaggtggtgataaggaggtactaaacagaacgaaagtactatttattgtatatgcacttaacccttttcttagaggtttcttatctcataccttgctgataatgggagttaagaatacacttattggaacattgtagttaacctggtagttttttcttgactagataacaaagtaggtgacaccacttcctgtttattttgagctggacttaaaattcctcactagtatcagtacaagctgtctgatgatgcctttctaatttgcatttctttgcagtctattatacggagtaatttgcagtatgcttctctaagtgccctgagaaggcttccacttgatcctggtaatccggcatttctgcaccgagctgtccaagggtaagtgtgaccttttttcctctggaaacttaagtttaggtttattttccatgtctgtttagtttaccagttatctactacctccatttcatattatatgatgttttggatttgtcctaagtcaaatttcttagatttcgaccaactttatagaaaaaaaaatcaacatctggaacaccaaattagttcatcatatccaccattaaatatattttaaagtacatttgctttgtgttgaaaatgttgctatgtttttctatagacttggtcaaacttaaagaagtttgacttaaggcaaacccaaaacgacttataatgtggaacaggtcgaataggttattgcttcttttgaggataaatgggggcatgagtattgttttgtggtatcttttatttgattatacaataatagtttttcttattgggagcctagtctaaactaaaagattagatcattgtgatgacattgctaatagtacggcgaaggaggattcttcagggtgtgcttaatggagaatgaatattcgacatctgttggtttgttaatataacctatcttgagagatctagaaaggatgctattctcgtgtctaccttaaactgcaataccgcattagtgttttttagacggatataagattgtgagagccgatgctctctttaggccttaatatggatggatatccagtgttcaagcaggtaagtgtaaagacggagttatcaaatggtaaacttcatcgaaaagaatttctccctacaaagattacaaacaactccttaagctacatatttgtattgaagtcttctttaagcaaattgatcatttcattgtgttgtctgaacataattatcaaatggacacctaagtttttgtctatctatttttatgaccacttgattctgcttctgcaacaaaattacagaggggtatagcctaatcaaaaagtatcatcaaggaacctgctgttgcataattatcattttattctcatcagacctggtacaattgcagggttgaattttctgacccagttgcagtaagacatgcgttgtcaatagcctctgaaattgccgtgagagatccgtactctgtcgcaatggcactgggtcagtttactcactgattgttgttcatcttatttattgttcttgcaagcagacaaaacatgggccattaactcgtggtgtagaacatacttgatcttttatgtgcaaggaattgtatagaatttcgactataaattttttaaaaactgtcagctgtgatatatttagtcaatatgcagtaaatttggctcatgccatttcgtagattctcattctcatgtttgttttttgttttgcaggcaagaacgcacagcctggtggtaatgttttttcccctttcttctgtgtttcatttgaacttaacttgattatgcatctgatttgtgttttagagttctagttgaaccgaccgagtttgtagaattaggatttctaatgatatgggctgtattctgcgaagaatcacgtgttaaatcgcattcatatattgttgtttgatttatatttacttgttgatgcactggcatgaaatgtaaaatataagcaataatctggggaaaaggcagtacctttctgtcagttgctaatgtaatacgtgctcaatgacaacaagaaatgccgtacatgtattctttgatcaccatatttagttcaatggtatttgagacctgggtgacttaatagcgcaaccttttgtttattgagtattttagtgtatgatatatggattttgagaggcatgaatcaactaatggtacggtaattgcatataaatagcttcggacaccatctgattgttgtgactgatcttgctgttgattgttttgaattccacaaaaaaggaatttacctgcttgtatatctgattgcttacaaggtgtttcttttttctctttgagtttgttctactttgatgtactcatttcctattattacgctgtgtcaaatttaaccaggagctcttcaggatatccttcatttgcatgatgttcttgccagagtttaccttgcaaagctgtgccattcaatttctagggcacgtgtattggatggtgagtgtaatttgtttttgtgcctgtcttaaatcaagatgaacatgtcatgattccagagtgaatgcatttaatcgtggttctggtcaaatttgatttacgcagagagacctgacataaagtcccagtacagttctctcctttaccaacttcttctggacccaagtgacagggtctgttttgaggccatactctgtgtgttgggaaaagttgacaacacagaaaggtactgatgaggtttcaccaatttaaatttctatataactttgtttcttcacttcagttcgacttgtacgtctgtgtttttccatataaattactatatcttgcagcacggaggagagagctggtggatggattaggttaacaagagaaattcttaaattgcctgaggccccttctgtagcatcaaagggt

SEQ ID NO: 57078 - DNA, 14658 bp, Oryza sativa
tttttccccttggttattgttctcttatttaaggcactaaaccgatagtgtggattgtacttgatagggtgatggataaaattaatactagagttgttttactgtctaaggcattgtagtttaggctcactggacaatggattggaacatagttgataggatgatgggtattagatttgtgtttgagacgatgtcctcatatagattgaagacattcaaccttgagttttccagatcacactgagtaggttttggcaaattttcccttctatttactctcttgatcaacacacgtgttcctgtttttgttgtcatgttactgttatattttcaagagccttaccattcgctgagaaaacaatacttatagatgttattattgtaaatattgaaattctgaaattaaaatcataagaaagtatttttaaatataaatccattgatgccacttgtatggtgctgaacatagatattggaagcttaactttttttttgtcaaaaataacaaatgttgatatttctgaatacacgtgtgccctatatttccaacagcgggagtaatatcaaaaatcataaagttattgggttttataaagtatcataatgtaaaattactggtgaaagtttttaaagtttaaccgaatcttgttctgaacgccaaatatttatgaccggagcgagtactaggtagacaattttcccatatgccataattcttgtagattttggctgcaaaaggctcaaggtttttgctttttattgtactaaaactatcagggtaaagcgctttatgcgttcaatttattttaatattatgatacttgattattgtagctgtgagggtgcctgtcgaaggtatttccaccgaaccatttccaatgatgcagattttaactgtgaaactctcaacatgagtcaagaacaagtggtaagtgcatattcctttgcctcttcaacttattcttgtttaagtattccagtattgccatttaccattaatatttttcaacaatataggaatcatcaaagttcatatgcaagaactgtgtgtataagcaacaccaatgctttggttgtggagagttgggatcctctgacatgtcatcgggttcagctgaggtatgtataagaaaaagaaactttgtatgtccttgggatacttcctcttgtatttggtatttccttgatttatcattttgtttttcaattttcttatggaattgaattaaggcactgcttgaaagcaatttttagggatggctaggagtcaatgataactttgaggaatctgagagcgatactttggaattgtatacacattaaagttcaagaactttttttttgtatgtgctcgtcagcataaaccaatttcctttaaattccaacttttccttcactttttgttaggtatatcagtgcagtaagagcagatgcagacgcttttaccatcctaagtgtcttgctgaatttgactctagtaagaacccaccagtttttgaatgccccctgcatgaatgctttgcatgcaagaacaaaggggaaaaatataacgaggaaacatgcaagaacaaggggcaggagagtatcaagaaaaaacaaggggcggaaaacaacaagaaaatgcacctggcattatgcaggcgatgtccaatagcataccatcgcaagtgcttgcccaggtgtgatatgtatttggcactatttgctagtgatagtgcccttctaaaaggatattttgttgacacggtgttctcttttttaggaatatttcctctgttcccaaaggttgtcttccaaggaaatggaaaactaataagggccaagttttcttctattgcctgtaagctttttgcacttcatcctttttgttagcatatgttctccatctccactatattcgtggaacttattattcacatagaactttttcagaaagcatacgatggtagaacatctcagaagtgcaacaagggatcacctcaaatttccaaaagttatggaagagcacatgcagaagtatgttcccaaaagagaagttgaaaacaaaaaacttattgtttatgttaggaaacgacatagaggtgcatctaagaaacaaggagcttccatggtggaagaagttgatcatgggaccatggaaagtgatcatgttcagagaagtagagatattaatctgcgagcacatgaacaaaccgaagcacctcgaaactatatgtctgaccgtaacacaagcactggtttcgtgttgtcttttgcacctaagtccttgttcccactcccatatccaggcaattgtggttggcttgatgattgattcatgatagtatttcagaaagaaaactgaagatttttaagtttcatgtatggcagataactttgtctgtagcatgtaacaccgttgtgttgatgttcgtgatggtagttaattactggtgactgttgagtataaatgtctggatactgtggcagcgacattccttccattgtcaggaatgaggatatattaagtactattatcactgtatgaaatgtttttcgcgaacgcctgtatgaaatgttattaaaatgcttctgttcatacctaggtgaaacaatgcactaatgtgtaatgcaggtatgtaactctctgttgggcagctttgctctggcctctgagactgggagtgtggctgtttccctacaatggtgaatcggtgatgcaggtcacagccttgcatcttgccgatttgtccagctcatttgaggtgacggatatggtggattttgctgtgtgttcattgtttatgcagtactggttcctccaattattttcataattttcttttctgttacgggccggcggaagctgccgtgaccgtggatagcttgatttccagtggacaagggagtataggtggactgtcaattgcaagtttgccagtgggaaactccagtaactaatgcatgcctcagaaagcattcagttgagatggcatgatgaaattattattttttgcaaactagatgaggagatgacgtgatagcctatttaagcgaaagcgatcgggttgtagtccacattacgcagaagcagcagtaaaaaaacagtgtctacctccgtcagccggaataatggccagcaacagggaagttctacaggtggtaacatgctgtgacggtgtatctaattgggtttatattctaagtttgacactgatgtctgctaattttagaaaggaatacacgtgggcacgtcttggtggttacatggatgctcatactctagcgggtgtttgatacgtttgacggtattcatgtatgcgaacgacacacatacttaaaaaaatttccctcttagaaaaagaaaagaattgtctgaagaggattagataagtcataaaccgcggtgaagtggcagcttgacccactagcaatcgcgcacagccgcacggttgttatcatcaaagattcaaagctgaagccttcaaccagggcaatctccattttccactcccggccgggtcggagtcgcgcgacgacgccaccaaggcaccaactccacgtctccgccccttccggttaattcgctcctacgcgcacccacaccaccaccacgccatggcgtgggagtaacgcgcgcccgctccacaccaccgacccgtggcaacgtttctcatctggcatccggctgtcacgttttcccgttcgctacagcccgcaaactcggggtttccccgtcacgccagccgcccaagcacaactgcacagcagcggggactccgccggtgtgcgccgacgcgagccgcatcaaccagttaccgccacccgcgcggcaacggcagcggccgcggcagcgaatcggggccagggcaagggccaatccatcctcaccaaccgcaccaccaccaccaccaccaccaccgcaaccgaacaaaactcggggaggccgcagaataaaggcgaggaggcagtataccggcgcggctggcctagtgtagtgcgcgctgtactgttcccacgtcgcgtcgaggcatcggttcgagcgagcgcgcgcgcgacgcgggcgaggctccggctcgattccgtcgccaccctgtgacagcagcagccaccgcccaccgccgccgccgctttctggaggcttcccgttggctcgtggttgcggggggactcgcggagtcgcggttgcgagttggctgcctgctactctgctagtgtgctaagcctgccttttagttagtctgggagcacgctactgctactttccccaatccaatccaatccaatccaatcctcgccggcgttggttcgctcgatcggcgcggcgcggatggagacgctcaggaagcaggccagcaagctcagggagcacgtcgccaagcagcagcaggtacgggttcctttgcccaattccagtggctccgtctccccactatgccaccaccaccgatcagcgcgtggcccgatgcgcggctaaaaaaccggaatttgggagtgcggggagctgcgtggtcgggttactggagttcttgtttgctccccgcagtaattccgcatacctagtggtaggaatcagggtagggagtggcgagtgcttgggttgggatagcagcaggccagcagttggtggaaggagctgaacatgaactgctcatttgctgcgcatttctgtatatcagatgatttgttccgaagcttgagtttcacttgttccagtagatgtgcttgtttggtaactaataacagaattccttgtgattacaggctgttcggaagcagttcagtgcacgctataaccaggatccttctcttgtcgatgaggcggaacttgagtgccaccagaatcttcagaggctatacaacagtacaagagctgctaaagtatgtgctccaactgtttgttatatgtgatataagaaagttgtctagctcatgatgtaaaagttattgggcatatgtctcattgtatagcatttccaacgaagtattgtacgaggtgtcgagggtttcattgctgtcagcaccaaacagatggagattggtaactgttaccatggaatatctgttcaacatccttccaaattttataatttttgtgtgatcacgttgcgatgtttcttcctgtagtgaaaaagctagctgaggattgttgcagatatggaaacgacaatcaaaattttggttttattcttgcaagggcttcagttgagtttggtaattcccatagccaaatggagaaagagcgggagaatcttcttaaatttcttggagagcaggtgctgtcatattatcattttcctctctttcttaagttttcagaaccaagcaaaaacaaatacattgcaacatgcaacggatatttaaataaatatatcataaattgtatactcaaaaagctttatataaatcctagaggaaaacatatataatctgcaagcacacatcaatccctaaatagcatcattataagcaacatgcacttattttctaaaaaaacacatgcacagatgttatgcttatcctcaaaacatcccactaactcaagatgtggtgtgcgatggcacttactatcaccaacaccactaacttattttatattgcatagaaatttcaatgctgcctagaatcttgtttaatgttcttaacctgaatcttctaggtttccatatatttttctttttgtacccttgacccttgagttacctgaaattaaatggtgttctcctgaaagtaacaaaacagtgtaaaaaacaattggtggattctactccaagagtacatattatatatggaagtttgctacaaacagaaacttattcagctttgctgatgcttgatatttaagttgatggacgtagcatagtttgtttatgcagtgcatggagctggagggaatttttttttattgctgtgtaaaactgagtgccttaattgcttcatttcggctccaatcttgcaggtttttgagcctcttcgagaaatgataatgagtgctcctcttgaagatgcccgcctgttaacttaccgttatcaacggatcagacaagatatggaatctcaggtaattacccgaagtgagacttcctgttcaccagagatgacaaccagatactaaaaataaattttattagatagctgatgtgatgagaaagcaactgaagtccaaggagagtagcggtaatgcagataattctgtgaaactgcaacatgcagaatcaaaattatctgagctccgaactacattatcagcattaggaagagaggcaactgcagctatggaggctgtggaggttcagcaacaacaggttacctttgaccgtctccttgcaatggtatgataagcctcactgttctcataaaaatattgcttaacatcatcaaataatatgtttttgccaatggttaagacttcatgtacatggcaagttgagcctatccatcgtaacaacatggctatttctcttttgctttgagtatggtgtaaccaatacatgtacaccattaggggtagaaaactgtagacatcaaggtcacaataacctttgggttctgagcagaattggtgtttgtggccatgtttggatgttgctttttttttttccctgtcaaccccaatgtgcaggcccctttgttagttagagcatatctttgcaatatgttgacccataatcctagaagtttctgcatatctacgacaatgaaaaatcccactccattgtttaaggccttggttggttggggtggtttgtcccagtccttataaaatttaataccaggaatttgatcggttttcctaagggcctggtattgactcttaagcccacactctcatacagggttccttttctccctgctcaccttagattgtaacaatcttatcttttatatcatgtggttgcttaagttcccatataaatttctcatctggatttccatttagtagttccagtacttataccatttgtccataggatgttcctttcataaagagtcatgcatctccaatttaccttatgacccacttgcaggttgatgctgagagagcttatcatcagaatgctgctgatattctgaacaaacttcacgacgaggtacataactgttgcaaaagaaagaaatggagattcttacacctgttggcttagaggaaattcgaatgccataaacctggaaaaagtgtgtatgtttatgctgaatatcactctgtttttgttctgctaatttgcacagatggtccaagcaaaacaccatgatgagccggaaaaccattatgatgagacatcatcagatcctaaaacagctgcaacacatgagcattcacgtagcacatccgaagatcacatatttactaatactagtgaacctacaaggactgaaaccagtgaacctacaaggactgaaactagtgaacctacaaggaatggtcaggaagtgcattatgttggagaggtatgtgtgccctttgcactgctgctcataatgatcataccagaacttataatgtgtcaccaactcacaacatcactgtctttcatttaattgcagtgcagtataaaatgttagaccttagcttgtattactggcattgtatctgtgctatctgtttatgagatgttttagacatagatacaccctcttacaaatatggtacttcgactgaattttatgtccacatgatatatataaagcggtttgattctgcagccaccttagaagttaaaatttcgatagcatgagcaatacatatgtgattttttagagctactttttttttaactttttaggaatggaatttagagctactgttggtaaagatggtagtctgaaatcatgtgaatttaaattcaaaaggtgcaacttgaacataccggtgtttcttcaacataaccttttaccttaatctttacatttcactttattcctctttacacctggtaaatactatcaccgaatgtcggtatggaagtcacctggtaaaaagaagcaaacatatacaggcaaaggataatcagtatatgccaaaattactagttcaacaattttagcagttacacaatcagtaaaacagatcagcacattattatacaagctgagcagtttgtgaattactcattggtcaggtaatccatccattcgatgctcaggctgatggcgagctcagtatttccgtgggagattatgttgtggtccggcaggtatacatggtttttgcaggttttattcatgccatggggtaactaatgaccaaaattctgaagtaaagaaccatgtactgtataattcactgcggtagcatcctagtgtatacatctgtgaccgctgcaggactatgatcagatgcagtgcaagcatataattgtccccttgttatatttttaattctccaagggtgaccaggggggaccagaatgctaactaagcattccttgtctgtcttcacaggtggctcccaatgggtggtctgaaggggaatgcaaaggaaaagctggctggttcccatctgcctatgtggagcagagggacaaagccccggcaagtaaggtgatagagcctggattgctgactacttaatctctctcatactaatagttgctttcatcgccctgtttcccctgtacatggggtttttcttgagtgaatagcattttgtagaacttctacctttctgtgcatattcatgtgcttctaggcttgctgttacccaataattgtatgtaaaatttattgttttgcctttagcatctcgttttctctttctttcacaatgtatagagctattggtcctgggatgctgtaaccttccctttcttttgtggaaagcgtgcttcctgccaaaattgtgagatggatttcagaacagtctcactggccttgttccttcacttttggacccaaaagctcgtaatctacttccctccaaactctatttactcttcttttttctgttcttatcaaaacagcaaagcaaaggacggattgcagcattcggtatgtctgattgggtagaagaagaaggcatggttgctggattcctggatccaactttatctgaaaccctgaaccttaacgggaacaggagcacttgtttgattgctcccctcctctcatcatttcactgcccacaaagttaatttgccacttttacctacttttggctctgcggatgctgaatttatggggccaagccctgacgcctcttccgttgccggtccgcttcgcggaatcgcggtagcctggccatgagcgcgccaccaccgccgcctcgcttcttgccgcgacacgcacatggagctcggaaagctcgcgtttcccaagccccgcgcgatgagtgcaacgtagcccggattgattcgcgacgttagcccgtagcacgttgcgcgcaccagcggcggcaggactggatttttcacattttggtccttttgaaaaacttatttcgcaaatagacccctgaaaaaacttatcccagaaatggtcctttttgggacgccagagtggctggcgccgtcatccaacgggacggtgccagcctctctggcgccgtcctcctgccaccgtggcgcacgcgaaccgacgtggcaggaggagggcgccagcatggctggcgccgccgcctctattcctgtttctctgtatggagttgcaacggtgtcatttttattttatttttttgatgttttttcacactcaggatcacgatacaaccaaccacaaaaaaaaattaaactcgaactaccacttagctaagtttgaaaatatttagcataccacttagtctactttgcaccttcactaaaattagaccataactcttttagtaaaactctttgatcagcatgttaaacataatgcactctaccactatatgaaattacttaatctaattcaaaatataaccacatgaaatgagatatataagttaaacagtacatagagatgtaatttttttatttttatttcattttttttgatatttttttcacacttaggagaacatagaaaccaaccgtataaaaaataaactcaaacggacaaaatatgtgacatgtagaattttccaaaactctaccgaaacggacaaaatatgtcatctattaaaataggcgtaactttctcatacggactcggaatcaggcaaataatatatgcacggacatctacagaaaaagttacatccgattctccccagctttgccgggttcggcgatattaaaacctccaaattccgcttgcaagattgtgttttcgaggagagaagtttttcggtggagctttggaaaattccacatgccacatatttcgtccgtttgagtttattttttacatggttggttcctgtgagttcctaagtgtgaagaaaatatcaaaaaaataaaataaaaataaaaaagttgcacatctctctcctctgcactagttcggagagaggagaggagaggaaaaattctacatgtcacatattacgtccatttgagttcaatttttctatgattggttcttgtgtgtccctaagcgtgaaaaaaaatatcaaacaaataaaacaaaaataaaaaatttcggggggggcgccagccactctggcgcactccccctagccacctcagcatcgccccgccacgtcggcagggggacggcgccaaagaggctggcgcccccccgttgaacgacggcgccagccactctagcgccccaaaaaggaccatttttgggataagtttttctaggggtctacttgcgaaataagtttttaaaaggaccaaaatgtgaaaaatccaggcggcaggatgggtcttcggtgcgtcgtgcgcaaggggcggcgtgtatgggtggtggtgtccaccggattgattgcgtgcgcttcgcctcaccggtcttgggctgctgggtcctcgtgcagttatggcgcggctcgcctcatcgcccgtgttccgccgatcgctttggggggcaaggtagcagagatggaagagagagaaaatgatgcgtgccggagacttgccagtgtttaccgttcgtctgtctgcctgcctgcctgcctgggtgggtttaacccctagactagtatcttcttttggctaaattttcaggacatgtactaaactaccacgtgattttaacattagtgaagcagctagggactagggagagaaagcatcaaccaacaatcgacaacgaaagattgaggccatgtcttagttcacatcaaacttctgcctgactctcaacttttcatcacatcacatccaaaactttcctacacatataaattctcaattttttttcaaactatcaactttccttaaacttttttttcaatttcaaaaactaaacacagcgtgagaagcttcaacggtagcaggagtacagtaaaacgggagcagtggtgtggaagggtgaaaaaacaggcggtttggcctggccgatgggaggaagggtcacatcgagagcagaggacaccgggtatgagacagcacagctcagcaacctctgggtcgcctcgttggtcagagctccgggcccgccaccagcgacccgtcgtcctgcttcactaggctttgtataattgtacccgtaggtgctgcacaatcaatactttacctaatacctaaatactctaccaatacgatacgccgcttagctcaactgaacatcttcagtatcatggagaagtcgacaccgcgtgtagtttccagtgacagactgacatgctctatctagtttaaagctgatattctgtagaaattttgtcctaatcgcaggtccaaatagctcaaattgaaacaaaacaattggctcaattatctatcttgaggtctatgccgacctaacaaaatgtactgctcctaaccaacatatattgacaagctgcaataactcggcctaccttcgcctatttggaagttgagagcacagggagggccgataggaaagagagaaaaacactgtagtttatcatctgattgttcagaatttaattcgtcccaaaggctaagcacggtccggcatgggaatctatcgctgtcccgtcccaattggcacgtcattttcactcagcatgccacacaagtaccgctacgacgcaaaggcacgcacacctaataaccaataaatgtgaacgaaaaagagaaggaaaggaaaagaaaaaacgggcgaagaagaagaaaaacgtaaaagcagcttgcggtgcgaggcaaaagctagtagacgaggcgggggtgattagctgttcgtcccgtgtcccgttgctcgcccacgccacgccgcacgcggacaaaaccgcattctctctctctcactacactcctcccccacactctcctctcctctctccctctcgcagccacagcacagcgcagcactggccgcctaatctctccgcactctctcccctcgccgctccctccactgccgcttcgtctcggccgacgacctcgtcgtcgtcgtcgtcgtcgtcctcgtgttcgccggtcgccgcgccgacgcggatcgccgtgccgctgtccagtgcgagagcgcaggcaggcaggcaggcgcaggtaaaaaccttgcccccgctccccgtcctcgcgccggatctgccgccgattcgtgcggccgcggtgagcccgtgcgtcgcgtcagcttgtgtgttgctgagtggtgaactggtgatgccgcggcagcgggcgctcaaaactggtgtgctcggtttcgtgtcggtagcgtcgcgggggcttgtgggttgggttgtggctgtaccctactttttgcttagtggcgtcggcggcggcagttgcgacggctttaactctggatgactggatgcgtgcttgcgttttggcggttgcgagctggaattagtaactgctttgttgtttcttcggctaactaagttggtccttttttttttctttttaagaagtaactgaaagatgttgatttacagtaattggggtgactaaattgttttcgaaattaaccgctgtctaaattgtttttgttagaatttttggggaaatttcaaattgcaggttctaggtaattcaaataccattaaacaattttgtggaagcacataattttttttattaataaattgtcatgttttggttcttatggtcgtccattttgctaaagaggagccatgagtgtgtcacaatgtactgcatttgatctgcatatctgattgttgctctgtttatttgataactttgcatgattgctgatatgttcctgttttcacttacagtgccagcaatttgcctccctcaccaggggcacatctacatgtggagttcattcccataaaagaggatgcacatggtatacctcacccatgacctctgtaataagctgcggtgatctttatatgcttcaccaactggtgaaaaatgggctcttttctgagaaaacagcccagtttcctcttaattttgttaattctgcaccttggtgctcgtgaagcaagagcactaagttcagatggtatgtgacatttcatagttatggttggtatttgtgtgctacatttgacaatctgtgctcatttattatgattcttttgacggtttcctacaggtgaagcacttcttgccttcaagaaggcagttacaacttctgatgggatatttctcaactggcgtgaacaagatgtggatccttgcaattggaagggtgttggatgtgactctcacaccaagagagtagtttgtctgtaagaccaaaataaaccctacataaatattgtgaaatgcttagaatttcaacctggctattattttgcttcagtaatatggttttcgtttttaagatggcattttctaataggaagggaatgataacttcatagcttccattgttataaatatatctgaccaccaatatcttttgtttaggattcttgcatatcacaagttagttgggcccatacctccagaaattggaaggttaaatcagttgcaagctctgtaagtgtgtgttgatagcgttctttgcttaacctctttcttttcagcatctgaaattactattttatgtcattagatcactgcaagggaatagcttgtatggctcactccctccagaattgggaaattgtaccaagttacaacaactgtaagtttctaagtattactgtttttccagcatttgtaacaccatgtcttgcaaaaaactattcataacattcatactgttatgcaattttaattgatgcaactttttacgttttgtgttctgacttgtgagatgaccagcaggtatctacaaggaaattatttaagtgggcatatcccttcagagtttggtgatctggtggaacttggtacactgtaagttttgggtggagtttctggttgctttttttaatcatttattacctcaatcaaccaatgtctttcctggctgtccatttcacatcagactgatctcccctgtctgattagttcaatctatgcatcagaaacgtaccatttcactgaaacaatcaacacaaaagttctgatataaaaattaagtgcactggattgcaaatgaattcgtttgtcaatttagaggattactcatatttctggaatatgtttttccccttcagggacttatccagcaatacgttgagcggatcgattccaccctctcttgataagctggccaagcttacatcattgtgagtgttttttatcttgataaatccattgaatt

SEQ ID NO: 57079 - DNA, 1004 bp, Oryza sativa
tcgggaaccgtggtttatgtgggaagcagattaactcggtgtgcaaagatgcacttcagtcaccatcaaatggccctctgccaccttccgcaggtaccagatgtttctaaaactgtctacatacctttttttcatgcttcaaacattttttgtaaatagttaaatggttagcaagatttcaatgtttgtatttaatatttatccatcaatatcaatcatcagtatcagttgcttttatatttgactaggaaatatacttctgcagtttggggttctgtaaagtgtaaattgatccctttcttttcagttcctttcatgaacctatgacttatgttcttctgattatcatatggcagacgacttcatcaatagaagaaacgggaagaattctaccagacttgttataagtgcagtagcaacagtaggagctcttctgttggtcgctttgatgtgtttctggggttgctttctgtacaaaaattttggaaagaaagatattcatggtttcagggtggagctatgtggaggtaaccatgtcattgaatatgctatgtgaatcatcttcaatttatgcggtccttataatcttgcttgttttcttttaggctcttccattgtgatgttccacggggacctcccttactccactaaagaaatcctcaagaaactagagaccatggatgatgagaatatcattggagtagggggcttcgggacggtttataaacttgcaatggatgacggtaatgtttttgcattgaaaaggataatgaaaacaaatgaagggcttggtcagttctttgatagagaacttgagatactgggaagtgttaagcatcgttatttggtcaatctccgtggctattgcaattctccctcatcaaagctattgatatatgactatcttccaggtggaaacctagatgaggtgctacatggtgagcatgttcagttttctacttcctatttattttatttgtattgcattcttccaattgttaaca

SEQ ID NO: 57080 - DNA, 14863 bp, Oryza sativa
catgaggagtatacatataatttgaattttagaacataggatagtatagtactatagttacattcaatctacctattggaaagaggtacaagtacaacaatatcttaaggggcatactagctaatgtcagctagacacagaatgcaatagccaagtgggagatgaagactttagtatgtgaaaattgtgccactgtgggggcaacaaagttgttcatttttaagttcttgatcgtcccatttggctattttgtggcatgttcagacctccatgtgaattagcagctacagattccacgatggatattatttctgcctcttgtaacaaaaatggaatgctacttagtagtcgatgggcatgggacttcagctattatgtagtacgagtagagggttgtatataacatactaggacacaaggacagaagatgctgtctactcatggtgattccaattttacattggcagcgagtctgagaattatactttattactttaaatacagacctctgttcattcttcaattacatctggatctaaacaatcgagataagagtgaaaaccttaaccatgatattaccatttatattccatatgcttgtggaatatatgcattgaattttataacaacgtataattaggtcttacattagcagacttcactattttattttttaacatcaagtcctaatatctcatctatcttcaatcttgacagaaaaatctgaacagttggactgggatgcacgtattaacataatacttggagctgcaaaaggcctggcttatttgcatcatgattgttcacctcgaataatacatcgtgatattaaatcgagcaacatcttactagacggcaattttgaggctcgtgtatcagactttggactcgcaaagctattagaggacgacaaatcccatattactacaatagttgcaggaacatttggctatcttgcaccaggtatgttaaaactgttctgtttcattcattgtgggaaaataacagcatataacaaatgcttaccaccttattgcatctctggattttatttatcaatatataatttcatatgctctgagctaatttgcaaaattcaaaatccagagtatatgcaaagtggcagagccaccgaaaagactgacgtctacagttttggagttttgctacttgaaatactaagcggaaaacgacctactgatgcatcatttattgaaaagggattgaacattgttggatgggtatgtatgacctttatgtccttccatttcatatccacagttttctgatatgaattacgtatgccttcaattgatttaatgtattcttgaaataatctacttgctctgtggcagttgaatttcctggtcggtgagaatcgggagagggaaattgtcgatccatattgtgagggagtgcagattgagaccttggatgctctactttctcttgctaaacaatgtgtaagttctttgccagaggagcggcctacaatgcacagggtggtacagatgttggagtcggatgtaattacaccatgccccagtgatttctacgattcagaataggcttcgacttacggctgctcttgaaaacgccacactgccgctggttttcctgtggaggcacattccatttattctttgcagattatgtaaattcattcctgcggtgttcggctccaatcggctagctcaatggggaggacatttttgtgtctatgtatctatgctacgtacaaattattactactacatgtcaagttaataagaaacttaccaggagattactgtacttgtattgaactgtcaatctcggaagaatggaaatggtagggattagggatgccaagtttcctgaatctccatgagctgctgctagatatattaatatatttgagtataaccagctgaatttctcacgcattgtgcgtctcgcgatcgagaaaatatgcacttggaggcttcacatgtgctaatttcttaagacataagaatataagattcatatttacactaatcaaggtgaagaaaattgactaagtagagtagtagtagaacataatatagttcactttcataatgagacaacaggttttaccgttttacatagcggagtagttcgagcggcaacaacacacttgaaaggaaccagagcacaccaaaaacaccagtaattacacctcacataagtgatcgatacacttgaagccacagataaatcgttttagattagcccaatgctctagccggtgatctggatggacttgacgtcgggcttcttgggctcctccttgggcacggtgacggtgagcacgccgttctccatggacgccttgatctgctccggcttggtgttctccggcagccggaacctgcggaggaacttgccgctgctgcgctccacgcggtgccacttgtccgtcttctcctcctgctccttgatgcgctcgccgctgatctggaggacgttgccgtcctcaacctccaccttgacctcctccttcttcagccccggcacgtccgccttgaacacgtgcgcctcgggcgtctccttccagtcgatccgcgcgccggcgaaggccgccgcgtcggagttggcgcgagggaagaggctgccgctgccggagccgaaggggaagccgtcgaaggggtcccagaggtcgagggagaaggggtcgaacacgttgctgcggcggatcatcgacatcgtcggaatagctgcgaatttggaggtggaacgatcggacttctctgagttcttactctgatgtttgcttggtttgctttgcgttttcttcgtggttctgccggtgaaggggagcgcggttttatagagggcagcgagagggcatcgtggagcttggaataagcttctagaaacttccagtttgcccccgcatgggctagaacctagtacgagatagcttgggctagaagtttacaccaccggtagcggggtgggctgtagcccatagcgtccaggactctccagaataatctaggccataagcaggcctagaacaatccagaagaccacttccaatttcggcccaaattaacgaacaaacgagaactatccggaagcaaaacttccagtagaacccatggaccatcacgaactgctatataaattgttgccaccacgcagcgacaggtgccaaggaaatcagctcatcgatcgaaagatcaacaagctctcttgagaattgagatcaccctctttccatctagaacacaaaccagacaaccaaaaaacagcaagacacaatacacaatgtcgctgatccgccgcagcaacgtgttcgaccccttctccctcgacctctgggaccccttcgacggcttccccttcggctccggcagcagaagcagcggcagcatcttcccgtccttcccccgcggcacctcctccgagaccgcggccttcgccggcgcgcgcatcgactggaaggagacgccggaggcgcacgtgttcaaggcggacgtgccggggctgaagaaggaggaggtcaaggtggaggtggaggacggcaacgtcctccagatcagcggcgagcgcagcaaggagcaggaggagaagacggacaagtggcaccgcgtggagcgcagcagcggcaagttcctccgcaggttccggctgccggagaacaccaagccggagcagatcaaggcgtccatggagaacggcgtgctcaccgtcaccgtgcccaaggaggagcccaagaagcccgacgtcaagtccatccaggttaccggctagtaagaaacttcgggtgtgacatgcacggtggagagcttcgattcgagccttcggtttgtgatcaattgcagtaaataaaagcgtcaaatctggtcctcagtgtttatgctgtgaaaaagttcaaagctatgttggaagtgagcaataaagacttttcttgttttgtgaacgaacctgagattatactagtcctacacttgtttgtttaatctaatctccggtatattctgccatttttatctcgatgtttcagtacttttagcctttggttcttgaatccttctgtcgagactggagagttcatttcggaaattgagagctcaatttccacataagtcccacaaatttcacttgtttcagcattttcacagcaatcgattcgattccaacagaagtcccaaaaatttcacttgtttcgaaagatgcctataggttttacgttttcagatcggactgagaaaaggcctataggatttccgttttcagatcagactaaaaaattattccaatgctaggccatgactgaactaaccaaatataacgaaattgctaatattgtgatttgcgattcgtacttcatgtgttttttcttcaactccaataacctcatttatttctacaacactgataacaacctaaactccggcaaataggtttgggtttaggttggggctgagagagaaggggaaggtggcttagagggatgattgtggaaggtgatggcccgacgatgtacagcgggatgagtgggtggcgaggcaacgacggcaccgccaaagccgtagggtcgataacatacggtgggtcagtgttaggggcaaagtagagcgacgggttaggagatggcgtggcaggggcacctcaccaccattggattgaggtgacaacagaggcagcgatgacgagagccattgagcgttgttcaaggacaaaggaacaaaagataaaagataaaaggattagggtttggatatctgcaccaatccgaaagcgatctaatggctcaaaaattataagaatttttaagtggtgttttctgtcaaatgtgtaatagaaagtctcaaatataaatatgaagctctgttatgattaaggagtttctacttctaataaatccataaaatagaacttttatttatgcgacggtggtagctcatgcagaacatgccatgatattcacaactattaaatctctgacgtataaaaagtggatactttgctatggacacaaacatcttagattttcagccaaaaaaacgcatggccgcatgtctaagggcaatcccactccgaaccttcaatcgaacaaataagggcatcatgtcacaacctgttatagatcaactaatatgagggtattgttctttagcacgagattgtttctagcgcactttctttttctcaaaactttgtttaaacttttttcatatgaaatgattttattgaaaaattcatctgaaaagttttacatgaaaactttcatgttacgaaagcacgtaggctaaatagcaaatccgactagggtaaatagatctaattgtcctaatcctgttccgggaccatgtgcagatggttcactctttgcccaagagaaggtggagcccaccatttggtccataaacggagattgagatcctctaccttcaaaggcaacatgccttatgtcactgacaaagacttcatccatcaccgccaccatccctcgcggcctcgccggcgatcaaatcgcctgcacggctggttccggtagccgttctccatcttggatgctcaagcgggcttggggtcctgaagaggcggcgccaattattttcttctcctccccttccgttctctctcgtggtcccacggcgttggcagaggccagggtgcctcaaccctcaagagtcaagaccctatgcgcctcgcgcagattgttggtgaaggggctcgtgtgcccctcttcctaatcccctgttgtattacttcttggtatttctgtgcagagattaatgatcattgcgctttcgttgggttgtggcaatggcattagtcttaacgctggataagtccatggtgatgcaggagaatgaatccgggaagtgtgccatgccatcagccaggtgcgtacattgttcttgccgcttcttcgtttgtccatacctttgtgattgcgttggtttatgttttgctaattcaccggcatagtattgtgacggtcgattcggattctgctattacgtctcttataagaagaaaatgggagagattcagcgtatattagttatgctggataataatcagaactgatccttctaaatcaaccgagctaccagaacaaccaatgttgtagaaccgaactggccactcccagtttccattccaaaaggctcaagaaaaactcaaacattggtacattaatcaagcttaaagtttatttcccgtacataaacgcataggagacaaacacatttgggacccttggaggagaccacacattcataaacacatgatcatatcacacacattttggactgtgtccctcacgacacaagcaaagtaccaaaggaggagatcaattgcagcattgaggagaagcagcagaataaacaaacggggctctagccggagatctggatggacttgacgtcgggcttcttgggctcttccttgggcacggtgacggtgagcacgccattctccatggacgccttgatctgctccggcttggtgttctcggggaggcggaacctgcggaggaacttgccgctgctgcgctccacgcggtgccacttgtccgacttctcctcctgctccctgctgcgctcgccgctgatctgcaggatgttgccgtcgtccacctccaccttgacctcctccttcttcagccccggcacgtccgccttgaacacgtgcacctcgggcgtctccttccagtcgatgcgcgcgccggcgaaggccgccgcgtcggagttggcccgagggaagaggctgccgctgctgctgctgctgccgccggagccgaaggggaagccgtcgacgggatcccagaggtcgagggagaaggggtcgaacgcgttgccgcggcggatcagcgacatggttgacggatttgggcgagaaggaaggctgtgtttgtgaacactaaaacagtgtgtgcttgggaagcttgggatgtgagcacaagggatcgcgatttgcgagttgctttcgatctttgtctgggccgcagagcgggaggggaggccggatttatacgggctgtgggcggcgttgagaggtgggatcctgataattctcgtcagttcaagaatgcactggaaaacacctgatttggagcctggccgcctgggccgaatcatcgagtgccttccagaacttttggccctgtggatccaaacggcatgggactctggttacagatttacaattgccgatttccttctgccatgttaatatagaaattgccatgtatctattgtgaactatagttagatttgttcctatttctatttttaaaaaaatatttaaaacgaagaccttttaaattttggtaatatcaaaatttaacaaggcagcatactaaacatactattaccaatgcaaccatattttagtaattcgggaactttctactctagctactacacaatttagtaatgtgttaaaccaaacatcgtccacatccttaccttattatcttactactaaacttcgattctggtaaaattactaaaatttgataagttttttccaagtgaaaaatgaacaagtcctacatctcctctggcctatagcatagaaacccatcactcccaatttctactttgagtacgcctaagcggtcaaaaaaggagaccgttcacacgttttacaatgtaagcataaacttatatggtcatttcataataatcactaaccttttgtcgataaaaaaacatccccaaatcttagggcctgtttactttaatgccattttcaactataccattttttaataaagttgtcaaaaaaaagtatctacgtttagtttgttgccaaatttagtcaatacataagaaatcatgccaaaattttagcaatattgccatcttgccaaaattttggcattgctaaaatttggtaaggtttattttagctacaatctaaataggcccttatagttttgggtcactagatgtgctttgcgattcgtgctgtagacccttatcttgtagctctggtgatctccctttcttctctggcaccggtgacactgcaaactctagtggagtagcaacggattagggccccgggggttgggtggcagtggaaggaggagggggaaaaggggatatccatgcgtttagatggatggaagtaggaggcggtggacacgagcaggcgacgaggcaacaatgacgacgctggagctgtggggatgaaagagagtggtatactggagcaaatttatggttaggaggcagtgaggagccactaaagacgaggaaaagggcagagcggggcacctcacggccggcagccaacgacttgagtaggagaagaggttggtaacggggaggctggctagggagggaggggggattgggctcgccagtgttattaacgccttccggccagccggcgaggccgggctgcagggcggtggcgacggaaagcatcgagcgagcgggtgattcaatcatgtctggtgacactagagtgagaagggaggagaggaggggcggggtaaggtttagggatgtatgcaccaatctatacctatacttattataaaaattgaagatgtttccgcggttcgtcatctgtgtttgtgtcggttataaaaattgaagatggcatcatccgtgtttgagtcggttttaattttatgttttggtttatactattataaaaattgaagatgtttccacggtccgtcatccgtgtttgagtcggttataaaaattgaagatgtttccgcggtccgtcatccgtgtttgagtcggttttaattttatgttttggttttaatctgtatatcttctctactattataaaaattgaagatgttttcgccggtatttttgtacgtcatccgtgtatgagtcagtttttaagttcgtttgctttcagtaatacagaaggaatcatataagaaatctgtttaaaaaaactcgcatgctaacttgagacgattagactgctaactgcagctcatgattttctaaaaatatatatatccaagggaattcccacagtaaatttcatcttaactaaaccatataacaataataagattaaaatagacttcacccgttgcaacgcacgagcatttttttttctagtcttaaagaaattcaactgttcaaaattcgacagttccctttatatattgtaacgtcttacatatgcgatttttatggttcagagtttctgacatgagtttcttatgtatgtctcacatgaattgtctgttctgatcgatacatgtaagttttcatcctaagggcacccgtaatggttatctataggctctctacaagatatctatgtcagcatattttcctacttgaaagagattaaatgaagagatagagcaaagctatctactaacctggagatagtctatagagaaaaacgaggcaatgaattagagagctatagatacccatgtagacatactattggggtagtttactattaatctagtctattgctgagatgtacatgttttatagagagcaccttactttactattgcgggtgctctaacagttccattttcaatttccaatattatctttgttttggcctctaccgtttccgtgaaaaataaatggctacagaaatgctttaggctgtttgtcgactgttttcaggactagtgagaaggagcctcgacctatcaacagtagggatgaaatccttcacaatgggtttaattaattcgccatcagaaaagaaaatttctacaaatatattataatttagttacaatacttttttttttagaaacacccccgtatatgaaacttgcagtcaagccaagaacttctcgaccttctccacttcctccacgctcccgatgtacagcggcactctctgatggatctgcacggcacattcacaaacgaatcaattatatagacacatttcgatttctaagtctactcgtagattaatccattaataacactgcgcatataatgtgtgcgcatattttacctccgtaggcatgatgtcaagtatcctctggtggccatcggagcccttgccgccggcctgctcgacgatgaagctcatcggcgcgcactcgtacagcagccgcagcttgccgttcttgctcttctggtccctggggtagccgtagatgccgccgtagagcagcgtgcggtggaagtcgccgacgaggctgccgatgtagcgcgcggagtatggcttcccggacggcccgggctccttgaggctgtccatgtagctcttgagcttgtcgtcccagagcgcgtagttgccctcgttgaaggcatagatcttgcctgccttggggatctgcaccttctcctgcgtcagcacgaactcgccgtacatcgggtccagcgtgaacacgtacacccctgtcccgatggtgagcacgaagatgaccgagctcgagtacatgcagtagccggcggcgagcaggttgctccccggctggcacacgctcacgatgcacctctgctccacctggtcaagctgcaggcacacgcgcgcggacagaggcgtttcgttctgttagcaccgtgtcagtgtgtgcatgagcgattgctaggcgatcgataacgcgttacattttggtcgtcggcgatgtcggctaggcactcgtcgttggggctgtagatgccgaagatggagccggtggagacggcggcgtcgatgttggaggagccgtcgagcgggtcgaacaccacgatgtagttgcccgagtagctctcctccacggccaccggcacgtcctcctcctccgacgcgatcacgccggtgcgcccgctcgatttgaggcagttggagaacacctgcggtgcgcatagcgctcagcttatggtcggtcgcgcttgttgcggtggttcgcgcactaaccacgacgagctactgataatttagtcgtttacctcgttggagacgacgtcgagttttttctggtcctcgccctgcacgttgacggcgccctggacgccggtgaggttggagatgggcgcgcgctgcaccagcgaggcgatctgcttgcacgccgtggagatgctggccagcacgatggtcatctcgccgtcgatggtcccggcctgctcctgcttcagcagccacgtcgtcagcgtggtgatctcgtagctgctcttcttgctagcctccgtcgcggcgggcgccgaggccgtgtcgacggccgccatgcaccgcacgctcggggccgacgacccaccggcgagcctgccgggctgcctccggaaggagaggccgcattggagcgaggccgccgcctgctggcgggagagcaggagcaggtgggaggatgtcgtggctgcggcggccatcgctgctgctgcttggttgcttgctctgctcgcgctctcctctcgctgcggctacctggtcttggtgccgatggcttcttgttttgttccattggttttagccgcggtttgtgtggccggagagagggcgggaggtgagtgtgtggattgggggagaattgtgaggatggcgttgcctcagatactagcctaattgcaactccttgtccttcagccagcgtcacgtacagtcacatacaagtagcatcgccttgctcaggggcagtatatacttgtgcttttgattaggcagatctattattcgtacctatgaatatagatggtcatatgacccagcccaaggccaggtgatttgacccggcccaggcatggcaggtcgggccatgccggcccagcctaacagccatgtcgtgcttgggctgccacctcggcacgttgggtcggcatggcccggcacaaagttcagtgtcgattggaacgatgagcccagatccacatagttccggaggacaaaggagcaaaacggtggtcagctgtcgatgatgaggctgctggctcatatgggtttgccagtagaggctcaagcatcagtgacgtgcgtggcccaatgagagagatggtgtcagaccactcccctaccgggatcacggacggcaaggtaggcagcgactgtgaaggactgaagcaggcgaggatggggaagatgtctgaaggggaagatgaggaggggcggctttctctgccgtcatcatcgcgccattgcctactattgtccccactcgagctcgtgtggcggtgtggaaaaggagaggggggtgagaaagagaggggttgctcgcaacattggtagcgatggcgatgggaggggaggctcatgtcgtagtgttagagggtcctgccaacaggatgaggccacagagtcgtcacctccatccctagtgagttccacaacctcctcgagctgttgttacctatcggcctactgatacatactcactgacatgtgacccccacatccggttggaccaacttgccacgttggtgaaaaccatttttaaaatgggacaattgcatatatgcccccaatttcaaacccaattgttgttttaccctcactttttagggtttgcggttttagccccactttttgaatctgaaccggccgtctacccctacttgtaacaatcgtttggtgggtcccacgttttgtgttaaaggaatacaaaaggaaataaaaaaaggttttaggaaatatgaatttacgtttgtacccctgagagaatgggtagggactaaatcctctcaacctgtgcgtgcgtgaatcagggactcgagggcgggcggctgcgagggcgtacgcgcggcggcggcaaccgtggagagggcgggcgtgcggtagccaggcggccgtggggctttgacacggggattcgcagttctagttgccacacgagttcatgctctccccgatcgccgccctctcccttgccgcgaggtatgccgccatcgagaggtctgtacgaccgcttccccctaccgcaccctcctcgcactactacgcagccggcgacgaccccatcctgctcgacgtcgatggcaatggcaacgccgccttcatggcggtcctcggccccacccacccaagcatactctccccggtgccctccgcgctgccccccatggcatcgtcaccgtcgaggctcttctccccgctcgaccaggcctccgtctcctagctcagcgacctcagccccttcgtccactccgccggcgcaacccctcccccccaacccatgccgccgttcgcgccgagcacgcatagcctgctgctgtccacgcccaccgtcgccgatgaccttctccatcaaggaattcttcagtagcaacttcccggacctgtcgaaatgctgtctaaattttgttcaaagtttggtcagattatgtacttggctagtatttgtgatttttttattaaagtacaaaaacatcacaagagatgctcatatttgaattatttataacaatcacacaataggggcaaaatcacacaagctgaaaaaaataggagcaaaaatgcaataatcactaagggtataaatgtccttttgctgtacaactaacaccgttaaaccggatgttagaagtggaggtagtcggatggttcaaattcaaaaagtgggggtaaaactacaaaccctaaaaagtgaggataaaacaacaattaggtttgatagtgggggcatagatgcaattgtctcatttaaaatagtcaagataattaagttacatcaattttaatagttggggggttagaacatcctctttcacgaatgaggaatagaatcagaaggactttaaaggaaaggagtgccatccaacagaaggccctataactacttacgttcagcaaatcctgatatgtagcctgagccgagctgctctttcttgggcttcttacttgttatactctgtgggccgtggcccaatttgacaactccttaccgttttacttttgcttttctatttctctaggggtataaaacagctgtaccaaatcaatagaaaaccaatgctgcatttcttgtgtactagaaacaaaatgtccatgcgttgcaacatttttttctttctgtggtacgacggctaataggagctaagcaatatattgaaacattggaatcactatacattgccccattcctttattttcagccccagcccaatccacgcctcatatctccctccgctcggcctgcctctctccagcgcaccctacaaatggagttgcaagagcccagctagcacaatcggttgcctcctccaaacactacagtagcgtcttcaaacctctagatgacagtcatgtgcccgtatcatgccggagctaatcatccccatcaagtccggtggaatctttctcgatctctcaaaattggttgagggttttaatccactcgatctcgatcctctttccatttctcccaaaatcagagcgtcgcatccaaatcgtcgtagcccaattttgtaaaacttgggataaaaacacgcgcacggtagcgctacggacattgacgagcccaaaaaactacaaaagccttacgtatttttaattaagatatataaaaaaaggaatcttggtctcgattagactcttgatcgtgtcgcaggtgcagcgatgatgaaacgaagcggagggacgaacggaagccgaatctcaaagggatttaagggaatcattgatggatgaaaatttcaacagaagctttacgcattttttaaataggtatatatagatatatgaactacttgtacaatacttttgtatcatctaacattttatgcaagatggacatgacgcagacatcagaacatattcttaaaagaacatatcagaatactaacaaattaagcaataatcacctcctccagcttaatccttttttttgctctttccacgacaccaaccttttgaacaagaaatacaatatttttgtagaccaaataatataattctcttgcagagtccaatcctcgtattgtttaagctttgagtttagcaaactctactcttaatt

SEQ ID NO: 57081 - DNA, 11634 bp, Oryza sativa
  unsure (1)..(11634): unsure at all n locations
aacgctcaaactaacctgtagctatagtcgtcggttcaaaccagtgtttgattcgaccacactctatgaacccaactacttccaccactccatctcttgatcctgaaagtgttaacatttcataattaggagatcatgctgggagattctgccaaaccacatttgcataccaacggcctagattttctatagcttaccagctgccactccaagcttgacttctgaacccgaataggttcacaacaaaggctgtatttagatctaaagtttggatccaaacttcagtctttttccatcacatcaacctgtcatatacacacaacttttcagttacatcatctttaattttaactaaaatctaaactttacgctgaactaaacacagccaaagccagattcgccgcgcttgccctctccggcaggcggcagcttgaccctacgcaccaaattaaactgaacagataggataggataggatgacctcattggagcgccagcatgaataacacagtaacctttttttctcgacacgaaaggagccaatgacctatatgagcgcttgcttttgctgaaactgtactttcacacggcagattaacctaacgtagatatatcctactgaaaagcatctcacgaccgacctgtactgctgctgtcctttctctatagacgatcactccgcagcaataattctggtccagtcggagacatcgaccccccacacacaatagctagatcgctagctagcccaaggacacccaagaacagcgagatggggcagatggcgatatcgccacgttctcgtttcattcgtttcagcggccgtcactttcactgcaaatttttcgccgcagatcgtgcagctaattataaaagctgataacaatcgatctgaagccgcctctcttcgtcccgttcacagaaattcatcttacctaattaccagaggagacactagctccttttgactttgcgtgtcgctgcacctgatcactctctctcacacacgcacatccattagctgggcatggctgctacttgcagctgagtgcccagctcacgtagcacgtcgcatacagtaatacacttacaggtcatgggctcatggcagtgacaaaaacaaggccgtcttcccaggctcgcacactggcaccggcagcctcgcacactggctagctaggtgacggagacggcatcgctttacaactcaaaagggcctccgcacctcggcacgcctcgttttctattgctcggccgcctttgcgcaccaaccggccgggtcggacaaaacacgagggcgtctcgcggatgattgggaggcggtctcgcagatgattgggagggacggggttggttgcgcgcactcgcgcgcggggcagtggccggttgtggaggaaacggtgctcctctcctatcccgacgtccccgcggcagctgatgttgaacgggctccaatccgatcgatgcgatgcatgcatggcttgactgcatgcgacgttaggtaccaaggctggctcagatcaggaccgggacgtactgtctcctcgcagctgtaatgaaaacttgcaaagcaacctggtactactaaatttgtcccaagatacaaaaatttttagagataatacagttattaagaaaataagtaaaattaaacggaagaggttatgattggatgagaagtgacggtagattaagaaattaaatggtgaacagttataattggttggaaagagaacgttgatagataagctattatattttgagacaaattctgaatactaaaaattattatattttggtacggataaagtaatagtagtacagtaggttattaagctgctagtaacatgatggattggaatcgccgtcgccgaccgtgcatgatctaacatcgatgccttctttgttttcaaaaagagaaaaaaagggtagaagaggattcggtggttctgttaatttgcagcccctgtcgttttcaggttctgtggaagcatagaagttatttcctagatattgactttgttattcttttttctttgacctcttacagctttcaatactttggatccattccaccacagctagcctaactccaattccttcgttgtataaacctattgcgctcttgacttttttagcatgagaattaaacaaactggaagtcttagcttagctgctgaacagcagtgcatcaccacaatttttttccgttattgtggtcattgatagtagcatctttgatctaagggatgaattgtcggtaacgtacaaaggaggcccattttccatgcagatgtgaccaccggaaccaccatcgtcagtgggcacggcaagccaagcggtaataagattcgcaagaacgtggggggtttgcctcccgtacgtgaagacggtgcgagcgtcagcatctgacaagtccagtggtgtcgggccttggcgcgaaattagcaagcaatgcttcgatcagaaattcagttatactataaacatgaaagaatcaccctgctcaccgggttttattttgttttgaaagggaaatctgctcaccggatttcgatcgcagtgtcaggttgttggggataccacgtcgagcaaacaataatattcccgtctctgtggcaactgcttccaccagcaagcccaggctcaccaatcgtgaaagcggccggccggcggcgatcagtctcctgtaaaacaccggaggagcaacatatatggctcggcactcacccactcacccagctcagctgtgtaacctctaaaaatactagcaatacttttaatttggaccatatcttatctgccttcactgacacctcttatccagtacttatgcgtatctagatcgtgctaatcattgacgctccgtaataatgtctgtgatccggccatttgattggagagtatgcaaaatatgcatagtattacagacggatggatcggatcgaatcagtgtactgtaaatgatgagtaaccctggcctgattgatccgtggatctcccatgtcgagcggcagccgggcaatcacaatgatgagacccgatctcacagagtggtacgtggtgtccatggcctttcgatctccagcagcagcggcagcggcagaaacctggttggcacgtcggaggaaacggacaggatctccacccccacgaacgcgaatacaataatcccgcgcgacgcgacgcccgcacgcacggggcgggggcggagcggacgacgctagcgtccagccacagcgcagcgcagcgtggacggaaccccgacccgccgatcaagccgtccacccgcgccggcgccgcgaatggcgcggcccaaccaccgggagcgtgaggataaaccaagccgagacaccgggaatctggcgcgcggcgtgcacagcgaagcggcccgatatcaagcgacgatcatggcggcaacctaacacgggggcccgggtgcacggtgcgtgcgcgcgaacgtcaacagcctacgactacaactagtactgttcgcgatcccctcctcctaatcgtttgaagccagtgccgcgcacgtaggcgccctaccggttatggaaagggactcgcgggccgttcggaacggattagctagtcgtaactcgtacgtactcaggcgtcatgcctatggttcgtgacttgtacgtactgtgttacatctcactccacggatgcgcgatcaggatcgagagagaaaaaaaaaaggcaatcgatcaattgcttcccaacaactccaggttcccattatcaatctgaacgtgtcgatgcttccatcgaattgactactcgtgcagcaacactccgtacgtagtatcatcttcaacagcgaagaatcggttaaatgcaagtttaactgataaagtgagtgtgtgggaacactgcagaacggcacaaaggctgaaagttgaaaccaggaaagggcaacgcatgatcgtgcgtatatgtgtatattactgtttggacgatgagcacaaggatatctcttgagaaaagaaatgttaaacaagatcgcagagtgcgtgcggccacgaccaaattttgggggggcaaaaataatgtaagagcaaatcttggaccccacctgccagctgcccgcacgactcatcaaaaccggtacaaacccaccgagacagggtaggcgtcataacgcaacacaaaaggaaccgcgcggcggcaccaaagcgagcagaagcagcagccgaaggcgatcggagctcgcgcaacaggagagctgtctccatgaggaagctgtgcccgaacctggagcgcgatgacgcgctggacacggtgctcgaggtgcccatcccggaggagatgttctcacgcggcagcggcggtggcggctcccgcggctccaggttcggctgcaccaacgtcaagtcgtgggtgcggccgaacgcgtccgaccgctccggcggcgccggagagccgtgctccatgagccgcggcgagctgcagctcatgctcggcgtcatcggcgcgccgctgataccgctccccgtcgaccacgccaagcagtcgccctgctccgtcctctgcgaacagctcaaggccgatcccattgtacgatcgccatcatcggattcttctccgtttcgtttgtccatcgccgcgcgctgattggctcatccatttatggcgtgtcccctttcaggagtcgtccacggccaagtacataatacagcagtacatcgcggcgtcgggcggggagtgggcgctgaacaaggtcacgaacatgtacgcgatggggaaggtgaggatgaccgccgcggagctcaacagcagcgacgccgacggcggcggcggcggcggcggagggcaccgcggcgggaagaagagcagcaagaacggcggcgaggttggcgggttcgtgctgtggcagaagaagccggagctgtggtccctggagctcgtggtgtccggctgcaagatcagcgccggcagcgacggcaaggtcgcctggcgccagacgccgtggcatcagtcgcacgcctcccgcggtccgccgcgccctctccgccgatcgctccaggtataatataaaccgcgagttcttcgttagttccatataaacgcttaccgtattcgcacgacttgactgcaatactgcatggtcgcgtagcatcatagaaaacacgctcaactctcagttaaagtttccaacgactaggagaactgcgtactgaattggatcctgtttatgagacggacgactacgagaaccaaatttggtggcacatattttcttttctggttcgacgtcaaaacgagtagtcctttgtgtttgggtcgatccaacgttgctgttggccgaacttacgtagcgagtccattgttgtcatcgttcctagtggtaggtactaataggcatcggtatcatgacatggaacgcatacgtccaaagtcgcaaagttctcatcttaatgggaacttactttctgtagttctttgtcccaagaagctctgtttttccccttcgtcctgctcaaaccggcctgatttgggtactaggtggccatcagtacgcgccgtaccgagcgtgcgtagtacgagtagagagtagagcatgcatggcaacttggccagtgtcacgtacctggatcttccctgcatactgtcggtaggacaggacagatcggtcgagtacccgcacggccgagcgacatgattacgcctttgccgcactcattgggccgttggcattagctgtggtcaaggtcagtccagggcggtgtcgggatagggctggccgatcgctcgctcgtctcatcatgaggcttgtacacttgtgccgttgcgcgagagatctggtccagggcacccggtacacacagatatgggggacgtactcatcatccatcgtcagtagcggtggctgcacgctgtcgctgtggagtgggggcgaatcatggcaaggggagggcgattagcgggaacaaagcgcggagcagcgggattaggggggacgggttttcaacaccgtcaccgcaacgtgccgccatgtgctgcagcaacgcggcgggacacatcacgtggacatgggcctaaaccgggacgcgacccacgccatcaatcggttggtggctcgcggtttgtcacccggccggttccacccgactcttgaactctccccgctaatcgcgctgcaccaaccagcccgatttaatttgaccgcggtgtcaactatcataccatgttcttttttcataacagctataaatagtactagtatatagtgtccacgtggattaaattaagtgactggagaaattaactaacttgtgcatgcatggtgtgtttggtacgcagggacttgacccgatgctgacggcgagcctgttcgcggacgcggtgtgcatcggcgagaggagcgtggacggcgaggactgcttcgtgctcaaggtggaggcggaggcgtcgagcctgcgggcgcgcaacagcagcagcgtggagatcatccggcacacggtgtgggggtacttcagccagcggacgggcctgctggtgcagctggaggactcgcacctgctgcagatcaagtcgagcggacacggcagcgtcttctgggagaccaccatggagtcgcacctccacgactaccgcgccgtcgacggcgtcaacatcgcgcacgccggccgcaccgccgtctcgctcgtccgcttcggggacagcagcgacggcaacacgcggacgcgaatggaggaggtgtggaacatcgaggaggtcgacttcaacatctggggactctccatggactgcttcctgccgcccagcgacctcaaggatagcaaggaggacaaggacgtctccgccgccgtcaagcccgcgcggccgccgccgataaggataccggcggtggccgtccgcgtcgggccatcgcaggtcgccgccgtcaacatggacgattccgactcgctcattgcgaggtcatgacatacatagcgggcagtgttacaccgtatgagtcgtgtgtgtttacgtgccttatcgccataagttacttatggtaagatctgtaaatatattgcaggttgagatatttttgttttcggggagtggattttacctcagatagatgctcaggggtgagtagtaaagcgagtaatccgggatagatgttctaattagcggtattgtaatttgcttatgacgccccttcactgtaaagttgaaagaatctccagttctgctagtcacacactgggcttcagcatgttttccacttctcctgaacatacttgtgctacaggtggctgcaatccaaaacgcacataacttgctgcaagtgttttcaagagtaaaaacttaagcctcagtcctcagattaacacaatgcagttccaggctttcagcccccagaacatgtacagagagtggcacaaacgtatcacaacatcggtgccatttctgcaaggggttgagtgacagaagctttgcgaggatctgctttgcttgcatataaaaagggtagctaagcactgagatgagccttgcagcaacacacctagtcattttacatgtacagttagctaccccgctaaagccgattccataagattcatcacatttcgatgtgagtcgcatatggatcatggcataagattccacgacgcaactcgagttacagaagaaaacgaaaagaaacaaagaaaaacatacatttttatcacaggaagctaggctcgccctacaggagatagcggcggccggtgtggcacatagcttgcctgagctctaccttgactagctgccatgatcttgttgagcttatggtcagcgagggatgcgtgctcttgcgatgcgtgcacacctgcttgcgtcctggtagggcgcctgccgtgaagcatcactatacacatagcaaaagcctgaagtaaagcaatggatgatctgaattcaactgtgtataacccttctctgaatgaaaccatactgaaagcatgcttgtcttctcgtgatcgaccctacaaatacagatttatataagcatcaactgattaggtcgtcatagattagatacataaggacataggcaagaacagagaagcacaaggacgcacctgaacaaacaagtcaaaccgttgacttccatccgtcgtctggtttgcttgagtggatttatcacctttgttttctcgggcgtcatcgctgaggacactgagcatgcagccttcatcccacccaccacagtcacacgctcctcctgatttccacctctcaatcagaggtagtggctgtcctgaggttgatgtaccatggaagccattaggaagtacggcaagaacactggatgatgcacaactatcatccctcgtattaggatggaaatttcccaatgggcaagaacagtcggttggtgttgacatgcttcggctggaatgctgtgaggatgagtgacgagaagtttctggttcttgctgagacaccgcactaataaaagccgcaaactctctgctaacatgtgaatcacctgattcttcagaagatggtagctgctctgagccaaccagaacaaattctctatgcaaatggtttttttctgcctggtagcatcttgattttcgatgtgaaaccctcatttccccaacaatattataaacaagctgatctttcttgttcttattacctgccttgatccaagccccacctcttttcttaggttcttcaacaccaaacagagtgtatgtgctctccagatcattgttatcggagatgcccttccttctcacggtagccaccaggatatcagaaccacaagaaagcatgaaaaaaggcaggccattcttccacgctagctgcagaagcgcatgccttgttgttgttgaatctatatcttgctggaggtacctttcactgttcaggacctgaggaggctggtttgtattagtttctgttcggcaatttgaatttaccactgaatcaactgacctacgttgaacattctgcaaagcagatcctcccaagctcagagattgcttatcaatatggccaggcagatgacactttggaacaaatgaaggttgaattggaccagaagtggatgactgacgtggctttaatattggatctaacatcctcctcaatgggctgcgtctactgcctttgttgcctgatgacttatctccatttatcttatccacagaggtgcttgcttcaggttgtcgaggacatggtccatccttcaggcttgaacagcggttcactcgattcagtccagaaacaagatgtctatgtggtgacgcatccatatcactgaactttgcactgatccgaggagttctctcagaggcacccctggaaatttgcttttggttgcgattttcacctatagttacagcagcaccaacagaatcaccttgagtcccagttctgctggtgccaagctcttcagatgaatccatgataggaagtggacatgagtatggaattcgaggaaattcatggtgttgcccaatatcttttgagaaaccaacaggtgacaaactggcatttctttccatttccatcaccgcactagacactagagtctcaaaaacctcaccagtcacgccactgctctgctgaaaatcaccacatgcagaatcattgttatgtgaggtgaagaaactttggccaatgttatcatcatctgtaaaaagcctgcgcgaacaatgatggacggcctcctctatattccttgtagtctcctcatcatcaaccatttcatgtcgcatggaactcccagtggcagtaagaagagggtccgagagtggagatatgtttctgagattcaagtcaccgtatttgccagtgttctctggaaagtgttttccatgaacaggcaacaagttcaacactgcagaatttgggctaggtgaatatctggccttcccatggtatttatcctcaagatcactttgctgaaactccatagaacaatgctgatggtcattgagtgtaggagattgattgctttcaagagatttgctgctgggacttgcagatgactgggatggagaagagaatatcagggacctactagtattagatggagaggcaccatggctgctagaaaactcatgcttttgttggtgagaccacctggctaggaggccccactcgagaactccaacattcaatgccttgtcctgaagatggcctgatgtctctttacgctgcaaatatgaaggaacatttgacatatgcttgacaagctcatcaaccgtagtggcctttcgaccaggccatggttttgagcctttcaaggatccacccgcatctgcactccgaggttcccgttgccttcgaaacttctcatttttcacaactctgattctatcttcaaattttccatcaatgttcccaccgactactgcaatcttctcttttggcacttgtacagattgatcttgtgaatttcccctttgacgtccatcacgacctaatgtggcctttacattcctttctctgctaaactgtcctttcgttggcatctttttttatggtttaacatacgccaacaagcagagcttttcacttgattcaaattgaatcgtcaagtttcaacaggatactacacttccttgaacctgcaacttcaatattagcagaaaaaaactcagatatgtagcttctgatatttccaccagagcactaatgaacagaaagaaaatagcaggcagcaccacagaaccaacataactacagtattgcagtatctcaattcagaactaagtatttgtcggtggacaatggcatcattttgtctcccgggaatcctggatttatgaaacattatgtttctacatgtacttagtggggttgggagttggccaccgacagttttgacacaataatgttctaattaggatatgtcaataaccatgcaaacaagactgaaaaaaaaagggctcccactaatgataaaaggtgcaaataattatagatatttgccctgatgctataccgtgtgtggcttgtatataaaaatagtttgcacattgttaagggcccagccatccataaatagttcagtcagtcctgataaatgtatatcaactatggctatggggcatctttccccgtttccctcaaganaaagggcacctttctccacttgattttgttgggtggcttacaaaatgaaaatttagccgtgcaagcctagctactcacaaaaaaattaaaggtctaactacaagcaagaggggaaaaaactaaagttagttgcccggcaaaaataaaataaaatctggagttgcatagacaacaaatattttaccatatggattaggttgaaaccattttttccctttgcaaattagcctacaaaatgcatcatcatcaacgatggtcgttatagcggcagaacgggggaagttggagaaaacttgctgaactgaataagatggaacaccagctgcggcattaaacccaacagaaacccaccactcttcagcatctctctccaatcgagccaaccaaccacattacccaaacattgaaacagaagaagaaaagaaaaaagcacacatacgacgaagtcacgaagataacataccaagatgctcccaagaaccacttcaagaacagtccccccagctcatcgagatcccatatggaggtcacgcacccgcagatccgccacctccccta

SEQ ID NO: 57082 - DNA, 13071 bp, Oryza sativa
acggtattcttttacttagtctttttagtgttaaagtgatctccattattgggtttcacacttaataactgttggaaaataacgtactgaaaacctatgaaatcaaatgtatgcatgctgagatgggcatatttaatttaattaaactttaaataagaaaacaaaagcttttacttattcaccatctggaaatcaagtcaccgaacagcaaacttagctattgatgtaggaacctcgctgctgcttcataacaatagatttccagatggcatcatttgcttaaagagcatcggtttgcgttttgtttcagatacgtgaagaaccaccatcatattcaacatcagttctacagaaacgtgagtcattcgaaaacccccttgctgggcgtggtggtcggagttttggatcccatgaggacgaagacaggagttcagggaaccctcaatctgggaaagcactgtatgacttcacagcaggtggcgatgatgaggtatggaggctgaaattgtcttggttggctataacgtaacatcctgagcttcaatgcttccttgatcagagcttgataggcattagctgttgtgaaacatagttatttcagtgaagcgaacctcgtgcttttcatttgttacaagaacttaatatcttaattaattgagatagctttttaaatttatgatttgataagcgagttctgtagtaaaagagaagaccaaatgaaagcacaagtaaattatttgaagtgattaagctggctcttatttcttgtcttggaatgcacacaaaagaaagtttatccatgtaaatttctttcagttgagtttaactgctggagaagatgtggaaatcgaatatgaggtcgatggttggtactatgtaagttctcttctcactttctagtttttcttgttctttagtcatgcgcaaaaacattttaatattggttattattgctgtatcttcaggtaaagaagaagagacccggaagggatggaaagacagcaggtctggtccctgttctgtatgtgaattcgtgatagctatgagtcctgtgacataatgctctcgaaagctgattcggagtaaacgggcatacatatggcgtctggggaggttccttctgtgatcttagtagtgcacataaccttttttgagctccctagcatttgacaggcacatgtccttgttggaggccaaattcaatcatcgtgatgtctgtaagacgcagcaattttcttgctggttgtgtttctttgctttatacacaccacgagtccattcaattcattgtttatgtgtagagatgtacacgtgcttcggggttttacctttcgtgtgctattctggcccgtctgttatgattgaaagacgcagtttactcctctagttctccatcagataggcattattttgtcaaattgttgctctattggaggctgtaaactgctgaaggctgtatcttgctccccaccattatttcggtcttgtttatggtgattcagtagaagtagtaggcctgttaatttgtgtaaattttgtcttgtgcggagtatacatacatgaacacatacgacaatggaatggtatgcgtcgataactttcttactctgaacacttaatgcagtatacgctatattctggctatttttatggttttcgattcctgtatgaattgattgttgtgaaattcctggatcacagtttcaaaatgagggctaacatcccgtaattttgttttatagtacttgactacttgtacagttgtactaaagtcggtactcggtagcaacacaaacaatgcatcgatactccctatgtctcgtaatataggattttgctccttccaattatcccacaatataaaagattttggtgtaatacttgtcacatcaatcaactcaaattcaaatttctatctattttaaccttcaactatccactcatccataaacaagggaaagtgatttcatccctcgaggggatatcctctcgtttcgtgcatatcacctaaatagctataaaaaatataaaaaaattggcaatatagattaatatgaaatatatcactccacaaacattgcaagtttaaattgaacttctacaagttacaacaaaaataacaaatatagttgcgaatgtgcgataactattctcagcttaatttgttatttttattgcaacttgtagaagttgaatttggtctttcatatttgtggactggtatatttcatattaatctatgttgttgttgacgtaaaacacgaggcctgggagatctgcttaactccagtgcaggtccaaagctcgccttcgggtgtgttagcgtgccagttgatttgattctacaatcaacaagaaatagaaacaaagagatcgcggttaaatctataaatgatagctgatcggctaagtgccgatgacatatcatttatctttgagccgatgtcatatgtaaatcgatcggcgactataaatagataataaagaactaaacctactcgatcggctgtagatattaccaatatatagttcttatatcgatatatatttaaatcaagtgattgagatagatcggtcgccatgccaagacagtataaatcacttggatcaaactatatattaataacaggactatatatgtttatagcatagccgatcatataaatttagcatgtatcggttaatactccgatactactctatatcaggatattaaaacaagtataatatatcaaacaaaagcttgatatacttaaatgcaataagatcttgacataaagggcggatttaacatgtcactgaagcatatagagcgaatatggttaaatcagataagatcggctgaaactccgatactaccctaatcggcaaccagaaggcgggctagagattgatattctaagcacgacttaatagatcaaactcaactgatgcagcattaagtatgaaaagaagaacaatatctagacaatcaagccgctggaagtttcatagagtggtagatatcttatataatctaaatcaacatcaaaatctaacctaatcggctgcgctctactaacagatgttagccgattgtaggttagatagcgatattgcaagagattatgtacgatatatgataactcgatgaattacgtaaacaatattagagtatcataaagatggaagcactaatcccgagaatacaagccgtcataacaagttttacctcttgttgaagatcaaaaccgatgcagctcaacccgaaagtaagaactcgtcgaaataaaactaaagcaaaaaggtggcgatgcgccgaaattgtattgaacgtgtgtgtgttttttattacatagggctcggggtctatttatacccgagaattataagatatgtccataccggacacgactattatctctaacaaactctaagataccataagtctttgcggcagacttttgccctaaacatatctctaaggaaattacataaaacatcctaattaatagatataattaccttttcaggactctatccacgtgcggcaatcatcttgaagcatatcaactcaaacccaatgttggatacgagtcatattgccggaatcggctgtatcacctaacccagtctgattcagatttagccgattctagtcgtagccgatctggactccagccgattcttactctgttcccgcaacaacccttatctttggttccgcttcgatcccatgttcacccccgatgctgatattaccaaatttggtcgttaacagttgtcaatgtcttttaaaaaattttaataaacaacgagaagaagtcccctcgagaaataaaagtttacgtcccacaaacaaatcttatttaataagggcattctattcttgcttaatcttattcaaaagagaataatccttgggagtacggagtactgcactgctcctaccttctgcaaatccaatcaatcgcgggttaatatcccagcacaggtcctcgtggacatcgtcgtgttgtcgggcgcgtgttcttgtgagccagcaatctccttcgatctgcgcgccatcctccccgatcgtgacctgcgccatcctccccgattgagactcgcgccagcagaattaacaatcaaggattgccttttcttccacagaaaaaaatcgccttctcgcgggtgggtggcagggtgggtatacgtacacgtctccgaagccgcaaccaaaaccaggcaaccagcacgcgatggggaggggcgagcaggaggcggcggcgagccatgggttcggtagcatggaggagttctgggggttctacctgacccagcactccaagcccggcacccggcggtggcacttcctcggcacgctcgccgcgctcgcctgcgcgctcctcgcggccgtctccggccgcgccgcgccactcctcgccgcgcccgtcctgggttacggtatggcgtggtacagccacttcttcgtggagggcaaccggccagccacgttcggccaccccgtctggtctttcctctgcgacctccgcatgttcgccctcatcctcaccggccgcatcgacgccgagctcgctcgcctccgcctccagccgcctcacgacgccgcggctgcctctgcacaccgggactgatccgccgaagtgctcgcgatagcaacatctggaagtgttgatgtgtactccaccctgtaatttgctaatccaatttggtactttttttttgttgcttttatcattttcctcgccgatctgttttggttgcggggaaagggtttggataagcagtgtatccaaaattagtgtggctaggcagtggctgcttaacaaaataatgaccagctactagaccataacataataatgctgtttttatttcctgtaatacttgctgcccccaaacacaaatctgtgatcgaagcacaagttcttgggagtacaacacggttaacaccacaagaaactccttgcagaacagtaaagatgcatgtgtcctatgtgaataaccaagtgtggcttctttatatgctggtggaatgcatacatctggctgtacgtgtagtcatgtagagcgcgcgttgctcagctgtcacttctgttgggcttgtctgacgccggatacacctgaaaccaacaactggttgcttgcttactgatgcttcttgaacagaatttcaaccaaactctgttgataattgctgaagaacaggcatgtatacagcattggacaacttaaacaagtacagttaccgtgtcagctgatgggatccactcgtttgtagcaggatttcccttgcaggaggcatggcgctccgatgcatctgggtcatcagacagatgaaacgaggcgtccgccgagggcttgtccatcttgatgaaccctgttccagtctgcaggatattgacagtgcacacacaaattaagatcataagtgcactgtgatcagttcgaattaatggatggaagcatgagggaactaggcagcgacgttacgtaccgtgtggtgctgcttgccgacgcagccgagatccttgtagtactccgtctccacgaactcatcccctgccttgccaccctcgcacaccaatttctgcagcagcaaaccaccacgtaataacaccgtaagatcaactctaagctttcgtgggacacatatatgaaagtgcagttgagagttgggactgggagacctcggtgtgggcttcgagctgctggaacctgtcgagctcggggtgggagtcgtcggggacgagcgcgtcggtgtagacggcggagggctcgctgcgggagggcttggagtggcgcttgggcgccgcctcgtcgtagtactcccgcacctcggcctccatcgccgcctccccctccggggacaggtgcgcgtcgctcctggccggcctcgacatttcttccgatctttcgcgcgaagcgcgctgtgccttcgttagctagcgctcgtgtaagcttcaagcagtccaaggacgacgaggggactgtggtgcgggtgctcgggctatattggcgtgatggctgcgtggtccgcgccgcgggtggatatggacgagatatttttgtgacttctgaggataaatatctgcagggaggtgtagaggttggtgggtgggtcgattggcttagcgagaggtggacgtgcgcgtgagatgccaggaggacggaatttgaccgcgcgcgcggtgcatctcgcggcggcgcgcgtactcgggtgttcgtttgcaggcccggaacgtcgcgtatgcggccgaaggcccaacaacaaagtccccgttgataactgggcccccgtccgtttcctctcctcggccgcatatctgcacaagacggcaaacaccgcccactcttgcagaattcttcctctccgcttctctgctcatctgctggtggtggctgcagattgcgctccgatggcgcaagcggtgcggccgtgcaatggtcggcgcgtcggtcgctcgcctttctctactcgatggtatggcttatcctagttcgcgcgcatggctttgattttgtgctggatgttgcagccacccttctcgcgcggctccgtgacggcgaggcgaggttcgagctcctcgaggactccgcggccgcggccgcggcctcgcccgctcctgctccagtttggcccggcctcagctgcttttctagggttgctacctccctgtacgtacggctggtttccctttctcctcctctgctgatctttgtgtcgcggtagggttgtgtgtgattcgtccgggggattgcaggaggggcgggtggtcgggggcgctgaacaaggtggagcactacggggtccagagggtcacgggtgatggccggtgcatgtttcgggcgttggtacgtcttgtcctgttcaattgcgcattgggaatttctctggattctcaaggaaaccctggtgtgtctcctcgtaggtgaaaggaatggcaaagaacaaggggattccattgacctcaagggaggaggtacaagatgcaggtaacctgcaattatgctttgttcatggataaatattcacagttgtttgagacagcctgtgcagctgagctatctctagagctttgaatttacatttacgaaagtaactgcaatagctctgaggaaagtatatttaggctgtgttcgtttgtgtgagatagggtgagaaaacaccttgttttccgcgcgcacgcttcccaaactactaaatgatgcgttttttgcaaaaattttctataggaaagttgctttaaaaaatcatattaatccatttttgaaatttaaaatagtttatactcaattaatcatgcgctaatggctcatctcgttttgcgtatcttcccaatcttctcaatcccctatctctcaaactcacccttagatgctaccgtaatcttttgatacataaatcattttttaaaattttattttgttcagcgcactcctacaacttaaataatgcttattcagaaaacagaacatccactacaaaaaggagggaaaacttgtcaacacaaggcatataaagagagagctcctattattcttgtgagattcgagtagcccacttgtccatcaattgcataaattagactgcattgcagttcttatctttggcttcaaaacaactttgttaaagcatgcattaatttaggatttccatattgttcgttccatggcagaagttttaacttctgaccgtaacttatgtaggaaattaacctagctactgtttgaaacatcaagttagttaggcataatttgctgccaccactgttcagacatttcttgttggcacctcaagaggtcattgttttggtcgaagaatgtctagaacagaattcttgcatttaagaatgcatgtttcctaccagtttcgtctcagtaaaactgtcattgctgaaactgtctcagtaaaatgttccctaccagtttccatgttcccttaccagtaataccacccccctatgtgccactttcgcatatgtgacttgtgacgtgacaaaaagataaatctggagtggcaaaaaattaaatgttccgttatccagggggcatttaaattttttccactctgcaccaaacgagtttaatccctctcacaacatcccctcttacaaagtggcaaattcccagtatatcctctctacccagcagccttgtcaagtatgacttttcatgagcaacttcactctccaaataaacttatgacactacccatctttcacctaatgagctgaagattttgcgcacagatttccattgaagttcgaagtttgaagatgatatattattttaatatacttttgtgttgatatcctttttcaatttcctagatgatttacggatggcagtaaaagaagttatctgcgatgatgagactgaacgacaaaaatatgaagaggcagttatagcaattactgtggatgaatcattgaggcggttagattcttatgtcctcaattcatttttatggcatgacctgtgataaagaggctgactatcctggttttgcagctactgccatagaataaggcgatctgatttctggggtggagagtcagaactcttggtatagttttcataattctaaagttagcatgcactattaatataaacagcaaccatacatcatttagacatatagaacacctgtttctagtatatgtatcatactctaaaaaaagtatgtgcaccatgtttatgcatcgctccttaagtgtgccaaaaaatataatattgtttgatcgtttcgctctgaagattctaccaaaagtaggtttacctgtttctagggatgaaactggttcggatagtttccgtccatccgaaccatttttcggattcggatagtttcggtcggaattattcagaaattttcggattcggaaacgaattcggatattttttctcggaaacgaaaacgaatacagtaagggtactatccgtcggaatcggaaaacgctcggaaactatccggatttttttttcggatatccgcagacattgagcaaattttagaaaaaacacgtatatatttataactttttcatacggaatcagatgaagacaaactttatatcaacattgtagagctcgatgagatctacaactttattattgactattttattatttgaggtcatttaaaggtctaaatattcattataatataccatattaatttttacaaaatctcggatctacaattcaaacgacatctgatggagatgtgttccatatcaaaattgtagagctcaacggatctaccactttgtagtttataacatttgtatttgaaagcatttaaagtataatacaaacattacaagtttcgaagatgtgaagtaaaataaataacatctccaatttatacactggtaagtaagttatacatctagtaaaaggtcttgggaatagaaaatgataatcatatttgcatatggatctcttaaaggaacagccatgaaaatcgattttcacatacagttgtgggaccgtatacaaaattgatgatataaatgttggagatgttgaactaaaataataagcgatatctcttcctttatcaagaacctcaatttgaggggttttttatataccggtaaatatttgctaccgtattcgttccgtctcgtattcgctccgtatctgtattcgataatatccgatttcatttccgtatccgagtttttgattccgattccgaaaaaaaaatatgaaaacgaatatgataaagctagtttccgtccgtttccgatccgttttcatccctacctgtttcatagtagagtgtaagggcatctcttgctttgtatcagtacatatggtcgtttcatacaaatctattctacatctgacatattgatgtttcaggttttgtctaaattgtgtcggcagccaatcattatttatattccagagcgtgaggtaagcctctatatacatggataacacatatacatgaatgtgtgacccaaaaatgtaaacatgttgtgaattgtgccttaaagaagagagtatttctaattaaatctatctctagatggttgcaaaataaatgttgttttggacattaatatgagaccataaccagcatttcaaagagacagttggcatatcgttgaaggcaaaatgggtgtcaaaccatgaattcgtactgtttctaatagactttattgcaagagaaaaaatagacaccagatattggtagaccaattaattttaggaccttccgtcaccatgcaaattagatctgggaatgttaaagtaccgagaagacagctagaataggcaatgtgccaaggtttacttgtgcttcatgatgaatggttgagagtgagatgatctgctaaagtgattccaaacatctggatttcattctatatttctgttatcttgttgtaatgctctgaatcctaagaggttcagaatttagatattttttaggttcagaggaaaaaaaattacagaacataggaatgcatttgcaactgatggatggaacttaatgaaaatatagtgaacgtctgaatgcttctctttgcatttttcttgcttataactgacccatcctccagtttggagttgctagttggatgtactcattgcactattgtctgtttccttgcaaacaatcttatgttgcttttctttcatagctagcctttacaatcccccatttcagctgctcgacttacatctttcctgtttgtgtaacagtaccatgggcgtggaaatggttttattcctatagcagagtatggactggaattctccaaggactcaaaacagtggaagaaaaaggtgccagtaagactgttatacagtgggaggaatcattatgatttgctagtataacatggttgcaccgaacgttatcagtaccctgaaggtctgaactatttatgacaactgattttgattccatcattccattgttattctttgatcccacgtagttttttgcttgcgtctctgcagacagcttcgatgctactccatccattccaaattgatctaatatagttttttttgaagttattcttaaatgatctacatatttgtgttcatttattgagtattcgttatttgtacattggagtaaatggacattgatgcatgcatctatgcacacaagtatttataacccacatgcaatatcttgatttgctattggctaagaaatattagggatggtgtatacatcgagtttgttgctagagtaaatatagtatgagagagttattagcttttcttggtcttggtgtacctataaaatatgtagatcaatttggaatggagggagtatatagctaactgttctacctaggaaaaccacatatatatagtagaaaactgaaaactaccgttggatcaaaaaataaatgtctgagatttgtccacgtcattatgagtaaatctgcaagtaaaatttttactcgcgatgacttggacaaatctaatatgtctattttttaccaatggtactacatatgtggtttccaccgtatattttcccgttctaccgtatgaaatccattggttccatcttatctgaaaaacttccatgactaaaatgacactaaacctaataatgtcgcatgagctaattacttcctctgtctaagaatataatagcaacctagcaaataattagacacaacctagtacaattaatctggaccggagagggttagtacattattctcctaagttactatatatattttaagacaaaggagtaggttgttatattttaggacggataaagcaggacaccaggtgataggctagtgaggtcatttggcatctaggctaaggttgttccccatcctagtgatgccattcggcatttaggctaatgctgttcgcagttcgcctgtgattcggttggcgtcacgccgtcaagctgttgaccgtatttccggttggtgccgggcatcgtaataatggcgtgttcgtcggactcggtggttgccaggggcaaagacgatgagaggacatgcttcaaatcctattcttgtgtcgttgcaagcctggttgaccggaatcatgttcttgttggatgagctgtgcgatgcatctactcctatatcttgccatatgttttgttgaacagcaacagcgaatgttttttcccctttgaagcttggttcgtttaatcctaagagaaaaggattgagagaaaataatttcacactacaatacatatgaaataaattatttccaaatccccttcaattctcttgaggaagggattaattgaacaaggcttgaatggggtaattcttttgttgaatcctacattcctattatatctattattctctttgctaaagtattggggaaaaaggttacatttttaaattggttgcaacatattaaaaaaaacgtcacgctatgcttgccaagttatgatccagtggacgaatggtgatgcccaccagcagatcgtacgttcctgacccaaatcacgcttaaaagcaagagttgctaaaacgagccgtaggtgtaacacaggtgtcattggagtaaatgatgcattgataccttgtccgtttgctaagctaagctagagctggccacaggccactgccgtgccaatgctactcgcctgctgtgatgggcccacaattcagcgtctcaccatcgacgtagaggaccgaactcggcggtgcacgtatcaatacaagaaatcgtcctttctctctgcaatgttttttttttcgataaaatggagagagagtacccttccatcctataaaataccgacataatatttggatacacatctatctagatttattatactagaatgcatcacatctagttgatttattgtttatgagacggaaggaaaactacggtgtactgcaatgcgctatgcagggcataatgtgctgctctaattccaagcaacaaatgccaatggaggagaaggtacaaggggatagtccgacgaggcagccggagaaggctggccgacgtcgtgggccgcaccactacgcgatgaaagtatctgtcatcacgccatcatccactgagagcctggcacgcgggccccatgccccgtcccccacccccccc

SEQ ID NO: 57083 - DNA, 3988 bp, Oryza sativa
cgatgccatgtggaccccctcgtctccgggaccccacttgcagcgagacgagtggccgctttgtaagcaagccgctgcgtgcgcgtaggctaagccgcacggggacaccactaatggcagtaataattgcgtatttttgttaatgagcgctgcacctcgcggggcccatcggtctcactgacccgctctctcctttttcctttccgtcgcggcaaaagtgaggcggcgtcgacgcgagttgagacttgagacgcccaaaaaatcctcaaaatcccattgctcacccgcgttatataaccgcggccggccattgggagggacgccgcgaggggtgctcgtttcagcgcgggaggagatcagatcgggctcagatcttccagctcgccgcgccgcctccgccgccgcagcaggaagagagagggtgaggagaggaggaggctacgatgtttagcgggacgcagcagaagtgcaaggtgtgcaccaagacggtgtacccgatggaccagctctccaccgacggcgtcgtcttccaccgctcctgcttcaagtgccaacactgcaagtccaccctctccgtatgtcccctcctcctccctgatcgcgcgcatatatgctttttcttttttctttcgcttcctacctgttcttttgttctggaggtgaaaaaaaaaagcagaagagggaaaaagacgtttttatggccgggggaaaagtaaagatggatctgtaggatagtgcaatctgtaatgtcgcaagcagtagtagtagatctgtggattgatgtcgtgaatggatctggtgcttgggttttcctgctcgaatttcgtgtttgagagatcatggttttgtccgtttcacatctgctgacttggtaaaagaggatcatgagaaaagtcggcttttgattaatcagttaggagtagtcgtgcttgttcaggcaaagatttgcgtcagtctgacaatcgttctggttatctcgctttgcgattttacagcttggcaactactcctcgattgaaggagtgccatactgcaagccccatttcgagcaactgttcaaggagaccgggagctacaacaagagcttccaatcacgtaggctactattgaattccaaaattgcgaacattgacaacctgtttattttgttgataaaatgtgttatgaattctgatgctctggccctgcttatttgttcaattttatgcagccgcgaaacccgcatcggagaagttgactcctgagctggtgagtgccattggctgcatgcattgcttgtctgttttcattccaaagtacttctatgtttctatgtgatgctacctcgcttttcaactaattttgtctgaaacattcatttcagacaagatcacctagcaaagccgcacgcatgttttcagggacacaggagaagtgtgccacttgcagtaaaacagcgtatcctctagagaaggtaatgccccataatttctgctcttttcatcttagtttcatactgtagtgttgttaggtcatttcttccaaaattgcattgttagatgttgaaatagggatgaatgatcagagggatcttttaggtacattattccgcctaattgtattgttctactgtaacaagttgtaaggttctgccttgattgtacttatttaccaagaatttatttcaattatgctcctcaagtctttggaacatgcagtggttgtgatgataagcttttatttgcaggtgacagttgaaggacaggcctaccacaagtcctgcttcaaatgttctcacggtggctgtgccatttcgccatccaattatgcagctttggaaggtatcctatactgcaagcaccatttctcccaacttttcaaggagaaagggagctacaaccatctgatcaaatgcgcatcagtcaagcgcgccgaagcacagccggcaccaccaccggccgctgcagattcctcctgaatgtaccatatctccagtgaggcttgagggcgaaaattcggaagccctctgttttacaacctgcttgtatgccatgttccagttctgaggataccgggacctatcaatttcgtgtcctctgctgtgctagactcgatcacattggtgaaccatgaatatcatgtccctttcaaagaaatcgttgtgcaagtactgatataccgtactctattttgttgattgctttttgagcgtgtgtttatctgttcagtcgtcttgctctcttttttttttttttggggggggggggggtgggggtggatttttcataaaattggtatgcggcactaacgatcatgatagcgtcgaaagaacacgattcggtttattagccccgaaaattatctccatttttctttttaacattttggcggctgtcatgcaaaattgcgcaggaaattagactagttagtttaatatcaaaattggccacatttgagtattactttttgttccccgactgcatggtaaaaagaaagatataaatatacagaaatacttctgaaaatctactgacatgattttcattttttttccatacgttaacacacgaagtttaagaacctctcttaactgctagcgttccaaagcaagaaaaggacaaaccgcattttaaaacaaactccatgttattttcaaggaccaattaatttgcatatgtgagtgcattcgatgatcatgtttacgctacctccaattttgttgaaatgtgtgatagtagcttaaggaggtagcaggacccaaagtgggtgtgcgtatccacaagtgcgtgtaattgtgttcaccttgtactaggggaaaaaaaaagaagagcaagacggtatggggtaaactgagaagaaaaaacggagaaaacctctatttcttaaaatccctttctcaactcattttactcacgtccatgctcaccacaaagaaatgaattcgcagtcaaacatcactaaaataggtaatgctccgcaagttcatccactacacctacggaaaaaaaaaatgtggtgcccaaatgcccaataatacaaactgttcccctcccgtttctttggctgtcctgttccatgctctttgccgagccagaacaaaacacaattgagcaagccaaccatggaaagctcagcacattaaggcaggtcaagatggaacctgcacctcatgtacctacgctgtaagtcagcttgtgcttgcggtggttctccaattttcccctgcataaacaccgtcacttccagttcttcctctattctaagcagctgcagagaagatgagcacgataatcagaaaccatcccatcgacaacaaaaggctattgtactatgacttatcaatttctatagcagatgccggtgtgcaaatatgtgaatggtaatggtatatttcaaaaccataaaagttgctctggcatgaatctaactaacccaaaaaacaaacctgattgtatttactgagacattctccacggcaaggagcacccgctttgatctgtccagcagcagcaccaacagccaagtcagcaatgaaagaatcatcagtgtccccggacctatgtgacaccattacgccccaatgagcatcctttgcctgtctcacaacctctatggcttccgtgacagtgcctacttgattagcctgcatatcatacacaagcacaattcaggtatatactaaatgacctttgaggttgagagagaaatcagtgatcaaggaagattccagaaaataaatacttcatacttcatttgcatgcaaatatcgtttgcacctctatgtctacaacatgctaaaagttaaaaagtaaattcctccagtggatagttaatcttgaattattatcatattaatttatgtaaatgcctattcaagtactaaatgccaaacgtgtgaattgactatttgtatgctagcctattaacgattggttttcattgcattgtttgtaaatgccttagaaatcaactcatatgacacaaaacttgaactataatcaacactgga

SEQ ID NO: 57084 - DNA, 7170 bp, Oryza sativa
tctttctatccttacccatgcaaaaatcggtagcggcgacatcaattgctagcttgatccttccattatatccagctctatttattgcctcaatgacaagatccaagccttcggttatgctgaacattgacccaacggatacggcacattgatatcaatatgcaggtgaccaaaagggaaacaataatagaaccacaaaaaggtacagacgattccttacttgcctggaaatatttggagcaaatccaccatcatcacctatgttgcagctgtttgaaccatatttctccaagatgatatcctatcaaatcaattggtaagaagctattcacgaagatagtaagcttctcttcgcactataaaaacaaaattttggaacatctgaaagaataaatttatctaaggaggaatccacccaaacaaattaacactaatcagagtggacagaaagctgaaaagggcatcaaaagcagaatacaatgccagttaagttttgtggacagaatcttaaactatttgaataacaggttggtcaacatatcagagtggagcagatgcatgccatgggaaggtaggcccagcatgcaagttatagtagtctagtgatagtaccttcagatgatgatatgtctcagaacccatctgcattgcttcttcaaagtttttggcaccaacaggaaggatcataatttcctataaagaagcaactttacttgcaggtctcaaaaaaaatatatgacaacatagcaagatgttgatctacctggactatcttaacatgttcccagagaaaaagaaaacttcaaacaatgaaagaaacatgggaataacaaatttaaactttgcagatttcttaatggaatctgcagaaaagagtgatccagtaatttgcagagaaatgttggctaagaaaggtaattctacaggtttagtgagaatacttgaatagggagactgtttccagcatgtgttcctccattaatgactgtaattgcagggatgggaagtgtcgtagcgcttttcccaacaagttctgctatatgcttgtacaatggaacctgcacagaaataagcaaccaactataagaatgcattgccatatccaacaccttcttttaacccagaaccgtggtgattttatacagaactattacctctttttcagcagcacctgctttacaagctgcaattgatacagccaacatagaattcactccaatctcagcctacatgatgcagtgtcaatagttattaaagcaggacaattacaagcgatagaagctgtactgagctggctgctacaaagttaggcttgacagtaaagtgagatggtagtaaagaggagtagacattaaaaaaaaattatagaaaacaacacatcaattattttcatcattaaatctacatggaacaaaccaatgttaagaactgtcatgtggctgattatacagatcgatcgactgtttgtggtaaagcacaacccttgaataatctctcattataactctcatcaaatagagctcagcaatgtaggatcaggttaattccatagagtgagaagagatatcgattggggttttagggatttaccttgtgatgcgccttgtccaagtccatgatggcctggtcgatctgcgactgctgctgcggatccattcccacaagcgcctccgacaccttgtcgttgatcacccgcaccgcatcggcgaccgccctggcgagcagcttccgcttctcggcgtccctgacggcgtcggcggcggcgccctcgggggcgtccgcggcggccgcggaggcgcggtgcacggccttgttggtgtggaggctgacctccacggcgggctccccgcggccgtcgaggatctggcgcgcccgcacgctcgtgatcacggccggcgccgcccggcgcatgtggttggagatgaagagcaccgggtcgggggccttggcgcggaccgccgcgttcacggcctcctcgatcttgcgcgacagcaggtgcttctccaggtactcctgcaccgacatggctgaggctgcggcggtggcggcggcgtcccgcgctgctcctcctctcgccacgcttcccccctctctctggctctctcctcccgcgccctctgcctctgctcgtcggctcgtcgcctccagctgccgggatcgctaggccgtggacattggccgaactcgaggaaggggaggctcgagacgagaagtcgagagtcctcggaccagtgcgtgcgtttgggtaggcgtgggccagtttcacgatgggccggagcccatttgtgtaagcttgtaccatgggctgagtacacactgtgtctatgggccactgactaggagaagcccagcccggtggtcatttccttcccattgtcttcaaggaaaaaaatcggatcaagcactccaattttggactggaagttgctggatatctcgagtttggaagcagagaattaactgcacttgagtcagtcactgatatgtgggccccattttactatggcccacatatcagtgactcaactacacagcagttaagtcagagcatcctttccctcgagtttgttctggacgattcgggtcgtgctggtaacctgaactgttccgttcgtaatctaccgagcccagaaccaagtccagcattttcgagtctatccaggaatagaagagaactatcgagaagctgctttcctctccatccttatcattcccccgccgcatataagaacgccatcccctcctcgacagatatccaagcaaagcgagaaaagaagccagcaatcgaaagcccaagcttccaaaaatccgcttccaattcgcgaaactacactagtcgtaagcgccaaatccaaccgacgatgtcgctgatccgccgcagcaacgtgttcgaccccttctccctcgacctctgggaccccttcgacggcttccccttcggctccggcggcagcagcagcggcagcatcttcccgtccttcccgcgcggcgcctcctccgagaccgcggccttcgccggcgcgcggatcgactggaaggagacgcccgaggcgcacgtgttcaaggcggacgtgccggggctgaagaaggaggaggtcaaggtggaggtggacgacggcaacatcctgcagatcagcggcgagcgcaacaaggagcaggaggagaagacggaccagtggcaccgcgtggagcgcagcagcggcaagttcctccgcaggttccgcctccccgacaacgccaagccggagcagatcaaggcgtccatggagaacggcgtgctcaccgtcacggttcccaaggaggaggccaagaagcccgacgtcaagtccatccagatctccggctaggcatcgccggcgtgccgcgtgcgcgacggagaggagcacggcggggttttcgctttggcctggtttgtctgtcgtgaaggagcaaataaaatcgggtccggttgagtccagtgtgtgtccgtgtctgtcttgaacagtcgtgtgtcgcgtcgtgtcactgggtcagtgtgttgttccagtgcgccgttcatcagccgatcagcgtctgtaccggtcttttgcaactagttaagtgatgaatactataatctgttaatacgtgatctgtctgatgcattctgtgctttaatttgattgagtttgggtattactacctgacaagattagaaaccatacaagcacctttcgaatttcgtaactctcactggcggatttaacccctctagccgccaatgctcgttgccgaaaacctaaagtttttttatatgttttcaatgattgaagagtttttctttagcaatatatagaattctgttttttttcaatgatttaaaaatagtttttctttagtaaatgctctatatagctagaggctaggtttgggttggactttttctgtatctatctaagattatggtagcttgcagtgactttagaatattactctctctgttccttaatatagggcgtggctgttgtagttgcaaagaccaataaaaccgtttaaatatcagttacgctgattaattctctctgttcgaagagcgacgtttaggtagttgcgcggtagatacgctagcattaaccatcatgcagcgtgcgctcgacctgtactttccgcgcgaatagccagcatgcatgcagatgcatttttgctagcgtgctttgctcgcctggcataacgccatgtatggattgttttgattcaaaaatttggaaagccccatgcatgcatgcttgatcgaaaatttggatggcgccatcagcgataaaaaatgaatagaaaattttcacttggcgccactatttgccagcaaaattttctcctataaatatgggcaatgcaccacacatttttttccatctctcttctttcctcccatggttcaacgtacgtaatggctggttttgatctaaatctacccatcatcaattgggacgaagttgaggatttcgatggagatatatctgatttgaactatgactttgtttgggattatgacaatgaaggtgttcataggagcttcttctcttgctttgtcttcttttttttcttgtgcatgtgtgactataattttgtttcaacgcacagatggtgaagatggcaatggccgcggcagtggcaacgacggtggctgcgacggcagcgacgacgatggcggcggcagcggcggcggcggcgatgacgacggtggtggcgacgacggcggcggtggcggcgatcaaaccaccgatggagcagtcgatgcaggtaatacacgttcattttctttttgttgctgtgtctttttgctgcacgagttgaaggcctttgcatgtacacatgcacagtgccatgcttaagcaaactagccgatgcatgccaaccatagtatagcctgcacgttctcagccatcatccaccatgcatgtgtaggtatcaatatcaagaggaggagacactaccctcctgatatgaaacgagccatatatgcattgtgtttggagagatcggatcctggtatgatgaaggagggagtgacaaagtcagttgctactgatatgggggttccatggagagttgttcagcatgtatggcgacatggacaaattggaggtggaattgaagctttcgaatcgaagaagaagaataactgtggccgcaagaaactttcttttaaccctgatgccatcaaagatgtaccgcttaggcaacgccgaacactccgtgacctagctaacgctttgcatatgtcaaaaaccacattgtttaggcgtttgaaggaaggaaggtttaggcgccatacaaatgccataaagttcaccttgaccgaagataacatgaaggcctgtgtgcaattttgcatacaaatgcttgatagccaaagcataccggacgagccaactttcaaatctttgtacaacattgtgtatatagatgagaaatggttttataggacaaagccggacgaaaattattacttgtcacttgatgaaccgaaccctcgaagaaatgtgaagagcaaaaatttcattgataaggttatgtttctagcagcgaaagcccgtccaaggtttgatgagtatggcgaatgtacatttgatggaaaaattgggatttttcccttcacttactgggaggcagccaagaggagtagtcgcagtagggagaggggtaagttgtttaattatgcttagttactccacatatgacaactctactaattttgtttaattgcatgatttaatacaggaaccatggagctcaaggccatgacatctgtcacgagggacattatccggaactatctcattgaaaaggttttgccggccatcaaacataaatggcctaatgaggaacgaggacttccaatattcatccaacaagacaatgcaaagacccatattgcagttgatgatcctgcatttttaagtgttgcacaagaagatgggtgggatatacgacttacatgtcaaccaccaaactctccagatcttaatgttttggatttaggtttttttgcagcattgcagtcattgtttcagaagtcatctccatcaaacatcgaagaaattgagacaaatgtgatcaaagcatatgaagaatatccggcgaatagatcgaatcatgtgtttcttactctacaagggtgcatgagagagattatgcttgcaaaagaagggcagcactatgcaatcccgcatatgaagaagagatcattagagagaaatggtcaacttccaataaggttgcaatgtgataagcaaatttatctagatgcggtagatttcatcaatacatagttaggatatttctcttgtaactttgcatcgttcaacaattagcaagaaaaagaggagtattcatgtttgtttttctctgatcttcacgaaaaagacattgcattaaattgaatagaacaatcaagtgcatacacattagctaaaccatctagcaatgacaacaagcagcaacattggcactgattatacctctagtgaatcagttgtttttttcctcggcgttagtctcctctagtgaatctgcaacaaatgtgttgttggccagtgagtcaacaacgtacccaatgttgtcagagtcagtgaaacgatcggcgccggccagtgagtcgaccacgctgccctctcggattccggcatcccctgccttctctccgttgtcacccttgccgtcgtcggtgttgcaacagcgaacgagctctgcttgcgctcgcagccgcatgcgaagggcatgcacacggagcgtacgagcatgagcgatatccatctgcgcctcctgccgcatgcggacggcggcgtcgcggagcactcggacacggccaagctccacttgagcacgacgtcgcatgagcacggcgtggagacgaagtgatcgcgcgcggccgaactccacctgcgcctgctgccgcatgagtcgtgtagatgcaatcttctcctctgtcgtcgccatcgtcggcatatgaagtgtgagcagtgtcacagaggggcggtgtgtgcagtgagagagagagaggaagcagtgagagcgagagagagagaggggccaggagctgagctttttaaaagccaaaccgagtcatcagttaattctctgcatgcatctgcatgcatcagtacaggagccgaggagtactcatcaattcctgcatgcaccgaggagttg

SEQ ID NO: 57085 - DNA, 1599 bp, Oryza sativa
aatatagtccgatattaaaaaaaaaacctaaaatcagcttcaaatttaaaattaaaaaaagaatcaaattttgactgataagtataagtatagatgaaaagatgagacgttttcctttaataactacttaatatagttagaattgtctgggctattttttttatctaccaactctgtgtttattacttgtgcatttaaaacccacacagaaaagccctcacaatgtggcactagttttagttaacttgtttcactgatgaattagcaaagcttagttaacaaaaactaagcccctaagcaagtacgctcatcgactcattatctagtaaccctacgcacatgagtgtttagttgagtgataaactttgtcatgcttggaccattcctttgactagtattcggctacaactgtagtgtgtcacactttcttttaaaagaaaggtcttgttcgatagccctaaactatagcgttttttgctgtgcaggactgtgctgcacagcccagccgaacggctacattcggcaatctgctgtatcatgtgaagctcaaccgaattgctacagccggccatctgttgtatcatgtgaagcgtgtcccaccgcaattggccaacagttataactgttatttgcagtgctgcagctgctaggcctaccgaacatgttgaaattaggcccacttgttattggtggttactaacaattattttaaggattatatttgaaacaataggaagtaatgtatacaaatattatatttatggtgtgccatatttttaaaagaaattaggcccactctctcctaggtggttgctaataattatttcaaggatattatttgaaaacataggaattaatgtatataaatattttatttgtcaaacaggtacactcatttagccaatatcataaaaggaatgttatacatgcgtcattatttacaacaaattccaaaatgatacctagtgggaatatgtgctaagggccaacatattataaaaagggccccattgccctcttcccctcatccaactccatcgccctggcgtgcaaccaagttgcatattccccttgctctccttgtcatccctctcaataaggcaacgccggatgtagatctagaagcggaggacctcaattgagcgcaagctattctagatctgaacaacgtaagtactctatttggtttttatcttctccttctccctctgtgttgtagtggatctagatctagggttcgttctatttggtgacattatccttcctcatggtgacgcaccctaatctaagggagcatcacaagtgaaatggtgtgtgctaaacaacacgatggtcgtcggttggtgatagtgaaatcgatgatgacaaaggtggggaagactaagagaggttttgtaggtgggttaaattgcatgttttgtctatttgatttatgcaatgcaagtagacaaccatttgaatgttaatttcacccccaagtgcttttgggtagttccggttgttagtcctcttcggaccatcctggtcattttgcacaacagtataagtgagccttttctattatacgtgtattcgttaatcttcaagtgcgctatttga

SEQ ID NO: 57086 - DNA, 3241 bp, Oryza sativa
tttctattactttattaagttaataggttttatccctaaatgtggaaactagtagcaaggatgctaactactccctccgtcctagaataaataaagttcattttcatccatcccgtaaaaaccaatgtagaacaaaaaaaaaagactataataccttcactttatgaaatccctatgcaattattttttatctactcccaatgtacctatacatactttcacaaactctgatgcaatgattgctaaaaaagaatttatttgagataaataggatgtgctaaaaatgaacccattataagatgaagagaatattttaactgtgaattttgaaaagcgaacaacttctttccaagtctaactgtgttagcaaaataattaatcccttcattctaaaatacaaggaattctagggttcagatttcgtattaatatgagcatgtatacaccagttttcatgatttccatcactcaataattctatagccaattagatgcttgataagtaaattcaaaattcaaaaaaatgacaactagagtgacttaaaaaagaaatctgttgaacttaccttagtacttactaaacaacctaaaaatcattatactccctcctttaacaaaagttacacatgttatttttgtcaccaagaccaaggataaattaacttatcttgcatgtaacaaagaacaagaaatgtatgcacgcatacaaccaatgagtatgaagatggcttctcgggttctgatcaaacatttaatttatctctccacttaagtctgcaatgcatagagattacaaacagaacaacttatttggaaactcaaatataaaatagatctaactcttgtggaaggagtgagtactatatgacatcactacgagagaagtttattaatgaacattgcatacgcctttagttcttttatatttatttttgcctctaccaatgagttaactgttttgtaaaactagataaacctcgtgcgttgctatgggagttctgtataataatagtgtaaataacatttaatatagctagacaatatcactttatatactttataaaattttcatttgtgatcggccatgaaaaaagttataaataattatgatgatgacgtggttataacagtttaaatcatatatataggatgatcaatcaaaagcaaaactacgatgatacatcttaataacataagagaaatgaaaagataatatagattaattatccaaagacaaatttaagtaatatatgattccgtaggtgaaggaaaagagggaaataatttagaccatagattaatcatctaatagctaaaaacaattaaggtggtatggcttaattagataatagagagataactttaactgtatttattgataatgaattttaggattcgtatatatgaaaatactatggaattctttcgttccaaatggacgactttaacttttatcggtgatacgtgactaaacgtgatgaaaaaacacaacacgtacaccggaaaacaaaacgtagtagattaacttgtgtcatcctgcttgcttagcatcgatcctttgcttcccttttctctttagattgagttgctttcctttgtttcttcttttactccaacataaaacagacgttagatatcgttcgatcctttacagagccggccgctttgtttggcacatgtggcaagcttctttattccggaaatggtcgtgaaataggtttttgggtgccattctttaatcatcaacacgtacttcgtatctttgtccgcctcttttctggctcacatgtgcaagcgagaacacaaacaaatatggcttatacagttcaagcttttccgagacgaaataccactacacagtacacgtcttggacggcatacaatgcgtgtgctagacaccgatccaacaacatccagagctactgcaccacaaagtccacgacgaatcctctttcggcaccgatctcccatatgctgtgctccaaagttgcccagaacaagttctctcctgaagcagtggctttgggaagtactatacgcgccatgcagatctttttgttaccatgcgaaatctgcgagacatttgcaagatccacaacgccgctggggcccccggggttctacgcccttgtgtcgtgtgttctaactaatgcagcatactaagctgcttgcctgcagttttgctgttaaatttgacccgctcttttcttattcacttacctatgttatttcatatttttgttagcacatttttaaactgctaaatgatttatttcgtatgtaaaatttttatatcggagttattttaaaatatcagctagatatttttttaagtttataataattaaaactcaaataattatgtgctaataatttttatgctttccgtgtcctaactttatttggatcttcagtaaaacaaacatcatctttgatcgcatttttatgaacactctactactagcagatatgacaaatgtctctgagtataacccatgtgacacacacggtcacggtgatatgtgaatcgaataataacaaggtgattagtactccgtagtcagcaacgcagtggttgctagtacgcgataagaggaagctcacgaggagagataaggatcacgaattttactaatacacaaacgcacggacatgaggaaaatgcatcgaaatgattgggagaatcttgtcctggtccgatgagtggattaaagaaccagctttccgtcctgtcgtggaatctcatggtgattgagttctcatcctacgctcggcgagaccacagcctaaaaagaggcctattggacgctgtacattttgacagcaaagctcgggaaaccggcgaaagtgtgaagctggaaacgctagaaatgaaagccctaaatactagtagtactgcaccatggagttgagtactttggctaaagatgagtgtttgtcatgatcccatcgatggctttggaagaatccaaaggcaaagccgtccgacgcggggcaagaatcagcaacgaacgagtagcgtccagggggatgaaaacggccacatgctacgggtggtttcgcccattacgaggctcgttcgttcgtgctcgcgccatggcgcggtgtcgcgttgtcggatgatcagcgagccggggctgccgttgtgatcggctggatttctctgcgattgcaactgaccgagccatccgtccattgtcttttgtctccattccattacgcacattgacagacatattag

SEQ ID NO: 57087 - DNA, 1039 bp, Oryza sativa
ccgtttcttggcccacgttactaatacagatattgcaattggcccacgtaatacagtcacttgggctcggtccagtctagtactcgtaggaggccctggctgcagcgctaggcctaggcgacgccggctagaacggtccgctgctttgcccatctccgtgtgccgcgagaaggcggcggcctacggaaacggtgaaccttcacgtgccgcgcggcccagccattgcccgtgccggccgtgcgcgtgacggcccgagacgacagtacgccacggtgtcggtcgggcggccgcgcgcgcggccacgtacacggcgcagcgtggcgcggcagaggcgcacctcttcccgcgatgccgtggatattccccggcaccgaccctataacttggaaggcgtattcctttaaaaaaaaaaaaaattggaaggcgtggcgggcgacgctaccacaggtgtggaaaaaatctcttctacctaccggcacgcgcgaaacgagcagtttctatcagcacgtgatgcatcaaactcgttctatggcggcaagcatacacacagcgataaattccagatgtacacgcgcgtataatatactagcgcttgttaatatattttattataacgtcgtttgattttaaacatacatgaatgcaaaatctacaatagcaaatacatatttttgtaaataagatgaatgataaatatatttctaaaagtcaatgactccagacatattaaaaactgaaatgagtaccactgccatcgtacattcgtagtacaagataagagtggtatgaagtaaaaaaataattgtggtcaaaatattgtactatgcaatttgaatactgcatcaccgtagttttacaagaaatgtatcactggcacttcttggagtgggtcgacaacgacagtatagaaaatacagtgtctcgacgggcatcgtgtcgttttattcgcgggcgccgacttcatacacaaaggagaaaactaaagaggggatcccaaataatattcccaaaccctaaagccctcctccccttcccgtgg

SEQ ID NO: 57088 - DNA, 29270 bp, Oryza sativa
  unsure (1)..(29270): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatacctggtcttataaaacatatgtgagatataatgtgatgttcagaaaatgttaatttctcataagtgtcaatgtgtgacagaatgccttcgatatagtaagaacattttctattcaatatataatgactatatagagactatctatatggatttatctattctttttgagggaaaaaatatattgacataagtatatgtgtattcatacgaagatatcttctgattgcaatatgcaaggccacggtacatatgaagtcagcttttgctcttttgtgtgcatgaatcttatttgtgttattaagttttcaagtcacatgctactatttgtactcaaatatatttaacaaccttatagttgaaacaagctacactagccacaaagaattcgattttcactaatgtggaataaactagacctttaaccataactttaatgctagaagagtacaatagttctttttaattttttatgtagtttagtaacttaatggtacttaagctagtgtggaatttgtacttattaactcacacttttgttgttttcgataacaacaataatattatgtgatcttactctcatgtacacaagcaccagtaggtccgtgaaaggatacaaaacggatccaactccaggtaattcaagtaaagtggaactggtttatgaaaagaaattttgtaatatgtcaatactctcttatagtactttcagctcaatcagtctaaaacatataggtactactcaataccagaggggaaggaatccaactagcggcaatattcaacatggttttgtgtgactgttatgtgaggatttgattttgtgatagttggtttctccattgttcttttggaatattatgtaattgttgttggaggatgtgacttcttaagaattggtctgtgctgaagttttagaatatgctacctcaatagcatccaaatgttagcatttccttttaaagttgtattttaattgccacaaatgttttatttaccaaatcaagtacttttgaaaggaagtcatcattattggtatcacaaactagtttatcaaatcacatacttaagggatacattatcatagaattgtggatttatgtgagaaaaaaccaccaaaatgtagtatgcattataataaaataagagataatatattctgtgccattgagtttgtcatggttctatgatttaccaccgaatttgtacacttccattatatgccatcaggttttgaaattctctcctacaatttgccattgctgtcagttactttgtccttttgaaaagacaaaatcacacataatcaaatgcacaagatttattgttgtcgcatttctcaggtagccgacctgattggttgctagtttatctccaatgaaaataacagaacaagatttcttctctacctctttgagtgtcaaggataaggcatacctcctacacaaggattcatggaatacggcaataccatatacttgattgtatacgagcaggtatcctttaattaaggaaatatggtagataatataaaaaagaaaattatcttcccggaatagaaggtgttagagacctattcagggaagataaggtctccttgggttattttgttttatctctgtgagtcctacttggagaagaagatgatctatgttatatatacaaggccttctcactcagggaggggcatcaagttacaaagccatagccaaagccatacccagaagtaatccaaaggaagccaacgccctattcgccaatagatcttgtcgggttgttctcgacaactacaagtcggcggattagtctagtcatcctattcctcattgtaaagtgactttcccacccataatacatataaactagagtagggttattactcatcttgagggcctagaccagtataaatctatgccccttgtcttcttcatccaatatcgcatatacgcttgttccaacgatccccatactctacagataccatcattttaattgttgatttgcgatagcatttatctctttgtacggcatacaatggattctcccatgataaactgaatggcatagaataaattctcgcaaacaaacatatgtaataagaaaaaagaacaagcttagatgcaagaacttgtttacgattgaaatttaggtatgcgatatatagtacttccaatcatatataagttcccatgtgagctcttgtttattagtgaaatttagacatgaggtatgcaatactttttatgattggaaatataggcataaaacaatcggcatgtgtcttgttttatcctaaatttaggcatgcgtctcatgcctaaatgagtcttgtttgtttttcatggataaaaaaaattggcgaggacatcaccacagtcctcattacccagatcgttggagtttcaactcaaaagtttgtatttcttataattagtgctttgggatcatttgacatcctgtcccaattaggatgtggtaaatgtagcccatgattagtaccaccttgctagtttagcaagagtggaaccaacttctaagggtgtgtccctccaaccatatcatctctgggttaatcattttacaaaacacgaggatggaactgtaagtggggtgctatatgtaagtggccctgcccattggatggtctgggctgcgcggttctagagagtgggctgttacatctgagtcatcatgccctggtaatctttgatgccaaatccttgcaaaggattactagaaccaatacctatacgcttaatatgtcatgacatacagagataccgtctattagtaaacttttcgaactgaaaatatgagtggaattgatagccttcgaaggagatctacaatacatattgtgtatatcgtacggcctaaaatatagatccttggcagggggatgtgatggcaccattgcgcgccgactactccatcatcatccccgcaaccatcttgtcagcaatggtgtgttcctcccaaatctgttgtggatggcgaaatatgaaattgattttggctcaattggggaatagttgggactccacaaggtatgtcataaatgccattatatatgctatcatgggcatttgtggccattgatctgtacttcttccattggttgttaatatttaaaagcagtaactttgtgacaacctttgcaagtgttctttcccttaatgagtaggttcattgggttttaagatatgcggagtataaatgctagcccaatttatcatcaatggatgataaacatgaactagatgtgaaaaacattaaaagatgtagccttttgttttcttgattgtgctatttcacggaagaccatgaatgatcgattaggtagtcacctccttctctgattgatataccatagtagtagcgggagatggagtttgcatgtcatattgggggcagcattggggaaagatattgcgaagcatagcgggaggtagatggagcttggcaagagtcctgacggcgcctaatcagttggccatggtgtccgatggcgcaacagagatcgagatttagttgttgtcgtctggtctccctcctcccccgttgcaaccggatttggctgtccctgggcaatgtgatttgctactcaaggacttgcgggatggagacatagcgagagaggatcaccacactcaggcctaggcttagggacggcggcggtggtatagtgatatggtggcaaccccctcctccctcatcttcttgtagctggcatcttagccgtaatcctcctctaaacctgcgcggtagtttctgcagacatgcagagcatagatcctcaccggatcataggggcacaatgcactcacgtagcactatgtgtatacggtacgcggcgaggtggcggtgacctccttctctatagggccactgccacatgcacgcctagatgtggtcaccaacgcctcgccaactactattctttgcgttttttattgaccaatgttctagaaatactctgtgcaaactatttcctaaaccaaatgtgtttgtagaatacacatattcataactataaaaatgggtaaatgacataacatatttcgatatattgtgctaaaaatgggcaaagcatttttagccaatagtgttggagtgataaatatgtgtgggacatatttggtaaaatataagatatagctacttgcattgtgtcatctagagttggtgagaacaaggataatgatcaatatactctagtttagtttgtctatggtaagggacgcctaactcattgtaatacgagaggagagtttgtagagaaaacaaatactggagtcatttgcaattcaccaaatccgttggcaagaacaatgtcatacacatatgatggtctttacaaaatcaaaaattacctaggaggcaaaaaaaatgtcattccaacgtgaaactatgtatgaactaggaactagattagctggggcaatgtagtttaggaaattactcaggcatggatggaaaactagtcctctagagatcatgttgcgcagtgtgaaccctgggaactggatggacttgagcaagcggtggaggtgcaacacctgtatggcctctatgtggtgcttggggttgtcgagtgccagcagtgcatcaaaccccatctgctgatagcatccctgcaaaaacaccaccccaagacgcagcactagtcggcagggatgagggtaggggtgtgtggggtgtgcgtatggaatctacgacaggggcaaggaaggcggagaggatggcagggaggaggtcaggatgcgggtcagggatgtcctccgcgcggaggttggtggaaggggcgaggcaataggtgtgaattgcctcaccgatctgtgttggcatcatctctaggatgaagaaatctaacatcatcttcaccgtcgccacagatctatctaccttcccctgcatccccaaaccaaatgtgagggagcagtttcaaaagtacgaaaatattcttgaaatgcaagcagttattgcctcttttcccgcccaagaaaatgatttgatcagcacaccattttcatgtaaagcatggtccacccgtggttttgatggaacacacaaccatgacaatataccttcatccttttcacccatgccaatacatattgattcataactcataagacggaaaaattacttaaccttttcttcatctctcctttcctcttcctgtactccaacagagtagatttagaaggaagctaagggtaaacacaaattgggcgaaagcaacttatgagaggaaataaaggaatccagtgagcatatgaaggtaggtcactcgtgtagaaattctagccacaacatatcgatgaatgatagtgagtttattaacatagcaatacaaactttctcaaatcgatgagcttgaatttgattcctcaaatttgtttgctcagggaaaacaagaagataattttgtggggacaacaaagaatggattccgagctagaatcctcaaatttgtctgatctaggtgtagaagagggattggaaaactctagccatggctaccaaggatgtacccgtggaggtggaaggtactcaaacaccaccttgaatctcctgaagatgaaaatgaagatgaagattaaatgattcacgcaaaacgaggtggtaataacatgtgattaattgagttttaattattacaaacttgaaaaatggattaatctgatattttagaacaactttcatatagaaatttttctcacgaaacgcaccgtttagcaatttggaaaacgtgccactttaatccaaaatttagtccccccatttcaggacattcgaacggggctgacaacaaaaggatgaacaatggaaatagaactcgacaagataacggtggaagtaaaacaaaggtgagtaacttcaggtctcatatatattttataagaccagaagtatatgctttcaatttcaagggggcaaaatggagttattttaatttatattaatgtcatttggtttggccaaggttcattactatataaaaagtgtgagagatgttcagaaaatgccaattttcttgtaagtatccacgtgtgacacagtgcctttcatatagcaataacttttttaattgaatatataatgactatatagagaataactctttgatttatcttttttttgaaaaatatattgacatatttatatgtgtactcatatgcagaaatcctctgattgtaatgtgcaaggtcatggtatgtatgaaatcagcttttgctgtttttatgtaatgaatcttatttgtatcattaagtttttaagtagcatgctaatatttgaactaaatatatttaacaaacttatagttgaaacaaactacactggccattaacaattcgattaatgtcgaataaactagacatttaaaccataactttaatgctaaaagagtaaaataatttaaaattttttgtatgcagtttacttagtggtacttaactcagtgtgaaatttgaactaatcaatacacaagtttgttgttctcgatacaaataatattttgtgatcttactttaatgtaaacaagcaataataggcttaggcacttgtgggatcaccgagattgggtctaggcatatggatggtggtggtgatataatgatctggtggcaaagccttcctcccacatcatcctgagtggtttccgcagacatgcagagtacagctcattccccgtggaagctgtaatgcggatgggcagcactgtaaagggtacgcgatcatctcctctgttgtgccgccaccgcacgcatgcctagatgtggttacagacacatcgtcggctgcctagtctacatgattttttttttaaaaaaaatatcaatgctatggaaatactctgtgcaaactttttactaaacgatatgtgtttttgtagaatacacatattcataactataaaatacttatattaatattagtgacataacctatttagatatattgtgctaaaaatgggtaaaacatttttagccaacagtgttggagaggtaactatatgtggagcatatttggtaaatataaggtatagctacttgcattgtgtcatctagattttgtgagagcaaggatagtatgaaagttatggagcgagaggtgtgctggatttggtgctaacaactgccaggctgacgggccattttatgataatgctacaatccaaccgttggctcacaaaaccagacacagattaatggatttcattggcataccgttttcatgtaagccatgagccgcctgtggttttgatagtacacataatcatgctagttaatctgctttgatccttatcacgcacatgtctatatatatcgattcataactcataagacaaaaatcactcaactttttcttcatctctcctttcctcttcctctattccaacagaactgatttagagggaagcagtgggtaaaaacaccttggtcgatagcaacttaccagaggaaacaaaggaatcgagtgggcataagaaggtaggtcactcgtgtagaaattctagttaaaccatatcgatgactgatagtgagcttattatcatagtgatccaaactttttcggatcgatgaatttgaatttgattcctcaattgtgtttgctcagggaaaacaacaatatagttttttagggacaacaaaggatgatcatgttgatcattcagagctagaatcttcaaagtttcttgatcctggaaataaagatgtaccataggaattgcaagctctggaactgcctaccaatgatgtacctgaggaagtggaagttgttgaaacaaaatccaataattttgtcaacaagacaacgaggtaacagtggaagtaaaacaaagattagaaactctttctctctctctctctctctctctctctatatatatatatatatatatatatatatatatagtaaatttgtttggtgctccatggtgcccgggcaccattgttaaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgatatcatggtgcccgggcaccatggtgccccatatgagtgtcctatatatatatatatatatatatatatatatatatatatatatatatatatatatatatatatatatatatatatatataaaggcggagatagaggcatgaggttaggccgcgggctggcgatgtcctccgtgcataggttggtggcagggggtgaggttgtaggtgtgttgtacctcggcgatctgtaccagcatcatctttgggagagagaaatttgatgccatcttcgctatcgccgctgatctcacaactttccctcaatcccccaacccaaacgcgagggagcacttcaaaagcaaaatatattccggaaatgcgagcactttttgcttcactacttaccttcggaaacggattaaaaatgaaaggggccaatttatgcggttgtgtagaggagttgttagcccacagcccatactcatcttactaaccgttggctcacaaaaccgaacacagatttatggatataatcagcacaccgttttcatgtaagccatgacccgcttgtggttatttctcgtcatgccggtgacggaacgacggccaattttattaaagccacccgtgtatttgatagtacacataatcacactaatatactttcatccttatcatggataagagtctatatatattgattcataacacataatacagaaaaattactcaaccttttctttatctctcgtttcctcttcccctattccaactgatctattccaactgatcagatttagatcattcatgtcaaaattctagctacaccatatcgatgactgatagtgagcttattaacatagtgatccaaacttttttggatcgatgaatttgaatttgattcctcaatttcgttttctcaggtgaaacaacaagatagttttgtcgggacaacaaagaatggtcatgttgatcattccaagctagaatcctcaaattttcctgatctagggttagaagaggaactaaaaaactctagccatggctaccaaggatgtacctgatgaagtggaagttgttgaaaaaaagtccaataatttagtcaacaggagaacgaggaacaatggaaagagaacttgacaggatatcagtttggagcaaaacaaaggttgataactttatatctcatagaccagatgtatatacttccagtatctgggggacaaaatggatgattttaatttatattaatgcatatggtttggcccaggtttagtactacttgaaattggaaaaatgattagagtgttagtatcagattaattgtcatattagtgaagagtgagtgattttcaggaaatacaattttgtcgtaggtgtccatatatgacacaatggctttgatataacaagcacatttttattggatatctgtatgatttatcttttcttggaaaaatatattgacatatgtatatgtgtattcatatattcaacaaattgtaatgtgcaaggtcatggtatgtccaacagtccaagtggctttaccaatatgagtaaaccggtctgtgggaatcatttcattccagtgggcaagatgcatgtatgtgatctacataagcacatgatgacgatagatatcttgtatttccaaatataagcattgaaatctaccatttataatattgaatagatttggttggccttctctctttttgcaaccagatctgtccattgtcactaggggaggtgtcatcaaagtaactcggttaccttacagaaaacaactgaaagtatcaacgtcccttgcgcacactaaggtgccttcgactcttcctcttactagattttcactatggtggctatggaaggggtagggaatgcaaaatgactaatgccttatcttcaagcccatgcaaataaattgttataacatcgtgtcgaattgagtctgcatattggtttttagccattgtgtgtgtgcacctagggtggggaagaagaaggttgtgaggtgaatggtggcattgtgcgagatggtagaatggacagagggataggatggagtggctatgttattagaaagctaggcatgcgtgcaacatttactctctaatgctggacaaattcaattgaggtataggtgcaaaataatagaaatatagcgtaaccaatcccacatttctacacatgcgtgagcaccatttctgattgtgttaagacatttagtgcaacaaaaaaaatagatgtgcgtttttggagtttgacacactagatttaaccatagctttatttaggacaaatctcttttctattttcttcttgtttgatattttgtggtgatttcttttaactgttttatgtaaaaagtgtgtaacatacactagttaccaaatatagatctagaagttatgttgttgacacttataaaaatattttactcttttgttgaaaatatgttgtttacattttttttgagttgttctattaactggtattcaatatattgtattaggtatgtgccattgagggcggattctgatcgcataggtggatgtccacgtacactatctgccgttgatcatgtcgccaagattcgcgcgcacaacaggcagtatttcgtgataatttggccgtatactgcgatatacatatacatttcaatccccgtatagtacggattgtactttttaaattcgcaaaagccccctatcgagggaggaaaagctacctatgcctttttttcccgtccaagtctgcttccggacaggtcacgggctcttctctagcatcccacccatgtctctctgctgctcagcaccatctctgcattttcttccatagtagggcagatctggcttgttcttgttgtgttcctcgctatttctcccatggaggatttacgtcctactcggtccttcttacagttgatggctaatatgcagccccgtggatcctggtctgggaaggttagtctttactaatctatagtgttgcagacttgcagttgcaacaaacagtccttcgtcgcccctaccctctatcgatccgtgctttttttttttttttacgaaaatgctctgattttttctctccatcaaccagcttggaaggcgcatgttatttccaaggagtagggaaatgcccataccctccgggacagagctcaacactttctcctgatgaatttttaccagcatcgtgagttttctagtttttttcctggggttttatttttcaggtttgtttacccccttcctcagagattgtgttacctttacagtcctattgatctggaccccgtcccaagttctatggatgttctgccggatagcacaaaatactgctgaccaagatgcattgtaagcaactctattccgcaccaatctatttctcttggtacatttcgttgaaaaggttttattttttctacattccaggggagatgaggtgtacatgtgtgaccagtatgtagcaaacatggattctgaaacggcggaaaacacatctgattccgtgtgggcagacatcagcgggtactcatcttgttctgggcctagctaaaggtaataaatcagcactgacatctttcgtttaacctgtactccatgttcttaactttggttactgtagtgctatttgccttgttagccacgatagtagtaccatgaatggattcacttatttgtatgttttttttgggtataaaactagtctttttgcgcaaagatgttttggttacttgtatgtgctcttaactttggtaactatactgctattgaattcctgatgatgtgcttgttgacggtcattataggccaattttgaccgccaatatatctacattaaaggagaattagctatgcttataatgcatatttgttttagaataatatagttccacttatacttggagaataatgttgcatgaattgagcaaataaataatgaagaaatgaggagaactcactcctaagcaagcatatggataaggagggcccacatgttaggtgtaaccgtccagaaaccaccttaactgtcacaatcgactagaggacccacctgtctgtaccatgcccgaagctggaggcctgctgggctagcccaggggccgaaccctggtggcccccaatcagcctggccctccatgtggacgtccaggatgcactctcaatgacggttgtggggtaggaaggtcatttcgcctttcctaccatcgtcatgctgaccctataaaaggaggagcccatttcactctcaaaacactcaggcaagctcaagattcctcttcatactttattttagtagttttagtactaagtggagtagtatagaatagttctcgcagtcctcggagcttccagaagaatttcggtatggctttagtagctttcttattttcttctgtaagactctcggaaataataaagatactcttcttcttatattctcggtactttacttagtctgagtgctgctcttattttatatttgtgtagtcacaattgtgtgggtagcctaccagagaggtgcaatggtgtgggtttagtgtccgagttatcggttgctctatatcatctgcagaggagtagtatttattaatgtaagcatggtgcttagattactaaatatcactatctgggcatatatgctgcgggatagtagaggtgggctgctgatggtgatagctcagtacgggtattcttccacgttagtatatattcctaatacaaattcctagggagggtactcctccgtatttagccccggttggacagccatgacaggttgtcataagaaactcagcaaccaagggtggtctctcgaaacaccaggagggcactgttagggggtatttgccacataattgtatactagcaaatgtagactagagtttgagtgtatattagaagtataggaaatgagttcttcctatctcttcttccactcagttagaattatttatttgaggaaatccaaaggcttcgcttcgtgtcactccatccttatattaaattaacctctacttagattttgattaaagcaagtaatatatgtatgtatatattagcatggttctctcttttacaatcttcccttgggattaaataaatatgataccttcgaatacttccgggtgaaatgctacaatggtatatccatgcgcttgcggattacttctgtaaccataaatatatcaggactatttctgtgccattgctagaaatgaatatttctattaatgttgttaagaaataccaacagtgcctgtaattgtttttgggtttcaattttgtgtgagaatgagacagtagactactgattaagagcgatgtgcatggattagaggcgtttcaacagcacttggacaagtttctcagtttgattcactggatccatatgcatgtatcatttgactgaactaattgttgctgatgatgtgaacttggacaagtttctcagttcgatgcacgtgctaacgctacgacaatatttgataatgcaaaattaaaaaaaaatcaaaatattttatatatcttgaaagtataaaatgagataaattttaaagtcatgaaaaaaagttcagtttaaataacaaattttaaatcatgcagaaaaaaaatcaggtccagagatggatagcaccagtagctataccgtgttactctaaaatacaaaataaaataattttatctcctggatgtaaatctatatttttgtttcataacaccacatttttcacaattacaaagagggtcgcctcaagcaatcgaaacatcaatggtcactacatgcatcgctagaaagaacatcatcttgatgtaaactgctggacctgaatagattggcctctctaacagcaccaggatcagctccaacatcatcttaagctagaaataacttcgatttctgaaagctcaggaagacattagcatgaggcatgtttgcatggttccaactcctaaactcctgagaaaccaaatgccttaaaaaattttctcgtttagccacatcaaaaatctttcaagcaaattacatccaaataaaaagaagtaacagaaccggccatagaatttatgcattgcatcattattagtaattacaaagtcatcagcacacttcaatattcaacatgccagagaaaacacatctttattggattcatccaatagcactttttcatggatatgatgaagctatcgtttcattgtctggagctccaaaattggttggtgcatacaaaggagatactccacttaatatcaagcaattgacaaaattaacatattttcaaagttatggcacctcacaaaatggaaaattgaccttctgctgcagcctacataacacatatcagcagcacaacaattgcagttcaaagagtctacactgatgaataaaaattgatttggttgatagaaagaaccacccaagtactcaatacaaatagaaaattgcaataattgttcagtatttacagtgaaatctaaatctacaggaaataacagcctcgatctgccatggagaaacttttccaatatatttccactaagttaggcactcaggctagcaaaatgaatacaagattccaactaatcaatttctgaaataacatggtgtctagaaatgctaatcctaattttagtgctgttctacttactctggagagatcttggtcgatgtcaacgattatcatggccatgttggtggatggggacaaggctctttgaggcggtcttcctcctctcattggcaatgcaaacacagttctgcaccctccaactcctactctgagtgggcctcacaccgccggcagaattccattagtatataatataattcaatctgcattcaacaaagaccaagagttattgagccctcccaagtatttgcaataaaaatggaagataactgcatgaataattgtcactctaatatcaatttacaagttcacattatacctctttgtcgacaaggccgaggaactcttgatgctccttgctaacggactgcaatataaggaagtcagaaaaagataacatcacctgttgttttctcaacgcaatgttagcgctcctttcataatataagcattcttcctagagtaacaacagtattcatgctcttctctaattgaatatgcaaagaacactgatttttccttatcaaacaaaggatgctaccatataacatttaaaatgagtagaatcatcaatacaaatttatcaatttatgtgccaattatgatcatcaacaaataggcgattagcctaatgaaatactctacataccagcaaagattgccatctgctaaatccttactgaagcatactgaaaagccaaatctcctcctggataaaaggaaactatagatttagtcatatattttttcagattatcaagctaaaagagtgccataagagatggcaaacttcaattgtgaaggaatgcagtgtggaacagtaagcccataaaaaatttccagtgtgttctgataaccatttagaacaagtattccctctttcactactattgtcattattatcatacgctcctctcaatggccacttataaatactttcattgtttaattgtgtagaaggaacagaaccagaagaaccattgcaggttattccacttcatttaaaactctatgagcgtgttgcacaaattgattgaccctcttagtcaatatttcatttcatttgtttagcataatattgtttagtataatacaccattattataggataaggagtcaggggagcatgtaggatccaaagtcagcatgcccaataatggcgtaccatcgaacttgatacgatctataattggccagacttacgactacctccctcaaggtacgttattgtatgacatgtgtttagtatcatctatctataactttttgtcatcagtaatccctttctccctttttattttacagattatgtattaaccaaccaggatgttactgctcaagacattattctggtatcatctgaaaatgagacgctggtgaacatgggaggtttttctgtcaaaaaacatcacctatcgtgccttctcactaaagatgaatgggtgaacgacgacgtaagtacaactgcacatgagtatacaacgttaatatttatttaattgtcaagttcctaaatattttaaattgaatctataggtcatcagtgcgtacatacactgaataaaggaggcgcaatcaaagaccgataagaaagtgtattatgaaaacccctttatcattgccatgttacaacgagatgcggtctacataatagatgaacatatagacaactttattacaaatatagtgaagaactatctttttcatgaactggtaaagtttggctctctaaatttaataggatttaagtttgttattatatgcattattgtgtactaattcgatgacttgtttagatttttctaccaataaatagaggaaatattcattggtatttagctattctcaacccccaaaaaaaagtgatacatgtacttgattctctctgtgaggacttcgatcgtgttgacctccatatagcggtaagtgtatatggcatattcaatcttttgtttatttagattgcaattcatttttctattgctaatcgcaaatgtaataattgaatagatacaaggagtacaaaaacatcttgatatcattacacggcggcaggacttacctagccatgaatggatagatctaaatgtcgtgacatggctgatcatagaacaattacaagtcaaaattcaactagatgggtatactacaaatcatatctcttggaatattaaaataagatacatgatatattttttactggtgcattcttgttttatttttaattaatgtttacaaaattgtagttcttcttgtgggctcttcatgctcaaatttatggagttttttgctggagataaattttctcatcctgttacacaagtgaatttcttagcataataacaaaatattagatcatacattttatctaattttcctattaaacgaagttatgtttactatgcagaaagatattgaactttttaggtacaagttagccggtatattactgtgttggaaaacaaatatggcggccgaggcttccaatgttgaacaagtcgaagatacagacaatgaagatgatgttgtgatagtgggcagtcgtcaaagagaaagatgggacatgaaataatctaaagtacgctcggcaaccaacgatctcgaatatagttccctcctctcggtggtttcttgtaacaccctgaaaattcgaccaacaaaaatcaaaactctaaaaacatgggccttcaaaaactttttaaataaattgcatcatgccgattttattcgcccatttcattggaatttggtttcaaagtttatagatcacgaagaaggattggttggaaataaataaaatattatcgcaaccatattagtaacaattgaattctagtgcaacggaatcaaaaattagcccaattaaaaattcaaataaattaaataaattaaatatgggtaatattaatcttgggtgaatccattggttggaataacataaatattgagtaaacctcatttatgcaaaaattaggatttatagaatagaaattatataggaaataggctaaaattgggataaataggaaaatacactgtttattgcactctaggtgctcgacgaggtccctagccctacccccttctctgccgcgcgcgcctggccgccccgagccccgcgccaccgtcgccgtcgcgaccgtcgcgccctgtcgcctctgccgcgccgcgtgccgtcgccatcgccgcccgtcgccgtcgcgtccgtcgcgtcgccgcgccgccatcccatcgcctcgcgccccgcgccgcgccgcccgccgtcgcgtcgccgctgccgcctgtcgcgcgtcgccacgcgtcgtcgccgtcgccgtcgccgtcgctgtcgccgtcgctgtcgccgtcgctgtcgccgtcgccgtcgcgtcctgtcgtcgctccgagccgtgcgccgccgctgccgcgccgtcgccgtcgccatcccgctgccgcgccacgcgtgccgtcgtcgcctcgagccccgtcccgcgcgtcgcgtcgcccgttccgtcgccgcgcgcccgtcactcgccgcctcgcgccgccgtcgcgtcaccatttaaccgcccccctctcttccctctcccctttttccccctctctcccctataaaagccccaccattccccactctccccaccccattccctcctcctctcctctaccctctccaccgcgccgccgttgtgccgccgcagtcggtaagccgccgccctcccctcgttctgccgctgttgcctccggggagcaagagccgagagagagagggaggaagaaagaaaccggggggggagaaaaaaaagaaagaaaagaaagaaaagagagagagaaagaaaaagagagaaaaaggaagaaaaggaaagaaaggaaaagaaaaagaaagggggggaataaaataggaatttgagggagattaagaagtttagaaaatttagaataattagaatttaattataggttaattatagcctagaattgtaaaatgttaatgtgattataattatttttggtaatctctgtaagaggtcgattcgcggtaggaatttagatttatttaagaagtaaataattatgtcgaatttctatgaatgtacttccaaatcccaaaatgacttaggttaaatgacccaacaattcgaataaagtggttccgcaaactttgtagtcaatttagaaagatcgatttgcgttcgacttttatgtgagtcatttggattttatttgaattctaattgaattcaaatcatttcttcgcacgtaattttagagcccgagggagttgcggatccgagcgagggtcaagacccgcaggacttcgagcaaggcaagtcatcaccattctttgaacatgttgatcccaattgcgaaattattttatttacaaataagattgcatgcaatgatgaacatcctacttgtgattatgccatgtcttgattattgtttacctttaaatccatgtaaccataattacgtatgagtccttagtcaattatgacacatccttagaaatgctactctagattcatgcacgctcatattttatcaaatgctatatgcttgggaaattacctttgggaaggtaattgagatgcggcatgtggagacatgagcgccacattgccatgatgatgatgacatgatttgtgaaagtaggaatgaaattaaacacttgttttagactggggcagacggtggatttgggtggtatctgggaaaggctagtaccgtccccgatcaattaaggaccgagccatgaagttaagcatgaaacgacccccgtacaaccgcacttctcgtatgggtatagacctagcagattaaatagccgagcggaggcagtatccctgcatagatggttcacccctgagtgaggcaggtgcgctaccgtgggacagccgttgaggtagggccgagaggcgtgccctacatcggtgtcgccatgggtaggactgccatgagtgcgtgagagagagaacttaacctgaatcataatttaatatgtgtgagacgtctctttcccaggagcgccagaactcctctcactgctagaaatgtatgacgcctagagtgcatgagggctaaagttcatggagcgggtactgtcacaccctaaaaattcaaaatatataaattgttgtttaaatggaatttttagaaataattttaaaagtcttgaagagaagatctaatttttaattaataaattccaatataaaatggggccagataaaatttcattaaatactttgcttaattctataattcctagatttttctaggatttatttgagctaaggaagtatttttaataaatggaattgcatttaagaaataatttaaattgaaaaaggttttaaaaagtcttcttttggctttgggccaaaagtcggcccaaaacctctctctctctcctcggcccagccggcccagtccgccgcagccgcgcgcgccctcactgtcgctgacaggtgggtcccgcctgtcaggttcgtcttccccgagccgccgtcgcccggccgaaccctagcgcgccgccgccgccgttcccttccaaattcggccgctcctttccttctccggccgaatcaaaagaggggaaatgatccttgagatctcctctaccttttctcctttggaaacttcggctaaatcggtttggaaatcgatggattcgagttcgaatcggatcggcttttctctctccgagctcgagctttcgttctcgtcgccggccgccgtgggccttcgccgccgcctcctagcccctttaaaaggacccccggtgtctcctctacccgccgccaccctcgccttcgcctctcgtcgtcggaaacgctctagcgccgtgtgccctaacgccgccgtcgtcgccgtcgctccagccgtgcgccgccgtcgctccagccgtcgctgtcgctcgggaagaccgtcgtcgtggtcgccaagtcatcgccgtcctcgtccgccccttcgctgtcgccgaagatcgccggagcaccatcgccgccgtcgacccgaagaccgccgccgtttcttcgtcgtcgccgtcgccgtccgttgatcttccgccgctcttttggtcaccggtgagttcgccgcgtcgcgctctacccgttggtggcctccgttcgtgccgaagcgccgccgttcgccggcgagcgtgcgccgtccgagccgccgagccgccgccgccggtggtgacgtcaccgctgacgtcatcgtggccgtctgccgtgagccgccgtggacccgatcgatctcggccgtccgttttggatgggttgatctcggccgtccgttcgcgtgaaccgtcgcccgtgcgcccggtccaccgaaaccctagcccgctgacgcaataaatcccttttttccttttcaaaaataattcattattgcgtcataattcaattaaaatcaatttaagtgttttaatccgattaaatcttcaaaaattcataactaattcatcttagctccgatttagttggttcaagtctctaaatttttctaaaattgagatctacatattaaaaatatccacatgtactgttcatgcttgtttatgtgctgttttggtgattttgcttctttctgcttagattccgtcgtttccggagagtccgttttcgtcggagaagagtttgaagagttccaaggccagcaaggcaagtcacacagatcccaaacaaccctttgagcatgttgatcctatttaaagctattgtttctattcaactattgcatttattttcgaatgtcattgggcggaattaacctattgtttgttatagcccttttggttcttgtttaccttattccttgataccttgggttgttataacttgactagttgagctttatttattggttcaactagatattagatataattgcttagccctccttagaaacattagcacactattgggataacttatgactcactgttatttaatgatggcttaatgataattcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccagccacacgccagcatgggcaacggctttaccttttgtatagcatggttcattgcggggcaccagactgagaagtggcagagataagcccacgggggtcgctggggagtccatgccttgattataagggggtgattatgatccaggaaaggtgcgctgtaatggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgtggttatgggcgggtctaacaatgtctttcgtgattagtctcacccttctcaccataatagaagatgctataactggtaataatttgattagctcctggtttggaatggtatattcctggtttggagatagaactgtgcagccgggatggttgttcaaaatggttgggcctatacaacagggtatgttgtatagcgttggattaatattgtttaattacttaactgttttattaaattctcaaatgtttgctaaatgctgcttttgcaaatgagccctatactatgccatcctttgttatcctgtgcacttgcatatttgctgcgtggcttgctgagtatgtcatatactcaccttgcaatcattcatcagaggaagagttctacagtgaagctgatggtgtggaggattaggtgtagccttggtcaagctgcccgtggagtggagccgtctgcgccgtttatcttattttccgctgcttagatctttattgaatgagaggaactatctacctctgtaatgacatttgattcgcttattaattagagtaataattgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttacccatagaagccctctaaaaagattggaaaagtagaactgttctcctccctttctcttctaattaaaccaaactaatggcacatgcctttcataatctcttttaatggttctcactcaaaatttattccagtgttattagtactgtacatctattactgtactaatggctcatttaccagcaaaagttttacaatgttgttttatttaatcttgctgcaataaaataaatttagcatgatgattttataactttcttttatttcttttgaaacctgttgttcaaaagtacaaaaattgtaactttgtttccaactgtttcaacttatcttgcaagtttggtttactttatttacttaccttttactttgatttcctaactttattcaaattaatccaaaaacttgtgctattaattggataaatgtcttaactccctcctttcacttgtctttagatgccgcgctacaagcctgagtacttgtttggtgttgagtgttttgtccaggagttgtgtacgatgtcctttgtcattggatttgggactgcccctttttatgcccagattcctcatgatcgtcacgaagagaagtgccgagtcaaagtcaccttgaacagtaatagtgaagatatcccctcagtaatgttcgaagctggaggaagaaactacatccatgcatgtcaggaggtggcaaggatcgccataggagagctccgcgatcattatagtgatcagttggccgacactgagtatcgctaccatcctcgtcaaccccagggaagtgaccgtggcagttaccttgagactgaaggaattgagaatgatgctaccacaaggcatttggttgagatgctgtgggctatggatgaaagtcgtgcggagactgtgttagcggctcaagatcgtgaagaccggaatcgtggtaagatttgcaagttagaagacaaggtggatcgtttggagaaggaactagccacattgaagggagaagcaccaccgcagaaggccaggattcgtcttaccgcaaggaagagagctctatttgtccctcgctatcaattggcgccaaaggttcgtgtggtggagaaagaagttaccccagccttagcagatcctccggtcatcatcataagtgatgatgaagaagaagaatccaagcgcaaccattccaagattgagtgggtagctacccaagatgatgaagacgagccgaacgaaccttcaatcgacctccgatgctcggaagaactagagtgacttgttaagtcgttgtcttagatcgttgtgttagtttgcttgttttaagtttggttgtgtgtgcctcgcatgtgatttacatcagtggtgggatgtaagtgcatgtgtttgtttgcttttgagtgttaggaagttggtgagtttagtggtgtaagagtcttcagttttgtaataatgaaactcacttaagatcaataaaagttaaagtaattctctgtcctaagtagtttcccccggtttctcttcttgtgccctgtccatgccagatggtgaacactcgcagcaacgggaatggccccaacaaccccaataacaacaacaatggagagaatcccacacttacccaagttcttgttcaacagactcagttaatgaacatgatgatgcagcaactccagaatcagcaaaaccaaggaaataaccatgcacctccccagaacaagttagcagaatttcttcgtgtgaggccgcctattttctctagtaccactaatcctgttgaagctggcgattggctgcatgccatagagaagaagttggatttgcttcagtgcactgatcaggagaaggtctcatttgcatcacatcagttgcatggcccagcctctgaatggtgggatcacttccgccttaacaggactactgctgaacctatcacttggcttgaattcaccgctgctttccggaagacgcatataccatcgggagtggtgtctctcaagaagaaggaattcagatcgctcacccagggatctcgctctgttacggagtatttgcacgagttcaatcgtttggctcgttatgctccggaagatgtgcgcaatgatgaagagcgtcaggagaagttcttggaaggacttaatgatgagctttcttacccactcatgactggggattatcatgatttccagaagttagtggataaggctattcgtctggaagacaagtacaaccgcatggagcagaagaaacgccggattgctcaattcaagacacaacaggggaataatcagaagccgcgtcttactttaggaccccagaccatgccacatggaggttcttcatctgttgttcgtccgcagcgtcagttcttcaacaacaatgctggcaataacatccgtaatcaagctccacgccctgttgcagctccaacacagcaacaacctgccaagagggagcaaggcagcaagcccgtggtgtgtttcaactgtggagacccaggacattatgctgacaagtgtccgaagccctgacgcgtgaaggttgtccctgcccagaataactctgctgtaccagcatcaaaggcccgtgtcaatcatgtcgctgctgcagaagctcaagatgctccagatgtgattttgggtacgtttcttgttaactcagttcctgcaacagtgcttttcgattctggtgctacgcattcattcttatctatgagttttgcgggaaatcatgggatggaagtagaagatcttagacgtcctttgatggttagtaccccaagtaatcaagcactctctttgcaacgtagcccctctgtcagaatagaaattcaaggcgtaccatttctggccaatcttatcctgttagaatccaaagaccttgatgtcatcctagggatggactggttagccagacataaaggtgtgatagactgtgccaacagaaaagtaactctcaccagcaatgatggtcgagttgtaactgttcatgcattgtcttctgagtctttaaggtcaagactgaacccaataactttggaagagattcctatagtccgggagtatcccgatgtgttcccagataatttacctggtatgccgcctaaaagagatatagagttcagaatagatttggtacctggaacaactccgatccataagagaccttatagaatggcagccaatgagttggcagaagtcaagaggcaagtagatgatttgcttcagaaaggatacatcagaccgagttcatcaccatggggagctccggttatttttgtggaaaagaaagatcatacccagaggatgtgtgtggactatcgtgcattaaatgatgtgactatcaagaataagtacccgctacccagaattgatgatttgtttgatcagcttaaaggtgctactgttttctccaagatagatcttcgatcagggtatcaccagttaagaatcaaagaggaagatatacctaagacagcttttaccactaggtatgggttgttcgaatgtattgttatgtcttttggacttaccaatgcccctgctttcttcatgaacttgatgaataaggtgtttatggaatacctagacaagttcgtggtggtctttattgatgatattcttatctactctcgaaccaaagaagagcatgaagaacatcttcgccttgcattggagaagctacgagaacatgaactatatgctaagtttagcaagtgtgaattctggttgtctgaagtgaagttccttggtcacgtcatttcagccggtggagttgccgtcgatcctagtaatgtggaatccgtaaccaactggaaacaaccgaagacagtttcagagatccgcagtttcctaggcctcgcaggatattatcggaggtttatagagaatttttccaagattgctaagcctatgacacgactgcttcagaaagatgtgaggtacaagtggtcggaagaatgtgagcagagttttcaagagttgaagaatcgcttgatatcagctcctattttgattttgcctgatccaaagaagggtttccaggtgtattgtgatgcatccaaacttgggttaggttgtgtactgatgcaagatgggaaggtggttgcctatgcatctcgtcagttacgtccgtatgagaagaactaccctactcatgatcttgagttacctgcagtagttcatgcgttgaagatttggcgtcattatctcttcggtactcgtacagagatgtacaccgatcacaagagtttaaagtatatctttactcagccggatctgaacatgagacaaaggagatggttggaattaattaaggattatgacataggaattcattatcacccaggaagggctaatgttgtagcagacgctcttagcaggaaaggctattgcaatgctacggaaggacgacaattgccattagaattatgcaaggaatttgaaagattaaatttgggaattgtcagtagaggtttcgttgcagccttagaagcgaagcccactctaattgatcaagttagagaagcccaaattaatgatcctgatattcaagaaatcaagaagaatatgagaagaggaaaagctatcggtttcttggaggatgagcaaggaactgtatggttgggtgagagaatctgtgttcccgacaacaaagatttaaaagatgcaattctgaaagaagctcatgatactttatactccattcaccctggtagtaccaagatgtaccaagatctcaaggaaagattttggtgggcaagtatgaagcgtgaaatcgcagaatacgtagcagtatgtgatgtttgtcagcgagtcaaggcagaacatcagaaacccgcaggtttgctgcagcctttgaagattcctgaatggaagtgggaagaaatcggtatggattttatcactggtttacccagaacgtcatcaggccatgactctatttgggtaatagtcgatagacttaccaaagtggcacatttcattccggtaaagacaacttattccggaagtcgcttagcggaattgtatatggcaaggattgtgtgtttgcatggcgttcctaagaaaatagtgtctgatcgaggcagtcagtttacttcaaatttttggaagaaacttcaggaagagatgggttctaagctgaactttagtactgcttaccatccgcagacagacggacaaaccgaaagggtgaatcagattttggaagacatgttgagagcttgtgctttagatttcggtggaagttgggataagaatctaccctatgcagaattttcgtacaacaacagttatcaagctagtcttcagatggctccttacgaagcactgtatggtcggaagtgccgcactccgcttttgtgggatcaaacgggagaacgtcaggtttttgggacggatatcctaagggaagcagaagaaaaggtgaaaatcattcaagaaagattgcgtgtggcccagtctcgtcataagagttatgccgacaatcgccgcagagatttgagttttgaagaaggagattatgtgtatcttcgtgtcacgccttgtcacatcctgattttcgtttcaggatttataaattatttaataaattaataatagaatttatattaagtgttctttaatttacaagtgaagttaaatgtgggaaataaaatttcctaaatataaagcatggatggatttaatttttgttaaattctccatggttaattatactctctgaaattttctcggatttttcagagctcaattcctaaatgatacaaagaacagttcagtaattatttgatcattaatgatctaattatttttgttaagtgcttttcttgtttaaaatccttaaattataaattgttgtttaaaaggaataattagaaatgattttaaaagcctggaagagaagatctaattttaatttgctaaatctcaatataaaattgggctagataaaattttgttaaatactttgcttaattctataattcctagatttttctgggattatttgagctaaggaagtatttttaataaatggaattgccatttcatgaataattttaattgaaaaaggaattaaaagtctttttttggctttgggccgaaaaccggccccaaaccc

SEQ ID NO: 57089 - DNA, 6897 bp, Oryza sativa
ttcctggtttggagattagatctgtacagccgggtatggttgttcaggatggtcgggcctgtgcagcatgggtgtgtgttcagtgttgattaaaatttctgataaactactctactgttttatttctcttaaatattttgctaaacgctgcttttgcaaatgagcctatattatgccatcctttggtatccttgtgcacttgcatatttgctgtgtggcttgctgagtatgtcatatgctcaccttgcaataatcaatcaaccttagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttatcgttgtaattaatttgatgaatctgtatattaaattgtcagtttgtgtacctcggctgattcctggacgaggattttatgcacaaataagttcggaaattactagtgaaatttcgggcgtgacaagttggtatcagagccatctcgactgtaggataagccaaatggtcaaaccttaaggactatttttccgacaaaaaggatttgtgaaaatttctcctttcttccttatctagaattctttgcaaattgtttcattgtctactctcctctctcgttcaacttgagtagttctaaaactagttgtggaaactagaagacattgatgtggtcaacttatggaggtcagtcaagtggatcgaggaaggaccgaagtgccaagtggtcaagatggaatgaagtttgcatcctaccttagaacctatgccgccaaactatccttgaagaatagtcagtaggatagaacgtttgttgcttgcttgtgtgtaggtatggttgcattcccgtcattggtgtggttcaatgatgagtgtgtaactatactaggttgcttgcttaatcaacttaaacaatataatggtctacacacatcagatcagtgttaacctagttaaggtcttgtctttagtgtaacccctctccttctatcttctctaatttgcaatagatggtgaacactcgcgccagtggaagtggaaacaataacaatgaagggaacccaactcttgctcaagttctggctcaacagactcagttaatgaacatgatgatacagcagatgcagaaccagctcaaccaatggaacaacaatgctccaccgccgcagaacaagttagctgattttcttcgtgtgaggccacctaccttttctagcactaccaacccagtggaagcaggcgattggctacacgctattgagaagaagttggaactgctccagtgcacggatcaggagaaagttgttttcgcttcacatcagttgcaaggacctgcatcagaatggtgggatcatttccgaatgaacagagcagaaggacaaccaatcacttgggcggacttcacggaagcattcaagaagacacacatacctacaggagttgtttctttgaagaagcgtgagttcagggcattgaagcaaaaggatcaaaccgtggcagagtatcttcatgagttcaatcgtctggcacgttatgctccagaagatgtgcgtactgacgaggaaaggcaggagaagttcttggaaggtttaaaggatgaactgtcagttacgttgatctctcatgactatgctgattttcagcagttggttgacaaagcaattcgacttgaagacaagaagaacaggatggataaccgtaaaaggaaaatgactgttttccaggaggcacaaggtagtagccagaggcagcgtatcaagcaactccaaattggtgaatcttcttctgctggtcaaggacagtcgcaacagttgaatatcggtggtgagatcaaaacagagactaatgaaagcaatgaagttaacatcgagcaagctaatcagctggtgccagttcagcaggatcagtctcaagagaataacagtagtggacgggagcagcaggtatgtttcaactgttacaagccaggccactttgcaagagagtgtccgaagccgaagcatcagcggccgcaaggtcaggtcaacaacatgtcgtgtgctgagattcctgcgaccagagataaccatgtttcatatcaatcaagatgattgctaaccatgtctaccacgcggacaagattgctaacaacattgtcgtcacaggagccaatgcagtgccagttgcgtcttcaagagttgtgtcttcaagtgttacaactcagccaccagtttcaaagcagcagtagttttctttaaagccttagaatgattatcggagttatggaataagatagactgcagtttgcctattccctttttctttctagctgttccgaatctcgggacgagattctttgtaaggggggtagtttgtcacatcctgattttcgtttcaggatttataaattatttaataaattaatagtagaatttatattaagtgttctttaatttacaagtgaagttaaatgtgggaaataaaatatcctaaatataaagcatggatggatttaatttttgttaaattctccatggttaattatactctctgaaattttctcggatttttcagagctcaattcctaaatgatacaaagaacagttcagtaattatttgatcattaatgatctaattatttttgttaagtgcttttcttgtttaaaatccttaaattataaattgttgtttaaaaggaataattagaaatgattttaaaagcctggaagagaagatctaattttaatttgctaaatctcaatataaaattgggctagataaaattttgttaaatactttgcttaattctataattcttagatttttctgggatttatttgagctaaggaagtatttttaataaatggaattgcatttcatgaataatttaaattgaaaaaggttttaaaagtcttcttttggctttgggccgaaagccggcccaaaacctctctttctctctccctccccggcccagtcggcccagtcggcccagtccgccgagccgctgctctcctctctctctcagccgctgacaggtgggccccacttgtcagggtcgtcgtcttcgtcgcgccgctgccgcccgaaacactagccgagccactccgccgccgctttccaattcggccgcgtctttccttctccggtcgaattgatagaggggaaatgatcctcgggatctcctctaccttttctcttttggaaacatcggctaatttgttttggaagttcgtggaatcgagttcgattcggatcggcctctttcctccgaaccccgaagtttccatctcgtcgccggccgccgtgggcctttgccgccgcctcctagtcgctttaaaaggctccccggtgtctcctctacccgtcgccaccttcgccttcgcctctcgtcgtccgtagcgccctagcgccatgagacctagcgccgccgtcgccgctgtcgctccagccgtgcgccgccgccgtttcagccgtcgtcgttgctcgggaaggtcgtcatcgtggtcgtcaagtcgccgccgtcctcgtccgctccttcgccgccgccgaagaccgccggagccccgtcgccgccgttgacccgatctccgccgccgcttcttcctcatcgccggcgccgtccgttgcccttccgccgttgttttggtcaccggtgagttcgccgcgtcgccctctacccgttggtgccctccgttcgcgtcgccgcgccgtcgttcgccggcgagcatgcgcgcccgagtcgccgccggtggtgacgtcatcgctgacgtcatcgtccccgtctcccgtgagccggtcgtggaccgatcgatctcggccgtccgttttggatagggttgatctcggccgttcgtttccgtgaaccgttgccgtgcacccggtccaccgcaaaccctagccgctgacgcaataatcctccttttccttttcaaaaataattcattattgcgtcataattcaattaaaatccatataagtgttttaatccgatttaatctttaaaaattcatagctaattcatttgaactcagttttttgtggttcaagttgcaaaagttatataaaataaagatctacatattaaaattgtccataaattgaattaaatttatttaattctttttaaatgggctttaaatagatttaatcttgtaaaattcataataaattcatatgaagtcagaatgaggccgttcaagtctcataattcatctaaaattatgatctacatgtttgtttactttttatgtattgtttatttggtttttattagtcttttccttgttttgcgtgttagcttatcgtttccgtcgttgtgaaggttcgcgagtgcgtcggaagtgttcaagaagattaattgaagaccgattattgcaaggcaagtcacacagatcctaaacacaatcctttgagcatgttgatcctatatttaaattctatatttatttcaactgtgtatttattttcgaatgtcactgggtggtgtgaacttattcctttgttatggccaatttgcattgattattttattccttgataccttgggttattataacttgactagttgagctatatatattggatcagctagatattagatatgattgcttacccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcacgagctactattgtgaaacattaaccgtgccaaccacaagccagcgtgggcaacggctttatcttttgtataacatgattcattgcggagcaccagactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacacatggtagacatgatgttgaggccgtgtcttgtgggtacagtggtacacctctggccagagtaaaactattcgaatagccgtgcccgcggttatgggcgagttgagcaatgtttttcgtgattagtctcacacctctcacaataattatggatgttataactggtaataatttgcttagctcctggtttggaatggaaaattcctggtttggagattagatctgtacagccgggtatggttgttcaggatggtcgggcctgtgcagcatgggtgtgctgttcagtgttgattaaaatttctgattaactactctactgttttatttctcttaaatattttgctaaacgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttatcattgtaattaatttgatgaatctgtatattaaattgtcagtttgtgtacctcggctgattcctggacgaggattttatgcacaaataagttcggaaattactagtgaaattccgggcgtgacacgcctcttcgaggagttcatcgttttcacaccaaaggaaaattggcaccgcgttttgtgggaccttataagattgtcagtagaagaggagaggttgcttatcagttggagttacctcaatctttggcaggagtccataatgtgttccatgtgtcgcaattgaagaagtgtttaagggtacctaccgaagaagctaatcttgaacagatagaagtccaagaggatctgacctatgttgagaaaccaatccgtattttggaaatagatgagagaagaaccagaaatcgagttatccgtttttgcaaagtccagtggagtaatcactcggaagaagaatcaacttgggaacgagaagatgaattgaagtcagctcatccgcatctgttcgccagttcttccgaatctcaaggacgagattctgtttaaggggggtaggtttgtcacaccctaaaaattcaaaatatataaattgttgtttaaatggaatttttagaaataattttaaaagtcttgaagataagatctaatttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcttcttttggctttgggccgaaagtcggcccaaaacccctctctctctctcctcggcccaaccggcccagtccgccgcagccgcgcgcgccctcgctgtcgctgacaggtgggtcccgcctgtcaggttcgtcttccccgagccgccgtcgcccggccgaaccctagctcgccgccgccgccgttcccttccaaattcggccgctcctttccttctccggccgaatcaaaagaggggaaatgatcctcgagatctcctctaccttttctgctttggaaacttcggctaaatcggtttgggaatcgatggattcgagttcgaatcggatcggcttttcttt

SEQ ID NO: 57090 - DNA, 17509 bp, Oryza sativa
tttattctgcacttgtgggtgtgtcttgttgagtacggtggttgtactcagtcttgctcaatttttcccaaacccagaagaggagttcctggaggatgaaggcttcggtgtctagctcgtgcctgccgtcaagtgcctgtggtcgtcgccctagtcttccgctgtttttcgtttgtctttgtgtgtgctaggccctcgttgcccatgtaataagttaactatttacgcttccgcttgttaaactctgatttgtatcaacttttggtgtaccttgcctccagggacaagaattaatgcacgcacgtaaggaatgcccgttgggttatttccggtcgtgacaagttggtatcagagccacccttgaccctaggacgagccgtagatcccaagccttagcaatattttcaaaaataaaaatcctttgttatttgtgaaaactgtctagtctctctctgtcttgctgcttcatttactgccaaaatctgacctttaaaatgttgcttttctttttgtttttgtttgtagatggccggcagcgtcacccgtcgtggtttggacatgactggtttcgtcttggagctgcggggcatgtgcgttgccctggggtatccacatggagtggactaccaggctaggccgcttccggagcaggagggtgacgatgcggagccccacgctgcttgggaggtcactgcagtgatcctcgctggctctcccgagcggacttcgctgacagtcaccgcgggtggagattctttccccgccgcttgccagagcgccgctctcctcgccatcggcactctttaccagcgctacccggacgagttgcagcactcgccctaccgctaccaccctcgtcgcggaggagcctgcgaccacgccaccttccgggatgctagctcggaggatgacgctaccatcgtgcacctggcgcgcatggtggaggcgtacgacgcggctcgtatcgacttccatcagatggtgcgccgttggatggtcgagaacaacatgaagatcctggagctgcgtcaagagaacctgcagctcaagaaggacctagacgcagtggaggcgcagctgcatcagctcaagatcgcccagggagagatctgccgccccaagcgtcgccgtgtctgccgcagtcagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggaggatgcgctgttgctcaccttccgtcctggcccgtcgcagcagtagacgagcagttagtaggcttgcgcgtgtgttcttcctcgtttgtcttcttgttgggtcgtgtggggcacggttatgccggtgtgtggtgtaactgtgtcggagcctgtctttattttattcgcctaagcaacttgaactttaatgaaccaatttaatagcagtaataagtttaagaattatggtagtcgtgggtggttagctttaattgtcagctctctctgtttgctggttctgtgtggggttttcagatggtgatgaccaggaggagcgctaacaccggtgatggcaaccaacccgaaggcagcaaccaccaccaccagggcagcccacctccacctccacctcctcctccaccaccaccaccagataccaacgccattctcacccaaatcctcgcccagcaagccaacatgatgactgctttcctccaccacctccaaaatccgccacaacagaatgctccaccaccacctccccaacactctaaactcgccgagttcctccgcatccgcccacctaccttctctagctccaacaaccccgtggatgcgttggattggttgcatgccgtggggaaaaagctagacactgtgcagtgcagcgatgaggagaaagtcatcttcgccgctcaccagctgcagggacccgcatctctatggtgggaccatttccaggctacgcagccagagggacagcctattacttgggctcgcttcaccgccgctttccgaagaacccatgtgcccgccggagtcgtggcccttaagaaaagagaattccgagagttgaagcaaggcaaccgctccgtgatggagtatttgcatgagttcaacaacctggcccgttacgctccggaggatgtgcgggaagatgaggagaagcaagagaagttcctggcaggaatggaccctgagctgtccgtccgtctagtctctggggattatccggatttccaacgtctggtggacaagagcatccgcttggaagccaagcacaaggaactggagtcgcacaagcgccgcttggcgaatttccgcaatcaacagggtgctaaccaaagggtccgttacaccaatccctatccagggggatcctcctcgcagcagcaacaacagcagcagcaacctcgctccgcgcctcgacctcaattcgtggtgcgcgtcccacagccgccgcaacagcagagtcaacaagggactcgtgcgccccgtcctcctacgccaactgtgcagcctggtcaaggccgcagggacgctcaaggtccgcagcgtctgtgcttcaactgcttcgagcccgggcacattgcggataaatgcccgaagccaaggcgtcagcaaggccaagcgcctccccgccccaacaacggtggtaaggacgtcattcggggtcgtgtgaaccatgtgacggccgaggacatgctgacaactccagacgtcatcgttggtacgttcctcattcattccatccctgctaccattttgttcgactctggagcttcccactcgtttatatctgtgccattcgtggggagaaatcagttgggggtagaaagacttagaaaccctctgctcatcaccacccctggaggggttatgacagcaaagtactatagccctgccgttcctatagaaattcaggggattccttttccctcggatctgattctgctagacaccaagaacttggatgtgatccttgggatgaattggttggctcaattccaaggagtagtggattgcgcaagacgcactgtcactctgtaccgagggccggaacaaccggttgttttctttgcacccccaacctctgtcaaaagttcagaacttcatcagataggactgtcagaaatccccatcgtcagggagttcggagacgtgtttccggaagaactacctggtatgccgcccaagcgagagattgagttccggatagatcttgctccaggaactactcctctgtacaagcgaccctaccgtatggtagcaaatgaactggccgaagtcaaaaaacagctggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgtgaagaagatatcccgaagaccgcatgcaccacgcgatacggactgtatgaattcacggtgatgtcgttcggtttaaccaatgcacctgccttcttcatgaacttaatgaacaaagtgttcatggaatacttggataagtttgtggtggttttcattgatgacattctgatatactcacaatcagaggaagaccatcagcaccatctccgtctggtgttgggaaagttgcgggaacatcaattgtatgccaaacttagcaagtgtgagttctggttgtccgaagtcaaattcttagggcacgtgatatctgctaaaggagttgctgtggaccccgaaacagtgaccgccatcactgattggaagcaacccaagacagtcactcaagtccgcagtttcttaggtttggcaggatactaccgaaggttcatcgagaacttctccaaaatcgctcgacccatgacacagttgttgaagaaagaagagaaatttgtgtggagcccgcaatgcgagaaggcgtttcaaactctcaaagaaaagctggtttcctcgccggtgttaatcttgccggatactcacaaggacttcatggtgtattgtgacgcttcgcgccaaggattggggtgcgtgctcatgcaggatggtcatgtggtggcctatgcctcacgccagctacggcctcatgaaggcaactaccctactcatgatttggagttagccgcggtggttcatgctctaaaaatctagcggcactatctcattgggaatcgctgtgaaatatatactgatcataagagtttgaaatacattttcactcagtcggacctgaatcttcggcaaaggagatggttagaactcatcaaagattatgatgtgggaattcactatcatcctggtaaggccaacgtggttgccgacgctctaagtcgaaaaagccattgcaacactcttaacatccgtggcattccacccgaacttagtcaacagatggaagccctgaacctaagcatagttagtcgcggattcttggctgcgttggaagccaagcctaccttgctcgatcaaatccgcgaggctcagaagaacgatccggacatgcatgggctcctcaagaatatgaaacagggtaaagccgttggtttcacagaggatgaacacggaaccctatggaacggaaatcgagtatgcgttccagataacggagaacttaaacagctgatacttcaggaagcccacgaaagtccttattccatccaccctggcagtacgaagatgtacctagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagtcgtggatcgattaaccaaggtagcccgatttattcctgtgaagaccacctatggagggaacaaactagccgaactctacttcgctaggatcgtaagtctccatggcgttcccaagaaaatcgtatctgataggggaagccaattcacctctcacttttggaagaagctccaagaagagctgggtacccgattaaacttcagcaccgcgtatcacccgcagacagatgggcagaccgagcgtctaaatcagatcctagaagatatgcttcgcgcatgtgtcctagatttcgggaagacctgggataagagtctcccctatgccgagttctcctacaataacagctatcaagccagcatacaaatggcaccttatgaagcgttgtatgggcgcaaatgtcggacaccgctattgtgggaccaagttggggaaagccaagtgttcgggactgatatcctgagagaagctgaagcgaaagtcagaaccattcgggataatctaaaggtagcacagtcccggcagaaaagttatgcagataaccgatgccgtgacctggaattcgccgtggatgattttgtgtaccttcgggtcacgccattgcgaggtgtacacaggtttcagacaaaagggaagctcgcacctcggtatgtgggtcctttccgtatcgttgctcggcgcggagaagtcgcttaccagttggagctgcccgcctccttgggcaacgtgcatgatgtgttccatgtgtcgcaactcaagaaatgtctccgagtgccatccgagcaagccgactcagagcaaattgaagttcgcgaagatttgacctatgtggagaggccagtgaaaatcctggacaccatggagcgcaggaccaggaaccgggtaatccgtttttgcaaagtccaatggaacaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaaacgactctaaaatacatcctcgaaattgtgcatagaataattaaaatccttgtgaaagcctccaacaattaaaatgtgcaaatttaaaagtcaaacaaggcttggaggatttttgtatatttcctaaaagcctaaaatgcgtaaataaattttagtggaattttcagagcacaaataataattaagaagaaataaacaaagttaaaaaggttttataaaaagaaaaatcctaaaagtccttttcccccccccttttcccttcttgggccggctcggcccagctccctccctctctctcctctcccccgcggcccatcggccttcccccgcgcgcgcgccgctgacgggcgggcctgcctgccaccctcgctgacgggtggggcccacccgtcatcccctacctcgcgccgcatccgccgcccgcccgtgccctagcgccgccgccgccgccgaatccgccgcatcccgccgtccccgcgctcattaaagagggggaaatcactccccgtgatttcctctctctttcccctctcttttccctctctctctctccctcggattcgtttggaatcccgcccgaaatcctcgccggcgtcatcaatggcggccggatcttccgcgccggtttccttctcctccggccgccctctctcactcccaaccctatataaacgctccccgtgcctccctcctccgtttccgaccctcgccgcactctctccccgtcggattcgagcccgcgccgtcgtcctctctctccgccgtcgccgccgagctccggttcgccgctgtcgtcgccccggacctcctcccgcttcggcatcgcttccttcggcttcgccgcgttctcgtcgacctcgtccactcctccgtttcgcccgccgaccgccggagcaccgtcgtcctcgtcgacccgagccgcgccgccacccctctccgcttcggtcgccgtttccgtcgtcgccgtcgacccggggtgagccgaggaccgttgtttcactttccccttccctcccctctctcggccgccgctccgtcgcgccggaggtcgccgccgacgaccatcggggcgcgggcgcgccgcctcccgtcggccgtgccggcgaggccgccttcgggcgcgccccgcggctgccaggtggggcccggccgtcagccgcccgcgccttcggtgcggctgacgcgtgggacccacggcgccggccggtgtcagccgcgtgcgcccggtccaccgtggaccgtgaggctgccgcgtgggccccactcccgtggacccggtccgcgcgcccctccctcggctgacgcaataaacccgattttaaattaaaatttaaatgaagaaattcgtaaatatccatttaaagaacatataaacttcaaatggccatatcttggccatttgaactcggaattggaccgttcaagtctctaatttttccttaagaagtcaagaacccatttttgtgctttgtttctgcttgttatatggagtttagtagagtaaaagccttttcttttccgttggtcatgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgttttatttaaatttccgcgctatcactgttttatttagccatgcctatttacctttgttatgacctttttattgttattgttattattaccttgttcaccctagaataaacaaaaccccaactagtggacactctactcatggtaccactagtatgattttaggtagatgcttcgcttttaattaggtaacattaggcggttttacaactctagactttgggaatattcatatcacctggacactctggaattgttggattattgtggaattggattcacaccgccccctctattcaaaatccccaaaaaaggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggcgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgtgtttacaaaatagctttgagcaactaaatatctttaaatgctgtttactgcaaccctaacctttatagtataactcctttgtactcccttgcatttattctgcacttgtgggtgtgtcttgttgagtacggtggttgtactcagtcttgctcaatttttctcaaacccagaagaggagttcctggaggatgaaggcttcggtgtctagctcgtgcctgccgtcaagtgcctgtggtcatcgccctagtcttccgctgtttttcgtttgtctttgtgtgtgctgggccctcgttgcccatgtaataagttaactatttacgcttccgcttgttaaactctgatttgtatcaacttttggtgtaccttgcctcctgggacaaggattaatgcacgcacgtaaggaatgcccgttgggttatttccggtcgtgacaactttattccttgataccttgggttattataacttgactagttgagctttatatattgcttcaactagatattagatataattgcttagccctgcttagaaacattcgctcactattgggataacttatgactcactgttatttaatgatggcttaatgatagttcaagatggtcagtcgtgattagttaattaattaatgtgccaactaaaacctggtaatggtgggttgtgagcacatgtatttgatggtcgtgctcatgacaattaaggaccggttcacgagtttcggttgtgaaacattaaccgtgccagccacaagccagcgtgggcaacggctttatcttttgtatagcatggttcattgcggggcaccagactgagaagtggcggagataagcccacgggggtcgctggggagtccatgccttgtttataagggggtgattatgatccaggaatggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccataatagaagatgctataactggtaataatttgattagctcctggtttggaatggtatattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgagccctatactatgccatcctttgttatcctgtgcacttgcatatttgctgcgtggcttgctgagtatgtcatatactcaccttgcaatcattcatcagaggaagagttctacagtgaagctgatggtgtggaggattaggtgtagccttggtcaagctgcctgtggagtggagccgtctgcgccgtttatcttattttccgctgcttagatctttattgaatgagaggaactatctacctctgtaatgacatttgattcgcttattaattagagtaataattgtactctactatcaatttgttattgtgtgcctcggctgatttctggacgagggttcacacacatgtaagcgtttggaattttggatagaaattccgggcgtgacaccggccgctcccgagccgccgccgctgcccttccaaattccgtcgcccctctctatttccggtcaaattgattgagggcaaatgatccttgagatctcctcttccttttctcttttggaaacatcggctaattttctttggaaaccggtggatttgagttggattcggattcatctctctcctctaaccctagactttccttctcgcctccggtcgccgtgggcctccgtcgccgcctcctagccactataaaagcatccccgggacctcctctatccgccgccacctttgccttagcccgccgtcgcgtgtagcgtcgcctccgcgtagccgtagctgccgctgccgttgccgtcggtccagccgcgccgcgccgccgttgcagccgccgtcgtcggtcgccgtcgccaccatcgggatcacgaggtcgtcgccgtccccgttcaccgctttgccgccgctgtagcacgccggagcaccgccgtcaccgttgacccgaagaccgccgccgcttcaacctcgccgccgtcatcatccatcgtcgtttgtcgttgtccaagtgctcggtgagttcgccgcgtcgccctctacccgttggtgtcctccgttcgcgtcgtcgcgccgtcgttcgccggcgagcatgcattgccgagccgccgccggtgatgacgtcatcgctgacgtcatcgtcgctgtccccgtagacccgctgtggaccgttttgatcttggccgcccgttttggatagaatcgatctcggccgttcgtttccttagaccgtcccatgcacccggtttaccgtggaccgcctttgatgacgcaatattcctccttttccttttcaaaaataattcattattgcgtcataattcaattaaaatccatataaatgctttaatccggtttaatctttaaaaattcatatctaattcattgtaactcggtttaatgtggttcaagttgcaaaagttgtgtaaaataaagatctacatattaaaattatccataaattgaattaaatttatttaattcttttaaatgggctttaattagatttaatctagtaaaattcataataaattcatatgaagtcagaatgaggccgttcaagtctcataattcatctaaaattatgatctacatgtttgtttactttatatgtgttgtttatttggtttttattagtctttttcctcattttgcgtgttagcttgtcgttcccatcgtttcgaaggttcgcgagtgcgtcagaagtgttcaagaagattaattgaagacccgttattgcaaggcaagtcacacagatcccaaacacaattcctttgagcatgttgatcctatatttaaattctctatttatttcaactgtgcatttattttcaaatgtcactgggtggtgtgaacctattcctttgtatggccaatttgcattgattactctattccttgatactttgggttattataatttgactagttgagctttatatattggttcagctagatgttagacataattgcttagccatgcttagaaacattagcatatgatcgggataattaatgtttcactcttacttaatgatggatatttaatagatcacgatggtcaatcgtgattggttaattaattaatgtgccaactaaaacttgataatggtgggttgtgagcacatggttttgatggtcatgctcatgacaattaaggaccggttcacgagtttcggttgtgaaacattaatcgtgccaaccacaagccagagtgggcaacggctggacactttgtataacaaggctcattgcggagcaccagactgagaagtggcggagataagcccacgggggtcgctggggagtccatgcctctggtttttgagggggtgactatgatccaggaaaggtgcactgctttggattgagttatgcgaggggtcttgtcacaactacacaaatggtgacatgttcagcatgggcacatgatgatatggtgacatattgtggagttgtgtcttgtgggtacagtggtacacctctggccagagtaaaactattcgaatagccgtgcccgcggttatgggcgggtctaacaatgtctttcgtgattagtcccacactactcattaataatgatgtggtaattgttggtaattaatttagctcctggtttggaatggtatattcctggtttggagatagatctgtacagcagggtatggttgttcaggatggttgggcctgagcagcatgggtgtgctgttcagtgttgattaatattgatgattaattactctactgttttacaattctcaaatgtttgctaaatgccgcttttgcaaataagccctatattatgccatcctttggtatccttgtgcacttgcatatttgctgtgtggcttgctgagtatgtcatatgctcaccttgcaataatcaatcaaacctcagttgaagacaagttgcgaaggagaagacgtttggcttataccccagttgagctgcctgtgggagtggagccggagcttcgctagaccgtaattccgctgcagttttcttttcttttgtaagtatgtaacgttattattgatgattctgtatattaaattgtcagtttgtgtacctcggctgattcctggacgagggttttatgcacaaattagtttggaaattactagtgaatttctgggcgtgacaaccagggcgtattgatgggtatgttttctatcaactccactccagttaaagttctcttcgattcaggagcatcgtattcatttatatctttgaaagcaagccaacaacacaatttgaccagagttaaactaaggcaaccaatgttagtacattcacctgggggtgaaatagccgtggatacagcttgcattgacgtacccattcgccttagggatgtggtatttccctccaaccttatggtgctgatgcctcagacccttgatgtcatattgggtatggattggttaacaaagaatagaggagtaatcgactgtagacgtagagaagttaccctgaccacaccctggggatcggatatgagagcaaccatggatcaagatcctagactaactgaacgtgccggaggcatatttaccatgctacccctgaaaggaatgcccgtagtgtagcgattccccgatgtgttcccagaagatttacctggaatgccactagatcgtgacatagagttcactattgacctgatacccgggactacccccatatccaagagaccatatcggatgccggtcaatgagttcgaggaacttaaaaagcaaatcagagagttgcaagagaagggatttgtacgtcctagttcgtcaccttggggcgccccagtgttattcgtcaagaagaaggatggtagcatgagaatgtgtgtggactaccgctcactgaacgaagtcactatcaaaaacaagtatccattaccacgaattgatgatctttttgatcaactcaaaggagctaaggtgttctctaagattgaccttcgatcaggataccaccaattgaaaattaggatcggggatatacccaagaccgcgttctcaacgcgctatggattgtatgagttcacagtaatgtcgtttggattaaccaacgccccggcatactttatgaatcttatgaacaaagtgttcatggattacttgggcaaatttgtggtagtattcatcgatgatatcttaatctactccaaagacgaggaagagcatgcggagcacttgcgattggtactcgagaaacttcggaagcataagatatatgcaaagtttagtaagtgtgagttctggttaaaagaagtcgcctttctaggccacgtaatctcagccggtggagtagcactggatcccgctaaagttgaggccgttacggaatggaaggcacccaaatctgtgactgagattcggagttttctaggtttggccggatactatcgaaggttcattgaaggattctctaagatagctcgaccaatgactcaactactccagaaggaaaagaagtttgtgtggtcagaacagtgccaggaaagttttgagcagctcaaagaaaagctgacctctgcgcctattctagttctccccaacaataggaaagactttgttatatattgtgatgcatcaaggcaaggactaggaggagtactgatgcaggacggaaaggttgtggcctatgcatcgcgacaactgcgaccacacgaggaaaattaccctactcatgacctagagctagcagccgtggttcatgcgctaaagatttggagacactacttgattggaaaccattgtgatatctacactgaccacaagagtctgaagtatattttcagccagtcagatctcaacttgaggcaaaggcgatggttggaattaatcaaggactatgatctggaggttcactatcacccaggcaaggcaaacgttgtggccgacgctttgagtcataagagccattgcaatcatctgagaatggaagggatggctcctgagcttaaggaggaaatcgcccagctaaatctacatatagtaccccgtggacagataaacaccctggacattcaacctcttttgagaacccaaatagaagaagcccagaaggacaacgaagaaatccaagaggtgaaggaacgcctagctgcagggtttgcaaaggaatttttgaccgatgaaaaagatgtcctttggtataaaaagaggatctatgtacccgaacagggtggactgagaggattaatcctaaaggaagctcacgaatcggcatattcattgcaccccggaagtactaaaatgtaccaggatctgaaggaaggatactggtggcccaacatgaagagagatgtggcagaatacgtagcgctctgtgacgtatgccagaaggcgaaggctgagcaccagagaccggcaggtttgttgcaaccccttaggattcccgaatggaaatgggatgaaataggtatggattttatagttgggttgcccaagaccgcaacagggtatgattccatctgggtgattgtggatcgactcaccaagacggcaagatttatccccgtcaagacaaactatagcggtgccaaactcgccgagttgtacatgaccaggatagtatgtcttcatggtgtgcctaagagaattatatccgatcgaggcacacagtttacctcgcatttctgagagaaagtacatgaagccttaggaagttaccttgcttttagcacagcttatcatccactgacagatggccagacagagagaacaaaccaggtcttagaggacatgttgagagcttgtgcattggattttagcaaagactgggagaaatgtttgccctacgtcgaattctcctacaacaacagttttcaagcaagcctaaagatgtcacccaatgaggcattgtttggtcgacgatgtcgtactccactgatgtggtccgagactggagaacggacggtatttgggcctgacattatcaaagaggccgaagaaaaggttcgcctgatccgtgaccgtctaaaagtgacacaatcacaacagaagagttacaccaacacccgaagaagaaacctggaatttaaggaaggagattacgcttatctgaaggtttctccgatgaggggaacgaaaaggtttaaggtcaaagggaaactagcaccaagatatgtgggaccttttcaaatcacggctagacgaggagaagttgcatatcagttacagctaccagagaatatcgcggatgtacacccagtcttccatgtgtctcaattaaagaaatgcttacgagtgccggaggagcaagctccgttggaagaaattcacattggcaatgatctcacatatccagaacacctagttcggatattggatgaagtagaaaagaggactaggaccaaagtgtggcatatgtacaaggtacaatggagtaatcacactgaggatgaagccacttgggaaagcgaagaattcttgaagacagaatacccacacctattcgaagaccggtaagaaatctcgagacgagatttatttaaggtggtcggtttgtaacaccctgaaaattcgaccaacaaaaatcaaaactctaaaaatatgggccttcaaaaactttttaaataaattgcatcatgccgattttattcgcccatttcattggaatttggtttcgaagttcatagatcgcgaataaggattaattgattaggaagaaaacctaaaaattaaatgagaaaaataaataattgaaatataattgggaataaaaggtgaggttggaaataaataaaatattatcgcaaccatattagtaacaattgaattctagtgcgacggaataaaaaattagcccaattaaaaattcaaataaattatataaataaaatatgggtaatattaatcttgggtgaatccattggttggaataacataaatattgagtaaacctcatttatgcaaaaattaggatttatagaatagaatttatataggaaataggctaaacttgggataaataggaaaatactctgttcattgcactctaggtgctcgacgaggtccctagccctacccccttctctgccgcgtgcgcctggccgccccgagccccgcgccaccgtcgccgtcacgtccgtcgcgccctgtcgcctctactgcgccgcgtgccgtcgccatcgtcacccgtcgccgtcgcgtccgtcgcgttgccgcgccgccgtcccatcgcctcgcaccccacgccgcgccgcccgccgttgcgtcgccgctgccgcctgtcgcgcgtcgccatgcgctgtcgccgttgctgtcgccgtcgccgttgcgttgtctcgcgccccgtgccgctgcacgccgtcgccgtcgcgtcccgtcgtcgctccgagccacgcgccgccgctgccgcgccatcgccgtcgccatcccgctgccgtgccgcgcgtgccgccgtcgcgt

SEQ ID NO: 57091 - DNA, 5339 bp, Oryza sativa
ggtacacctctgatcagagtaaaactattcgaatagccgtgcccgcggttatgggcgggtctaacaatgtctttcgtgattagtctcacccttctcaccataatagaagatgctataactggtaataatttgattagctcctggtttggaatggtatattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgagccctatactatgccatcctttgttatcctgtgcacttgcatatttgctgcgtggcttgctgagtatgtcatatactcaccttgcaatgattcatcagaggaagagttctacagtgaagctgatggtgtggaggattaggtgtagccttggtcaagctgcctgtggagtggagccgtctgcgccatttatcttattttccattgcttagatctttattgaatgagaggaactatctacctctgtaatgacatttgattcgcttattaattagagtaataattgtactctattatcaatttgttattgtgtgcctcggctgattcctggaggagggttcacacacatgtaagcgtttggaattttggatagaaattccgggcgtgacaggtactgccaatgcgaggttatcgaaaagctttgccgtgacgcgtctcatgtgttgggacgaggctcatgtgttgggtagtcacggagtgcgggtaaattatacatccactgcagtgtgagtaaactaaatctattcgaatagccgtgctcgcggttattgagcaccgggacgtgtattacacttggctagactctgaattcttaacttgtatgggatgggttattgcatgatgatttttatgttgttggagccacttcctgagaggcgggaaggtggacgtcctcagaaaaccatgacgactcaatggcgggaatttatccttgagatcacaatggatggtggacagaaccgtcgttattcaaatgtgaacactggtactaaaatttgatcagtcagtgctaggtcttaggcttatgaaaagaattacaaaacttgctttgcgcaaaagaaccatagccatcctttgaaatacccctatcatgtgcattgttgctgtggtggcttgcggagtacggttggtactcagccttgcaatatataaacctaatcagaggccggagatgaagcttcggaggatccctacgcgtactaccaggagggtgatgaagacgacggcgcttagtaggtcttagttacggtcgttgcctgtggcaaaggcgtgccgctgccttaagtccgctgccttatctacttctgcttttggaatgtattccggaccgctcggttagatgatctaagactatgcctacgggcttatgatgtaataattcgcactagactctcgtatatgtgcatttggtatttcagctatgaactcgtgtgtagcagactacttgatccagggaaatggtaccgtttacacgattgattcctgttataaatacgggggtccacatttctacgatgagtttacaggagttgataggcggccttttccagtacatacaacaaataaattgtgccgaaaccttggagtaagccacttctatataatgtatctaccctatagttcaaacatgcactaacttatttttttattgattgacaggaatatatgggtgcaaagttcatggccgcacaccataaaattaagtctcaaaacacttcaatcagtactaaaggatggaccacttgaccgtgattgcttcaacatggccatacgcaagttcatgtatgaaaacatccggtcgcttcacaaaaccagctaagcaataacaaagcattgcctggacttacaattttgggtaagtttttataatctacccaatattgattcttttgctcatattttaaacaattattgtacatcatatagactgctactggatttggtataagtccaatgttccataaggatatagatcttgcggggtcggttggtagctggtcgaaaatccattatgaagttgcaaaatgcaaattggtaagctagctatcctttgttcttatttgaatgtgtttttttatattatcttgacggttgactttttccatattcttataccagtatgtgctgttggaagctatatcttggtcatactggaccaagaaagcagaacactttatctactagaccctaatccactaaatccaatgtatcagaacaacccaactatgagatataccaaaaaattgttaaacgttaccaactattacaacagagccatgcgtgtggcatgtcctggctctaggtggactgaggatatcgacttgtggggccatatatatgtcacaaatccggtggctaactcgtaagttttcttgtataatcttgtttgatccaataaattatttttgtctaacgcatggtgcctaactattcaaatttcataggaatttgtcgggttgtctcgtgcatctgttcatgcgatcctggaaagatggagcacttcatttgccgtcttttaaggtcattccgactagcattggcatttagaatattatattatattttataatacagtcatttattttataaacatatgcatttgctagtcgattaattcctgttataaatacgggggtccacagagttggtatcagagccatacgactgtaggaaaagaccaaaaggcgccccgccccttttctagttggccaagggggaaattcccatttagtaatacttttaaaaataaaaaaacgctatgtttacaaaactctatacgattttcatcttactcttaactattttcttcacaaaacaagttttactcttagctgactttgggtttttcttaaaattagatggcagatcaggattcacccactacctaggagatgggtgtaccccgctcagagggatacgtcattgagctacatcggttgatgaggcgcctacggtaccccagatttccgatctaccgagttcgacagtgtggacccgtttgggaggcctgggtcgaggttcatacacgagttccttcaaagtcagactacagctttccgacacgccatcgtcgcgacttaccggagaccgcgatgcagggtgcagcccgggaggccttcctccgacttagctctattcaccgagctgagttagtgagtaccgagtttgctcaccacccgtttcgagaggagagcaactccgtctgcacagttcaggacacaccttgctgctacaacccgatagtgactctactgtcccgatgggctgaggcagtagacgacttctacgaggaggctctgttagagatcgacgaccagcagaggcgtgtgggaaagttagagagtgaggtgactgacctcacagtacatcagcttcagctagaggaggagcaccaggctgggggcagtgagatagactcactgaaggcacagcttcaggtccacggtgaccagtttcagcagctatctgatcagtacaatgatcgccgcgggatgatggatacactcgaggagcactgagagagagttaggagcacgtcagccagcttgaggagcagcttcaagcagctatagtcagcaccacaggagcttctacttccacagcagtggggcgtgaccgctacttcttcctcacccggccgtacccaccagcgttccacgctcttctgggagaggttggtatgctggctactgagtcagcaccttacttggtggacccgacagtgacacagccacctgccccagagattgtgcacactccactgatccctactccgtcaccgcagctgggttccagtatgaagactccgatccaggtcgactccgagacagaggggactgacaccgagccagagatagagccggacatcactgatcctttagaggacgagactcctgtcccccgcatcacctttatcggaggccctcgcaccctcagcactgcccgcaagagcgcacgacccccgggcaagaagcccaagccaaatccagaggccactacttccgagccgtggggactcgggtttgcccgtgccagcgaccaccctctacctgccccaggatcctgcggatggttggatgactagactggaggtctattgcagcttcgatctcgcttcagatggtttttggatagcatgcgagacacacacccccgctacctagattgacgagtagcttgatgattagtttgatgtatcttttggatgaactttatttggactgcgtatatgtgcagtcgattgcatcatgatttatgtactatctgtggaactctgtgatgttatttatgatattattactgttgtgttatgaatgagtttattccaccatgcttgcaaaataaagttcacaatcaaaacaactcctttaacgagataaaaccaaaagggctagttaggaaaataggatacttacctcatcggcgtacacagatggcaagccgacgtagggcgtcaaccagcaatgaagaaactcaagcacccgacctaaacaccctggccggagtcatggctacccaaacccaacttctacaagccatcacaaataatcaaggcaaccgtggaggatcaagctttggagaattcatgaggactaagccacccacgttcgccacagctgaagaacctatggatgctgaggattggttaaggatcattgagaagaagctgacccttgttcgagtacgtgaagccgataaagtgatctttgtggcgaaccaattggaaggaccaaccggagactggtgggacacatataaagaagcccgagaagaagatgctggagaaccaaaccgggaggaattcactacagccttccatgacaacttcgtgcctgccgctgtgatgcgaatgaagaagaatgagttcaggagactacggcaaggaaataccaccatacaagagtacctgaaccgtttcactcagctggcgcgttacgcgactggagatcttgccgatgacgaggaaaagatcgacaaattcatcgaaggcctgaacgacgagttgcgtgggcccatgattggataggaccacgatagtttccagagtttaatcaataaggtcgttagattggaaaacgaccggaaggttgtggagcacaatcgcaaaaggaggcgtgccatgaaccgcccgcctcaggccgcaccccaatgtcctaaaggaacaacctcctcagtatggaaaccaacagtggtgacaaccaatcgtcctgccgcatttagcaatttccacaggccgggaacca

SEQ ID NO: 57092 - DNA, 1095 bp, Oryza sativa
cggatccaagcgagggtcaagacccgcaggacttcgaccaacgcaagtcatcaccattctttgaacatgttgatccaattgcgaaattattttatttccaaataagattgcatgcaatgatgaacatcctacttgtgattatgccatgtcttgattattgtttacctttaaatccttgtaaccataattacgtatgagtccttagtcaattatgacacatacttagaaatgctacactagattcatgcacgctcatattttatcaaatgctatatgcttgggcaattacctttgggaaggtaattgagatgcggcatgtggagacatgagcgccacattgccatgatgatgatgacatgatttgtgaaagtaggaatgaaattaaacacttgttttagactggggcggacgatggatttgggtggtatatgggaaaggctagtaccgtccccggtcaattaagaaccgagccatgaagttaagcatgaaacgacccccgtacaaccgcacttctcgtatgggtatagacctagcggattaaataaccgagcggaggcagtatccctacatagatggttcacccctgagtgacgcaggtgcgctaccgtgggacagccgttgaggtagggccgagaggcgtgccctacatcggtgtcgccatgggtaggactgccatgagtgcgtgagagagagaacttaacctgaatcataatttaatatgtgtgagacttctttttcccgggagcgccagaactcctctcactgctagaaatgtatgacgcctagagtgcatgagggctaaagttcatggagcgggtactgccaatgcgaggttatcgaaaagctttgccgtgacgcgtctcatgtgttgggacgaggctcatgtgttgggcagtcacggagtgcgggtaaattatacatccactgcagtgtgagtaaactaaatctattcgaatagccgtgctcgcggttattgagcaccaggacgtgtattacacttggctagactctgaattcttaacttgtatgggatgggttattgcatgatgatttttatgttgttggagccacttcctgagaggctgggaaggtgga

SEQ ID NO: 57093 - DNA, 7801 bp, Oryza sativa
cctttttccatattcttataccagtatgtgctgacggaagctatatcttggtcatactggaccaagaaagcagaacactttatctactagaccctaatccactaaatccaatgtatgagaacaacccaacatgacatataccaaaaaattgtaaacgttaccaactatttcaacggagccatgcgtgtggcatgtcctggctctaggtggactgaagatatcgacttgtggggccatatgtatgtcacaaatccggtggctaactcgtaagttttcttgtataatcttgtttgatcttataaattatttttgtctaacgcatggtgcctaactattcaaatttcataggaatttgtcgggttgtctcgtacatctgttcatgcgatcctggaaagatggagcacttcatttgccgtcttttaaggtcattccgactagcattggcatttagaatattatattttattttataatacagtcatttattttataaacatatgcatttgcaggatgttgatgagctaaggaaacaatttttgctacatatactgatgtatgagcaaaatgagtgcacaagcaacattcctagcggcgcacgagattttcttcactgtatcgcaaatgcaaaacattagaatagttattctttacctatggggtgtattttatacataacaaatgctttatttaaataatggaataactctacacttctctaacatatttttctgcccgcaacaaataatggaataactctatacttctctaacatatttttatgcgtatattgccttttatattgtgtagtgtgtacatagggtatattatatataattaagtcttgtaaagttttactgtgcccacgtaatatcatagtactgcaccttacatgaaatatattaaatgtactatatgatttaattaaagttcaaatgcacagatcatataaaaatattttttggtaacgtgaaatttttttaaagatacagttaaatataattgcaccgtagcgtttagcacgggcatattactagtactattggctgaactaattctaagtgccatacacatgatcctaaaaatggatatcatgcacttgggaaagtttctcattttgattcactgggtccatatacatgtatctatgattgaactcattctaattgccatacacttgggaaagtttctcattttgattaatgggatccatctacatgtatctattactgaactcattctaattgccattagagccattagacgtgatgtcgttatcacagagtattgtagacattaacatatgagcaatgcaggctgaagagacgatggtctgggacagacttgcttgtgaataatcccaaattcgctggagcaattgagcaagccataagaaacacatttacaacgtcgacaggaatcatctgtcaaccgcacgaggggcaactatttgattcgccggcagaagcctatcaattttacaacttgcatgcttgggagtcagggttaagtattcgtttagggcaaagccggaagatcgatccaatggagtgctatacatgcagggagtttgaatgccagctatctgtcggtgaacacaaatcattaagcataatagttttgtctttttttttatcgcgaatcctttcatggaatatgttcgtgttctgcataaaaaggtcaattaggcctagaggggagggggggtgaataggctaatttaaaaacttaagtaaagcggaagcagtaattttcagaactaggctgggaattttcggaacttccgaaaggattttcggaacttccgaaaatgcacagagcagcgcacacaaaaagaaatatctagatctagaagtctaccacatgtaatcaaaggcacatacaacaactagaccaatagcggcacatgcaagcaaagttagaggagagggatgaagagatatcaccaaggtgaagcttgcaaacttgttcccggagttcaaatccttgaggggattctactctccgttgaggagctcactaagagccaggtcttagctaatcctttcctcgagaggttacgctaagcactcctcctaccactaagaggtatctcttccctagcttgcggaggcgagatccggccttcataatcttctcccggctaaccacaagtagatcggtggctcgggagtgacacctggccgtctaggagtcctcaacctccaagagtaaaagatgatgcaaagaattcccggagatgatgcaagtgctcacaaatcttcacaaagaccacaagaagcacccacacaaactcgaatccacactctcacacacaccaaatccgaatcaaacacgggtggagagatgaatcgaggaagcaaggctcaaatgaactagagagagagcaagccaagggcacaaataattggaatgaaactagcagccctcacaagtgaggggaggtgggtatttatacccacagcacaaatctgcccgttggagtgcaataaaagtaattttcggaacttcggaaacaattttcggaacttccgaaaattccagatctgagaaataatcaaagtcaacgcacttttcggaacttccaaaaaacgttttcgcaacttccgaaaatttccagaacgcttatgtgtattttcggaactttcgaaaatcattttcggaacttccgagaatttccagagagctatcaaacggttctgtgtattttcggagcttctgaaaatttccagaacgctccaaaagagaaatgctttgaagaaaaattgattttgagcacacgcatcactccttgtatgtctatgcatcatcccccttaatagtacggctttcctacgacacaatgcgaggaaaaagatacaatataccatttgatcattgccgcattgcatcgcgatgtcgcattcacaggatatgcattgtattacaacacgttgaggacttaacaaccttcacatttgcttgaataaaaatgttagtcctctctaatcgcattgtaatcaattatcaaaatcattagggacctagatgcactttcaatctccccatttttggtgattgatgacaattcgattaaatcacaagagagaatgataataatagatgattttggtgcaaatgtttagtgaaatctccccctaagagtgtgcataaaagcaagtggagagctccccctaaatctttgcatccacattgaaactcacaaaagaacaagtatcatcacaatatatgcatgaaggatcatttcatcatatcaaaatcgcatctcaaacaaaataatcatttcatctcaacaccatcacaacatagagagaatagaccattgcaacaaatacatcatcatctcatcacaaccacaatatagaataaatgagacatgacatcacatttaaacataagacacaataatattgaaacaacccggaattttaagctatttaaaaaaataaaaattatgtgacatatatcattaattaatcagttaactagcaaaattgttggaaacaagaataagccactcaaaatttataacattcgcatccgttgaagtaaaacaaataaataatgtccaatataccaccacaatatactaataataataacatggaaatattatacgaacaaacatcactataaacagtcatcatgtatacataaacttacactaataatacaatacatcatatatttgaatatacggttgcacaggacatacatagcttgaccccttttatgcacaaaaggtaatatgtaaataaatgttgccgtcagacccatacacaaagtggtgtatattcaaccgttcactgagatacctagatcacctagatcagctaataccgtctggcacccctcacttaagtcgggttcgtcatccggctaattaacacaaagaagccgcacatctcatataaagaattaatctcaccaaagggacctcaattcaccagcagtattaattatccaccaatcacatagctccacataggaagcttcacacaagaccacaaagatagtagcacaactccatccactttggtcaagactctatctcaccttggtcaagcactcaaagcatgaccacagccatggcagcagatgcatgcatatgagctccaaccaattagtgaggagtgagcagcccaggagaggaggaggagagaagtagggagtgaggagcaaacaaatcagtgaaatgcaagattgcgccccatccattgcaagcaccaaatcttgaatcccctataattagtagccaaatagttcttggccaaatactcataccatcactatgtcggctaggaagaggagaagagaaatcagcaaggagggaatgtgatttacccaaggaagaggaaaggccaatgcatcggcgaggatgaacacgggagcacagccatggacgaacttgtcacctaggcaaaggtgaatccctcaatacttggctttcctttttttttagcacctagcaaccaagcatctgttccccctacacctgcaaatcaccattagagccatcactaaattgcacccatcactgcacaagtgctacagccagagagatgagagaaggggagagagagagggagggagagagagagagcacccacagccgcagccgtagctgcagcaaccaccaccgccacagcagtagccgcagcagagctgatccacactagcaatggtagatcggtagccatggcttggatgatttagctgggaaagggagaagtgccttaggaacagcagcaaggaagaagaagaagaggaattactgctgctgctgccttatctgttcgaggaaggagagattagagaaggaaaggggattaattgctggatgtacactactaggctacacaagatattaaattgaacctacgcattacctattactacacattatctggaagaaagtttgcacattaaaataaactctacagagcacattttattggtagatcatttgtatccctagtatttaaatttatcaaaacctcaacgtatatatataatataatgcaggaatgagtagaatgataattgggtcaatcggcagtgctacataatttcgattcaactacagaaactcaggcaagtctctcctttgatcatgttgatagatgataattctatttcaacttaaaaatctatttcataaaaatatttctcctagtattgcatccaaatatattttctagaataatgagattaactatgatgatatgattgacaaactgatgatgatggagatcattgggatactagtatggtgggtatggggagctcagggatgagatgattgatgatgagggcaggacagggctctccctacatacggtgtataaatataaggactaatcatcccctcactcgtatcaaagaaccgtatataccgtgtcgaccatatatccgtcttaagacgggctggacctagtaccttatcaagtttattatactccacatgggtacgtagtagtaggatgggagatgatataaaccccaggaatgccgatgaagtgcattccaggcctcatatagtagcgcggtggtgtggagagctgataggctcaacacaaacgtggagtatagtaaattgaagtagggaaaaagttttgtactcttagcgtggtgccgcatctagtgaagtgcgacagtcaaacgtgttaagactagctatgggtacagtgatacaagcctgcgcagtgctaaattaaatcgtgattcacgcctgtctcctggattggaggctacggggagttgttacaaactctattcaatgttacgagtgtactctagcttttataaatctccttttgaaaactcttttagaaaatagaaatatactttacttttgatgacaatgaaggtgatgatgttacgtaaggtatagtattatagtatatagatttatatattattattcatgcatatacattttattactaatgacttgctgagtacgaaagtgctcacccttgctatataacccctttgtacaggtttgatcccttgcaagagtgagctggattagagatggccttaatactcctagggacgaattaaaggtagctctaactattcctctgttgcgatctctgatggtggattattatttggcaaaataatggttgttaaataataatctacagtctggcacttttatcttcattgttaaaagtgtggggcgtcacaaatatccattacatcccatcatccataattaaacaataatgtcttacaaagcattaaactaacttaagaaacacacatgtctcatacaaataaaaagtcactaatgttcgaccaacataagggatagagatgatagatagtctccccctttggcatcaagacaccaaaaagagaggacgaagagacaaagactcaagcaaggggcgcctgaggaggatcctctggaggaggttgtgggggatagccatagccatggccataacaaaagaaatcaaagtcaggaagcaccccagcaaatggatcctctagctcttcctcctcgggctcatcgggctcggcctcgaaacccggaggggaaggagggatatcaatgtggtggtcctcatgataccgcgccttgaggtacttgacgtcactagccgttttcttcaccaaattccgtaatcggcggttctttttagcctccgcggagcaaagactaaaaatagtccgcaaaatgcggaataagggagacggctcatgacgagccatagaggaaggacgctcagaagcagaaggcggctgagaggatgtggaggggatgtcccgaggcacagacctgtgcttgggcaagcgcaaggaaagagcggtatgtggttcctcgcacacaaactgaaggtgagtgacatgttcaatcatccgaattatatgaggagcatagggaagccttctcttaaactgaagagaagccatgcggatttcctgccaaacaaatagaaagacatgaaagggacggcaggggggattgaacctgaggagcatagagcgggagaaatggttgatgttgctagcatcaccatcctttggagtcatggtccgcctgaggatgtggttgagatagatatgataaggcttgagcccttcagtagtccccaacttgccgccaggaagatacagagggtgcaagtcatgattgtgaggaatcacaatgtcatgcaagtgggtcatgtaccgcatccagttctcatcaaaaccccacagattggcaagctggtcataagagatagaataccacgagccctgagtcatccaatgaatgtcacgatcaccattaaaatagactatggcatagaattgagcaatgatctccttgcaccaagcctgctgaagggtcgtgaaattgcgaacccccatctcctcacaagcgccaatgacggcattgaggtcaggatcatccagggtcgccaaagcctcccaatctatccattgcatgggcagtgtaggattggaaggaggcaaaatgacagtttcataaaagtcttgctgaaaagaggtccagtacctgtcatcagaggcaatgcgcggcatgcaacgaggatcctgattccgctccacagccacaatgtcagacttttggtgccagtcacgaacaggtcggtgaggattgcgcgagggagcatgaagcatgagggggccgatgagccccgccggaggaggcgcagtggtgtgagcttggcgagaagagccctcgccagaggaagccaaaggctgctgcgaagacccttgatccccatgagtggagcccccaggagggatagaagaccccccgggaacattggctacctgaggg

SEQ ID NO: 57094 - DNA, 9601 bp, Oryza sativa
ccactccttgttattcttatactcattgttattcttgtcttgattgaaggatgcctcctcgcaagaaaacttctcgcaagtccaagcgctctagggatcggtctcccactccttccccatcctatcatgaggactcggaccgtgattggtccgggggaggagaagaggagaccggccctcaggtggccaatgttccccggggctcctctctcccacctcggcgctcaactcatggggatcaagggtcctcgaggcagctttgtgctttctctggcgagggctctcctcgctaagctcacaccactgcacctcctccggcggggctcatcggccctctcatgcttcatgctccctcgcgcaatcctcgccgagctgtacgtgactggcgccaaaagtctgacattgtggctgtggagcggaatcaggatcctcgttccatgccgtgctccgcctctgatggcaggttttggacctcttttcagcaagacttttatgaaactgtcattttgcctcgttccaatcctacagtgcccatgcaatggattgattgggaggctttggcgaccctcgatgatcctgacctcaatgccgtcattggcgcttgtgaggagatgggggttcgaaatttcatgacccttcagtaggcttgctgcaaagagatcattgctcaattctatgccacagtctattttaatggtgatcgtgacattcattggatgactcagggctcgtggtattctatctcttatgaccagcttgccaatctgtggggttttgatgagaactggatgcggtacatgacccacttgcatgacattgtgattcctcacaatcatgacttgcgccctctgtatcttcctggcggcaagttggggactactgaagggctcaagccttatcatatctatctcaaccgcatcctcaggcggaccttgactccaaaggacggcgatgctaaaaacatcaaccacttctccctctccatgctccttaggttcaatccccccagccgtccctttcatgtctttttatttgtttggcaggaaatccgcatggcttctcttcagtataagcgagggcttccctatgctcctcatataatgcggatgattgaacatgtcactcaccttcggtttgtgtgcgaggagccacataccgctctttccttgcgcttgcccaagcgcgggtctgtgcctcgggacatcccctccacatcctctcagccgccttctgctcctgagcgtccttcctctgtggctcgtcgtgagccgtctcccttattccgcattttgcggactctttttggcctttgctccgcggaggctaaaaagaaccgccgattgcggaatccggcgaagaaaacggctcatgacgtcaagtacctcaaggcgcggtatcatgaggaccaccatattgatatccctcctttccctccgggtttcgaggccgagcccgatgagcccgaggaggaagagctagaggatccatttgctggggtgcctcctgactttgatttctttggttatggccatggctatggctatcctcctccacctcctccagaggatcctcctcgggcgccccttgcttgagtctttgtctcctcgtcctctctttttggtgtcttgatgccaaagggggagactatctatcatctctatcctttatgttggtcgaacattagtggctttttatttgtatgagacatgcgtgtttcttaagttagtttaatgctttgtaagacattattgtttaattatggatgatgggatgtaatggatattattgtgtcttgtttaatgtgatgtcatgtctcatttattctatattgtggttgtgatgagatgaaatgattattatgcatgtgatgtgatgagcaaaatgtgagtctagttgtcttgtgagcttcaatgtggatgcaaagatttagggggagctctccacttgccttaatgcacacttctagggggagctttcactaaaactttgcaccaaaatcatctattaaatccattctctcttttgatctaatcgtattgtcatcaatcaccaaaagggggagattgaaagtgcatctaggcccctaatgattttaatgattgattacaatgcgattagagaggactaacatttttattcaagcaaatatgaatgttgttatgtcctcgacgtgttataatgcaatgcatatcccgtggatgcgacatcgtgcaatgcggcaatgatcaaatggtatattgtatcttttaccttgcattgtgtcataggaaagccgtactattaagggggatgatgcatagacatataaggagtgatgcgtgtgttcaaaatataattttcttggaagcatttctctatttggtttgttctggaagttttcggaagtattttcagaaattccgaaacacagaacgagttataagcttctggaaattttcggaagtattttcagaagtatttttggaagtttcgaaaatacacagaaccgtgtgagagctctctggaaattttcaaaagttccgaaaatgattttcggaagttccaaaaatacacaaaagcgttctggaaattttcagaagttccgaaaaatgcgttgacttcgattatttcccaggtctggaattttcggacgttccgaaaattgtttcggaagttccgaaaattacttttattgcactccaacgggaagatttgtgctgtgggtataaataaccacctcccctcacttgtgagggctgctggttccattccaattatttgtgcccttggcttgctctctctctagttcatttgagccttgcttcttcgattcatctctccacccgtctttgattcggatttggtgtgtgtgtgagagtgtggattcgagtttgtgtgggtgcttcttgtggtcttagtgaatatttgtgagcacttgcatcatctccgggagttctttgcatcatcttttactcttggagtttgaggactcctagacggctaggtgtcactaccgagccaccgatctacttgtggttggccgggagaagtttgtgaaggccggatctcgcctccgcaagggaagagatacctcttagtggaaggaggagtgcttagtgcaacctcttgaggaaagggttagctaagacccggctcttagtgagctcctcaacggagagtagaatcccctcaaagatttgaactcctggaacatgtttgcaagcttcaccttggtgatatctcttcatccctctcctctaactttgcttgcttgtgccgctattggtctagttgctgtatgtgcctttgtttacgtgtggtagacttctaaatctagatacttctttctgtgtgcgctgctctgtgcattttcggaagttccgaaaattcctggcctagttccgaaaattactgcttccgctttccttaagtttttaaattagcctattcaccccccccctctaggcctaattgaccttttcagaagccaaagagaagatgtacaagtgattggaggcaagaatcattcgaaaccaaggttggagggctcggccaggaattttcggaacttccgaaaataattccgaaaatttttggaacttccgaaaatttcagcccgagcactacaacttagatcccgcacaaatccaccaacaaaaacttgtgaaattgaatctacagggtctatggcactaggggaacaactccaccgaaggaaatcgcaagattaaactcgaggaatcgagggattcgattttaagatgggtacctcaagaacacgaagaacgcgaagaactcggtgaagaacaacaatgtagctgccaagaagacgcccaaccttgctcccacaaagttggagtggaggggagtgccggggaatcgctgaggaatcaccggggaggagtggatcgccggagaggggagggaggagaagaggaaaccgtggagaagaaagaggagagagagagagaaaagaggtccacggtcgggggtattagtatccctccgagaattttcggaaattccaaaaattttcggatagatccgaaaatttacataaacatttcgacggttctagaaattttccgaagttccgaaaaattttcggaagttccgaaaatatacagaagcgacgcaatggttctggaaattttcagaattatccgataactttcggaataattccgaaaaaacctggaaagctaacaaaaacccctttttgaaaggattcgcgccagaattttgatgaaaaacaattttgcaaactttttgaaatgcatttttcaagggaattcgcaccaggaattttgatgaaagcaatttgcaaacctttggataggagatggagtgaaaagaatggtcgaacatttaggccccatttgagcttatggctagcacgcaatcaaccacacaaaacaatagccacaagacaaatggatgatccaaagatcaaatgagagtgaattaccatgagacaagatgattcaccctcgaaagagggaatgtgcgcatctactgcaaattgtgttaggaccaacattcattgaaaaatgagatccccatacacatagattcaaaatatccacagaaatgtgacgagtgtccatccatgaattgaatgttcattttatcacaaggagaaaagtaacctatagtagaaataaaaaacaaatgcatgcaaaagatcaagccacgtttcgagaatccaagatatttagttcacttctcaactcacaaaacctagcttcatctagaggcttggtgaagatatccgccaattgtttgtcggttctcacatgttggatatctatgtcgcctctcgtggaattgtctctcaagaaatgatggcgaatatctatgtgtttggttcgggaatgttggacggggttattggctatcttaatggcgctcttattgtcacataggaatgggattttagacatatttaggccatagtctctcaaggtttgcttcatccaaagaagttaagcacaacaactctccgccgaaacatattccgcttcggcggtggatagggcgacggagttttgcttcttggaagaccaagaaacaagcgacctacccaagaattggcaagtacttcatgtgcttttcctatccactttgcacctggcataatccgcatcggcatagccaatgagatcaaacctcgctcccttaggataccaaagaccaatgttaggagtgtgcactaagtatctaagaattctcttcacggccacaaggtgacactccttcggagcggcttgaaatcttgcacacatgcacacactaagcataatatcgggcctagatgcacaaagataaaggagtgagccaatgatggaacggtataccttttggtcgacgtctttaccttgctcgttaaggtcgaggtggccatttgatggcatgggagtgtggattggcttcgcattctccattccaaacttcttgagcatgtccttcaaatactttgtttggcaaatgaaagttccttccttgagttgcttgatttgaaggccgaggaagaacttcaattcacccatcatggacatctcaaaacgcttggtcatcatcctactaaactcttcactaaaagacttgttagtagaaccaaatataatgtcatcgacatatatttggcacacaaaaatatcattattatgccttttagtaaaaagagttgaatcggctttcctgatctcaaagccattttttcacaagaaaattgcgaagacactcataccaagctctaggggcttgcttaagcccgtagagtgccttatggagcttgtacacgtggttgggatattttggatcctcgaagcccggtggttgctccacgtataccaactcgttcataggcccgttgagaaaggcgcttttgacatccatttgatatagcttaaaattgaggttagtagcaaaagcaagcaatatgcgaattgactcaagtctagctaccgtcgcaaaagtttcaccaaaatctaatccttcgatttgggtgaacccttgcgccactaacctcgccttgttccttattacgaccccggcctcgtcttgcttgttgcggaagattcactttgtgacaatcacattttgctgaagtcactccaccaaagtccacacttcattccgggtgaaattgttcaactcctcttgcatcgccatcacccaattcggatcattaagagcttcttccacccttagaggttcaagagaagacacaaacgagtaatgctcacaaaaatttgcaatacgagaacgagtggatactcccttgttgatgtctcctaagatgttgtcagtgggatgatctctttggatactttggtggattcttgggcgagctaagttgatcagtgagggtggcacttgcacgccttcttcaccttgatccaagcttgaggtagagggattgtcggcttgggttgatgtaggtggctccacttgtgttgaggaagaggctccttgttgtggctccctagggcgtacgtccctaagagccaaccttttgattgcttcactcgggtcctcctcttcacctaacacatgtgagtcaacttactctacttgagagccattagtttcgtcaaatgtcacatcacgtgcgatctcaacaataccggaggatttgttgaaaacgcggtatgcgcattcatttgacccatacccaagcaagaatccctcatccactttaggagcgaacttagaggatctagccttcttattaagaatgtaacacttactaccgaaaacacgaaagtaagagacatttggtttgttaccggtaagaagctcatagggagtctcttaagaaggcggtgaagataaatgcggttgatagcgtggcatgcggtgttgacggcttcggcccaaaaatggtccgatgtcttgtactcatccaacatggtcctcgccatctcaatgagagtcctattcttcctctcggctactccattttgttgaggtgaatatggagccaagaactcgtgcttgatgccttcttcatcaaggaaactctcgatgcacgtgttcttgaactccttgccattgtcgctacgaatgttcttgatcttgaggtcgaactcgttttatgctcttcttgcaaacttcttgaaaatggcttatgtctcactcttgtcatgcaaaaagaacacccacgtaaagcgtgaaaagtcatcaacaataacaagaccatatttgttacctccaatgcttagataagcaattggtccgaagaggtccatgtggagaagctccaatggtcttgtagtggtgtggacccccgtttttataacaggaatcaatcgtgtaaacagtaccatttctctggatcaagtagtctggtacacatgagttcatagctgaaataccaaatgctcatacacgagagtttagtgcgaattattacaacataagcccgcagacattgtcttaaatcatcagaccgagcggtccgaaatacaaccaaaagcagaattagataaggcagcggattttaggcagcgacatgccattgccacaggcaacgaccgtactaagacctactgagcgccatcgtcttcatctccctcctggtagtaggcatagggatcctccggagcttcatctcccgcttctgattaagtttatatttgcgagggtgagtaccaaccgtactcagcaagccaccacagcaacaatgcatatgaaaggggtatttcaaaggatggctatggttcttttgcgcaaagcaaattttgtaattcttttcacaagcataagacctagtattgactgatcaaattttaataccagtgtttgtatttaaacaatgacggttctgtccaccatccattgtgatcccaaggatagcttcccgccattgaatcgttatggttttctgaggacgctcactttcccccttctcaggaagtggctccaacagcataaaaattcatcatgcaacaacccatcccacacaagttaataatttagagactagccaagtgtaatacatgtcccggtgctcaataaccgcaagcacggctatttgaatagatttggtttactcacactgcagtggatatacactttacccacactccgcgactgcccaacacatgagccttgtctcaacacatgagacgcgtcacggcaaagcttttcgataaccccgcattggcagtacccgctccatgaacttttcatcctcatgcactctaggtgtacacagtttctagcagtgagaggagttctggcgcacccgggaagggaagttttacacccatgtaattaagctataactaggttcaactcaacacacgacagtcctagcaatggcgacaccattgtagaccccctgccatacacatgagaaaccactatgcatggatactgcctccgctcggctatttactccgctaggtctatccccattcgagaaatgtggttgtacgaagtcgtttcatgcttaacttcatggctcgatccttaattgaccggggacggtactagcctttcccagataccacccaaatccaccgtccgccccgatctaaaacataggtttttaattcctttcatgtcatcattatcatggcaatgtggtgttcatgtctccacatgccgcatctcaattaccttcccaaaggtaattgcccaagcatatagcgtttgataaacatgagtatgcaagattctaaagtagcatttctaagcaagtgtcatagttgactagggactcatacgtaatcgtggttacaaagatttaaggataaacaataatcaaggcatggcataatctcaagtaggatgttcatcattgcatgcaatcttatttataaataaaaattgatttcgcaattgggatcaacgtgatcaaagaatagtgatgacttgccttgctcgaggtcttgcgggtcttggccttcacccggatccgcggctccctcggtctctataattacgtgtgaggaaaacaatttgaattcatttagaattcaaacaaaatcgaaacaatgaccgaatgaaaaacgagcacgagagacgaactctacatcaagtatattattcgcgaagtggaattattcctctacctaaaatttttgtgtttcttaagaaattttgtgatttaaagtcataccctaagactttatctaattatctagtccttaattacatctagatcactaccgcgaattaatcccttatagagtttactaaaaataatctataacaatctataagaattcatctagtcatattctcattaatcctataattaaatgctagtattttaggtatttaattagtaagaattcatctaattatatttttattaatactataatttaattctactatttttaaatattttaaactttcccctaacttttcccttttattttccctctttttcctttttctttcttttctctcctctttttctttttctctcttttctctcttcttttctttctttttcctctcctcttttttttttctttttctcccggcccctttctccctctctccctcggctccttcttcctctctccctctttctacctaccaagaccagttggggaaaaggggaaaaggcggcggcggcacggcttaccggggcaacagcaac

SEQ ID NO: 57095 - DNA, 3436 bp, Oryza sativa
acggcgcggcaggcggaaccggcgcggtgcggcgacaacaacggctcggggcgcgaggcgcgcggcaggcggcagcggcgcggggacaggacgcacggcgtgggtgcacggggagggttagggctagaggacacgatcgaacacctaaagcgcaatgaacagtgaatttttttatttttccaattttggttgtttttcctatataaatttgattctactattcctaatttttgcatatatggactttactcaatatttgtgttatcccaactaatgaattcaccctagattaatattacccatattttatttttatataatttatttgaatttttaattgggattaattcttgttccattgcatttaaacctaattgatacaaatatggcctcgatgatattttatttatttctatccttatatagtctttattttaaattataatttatttctttaaccaaatctaatttcagggttaattcctaattaattttcctctatttgtgatcgatgaattccgaaatcaaaatccaataaaatcatcgaataaaatcggcatgatgcaatttatttaaaaagtttttgaaaatccgtatttttagagttttgattttgtcggtcgaattttcagggtgttacaagtggtcatcacattcttgacggagtgatgtgctccaatttgtttgccggcttgacacgcgctacacaccctatctttctcaaattgataatttgttagtccaaggatgtgatcgtgctttagaagcttgcgaagattcctcataccaacatgggctagcctccgatgccaaagccaccccgtgttggacttagccactaagcatgtctcatgtttggctttacttgaggaaaaatccacaaggtaaagctttcccttgagaacacccgtaaagactaccgaggaatcattccttctatagacggtcacatcaacatcggtaaaaagacaattgtaacccatagagcataattgagaaacggacaaaagattgtaatttagagattttaccaagagaacgttggcaatggaaagatcattggagattgcaatcttacccaatcccataacctttccctttccatcgtccccgaagactatgttctcttgagaagtgccatttgaatcaagagatgaaaacattgattcttctccggtcatgtgattggtacattcactatcaatcacccaactttttccaccggagacatattcctacaagagattaatttctagttttaggtacccatacttgcttgggtcctctcatgttagtaataagtgccttcggcacccaaagcactctcttgatagaaatattcttgccccttgggcctacatacttagcaataatacgaccactagcattcttcctaagaacataagatgcatcaaaagaacaatgtgaagcatgatcattagggaggatacttttggccttaacaaagttgctaagaccttggggcctcttgatcatcacactcttgtccaccttccttttggtggaggaacatacccaagaccctcatggttgaagttgtccctttgatagcctacgtactcctttagggccttactacccatgtggcacttaagtaggccattgtgaagaagtcccataagcttctcattttgcttttgcaaagcactcaatgaaatagagttagtagcacaagcttcaatatcaatatttttgcacctcacacatggtttattgcttgggacaattttggagcacgatgcctcgcttgggagagagacactactctttaaggtttcgaacttctcttcaagggagaggtaagctttgtccaagccatccactctctcttgaagttgagcgttcgccacctcaagattagcatgagactctttggtttgcttgtaaagccgtaccaaagcctcatttttctctctctccttagcaagttcactcttgagttcatgagaccgctctttctcacgaatgagcaaagcctcttgcctctccagggttgtatattggtcctcaattctcccaagcaactcactcaagtgtggtatggattccttggttatggacttgaacaactcatcatctataacctcatcctcaacctcatcctcctcattactaacaagatcagcattaaatgacttgagaggacaaggtaccttgggctcctttgccatgaggcaaatgggagcatcctcatcacttgagtaatcgaagagcctcggtggtgatgaaggcttgacggcgaacgtggcgactccttcttcatcacttgaacttgactcggagtcggagccgaagatcatcccaatatgagcttggccataatgttctcgcttgctatgcttgtgcttctccttcttctcatccttcttctcacccttcttctcacccttcttatcttccttgaggtgggaaccatccttgaggtgggggcactccgcaatgaagtgttcgggctctttgctcacgtagcacacccttgcggagtgtcttccacttgacttgttggagtagtgcttggaagagtttcccttgaagaagccgcttcgtctcataaacttgccaaacttcttgacgaaaagagccatctcttcatcatcgatctccgccttgctcttgctctcgtggttctcttcttcttcttcctttgccttcagtgccaagtcttccttcttgatgcttgcggttgagctttggttgatgtattggataacatccttggactcttgcacgagcatgtcatgggcaaggatatgcccgagcaaatcatgaggtgtgatatttttgtagtccggacgcttagagttccttggagtgattgcccgaaccatcttcttgaccacaacctcatcagtcatgtccttagagccaagtcccttgatctcattgacgatcttgctcaaccggtcgtacatgtcgcttgggctctctccatccaacatcacaaacctctcaaattgtcctttagaatctccaccttagactcacgaacactatccgtgccttcatgcaagttccgaagcatgtcccaaatcactttggcactcttaataccatccacacggttgaactcacttccactcaaggcgctaagtattgcattagcggcttgagcattcttgtgctcgttctcgtcgtcctccttggtgggatcttcgggattctgcaaaacatagcctttttcgactattctccaaatagatgggttaatagacttcaaatgcatcttcatcttatgcttccaagcggcatagtccgtaccattgaagtacggagctttgccattgtaggtactcacataagatgtagatgtggagggatagtcaaaaggaatcctagctcccttttcaccatcattaccatcccccgtttgacccgacatgatctctccaagcggttaagcctaattaggagatta

SEQ ID NO: 57096 - DNA, 5651 bp, Oryza sativa
  unsure (1)..(5651): unsure at all n locations
cttcggaaaatgcacagagcagcgccccaaaaaagaggtatctagatctaaaagtctaccacatgtaatcaaaggcacatacatcaactagaccaatagcggcccaagcaagcaaagttagaggagagggatgaagagatatccccaaggtgaagcttgcaacttgtttccggagtcaaatccttaagagattcttctctccgttgaggagctcactaagagccggatcttagctaaccctttcctcaagaggttgcactaagcactcctccttccactaagaggtatctcttcctttgcggaggcgagatccggccttcataaacttctcccggccaaccacaagtagatcgttggctcgggagtgacacctagccgtctaggagtcctcaacctccaagagtaaaagatgatgcaagtgctcacaaatattcacaaagaccacaagaagcacccacacaaactcgaatccacactctcacatacacaccaaatccgaatcaaacacgggtggagagatgaatcgaggaagcaaggctcaaatgaaccagagagagagagcaagccaagggcacaaataattggaatgaaaccagcagccctcacaagtggggggaggtgggtatttatacccacagcacaaatctgcccgttggagtgcaataaaagtaattttcggaacttccgaaaattccagatctgagaaataatcgaagtcaacgcacttttcggaacttccgaaaatttctaaaacgcttctttgtattttcggaactttcgaaaatcattttcagaacttccgagaatttccagagagctctcaaacggttctgtgtattttcggagcttccgaaagtttccagaacgcctaaacacggttctgtgtattttcggaacttccgaaaatttccagaacgctccaaaagaaaaatgcttcgaagaaaaattgattttaagcacacgcatcactccttatatgtctatgcatcatcccccttaataatacggctttcctacgacacaatgcgaggaaaaagatacaatataccatttgatcattgccgcattgcatcgcgatgtcgcattcacgggatatgcattgtattacaacactttgaggacttaacaaccttcacatttgcttgaataaaaatgttagtcctctctaatcgtattgtaatcaatcatcaaaattattaggggcctagatgcactatcactgcacctaatagcattctgcaatactgtgtcgtataggggaggccaaaggagcaccaaaggtccaccaccaaatgtgagtgctctgcacgttggagagtgctgaaaacagccacgggtagttgttacgttaaaaccgtagtgcatgagcataaccatcggctggttgaaagttgtgtcgagaagcatcacttcttctcccataaatccattgatcaggctgtcaaggagatgtatagatggccagaaggcccgaggcccgacggcccggcccacggcacgatgttttggcccggcccaagcatggcacggcccgttaggggtcgggcccgtgccggcctggcccgaccaccggcacgttgggctgacccggcacggccgggccggcacggcacgatgggccgtaggccaggcccgacacataaacagtagggagtaaaaatagacattatataccacggtcgaaagaatagggacgtaaaatagacttattttagctatatatatgccagcccaaagaggagggacggaaaatagacttactttcactatacatgtgtcacagcccaaagaggagggacggaaaatagacttattttcgctatatatagtcacagcctaaagatgagggactgaaaatagacttatctaaaaaaggcacgatgggccacccgcgcctttgggccggcccggcacggcccgacggctggtgggccgtgcctgggcgggaggcgtggcccatgagccggcacggcctagcacgaagtgccaatcgggccgtgccggcccgatggctagtgggccgtgcctgggccgggccgtgccgggcgggccttttggccatcgataaggagatgatccgccacctaagaaaaaaacaacgtcagcctgtcaaaagtgaactgtatactagaaagcattcatggatcgatgaacgctctactattgacaaagaattctgtgcgcaatgtatgtgctgagattgcacaggacaacctgcaagatgatgtaaaaaagaccatggaactattccaaaagctttcaaagtcagaccctgacttcaaattttcagtacagcttgatgaggagaacaagataaaatcattgatgtggtgcagtggccgaagtcggaggatgtatagccatttcggtgatgcagttacgtttgacactacacaccaaacaaacttctatgacatgacttttggtatttgctggtgttttgctgacaacgaagacaaagaaagctttgagtgggcattttcagagtttattaacctaatgggtggccctccgcccatgaccatcctgactggttcgttgatctgtcattgcctataattaaatttttatatttattttgggaaacctttgctgcacttctttggttatgtggtgctttttgttatgcagatcaagctcccgctatggcagctgcaataaggaaggtatatccccatccacagacagtgcacaggtggtgcaaatggcatgtactgaaggacacacaaacggggattgatcaagtgtacgtgaacgacaaggaattcaaaaatgagttccagaagatagtaaacgaaatgatgactattgaagagttcaatgaaggatggaacatcactaattttgagatacaatctctagaagaatcctttcctgagtcgtgcctttgaaagtaaggaaatgtgggctaagtcattctttaaggatacgttctgtgctaggatgacaagcacacaacgtagtgagtgcgcgaactttatggtaaaaatttttgtccctcgcaattctcctctgcatgattttgttgaactgtatgccaagctcgtccatcaaagggaggaggatgatgaccaacagcagaatgacaattcacatgtgcgagagggaaaataacaattttggtttctttttcatatatgcatgttttgatttttccagctactatttttttccatgcctcgaataggtacgtatcaagcctgcttttgggtacccaatagtgcggcatgtagcacagatctactacaatcgctgcatacaacctattcgtgtaagaggtttccaaatcaacctcttatatcataacatatgaggaagagtctggtctgtacaaagctacagatgtcaacacggaagaaattgggtcttggtgtcgtggtacttatttggtaacccacaataccgacaacggcacatacaactgcgagtgtgggctgcagactcattttggcatcggttattttttaagaactataagttattttttaattatgtatttcagacattatgtaggtgtttctataactatattaaattcaataattataacatcacacaaatttcttaatttaatttttaactacaattacaagatcttacatctacaagttaaattttaactacatattcaatccccgtaaaggggacagggatggggcaagtgtggtgtttgtgtggcattgggaaagggaggaggaggtcttgtgttctatttattcatcaccggagaagaaagggaggtgccttggggcttggacaacgccatcaatggcgtcgattcgctgaaaggaataaaaacttcgagtaacaagttctaatggcttgattgagtgtgaaactcaaaagggaaatgaaggggtggatctgtggagtaaaactcctctattaatttggagaaacggcttgaggaggagccgaatcaaggggcggcgctggctagggttcacggggagagagagatacgggggcaactggaggtggaagaagggcctaactggtggggtccaccagtcagcagctaagtgcgtgtccggcatcgtgggtcggcctggcccacgcgcgaacagaatgacggggcggcctggtgagcacgcggcgctgggacggggaagagggggcacagcccacagtgggagaaaagagggagggaagagctgaggctgggccgggccgagaaagggtgggaggagagggagagatggagtgggccagcgactggtgggaggcagagagagaggaagagatgggccggaaatggcctaaggagagggaggtatatttattttactttttcttttttaagaaaatttgagaaaggtttttgatgcattaaaattatttatttataatgctatgaaaatttgaaaagttttttgaagcatgaggaatttaacaaaaattcccatatgccaatttgagttgaaacttggtgatttttaattgttgaatgctatttttagcctttacaatttctagaaataatttagacgatgaaattttagggtgattttagggtgtgacaggtggcctgacgtcgatggctatgccggctaggtcgtagcagtttgggcggtgggaggcgaaggcatcgatggccaagttgacatggacatggcttggtgctactactgttgaggagaaagaatatgagggtaaaatagatattttgtagcttctctctgctcaaccgagtgaatgttatattttaatgcttacagtgtccaccagaagtcttctcaagcaaattcacgttcttgcaacgtctgccagtaaaggccatatgttttgagtgtcctatagtaaatttggcctattaataggtataaatattgactgaaaatttgtatacctacaaacactacttatagaaaataacataggcctatgaaatagtactaaattgactagaattgagttaagtatggatatctctctctgtgcgtgcaactgtagatacacattgtcgattaaaaaagtttacaataaaatcatgatctataaatgagcacgtatacatctgtaaataatattattaattacgttgttgacgtgtaaattaattagttgtatccctgaagcatatggacatttcatatgagcaatttatccagaaaagaatacatcaaatagaggagtaattgctttccctttgtaactgcatctagctagctcttgctcttattaaaattggctgcctgaatgtttcagccatatgctcaaccaatcatcgcactctcaagctaagagcaggtacaataatagactattagccagctgtaaacatattttaatgagataaaaaataagagagaagagcagcgggctacagatctgtagtcagctgtagcgcggcctcttagatgcaatgtgtgtatgacaggtgggaccatgcattaataatatagtaagcaactattgtatgaattagctattagattggctatagatgaattgtagctagtagtggactatactattaaacttgctctaaatgaatcagactgtgaccaatattattgtgcagatgcggtgtgggtggtcccagggggtgatgcccgactgtgttgccctggtggccaagtgtgccagtgtggtgtggggtggtctangggcactgttgcccaaccacagggatgcccatgctctcaccc

SEQ ID NO: 57097 - DNA, 15714 bp, Oryza sativa
  unsure (1)..(15714): unsure at all n locations
ccaaggcccggccagcgcgggcaggcgctcgggctccgccgcatacatccatgcattagaactaattatagtgcttagccattaattagcctagatgcgtacatacacaattagattagtactaattatcatacttagtcattagctaatagcccaattttacttctatccatgataaaatgctatatgtatttgtgtttacttattaatttattttctatcgttagatttgtctaggttaaaaaaaatttctagatccgccactccagttattgcttagttcatatctatgcgagagatgagtagatttttattctctatagctatttctccctctacgacccttcttcctggcgatgtcaggagccagcgtgtgcttgtctgtttggagttgatgttggggcagtgtggttgtggctttgttctagagatctggtggcaatggattacatggatcatagaagattaattcctatggtgccgttatccttacatatgtttgtgtaaaagcttcagtggtaagagtgatgggttaccgctcctccaaatttatcaagaacagaggcacatgacattaagaatgtttccggaaagacaaacaaaaccatgtacaacaaaagagaggaacatatggaagaaatctatagattatgatagcttccatattgtgtgcatattgaggggtcatgtattgtattgacatgatgcatgtaaagaagaatattggcgagagaattatggaattgctcagaaataacaaaaataaaagaaaaatatataaacgacaggaatgatgtgggagaaagagacggacttttggcagttataaagtgaaccgaatggatggtgtgcaggactgcaggattagttagaaaagtaaaacgaatatgacttcaatacttcaaaggcagaaaaatacacaacggtatagacaccaagatcaacttgatattaaagttttaaaatttaaaatttagctacaactgataagcaaactagcacctacttattatatatcaactagaatggtagcccacgcacatgcgcagacaccttcttatataatgtgagtgaaattttattatgaatatttatgtgcggggttttttattaaaatatttttattatattccaaactaaaactaaacttattttgtattctttgaacgctgctatttttttataattactcttgcaacatataaattctaaaataaaattatttaatatcatacggttttgaattgataagaaaatattgtgtcaaaactatggaggtggttcctaatctcgaagaaaaggatgttgttgcttagagttttttctattaaaaaactaacaaatcgctagtctaatgctttgttcatttttaatattttctagtattttatttaatttaatagtaccacatagcatattaaaagcgtttgcagcatgtttagaatgagagagagaaagctgctaaacctagcgggtggagatctatttgtggtattttaatgtaaaaataatattgattttaatttaccatgaagttagctcgttggtacgtacttgacgaggaggtcctagatgtgtgtgtttttttaaaaaaacgatctaacctttgaaaataaaataatagatccaccgatttaaatgaaaatcgatgatcgtggattagagtgtcacttggcaatctaggagtgtttgtaaggtgtaattcggcggtttagaagtatttataggatgtttaatagacttataatagtctttttcttttgacatttctaagattttttttaatttaagaatgctatatagtagcttagaggtgtttataaaatgtttaatggattttaacaccgcatgggggtgtggaggggggagggagagaggtttggcattttttattaaaaaaatataacaacctaaaatacatcaatttaagtaaaaatcgatgatcggttgctttgtatttttttaaaaaaaaattagtactttctctaatttaatagcaccacgtagagatttcgaagctttggtaggattttaaagtgacgaggggagagctgtagtctatttgtgattttttcttttaccggtaaaagtaattttgattttagtcttcttaaaatagaaatatggaaggaacagatgggatgtacgtatagtacatacgtacgttcgttagtacgatccaaaactattacgtatgtttgtacattggttcagatgttggctccagatgtttttttttttacaaaatagatataaccatccaaaacaatgggtacaccaatttaagtaaaaatagatggttggatttctcttatttattaggtgccacggggcgactcgtgagcatttatagggtgttatttgacggtttgggagcgtttataggaagtttaacggacttttagcccatgcattcgcctaggcatgcatgtatcattgttaaatatttttctaagatatttgttagttttatattatgtaatacttaattcatctatgtacgcacttatctataatcttacagccttatcttttcacttattgttataccaatcagccaaaatttgaattttcaactttaaatttggagttgattttggagttttctcattgaagtttattattcaacctttgcttttagatcgctaataacacgcatataaaattattattcataaatcacttttcgtttgcaaatatgctacttggcttattccaggaataaaccaattgatggggttgttaatcttctttatcatttaaaaagatgacttagggggtgtttagatccagggactatagtagtgcctgtcacatcggatgtttggatactaatttagagttttaaacatagactacttacaaaactaattgcataaatgagagctaatctgcgagacaaattttttaagcctaattaatctataattagagaatgtttactgtagtatcacataggctaatcatggattagttaggctcaatagactcgtctcgcgaattagtccagggttatgaaatgagttttgtcattagtctgcgtttaagtaaaccaaaaatattttatctgtaagcaagtaagatcatcattgtttattaacggatagattatatgcaatatctggctactgatagattaagagagatccaattaaaggattcaccattttgagttatctatatttaaacataaatgtagtcttagcgaaccaaaatgaagtattacttctactacttattatttaaatcttattaactaattctttgtgtttcatattaatggttctacgaaattataagaatttctacaaatggttcaatttacactctatggatatttttctattttattttatacaaatattattttgagatcaaattttacgatacgataaatagtgatagtggtacaccctatgtgccaatttttttaaaaaaaagtaatcaaataatattgtatctataagcaagtaagattattattgtttattaatagatagattatatgcgatatcaggctacagatagattgagagaggttcaattaatggattcatcgttttgagttatctatatttaaatataaatgtattcatagcgaaccaaaatgatgtatatcttctactacttattatttaaatcatattaattgattctttgtgtttcatattaatggttctatgaaattataagaatttctacgaatggttgaatttacactgtatggttattttctattttctattttatatacaaatcttatttttagttcaaattttacgatatgataaatactgatagagttacaccctatgtgtcatttttttaaaaagagtaatccaataatattttatctataagcaagtaagattattgtttattaacggatagattatatgcgatatcaggctacggatagattgagagagatccaattaatggattcaccgttttgagttatctatatttaaacataaatgatgtgaccagaactcgaaactctaaatggactaaacgctaagagcagcaacacgactcaactatgtaacgcaaaactcaacaaagcaaaaaccgaaatgaacaatgcaatggcacaatatggctaggtaaatgatgcaattttttcggctattttctggttatgggtagataaaaactcaccgagcaacgaaagctctgataccacctgatgaaccctgagttcctctcaacactcaaggctgttgttggcccgatctttcagtgagttgtagataactacgatttgggagaagcgttgacgacccaactacaaccgtacgagacgttgtgttgcaccttagcggtcgatacacctctccgagggttgttgatcctgccggtgcaaatcaaccttattcctgcaagcaaatcgaagaaacaagcaagaacaagggtcatgctccacctggttgaggcgcaccccacttgggccccacttgggccagggtcccaaatgaagctacaagcccataggcccattacaggtggcgcagcaccttggtctatcaattgcggctcactgtgatggaatttcgcaatgaggctggatccgttggaaagaggactccgatagctttccatgaagtatgcacgggccgaaaacggagctcgtatgcagatttggcggccgtttgaaatcagtagtgcagcaggtggccgaatcggattccagcacttgatctcgatatcttcttgttcatccatgatatgagctatggatgcatctgtggttgctatggtcacatcaataaatgtagtcttagcgaacaaaatgatgtatttcttctactacttattatttaaatcttattaattaattctttgtgtttcatattgttctgatatatgctacatgctgttaattaggtgtttaatacttaagattttccctaaaattttgtcttgaatgaccaatagattgtccaaagtaacgtattcttttacttgttaaatatagttaatttgggtcttaaattatgcaacaaaatctgatgtacgtgcataaaaaataattatatgattttagatcgtatagtcatataattaatatgttttgaatctaatatatttaaaataaaagagacatgaagagaaggggaggagaggccaatacgtatgttagcgtggtgttagaactacacgtacaggttggaaggggtgaaacgtgggcctttcaattttttatttttctatggtagaaagtaatgggtccaccatatttaaagaaaaataaatttaatttattagagtgccacatggcagtttaggagcatttgtaggagtgccacgtgacgttttaggagcatttatagggtgtttaatggacttttagtatataataatagatcttattatttgttagtctacaccactcccttcgtttcaaaatataacaacttctaccattcaaatttatcttaaaatataataatttattcaccggcctatattcttcacttgaccaatagtaaccttcacaatcttcccccgtttaatttcatctattttttaatgtccatatcaagccttaaaatccttatattttattttaaaacgaaattagcaattgaaaagatcggtggatagcgacgaacttgtcaatcatgtcttaactatatatgcaagcgctagatatctcctgcttgtacggtgcaagaaaagtcactcgtatttatccagcgtccagtcattcctgagctcgatagcatcatcaattgctgatttgttactgtcgaacgacggggcaaaagttgaggtgcagcttcctccttcgagagacgacgagcctcatgtgtcttctccttgatgatgatgtgcaggtctttcttcacgtgtgaaaatagtgtcatagttactgatgaactttgctaactttactaaacggttggtatattgttacgccgtgcggtgagaggatgcgcacctgatgtttactaagtagataccaaaatataatagtttgattaaatttatagaaaaacatagcaataattttaacgctaaaattagttttagtaaatctagcattgaatatattttgataataggtgcgttttgtattatagatatagctaaatttttctagaaactttgttaaacttaaaaaagtttaataatctaatactatcttcgttttttaatatatgatgctgttactttttgacaaacgtttaaccatccttcttattcaaaattttttgtgtaaatataaaaaaaattaagtcatgcttaaaaacaacgataaatcaagtaacaataacataaataataattacataaactggtcaaatatattttgaaaattcaaagtatcatagattaaaaaatggagagagtaatataaaacgaggggagtactgctatatattcctattacttagtcaatatattgctatctttcccgacaataaaagagcaaacaatttattcatcttctacgatccatctataagtatctccagtaagcataccatgaaattagagcccctttcaatcaaacaatttatttagaaatttcataagattgaaatcccataatatcttttttctatttggtctttttaacaaagtattggagcttttaaatcatatgaattattttaatggctcattgcatatagtttttgaaggaaatttagtaagagctctaactggccttaggagaattttatttgtcaatctctcatccgatatctatgtttctcttgcagtacaactaaaaggttacgggtatttagattcagtggtgtaaagttttggcgtgtcacatcgggtattatataggatgttgcatggggtgttcggacactaataaaaaactaattataatatccatcattaaatcgcgagacgaatttattaagcctatttaatccgtcattagcacatgtttactatagcaccatattaacaaatcatggagcaattaggcttaaaagattcgtctcgcaaagtagttgtaatatgtgcaattagttatgtttttagcctatatttaatgcttcatgcatgtgttcaaacgttcgatatgacagggcagtgtaaaattttggggtgggatctaaacatgcctttattcatatgttttttcttttcccttatttcataatctaccgttttgcacttactttcctatcaaaatcctatgtttttctaactctttctgtttttccatccctatcattctaagggctgaaattaattgtcggcaatccataggatgagattcctcgaagctgatcatgctgagcccatgttgtcccacaacgaacagagggaggaaagagaaacgatagactatatgattcatttgttcaaaaattcgttccaatcacatcttctcgttatagcaccatgtaaggttgcgttcgctggttctggttatagcaccatgtaaaatttttttttaataagatgagtggtcaaacagtacaaatagaaactcaaaatcccttatattatgggacgagggagtacaaaatagttttcgcagacgaccctcatacaggattgcacggaacacgagaacgcccatatgtgtgatatagatttgctctgttctaacaaattaaaagtatctcaaagtaccagtacctcatggtatcaaatcgtttcctatcgttcgatctagctaagtaggatggatattgttagatccaacgatcggaaatgatttggtaccatgaagtaccggtacctcgaggtacttttcatcggaccgaagcaaatctctatgggataagttcggtctgaaggatacacaggctgtatcacaggcgacctatgacgtccgcttaaatttcagctactgcgcattattgtgatgtctgaattaattaattaattttttttagtgattttggatatacaacatgagaatccatgccgaatttctttacatagtaattaataacccaaaaattaaataaatagtaaatcaaagatttaatttataaaaataagaaggatgctatgtaaatgtacaacagcatccagatatggacgttgttccccggaacgtccagatcaggacactgtttgtaacagcttccatcccgttggagccgaacccaacctatggtagggaagcctccactcgcatctggctggttcttggggagaaagctaactatcggacgcccgatgctcctcagaaaatcggatggtcaaatgttgcagttgaccaacaagtaaaatattaagttatatatggtgaaaaaaaatcagcaactgaaacaattaaatattttatgaaacatggtgaagatacacgttgaaacatgtcgctgtcacatatgaaacaacaagtattaacggattgaaacatatatttttcctttatcaaaatatagtcatgcgatatcttgttgtaaagatttaattaaaacgaatacaatggtgtgatcggatcatatattggataagtaatttaagagaaaaatcattttgaaacttgctaaaataaatgcacatgtacatggatgaggtagagagagagagaggagtgagagtagtagcaggtagtattaggaattttgtgaaacacaataaagacgcacattgaaacatatcactatcatgtataaaacatttagttttaacggtttgaaacacatgtttttattttgatataatataatcatatgatatcttgtcgtaaagatttaattgcaacaaatacaacggtgtgatcggttcataggtcggataagtagtttagaagaaaaaatatttaaagggaaaaggaaagaaaaaaagaaaaaactggacatacatgttacagtaataggtttcgtctaatccatctgcccaggcatccgatatttccgattcgctcggacgcgcgatataaaacgtttcccggttcttggtcgggtcgttgtcctcaacgctgctcggcaaggaaggcctccgctgcgtctcgctcggtcagcatcagcgccctagccgcgaggttaatagttcatatccgatcctgcggtccgattcgacccatgcatcctaaatatttagcgcacttcttcaaattaaatggacagctcctgcaaatggcggaacaaacaattttgtttcattatgacatgacaattttgatttctctctatcctatgtgttgtcgtacgttttattacatttaatatgtccttagtttttatgttaatcgcgtgcgtactttcttcggtggttgacctggccttatacggctagatttttttttaagtaactgtgtgcacgccaagttaaacatatttcttactaagttgaaaaacaatagttgtagaagattgaaggggaaaaaattgcttgactagattagaaaaccaaaatgtaaaattttcaaatgaacagcgatcaaatttggtgatatttcaaaagggtggtgtaacggctccattttctaagccattaaaaactatttttataaaaagtctttattacgaaagttttgttctttgtatgagttaaggatataaatgtcctttccgttgaacccaaaatcctgattcaaacttttcatctgcagtcctgagacacaaaaattcgagtatcagcccaaacccatcaaaaatttctcaaatacttcctaacacctctcctcgcaaaattcaaatttgcatgaaaagcatccaatatatattttcctttaaaacccttcctttgatccaagtatgatatttcaattcaaacccaattttaaattttacaaaatgtccaggagttcaatccaacaattccatggaattttccaaatgtcattattgaaatcatgccaccctttcccacttttttccggccaaccatgcccccctctccttttatcttgtttgcccacttcccgctctatctcttcctcactgaagttcaccccccttcttccctctttcctcctcaaccacctaacctcatccctttccgctctcctttgcttccattcctcctagccatttccacgatcagtgccatacacttattttacaccacttctcctttgcgcctgcctccgcccaaagaaaaggtctcactaccaccgcttctaataagcctctgattaggctttagcttattggtttaggcttttaattggttttttttggcttatacgatttataagacgatagatttaaatttctaagtttaagggcgaagtcataactccttttttttgaaaataatagaatgaaacattccggtctttgctcaagagctacagccaattattacaaggttcacacaaaagcaaagtcataactctacctcatataaaccaaaaagaccttcttcaacctaacttttgccttaacagtgtaagagtggcttgtgactttaaaaaagctataagaaaaagttgtttatttgtttatacttagactttttagactcataaactagcttatatgcctaaacaaagagggcctaagctcgccgactctcttcgtcattgtttagtgcccgagcttgcctataacgctgccactacacattatttctcatcgcagtcccacctaactagcaataaattgagttttcattttacacaattaaggctccatttgaaggaccataaaaggagacgagtcattagcacacgattaattggatactaattattagaaacttaaaagttgattaatataatttttataaagaaacttatatattgaaaacttcgtgttgtttatagttcgcgaaaaatacttacaggaaacgagacattgcccaaccgataagccgagtagcgcacgattaattggatactaattattacaaacttaaaagttgattaatataatttttataaagaaacttatatattgaaaacttcctatcgatgtttcagtagttcgcgaaaaatacttacagtaaactgacattgcctaaccgagaagccgagtagaacgcagccctagctaagttcctttgcatttccaacactattcatacgagtatttcgcatttacaataggatcatttgggtagttccaggagaaaatttgagtgggtgggccaggtaaagaaagaaaaaaaataagtgcacgaggaactaaaaacaaggagagtgaaagaacgtgtaaaagttgatgtgccaacggacacagagcttgcacttgataacaacgatttactacgataaagtatagatgtttggagctgaagatatagagatagatgacctttgtgctgctagctatctgtctaatatccacatatatcaaatcgaccgttgtgctacgtccaattcatatctatctagcttcgtcacaaacagtggtagagcttccctagctacaatcagatcaggattctctgcattagaggtttcaagatgtttgacaccgttgactttttagtacgtgtttgaccattcgtcttattaaaaaaatttaagaaattatttattttttcatatcatttgatttattgttaaatatactttcatgtacacatatagttttatatatttcacaaattttttttaataagacgaacggtcaacatgtgctaaaaagtcaacggtgtcaaatattttgaaacggatggagtacaagaattgaataatatcgtgcactaggaggtttgcagccatccaatcaatatatcttacgatccaatcaaaaaaaatggggcaattgcttatttgaccctattttgaaagctaactaccaatttgaccaatttgaccctattttgttcagtttggttatttgaccccgcttttcaaatcgaaaggaaagctgaccctattccgttaagacgagttaacaccgtaactaagtggtaaaatgacaaaaatgcccctaatacatccatctatcctccaccactcattcttatccactctctctctactctctctctctctcaccagagcactgccgagaagcggcggctcggcggcgcgacgcggaagagcggcggtagctcggcgacgaggcggccctccaccggcggcggaggagcggcggcagttcggcgacgaggcggccctccgctggcggcggaggagcggcggcggcggctgcgcggagcagcggctcggcgacgcggaggggcggcgggaggagcggcggctcggccgacgatgcggaggaccgccactggcggcagatgcggagggctgcatacgagcggcggtggctcgatgacgaggcggccctccgctggtggcggaggagcggcgactgcggaggagcggcggctcggtgacgaggaggggcggcgagaggagcggcggctggacggtgcgacgcggagggccgccgttggtggcggatgcggagggctgcggaggagcggcgacagctcggcgacgaggcggctgtagacccccgattttggaaatcggaaatcttctgtgtttatccgtaccaatccctggatcagtagttggtacacacatacatagttggatcacaacatatcacgaatgaatttaggctaaaagagttaaatacttacattagggccaggtaggccaacaactatcagagaacaacagcggaagacaaaataatagaagggcccggttaacatgccacaggcagtcgactggggaacgagacctagaacaagaccacactccgatcatcttgtgggatacgcaagcgtaccgacaagggcttctcttcaacactctcctaaaagatatataaatagcaagggtgagtaccaaccgtactcagcaagccaccacaacaacaatgcatatgatagcgggtatttcaaggaatggcttcaggttcttttgcataaagctaattttacaattcttttcacaagcctaaaacctagcatagactgatcaaattttagtaccagtgttcactttaaacaacgacggttctgtccaccatccattgtgatcccaaggatagcttcccgccattgaatcgtcatggttttctgaggatgtccaccttccctcccctcgggatgtggctccgtcagcataaaattcatcatgcaatatcccatcccacacaagttaagaatttagagtctagccaagtgtaatacatgtcccggtgctcaataaccgcgagcacggctattcgaatagatttggtttactcacactgcagtggatgtacactttacccgtactccgcaacttgcccaacacatgagcctacgtcccaacgaatgagacttgccacggcaaagcctttcaataacctcactttggcagtatccgctccatgaacttaagccctcatgcactctagacgtacacggtttctagcagtgagaggagttctggcgctcccgagggggaaaactcacgcaagcctaacatcgcatcctgtagttgaacccaatccatgctgtcctcttttgggtatctccttgtagtcttgtagtcttgccaagtcagtctctagccatccgtatcgggtatccgccatttggccatccgtatcgggtatccgccagcagactgcttgttcgtccacacacctaagtgaaaccactatgcagggatactgcctccgctcggctatctactccgctaggtctatacccattcgagaagtacggctgtactgaggttgtttcatgcttaacttcatggctcggtccttaattgaccggggacggtactagccttttccagataccacccaaatcctccgtccgcccctgtcgaaaacagttgtttaattttatttctcctttcacaaatcatgtcatcaacatcatggcaatgtggcgctcatgtctccacatgccgcatttcaattaccttcccaaaggtaattgcccaagcatatagcgtttgataaatatgagtatgcatgattctagaatagcatttctaagcaattgtcataattgactagggactcatacgtagacatggttacaaagatttaagggtagacaataatcaaggcatggcataatcccaagtaggatgttcatcattgcatgcaattttatttataaacaaaataatttcgcaattgggatcaacatgttcaaggaatagtgatgacttgccttgctcaggataatccttagtattgatataatcttgatcaaccttcacctcctggaagttgcagacgttgcctcacgactaaccgatacacaaggtctataatacgcgagaaaaaccaatattcaaacaacaatcaaatatgcgcaacaaaatgtactattcgcgtctgctaatagattccaatcacgctaggggctaaggtttcttaatctttctattgtcaacgtggcctatttaggagttaaccaacatagcatttatgggatacatatatatttggctaatcggtggtttagtctatcaaatggcttatggaaggattatggctaagcatgcatctatctaaataggacggttatatactagaggttctgttgttagatggatttaggatcaatcaaataattacagtgaatcatttgtattatttattctattgatggaagctttactttaattatgaacatattttacttgccattataaattataaaagggctaataattatccatgctctatatgttaaattcgggaagtttataatattatagttacagattatctcttaatgaacaatccggagttacaattgaactatgaacatatgaggtcaagatttataattagtacttatctgctattcatctttgttatattctccccggtttaatatatgaaaaagataaattaattgtgtaactataatgggatgtacaatatatgtgtgcaacaacgtataaggttctggtcacctactgtacatgagcttatttagaaagtgtactacccaatgctccaagtgattcctaaatatattgtagtttaattatacattagctagtttctatgagtgatattgtatatgtgatgcgacaagtttaagcactggttctattgggttactaataagtggtaatcaatttaggcatatataagctattctatatggtattgcatcgattaatttacttagtgattcctccacatctagctctattattattctcctaaacaggttaaagattcatctatgtgtgtttatattttagttgcataatcataaggctacacttgatttaaataacctataagccatggatttaattatatggccatcgaatattaaataagtactagtattttcctatatatccattcatttgatacatcacataaaattagtttgtgtggttgttacagtggcaagatatgttagagacaaatattattacatctactctactgtacaatactaattttatttattaacatatttttaagttgactattatgcatcatcttgatattaattatttaatatttataaatatattttatcaaatagtgaattatatatcattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57098 - DNA, 2418 bp, Oryza sativa
ggtaagcaacttctccgcgtcgagcgatgatacggaagggacccacataccgaggtgcgagcttcccttttgtctgaaacctgtgcacacctcgcaatggcgtgacccgaagatacacaaaatcatccactgcgaattccaagtcacggcgacggttatctgcgtaacttttctgccgggactgtgccacctttagattatctcgaatgattctgactttagcttcagcttctctcaggatatcagtcccgaacacttggctttctccaacttggtcccacaagagtggtgtccggcatttgcgcccatacagcgcttcatatggtgccatttgtatgctggcttgatagctgttgttgtaggagaactcggcataggggagactcttatcccaggtcttcccgaaatctaggacacatgcgcggagcatatcttctaggatttgatttagacgctcggtctgtccatctgtctgcgggtgataggcggtgctgaaattcaatcgagtacccagctcttcttggagcttcttccaaaagtgagaggtgaattggcttcccctatcagatacgattttcttgggaacaccgtggagactcacgatcctagcaaagtagagctcggctagtttgttccctccataggtggtcttcacaggaatgaatcgagctacctttgttagtcgatccacaattacccatatagaatcatatccaccttgggtttttggaagtccggtgatgaaatccatcccaatttcatcccacttccattctggcacttggaggggttggagaagtccggccggtcgttggtgttctgccttgacacgctggcacacatcacacagggccacgaactctgcaatttcccgcttcatgctgacccaccagtatttctccttcaagtctaagtacatctttgtactgcccgggtgaatggaataaggacttttatgagcttcctgaagtatcagctgtttaagttctcggctatctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttccaacgcggccaaaaatccacgaccaactatgtttaggttcagggcttccatctgttgattaagctcgggtggaatgccacggacgttaagagtgttgcaatggctctttcgacttagagcgtcggcaaccacgttagccttaccagggtgatagtgaattcccacatcataatccttgatgagttctaaccatctcctttgccgaagattcagatccgactgggtgaagatgtatttcaagctcttgtgatcggtatatatttcgcagcgattcccaatgagatagtgccgccagatctttagagcatgaaccactgcggctaactccaagtcatgcgtagggtagttgccttcatgaggtcgtagctgacgtgaagcataggctaccacatgaccgtcctgcatgagcacgcaccccaatccttggcgcgaagcatcacaatacaccatgaaatccttgcgagtatccggcaagattaacactggcgaggaaaccagcttttctttgagagtttggaacgccttctcgcattgcgggctccacacaaacttctcttctttcttcaacaactgtgtcatgggtcgagcgattttggagaagttctcgatgaacctccggtagtatcctgccaaacccaagaaactgcgaatctgagtgactgtcttgggttgcttccaatcggtgacggcggtcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgattgtgagtatatcagaatgtcatcgatgaaaaccacaacgaacttatccaagtattccatgaacactttgttcatcaagttcatgaagaaggcaggagcattggttaagccgaacgacatcaccgtgaattcatacagtccatatcgcgtagtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtaacttcattgagagctctgtagtcaacgcacatcctcttcgtcttgtctttcttctctacaaaaatcacaggagcaccccatggggaagtactcggacgtatatacccctttt

SEQ ID NO: 57099 - DNA, 3603 bp, Oryza sativa
tgggtagggattggtgtagcggaccctctggttagcaccctgttgattgcggaaattcgccaagcggcgcttgtgcgattccagctccttgtgcttagcttccaagcggatgctcttgtcgaccagtcgttgaaaatccggatagtccccagagactagacggacggacagctcggggtccattcctgccaagaacttctcttgcttctcctcatcttcccgcacatcctccggagcgtaccgggccagattgttgaactcgtgcaaatactccatcacggagcggttgccttgcttcaactctcggaattccctcttcttgagagccacgactccggcgggcacatgggttctccggaaagcggcggtgaagcgagcccaagtaatcggctgtccctcgggctgcgtagcctggaagtggtcccaccagagagatgcgggcccctgcagctgatgggcggcgaagacgactttctcctcatcgctgcactgcaccgtgtctagctttttccccacggcatgcaaccaatccaacgcatccacggggttgttggagctagaaaaggtaggtgggcggatgcggaggaattcggcgagtttggagtgttggggagggggtggtggagcattctgttgtggcggattttggaggtggtggaggaaagcagtcatcatgttggcttgctgggcgaggatctgggtgagaatggcgttggtgtctggtggtggtggtggaggtgggttgccttgggggttggggtagctgccctcgggttggttgccttcaccggtgttaacatttctcctggtcgtcaccatctgaaaaccccacacggaaccagcaaacagagagagctaacgattaaaactaaccacccacgactaccattattcttaaattattactgctattaaattggttcattaatgttcaagttgcttaggcaaacaaaataaggcaggctccgacatagttatgccacacaccggcataaccatgccccacacgactccaaaaagacaaacgagaaaaaaaaaaaaaaaaaaaacacacgcgcaagcctactaactgctcgtctaccgctgcgacgggccaggacggaaggtgagcaacagcgcaccctccgagctaccaacgccggaggcttccccctcctggggaaccacgggcgcaggctcggcacgaggggtctcgacgaagcaagtccacgccagggactgacgaataagctcgggcctggaggtgctcttgcgggcggtgatcttctggctgcggcagacgcggcgacgcttgggacggctgtcctctccctgggcgatcttgagctgatgcagctgcgcctccaacgcgtcgaggtccttcttgagctgcaggttctcctgacgcagctccaggatcttcatgttgttctccaccatgccgcgacgcaccatctgatggaagtcaatacgagctgcgtcgtatgcctccaccatgcgtgccagatgcacgacggtagcgtcatcctccgagctggcgtctcggaaggtggcgtggtcgctggctcctccgcgacgagggtggtagcggtagggcgaggctgcaactcgtccgggtagcgctggtgaagggtgccgatggcgaggagagcggcgttctggcaagcggcggggaaggaatctccgcccgcggtgactgccagcgaagtccgctcgggagagccggagaggatcactgcagtgacctcccaaccggcgtgaggctctgcatcctcaccctcctgctccggccctcccgaggacggcgtcgccggatccgccgccgcaggctatcgccgtgcccgccgtccgccgtcgagcgccgaactcctccctagggcgacgaatccagccctcccgaggacagcgctgccggatccgctgccctcgccgcccgccgacgccatcgccatgcacccattcccgctgtcagcgagaagagaggagagaacaaagagagagaagaggagaggagataaagagagagagagaaataaatggggtggttgttgatggtccttaaatcataatatttgaccgtcaatacctgcatataatgaaataaaacattgtatccaacttagtggtagggattattctaatcaattccactagtgttggtgaaatatgtgtatgcaggtattttaaggataaaacacacccatcatgcgaggaaacacacttccggtcaatcagacgcaagtacacggattgaagggcccacaagtcaggtgaaacccccttggaacgggtcataactgccataaccgtcactagggctcaccagtcagtgaccctgccaaaggagaagccaggagatggggcccagggttcggctgaaccaccacaagctcctctcatcctggccttccacgtgtacgctgctgatgcattcccaatgacggttaagggcgttttggtcgtttcccatacctgtaatcgtcatatggaggctataaatagagctcctctccctcccttcactcacacacaactttgagctgaattacaagaggctctattttatcttttgtacattagaattaggtagagagtgaggggaagctttggaggagtgcccgaaagtttgccgctcatccaacttctacctcgatgagtgtagcttcctaggaggaattctggagttgtaccggagctgtcggtacactctgctctgggtttggagaaacttcttctataaagtaagcattcgtgttcctttcttatgttatttaattactttgtctaagtaagatagattttcatctttacgggttcattgtttagtattcgtattaagtgctctagtactaggactccagatagagaaggaagtcatgtacaagtattagagtagtaattaataacttagacatggtgtctagattagagattacctttctttgttgtgtatcccacggatttgtcagaggtaggcggtaggtggtgacagccctgaatcccgtccgtgtaatcctccacgtacggatacatcacagagctatagctggaaccacgctggcagaccagcaggggtcggtgcccaaagcaacagatagaaaattaccttagcttagataattaatacacataggaagtcctctttatcctagtctacctatcattagttgtccttggatagtcttagccttaggtagattacacacgttccctgagttcgatatccttttaggatcacccgaaggtgaagtgctacaacggtattccgtgcgcttgcggatttatctgtggtcgtaagaaataccaacagtggttgaaaaattttgaaatgatgaggagggaaactgagagaggaggactaaaaaatacgggcatttttacatgcggaccacttaaccgtccgcatgcaaaaatatatttttgcatgcggctctttaagaggaccgcatgcgaaaataattattaaaaatattaatttgatactaaataaagttcgagtcgaattttaagttgctaaataaactcatgtgaaaaggttgtcaaaagcaaagttgtacaactcattgagacctaccatttttcttttggtcattttgccatccgagtttgatttaactatataaa

SEQ ID NO: 57100 - DNA, 4933 bp, Oryza sativa
aaaatattaatttgatactaaataaagttcgagtcgaattttaagttgctaaataaactcatgtgaaaaggttgtcaaaagcaaagttgtacaactcattgagacctaccatttttcttttggtcattttgccatccgagtttgatttaactatataaaatttgaattttcaaatataataaattcaaataattttccgggtagtaaatgatttgaaatgaaaaaaattgtcaacaaaaaagttgaatagctcatcaagatctacaacttttgttttggtcatttttctatatgactttgtttcgacagtttgaatttggatttcaaactatgacaactccaaacaacattttttaaatattaaatgatttcaaatagaaaattcatcaataactcatcgagatctataactttttttttcgtcatttcttcatccgacaaagtgatttgtaaaattgtttataaaatgtacatatctcttatatagttttataaactataagagagatgctaccatcactttgttggataaagaaatgatcaaaatagaagttatagattttcatgagttatacaactttgttattgataactttttcagctgaaatcatttagtatttgaaaatattgtttgaagttttgaaattcaattttttgattgataaaacaaagtcaccagaaaaaatggtcaaaataatagcaggaagaacacaatgatataatagagcatgattttagaaacatttaggaaaaagaatcatccaatttagagttcgtatgagtgagatatactagtttcaaattttttaaatttatttttgcatacggctccttaagactcccgtatggaaaaatcaatttttccatgcgggcgcttaagtgagccatatgcaaaaatgtttttgcatgcggacctcttaagaggcccgtatgggaaaatcgattttttcatatgggcatattaagaagccatatgcgaaaatgcctctcgatttttgtagacgccactagttatggtccgtttgcaaaaatgaatgggtatcatacagaaaaatcacttttgaagtaatgtgatgcaattattatcatcgtagatgacgtagttgatgccgtcgacggtgcattgccgttgtagaggacacgatcgatgtcgtcgaagaagcgtattgcaaatgtatctgttagaggatgcgaggtgttcatctatgtggataagtcggtggcggcaagttgatgaagaccactggtgttataggatcggtgaagacgatcgcgtagtcgtacaggctatagatgcagcggctggcccgatctggtgtcacagttgcagcgcacgtcgttggcgaccacgtgtgggagttcggtgaagacgttcgtcgcagctgtagattggctttggttgattatgcacgtatacattggacatgcacatgtcttgccgtagaggtggtgatgatcgctagatgacgtcgacgttgatcttgaagcagatcagtagatgtacatgcactttagtttttttttgaccggatacatgcacttaagttgattggatgaatagctccatgccaccggggccacgctgctgcttctagtgcttggccggttggtggcgtggtgtggtcggcttgttgcagattgatctccgcgacagtgttttggaaaacggccgtatatacttaaacggtagtaaaattgttccgttaacgtgggtatacatttattgttcgtcaacgtcaaatctccgtttttagtgattagttggtcgttttccgtttaatcacacgaataatcatccgtatgttctattagatgatgctttagagtagtttttaatttaatttagaattatttattacttaatttagaattgtttatgttttacttatataatgcaaccaattctaccaccaccatgtgatgtataaatacggttttagaagatttaatgtttcacttatctgtttaattagaaaaacaacatgaacatatttgacttacatagttgtacccatctaaatcttcaaataagtacataatattataaaatttgtacatatatttgcaaacgttaaactttcgcataatttattaattgtctgcatttcgattaatcggtgaacggtatcttcttcgtccgacaaccgtattccgtcttccacaacactgttccgtgatgagaagttgatcggcgagctcccgctgctctggctctgcgtgctcccgcgctgcagcagcttgcacccacgcgcgcggcgagcacgttgatggcctcgtctgtgcagattggtggacgccggtgtattgatctgctaggtgagattaattcctgcattgctttctttttctcctgtttgctcatactggcgtggcttccgctgcttctcttctctcgaggatcatagggcttttatgtagctaacgaaggaattgatctgatgctaattgttagctaatctacagatttttgttgtgggtgactaagcgccggtgccctaggaagattatggagatctcatctccccgagacaacgcgcgtgcggaaggtaggaatggatcaaatgacgttggtgataccatgtgaaaattctaattgttgtattatgatgtattacatcggaaactgcctatctatttggtgatttctaaaaaaaaacacttagattttttctacccttagatttatatccaacggactatacaaaagaaaataacaaaaacatatttacttacacaacatttttatcaaaattacagtgcacttacatgttatatcaactgaatttacaaagtataattttagttatataggactgtaattttatattttaaataaaataactaacacatgtttacttatcaaaattacagtgtacttacatgtcatatcaactgattttacaaacgtaattttagttatatagaactatagttttatattttatattttatattttattttagtttcaaatgtcttaatttttcaaccgttaaagaaatcaatttttatttagaaaagaaccgggcctaagcatccaatgcatggccttatccacgcatgcagcctccaccaccaattcttgcacaaatcttagcgcacatatcgtgcggccaaaaaaaaggtggaatagctagaaaaaaaatcacgcgacagatatctagcaaaaagttacatcgaccctcttatagggtatatacaggagtgcataggagatagagacttgtagtacaatataagtaagagtagatttacctctaggattctatctttagaactctattttatctctaggattgtatcttatctctatattcgtatttaattcttatctctaactaacatatgtgtacttttaacaagaataaggtaaaagcacttcataaaaaaagaagacaagtaaaagtctacctaaatttattcttaaaaaaacgaactttaaatttgaatactggtttggattttacgtagtccatagaaaattaagcaagctggaccggagagatagaaaataaaaagagcgaggcagttttaactcagacagtggtgaacaaagcagggagccacaacaatcagataattaggcccatgggtatcccctaccccaatcacataattacgcccaacgatcatatcaagtatccaagattagcccactagcccagtacgtgcagctgccggctgccggagcgtggcttccgattctttgcctgcaggcagcagcaagagtgagccctttttttttttttgtttaattggatctatatcaccctagacggtaaaactaactggagagcgctcttcaattagtcttaaccagagacacccacgtgctagtactttagaaattttggttgctataatatatccaatagtgcatatcttgtttttcttcttataaaattctctcttaaactagtaatccaatctacaatctgattacaccattacgttcgttgcaattaaatctttacaacaagatcttacatgattatattacgatgaaaaataggggtgcctacggctcgggcgcccgacgatttcgagaaaaatcgggcgctgacgtcagcgtccgatttacatgcaaaactactttaaactgatttttcttctaaattacttatccaaatcatgatccgattgcaccattaaattcattgcaattaaatcttcaaaacaagaccacacatgaatatattccgacgaaaaaaaatagcttattattaaaatatttttaaatattgtgcgatgttccactaggtatatcggaattgtttcactattcagttcactgcaacattatatctatacgtagtgaaacattatgagtacactaggtaaaatatttttcggtggaacaaaaaataaaccaaattcccttaatagggggtttccaaaatatgtgggtttttttgttgcaatggattatttcagttcactgcaacattagatctatacatagtgaaacattgtaagtacactaggtgaaacaacttttgtggaataaggggagggataagtgggtgggtctagatggggagaggggagcgcgcgcatgggggaggggggagcgaccgatttttcccacctccctccggtcgcccgattttaatcaattttcaaaaatatttatatttataaattacttttattatatacgtaagttacttttatcttatatataagttacttttagatttgactaaattacttctatacattcataatgctctaagttgattatttttattattgtttttagttaattctatattttgtggactttataaatcttattcagctcactccaatataattatttctactatagagagttacttctattgcataactaagttacttctgttgtatataattatttctactacagaaagttacttctattgcataactaagttacttctacaatttaaa

SEQ ID NO: 57101 - DNA, 1136 bp, Oryza sativa
  unsure (1)..(1136): unsure at all n locations
nnnnnnnnnnnnnnnnnnnnnnnnnnnnnnnnnnnnnnnnnnnnnnnnnnnnnnnaggaggtagagctcgattttagaagaatttatgaagaagaatgggtcaaatcggagttcaaacggaaaagttatagcctccggaagtttgaattcaggaaaaatccgaggataaaagaaaaaggaatattccgagaatattctctggatatttaatttcggaaattgaattatttttagataaggaaaatatatgtgggcccactgtcagtggcatagagtgtatgggtgaactcggtgtatgtagactcgatgacgtggaacgacacgtggcgacataaggcgatgaggtggcactgacatggatggatctaggctgaggtggcataagttagggattatgtagatccaacggttgggatttgatctaaggatttggacgactgtgattatttggagtttctagatggcaagtcccacacgtcagtgtcacaaggaagaggacaaggagcagctgctccaccacaggcctgggcgtgcccggccattgcggcatggcgactccggcacagcgacgtcggcggcgttctccggcgacggcgcgcagctgcagtgacgagcagcggcgtcggcaagaggaggcggaggcgaatccggtggcgcagcaccgagctccgggacgaattggagatgacccatcaatgacgagcggcggacaccggagttgaggagagaggaaaacggcgcggaaggaaaagaggctcggcctcagggctttaccagcggctgcggtgcggtaggaagacggtgacgataacggcgcggctcccggcggcggctgctcacggtggagatggcggcggctttggaaaaaaagggggaaaagggggcgggggccgacggtatttatagaggagggagtagctagggttagggcgcactgcgcaagctttggaaaggcggcggctccgaatttggcggcgcggcttgcgggatttggcggcggccgtgtgggcttgcgggcggctggcgcgggctcggtcggcggtggcttgggctggcgacacagagaggaggaggaggccaggccgaggcggcacgtgggcttggggcttggcttccccaggcttgcagctcaagaa

SEQ ID NO: 57102 - DNA, 1238 bp, Oryza sativa
ccctatctttttgttgcattgaggagctgatgagctgagctaatcagggcagaacaaaggcaggaggatatagttttccaaggtttgtgctcttcctttgttctgttttagccctatgcatgaagaggaaggtatatagtcaagattgcatgcacttctctgattcaaaggttgcttttcaagctagtaactcaagtagatgatcttctggtgtttctctcccaaatctaaacaatgtctgaatctcatcagatcctagggccggcctgcatcaaaaagaaggatgcatccgagcggcggcgcgctgtcggtgccaccggggtttcggttccacccgacggacgaggagctcctctactactacctgaggaagaaggtggcctacgaggccatagatctcgacgtcataagggagatcgacctcaacaagctcgagccctgggatctcaaaggtaaaattgaaattgagcaatcaatcagtcagctcatctagctagccggccggagctagcaagcatgcaacagtgagatttagctgaagtttaaacatggtgattaatatttcatgtggtatatatacagatcggtgcaggatagggacggggcctcagaacgagtggtacttcttcagccacaaggacaagaagtacccgacggggacgaggacgaaccgggcgacgacggcggggttctggaaggcgacggggagggacaaggccatcttcctcgccaacgcctgccgcatcggcatgaggaagaccctcgtcttctacgtcggcagggcgccccacggcaagaagaccgactggatcatgcacgagtaccgcctcgaccaagacaacgtcgatgtccaggtatatatatatatatatatatatatatatttgacatcagcaaaaaccatatgcaacattaagttcacgatatacatacttagcatccatgaaatgccaaagtcatgcatgatatcacgactcatgagtactggtactccctccgtccaaatatataagtatttctagctatgaacttgaacaactgcgtgtttagattcatagctaaaagttactatattttgggacgaattgcagttatgctagttttgctatttatcagtcatctagaactttgttattttgtcagttacctacatgaatttgtgtgtactatgtatatgcaattggggggtgatccaaagagaataaagtttcaggctgagaattagtaaaaagggatat

SEQ ID NO: 57103 - DNA, 2368 bp, Oryza sativa
cgccggcggcggcggcggcaccgcctcgtcgttgcagaggcttccactgcagtatctggggtgcgaggcagccgacctgctcaggttctccaagtagagagattatccctccatgcatgcatggatcacttgaactaagctagcttaattagctgccaccgataaatgagcagttgatgatggtgatgatgatctgaatgatcagctcatgtttttttggttagactggttaatttgatcttccttttggtatggagcttaatgcttccaagtgtatatacactctatgctatgctatgctatgttttcccatgtgcatgcatgcaaatgtggctttgaaacctaattatacatgcatgagaatacttaattaatatttctgattttcccatgcatttttggatttaagtgttgcttcttaattaggatgcttcataattgctggctgatgaatgagaaccgatattaatttaccatgtgctttgcttgctagagttcattaatcaagaactgtcattatatattgcacatatatggattattgctcatgttgtgtttaaacctttatgcaatattatgttgggttaaacattgaggtaagctcttgataataattgatagaaccaaggaactgcatggattatattatttatcttgctctggattatgcttttatttttatggaggtaggtgtcactttccctctttgttcgtgcatgaatggtttggacgtttggtgtctattcctctactgaaatgaatgaatatgttccccttcagattaaggataaaccatgtcaaattcgtgttgaattattgtcacatctacttcttcattgttggttgttagacctgattgaagaagaaatcgttagaccttataagagaaaaaccaaaagacttaatttctttttttctcttagatgtgcactactcttccacaaggtatcttaaactcagaatcatatcactaatatgcatggtttaaatttcatattgactctatacatatcaaccatttcatcaatcaaggaggagctagtttagttatttaatgaaataagacgatatatagggagaggactacagtcgggtgtctgacgttttgtacgtcggacagtgttgcatgacattgattccaagtgtttcacatgtttcatcttttgatgggaaaatattcaacaaaatatggagaaaaaatgtttcatcgtatgaaaacaatgtttcaactgttgaaaaaacatgtttcgacataaaaaaaatatgtttcaacaattttaaattatgaaacacaatcaaaacaatactgaaacattttcttacaacacatgaaacatcaattttgaaacatccaaatgcttcgggaaaacaatgaaacacacaaaaaaaaaccactgcaacattttagtctaaactaatgaaacatccaaatattaagctaaaacataaaaagagaaaaaagcggtctagatctatttcttcctcttctccagtgataggtaggccaccatgttaatgttgggatacctatactccatgaagactctctattaccttctcctattgctgacgaagataaggcagagcttggcgccgcgccgctgtcaagcaagctaacactgagttgctcccctcattgatagtgtccactcccctggatctagtgccccttagctcaacgtatactggagacggtgccaatgagacaccgatgggtggtggacgtcaggacgcccccctactgcgtgccagcaatgtggcggagtgcgagatgagtcgctcttgcttgccgtcggtgcaggtctctccatagctagccgttccggtgaatatggggagagaagagaggaaaataaatggttgggaatgaggttaagattgactgttgagcagaaaaggatgaaaagagtggttaggtaggactcactaggtaagcgtcagatatttaatcacactccggacgtacgagttaaagcatttccgaagttatggtgtccaattttcttcttgagcaggttgaagcattttccaatatataggggacataattaaatatagcttcattccaatccaactggcctttaatttctctgtaaagctaatcttcatattgtgtagtccgttagggaaaaagcagattaatttccaatacattgcgtaggtgttcgcatgatatatagatattttgttgtttgttatgacttttttatacttcttgattattacccctccggttttaaatagattgcgccgttgattttctatcacatttaaccattcattttatttaaatgcaaatatgtgaaaatgcaagttatgctaaagaaacatttaatatatgataaaccaagtcataacaaaataaata

SEQ ID NO: 57104 - DNA, 1146 bp, Oryza sativa
tgaaattgaccatgccaaaagtaactgaatcagactctgaaatgaagaaactatatgatcccctataccaaacataactggctattactgactgtaagtatggaccatgttcactaacattcaactttgggaatgaaagttattgttttttttcagatgtggatgtatatgcaagcaaaggattaagacatgaaaacaaaaaaaaaaaaagaaaggaaggaaggaaagacaaaagcccagacagatatcctgctcacttcaccaatgaataaataaataaataataaaaagataaattgaagttacacttcaccaaatatgcaatataggaaaggggccttagcagaaaattttagtaagtgttccatgagtcatatgtatcatgactattcatgttacaagttataacagccttgtaaatatgctaactagaacagtatcacctaccaattttataaacagaaaaacattgagcagcaatgggaactaggaaaagttagatcaaactggtctgactgaatgggagtatctctgccaacacagtcataaactacaaatatcaaatcagtgaagagtttaatccttcataatgatgaagttctcatgctcccatgttctttttagataaaatggttatctaaaattgagttttgcaatacttttgcacattgcaaaaggactggttaacaaacctatcagattttagattaaaattaggagacgcaggcaggataggccattgtcaatattaagatattagtttaaaaggcaccaaattatgtgttcacatcatgttcccggaagaggcaatgatgatgcacaatatatattcccctatcattcttcaatatctagttgaatagttgatgtaagaagttatgagattaaattaagtatttccatctccttttggcatagtataaaaaaccggtccggactggcggttgaaccggagaaaaccggaaccaggcctctcaccggtttggttcaatagaaagaccgctcgtgcatttgacccggtaagaaccgggtgaaccggccggtttttgttgaaaaccggtgaaccgggctcataagaaccggcggttcattgcaagttgggctggacttgtaaggcccatcatcgcccatttacattttatgcaa

SEQ ID NO: 57105 - DNA, 1949 bp, Oryza sativa
tagcaactaggtaataagcctctttgtttgaccatggaatctcaactatttcaggatgcacgacttgatggtcaatagtcaggaatcgcaagtcagggtttcatgggccctgtgtatagtagtcctttcactgtcataactttttcaaccaattttgccttcttgtttatgcaattgttaactatcgacattgttattacaatgtcaccccaaaactccacacattaggtgccatgcatcccctcaactattttcctttaattgaatccatatttcgttgaactacatatatgaatgtataataactgcttatacatcttatttgattatatatatgacgtttacaacaagatttgatcgaatttttgaaacttcaaccactaattttatattaaaatatgtttaaaaaatcgggcgagttattatgattttactagttttctaagtaaacctgtacaccactgctctggagtggctgccgaggcactcgtcagcacgaggttagggcagccgaggaacagctataaacaatcaaaacttaaagtatcaattactatcaaattggttcttagtacgacgaagatcattccataattatttagatgatgaccggttttaaatttctcaaagataaattttgttaaaggacatcgtgacttcacagttttacctgtaggacccctatatcgtatgacattaggacccaaggacataaacaccacatttttagtgaattaggagtatggtttagcttagctattttatcctttggaacaaaagaatatattttaaaggaaatactctctccgcttccgcttcatattattataagtcgtttgacttttttcttcgttaaatttctttaagtttgaccagattaatagaaaaaatatactaacattttcaataaaaaaatactatcaaaatatattcaatattagatttaataaaactaatttggtattgtagatgttgctaattttttctataagctttatcaaacttaaagaagggagtataatatggaatgaagggagtataaaaaatcatgagaaaaatggctacatgaattattttacaactaaaaagtatagaaaattcaaatatacataactaattcattttaacaccaaatgaggtgaaccaagttttgttaggtttattgtaatattttatttaataccatattgacaaaacgtgtatcactattatgaaaaatgtcaccaactcattaggggaatatcagggtttacaatttcgaaatgggcatttctaccgtggggtccagaatctcaaaagtttcaaatgaacttattattaaatttgaagaaattgtgattgaatttgactaaattttttaaaagattgaaaattccacccagcataatttttttcgtgggatgggggtttgaaattccaaaaatttcaaaaattttgaactgaaatttgaaacaatagggagtatataaattctgtacctagacttttaccagcaatatctgtagcattctaccttcagtaattgtaattcgtttcctgaattcatctcaaatcaatgtctacacactttataagccctcgtgaatgttagagcatttgaatttaatttggtatccattttctaccaggtttaatttttaaaaaacgttgagctcgaccattgacgtgagcaaaaagtcaggtatataaggaaccaccagaaaaaagcaaaatccttttcttttataaatttcatctgatagtgtgaaatgtttgtttaaatttgggttggtacaattatcatatttgttgcattacttaccttgaatatttatatcctttaattgttgttgctaaacttataatgagttgtgttctggttcagtgctagcatggatacattcaagctactaatatttctacttgctttgccaaataataacaaataaaatttgtggatcactcatttt

SEQ ID NO: 57106 - DNA, 1295 bp, Oryza sativa
cctctggacgagcacggttatgaacatacttcttcaaaacgcccatgtacctctcgaaaggaaacatgttgtttaggtacacaggcccgagaataccgatctctttgacaaggtgacaaagcagatgcgtcattatattgaaaaatgacggtggaaatatcaactcaaaactgacaagacattgcaccacatcattctgaagggcttctaatctatccggatcgatgaccttctgcgaaattgcgttcatgaaagcacatagctttgttattgttgcccggacattatctggaaggataccccttattacaactggtagcagttgtgtcatcaacacgtgacagtcatgagactttaggtttgtgagctttgttattgttgcccggacattatctggaaggataccccttattacaactggtagcagttgtgtcatcaacacgtgagagtcatgagactttaggtttgtgaacttcttctccttcgtgctttttattcgctttatattcgtggagtatccagacggtacctttatgctctccaagcattcaaacatactttccttctctgccttgctaagagtgtagctggctggactcaagtaatggcttcctttctcctttggttccgggtgaaggtcgctgcgttgttccatatgcttcagatcattacgtgcttccagtgtatctttcgacattccatatacacctatgaagccaagaaggtttacgcaaaggttcttagtgatgtcgattgcgtggcggacgtccaagaattctcaatagggtaactcccaaaatatagatttctttttccacatctccgcgtgaccatcttcgctctctataggctggcttctaggcccctttccgaacactactttaagatctttaaccatagcaaacactgttttcccgctgcgatatttaggcttcgtacggtggtctgccttatgttcaaagtgcttgcctttcttccgtatcgggtggtttgcagcaaggaatcgacgatgacccatgtacacaaccttcctacagtgattaagatacgtactttctgtttcatccatacagtgagtgcaagccttgtaccccttgttggactgaccggaaaggttgctaagtgcaggccaatcgttgatggttaccaacagcagcgctcgtaggttaaactcctcctgtttgtcctcgtcccacatggggacacctttctttttccacccaagtttaagatcttcgaccagtggtcttaggtacacattgatgtcgttaccaggttgcttggggccttgaata

SEQ ID NO: 57107 - DNA, 922 bp, Oryza sativa
attaatgtgttgtacttcttttaattttcattttagtttgttttctattatttaagattagctttcactgtattttccttctcaactattttataaaaccttctttagcaaataaactaaatttctatatattctttctttcccacacaaattttatctcttatcaacttacaactaaatttggagacaaaaagtgtgcaaaacatagctccaaatgtaatatgacaaaaaaacattggaggatgaaattgctaaccttttaggcacatccgatttgtatataatcaccaaaataaattcactagaaattttagcatgacctcccctcttttttgaagaaattttaaagcttgctcgggcagctggaggaggaagaagacatatatatataggggtgggactttagtcccggttggtgggatctttagccccgcttcataacaccaaccgggactaaagttacgatcttaccaaccgggactaaagttacgatcttaccaaccgggactaaagatcccggggggcctgacaaaccctggaagtatttgaaccgggactaaagatcaaatatgcccgttaccctttttaaccgggactaaagatcatctttagccccgatttttattgcaaccgggactactgtggaattcggccgaccgacgaaagatggtttctccacgagtaaaagtacatgagttttttaaaaaagaactgtggtcaataaacgagatgaaagggaaaaaaacatttccccttaaaaaatgaacccaagagctgtcgcatcgatcttgttcgtgtcaaccataggtcaaccaaatagggacgagatcgaagtgacgaagaaattaggtttggagacgaatcaatcagcagggttgttggttcatgcgacgtacgtacgtacacgcatatatatcctccc

SEQ ID NO: 57108 - DNA, 2081 bp, Oryza sativa
  unsure (1)..(2081): unsure at all n locations
aatacttgtctctgcatccatccatttttaagtctcgtgcgctaccccttttattattgtcgaattcatgtttcgatagttgcaccaatagtagaattagagcaccttgattagaatagtaaaataatcacagagcatgtactgctgaagctgaaacatatctagctgcactttcgtgccgcgtcgactcgaggtgtttctcatgtggaggtcaagaaggattctacgattcagggctgtctatatgggattcgcataattttttagactttcatcatgcagtgtttcaataagtagatcgaaaatgtatcttttaaaaaaaagttggaacacaatcaaatcaccccttaaaacattttgctacaacgtataaaacaacggttccgaatatattgaaacatgaaacaaatttgagtacatcgagaaaaagtctatataagattcgcatgatttttaggcttccataatatagattttgaagtaatcgggcattgttttaccaagtatatcgaaaatatttcaatcttttaaaaagctgaaatacaatcaaatcacctcatatgaaacattttgctacaacgtatgaaacaacggttctaaatatacgaaacatgaatgatttagctatgaaagatcattcaacagccatttagcctttctgttatttttttatacaacgtgcacgagataatgtgatgtttcgtatttgatatagcagtaaaaaaaatgcaaccacaccacacacgtctagaactgtaacctgctactgcagagcaaaacacctagatgaatggatcttcaaactacacctctagggaggatacgatgctgagagtgttcctgccgcccgtcagggagagaagacagattccgcgacaatgcccaaggaggaggaggatgaggtgtgtaatacaccgtatattaaaatatatttaggtttttttaagtttgggttggctttttaaaataaatatatcaacagaaataaataaaagaaaaatatctttagacgtgtgctaacataacaaggcctataaacccaacccattagttctcccctaaaacctaaagagaggggaaccgaatctcacctcccctcatggtgccgccacccctctccctagccggcgcctccttcctcccctcctcctgtgttcgcatctctcgtctctacaacaaattgctctctctagatctcctccttcatagcttggattaaaaagcgaagtagaaaaacggaacgaggaggaggacaggagtagaaggaggggttagaccggagtctctcctattgtctcctcacaagttctctaaagaaaccttaggtgagacttattcccttattatatcagttgttctagcatggctttagtgctttaattcgcggatagggaagactagagaaggagtttgggtagttgcggttcggtttgttgcagttctacatgtgggtagatttgcagtgcttcagtgtttcgatgtttcggagctctaaatgttattttatgcaaaagtgtattactaggaagttgtagataatgtttggatctatcttcttaccaaagggagcgattttatctcaagtggtttaggagatatagtttttttagtatgactgttgtttntgtgtcataatctgtatagcagtagattgaactgtttttggaggggttaaacagtggaatcagccaggctgcctatagaagaagttgtagaggttttccttagctttccatattggtaaagtacaccctgattgggcaagtagaactctagttatggttgtttagtgtggacagtctaaaattctggacagattctgaaacctgctttcaagcgcaaattagaccatttttatggcagaataaaaatatgctttctacatcaaagttgtaggtattgttctgtaaattttcaaaatgtatatattttcagtcatagccttttcatattcaagatataaaggtttgaagcagcagtcttgtatatagtccaagcggcgttccttgttattgagttttgatgggatggggcaataggttcacctttttcattattttatacgcctgtttgaatgtgtt

SEQ ID NO: 57109 - DNA, 1549 bp, Oryza sativa
tagtttcttccccatggattataaggatggattgtattgtgggaatgatattgttattagtttaacttataattgcctgtcatggatgtccatatttacaagggagattctgccgaaatttctaataattttgggagtgttgatgaaaaacacgaggcctgggagatctgcttaactccagtgcaggtccaaaactcgctttcgggtatgcaagcgtgctagttgatttgatcctgcaatcaacaagaaataaagacaaagaaaccgcggttaaacctataaacgatagccgatcggctaagtgccgatgacatatcatttatctttgagccgatgtcatgtatgtatcgatcggcagttataaatagataataaagaactaaacctacccgatcggctatagatattaacaatatataatccttatatcgatatatacttaaatcaagtgattgggatagatcggtcgccatgccgagacagtataaatcacttagattgaggctatatatgttcatagcatagctgatcagatagatttagcatgtattggctaatactccgataccactctatgttaagatattaaagcaagcagaatatatcaaacaaaagcctaatatacttaaatgcaataagatcttagcataaagggcagatttaacacatcaataaaacatatagagtaaatatagttaaattagataagatcggctgaaaccccgatactaccctaatcggcaaccaagaagcaggctagagattgagaattcctaatcatgactcataagatcaaacttaactaatgcagctatatgtataaaaagaaagacaatatctagacaatcaagccgttggaagtttcatagagtggtggataccttatataatctaagtcgataacgatatctaacctaatcggctgccctctaccgatagatgttagccgattgtagattagatagcgatattaccagagattatgtaagatatatgataactcgacgaattacataaacaagatcagagtatcataaagatggaagcactaatcccgagaacgcaagccgccataacaagttttacctcttgttgaagatcgaaatcgatgcagctcaacccgaaagcaagaactcgtcgaaacaaaactaaagcaaaaagggtggcgatgcgccgagattgtattgaatgtgtgttatttgattacatggggttgggggtctatttatacctgaaaattacaaactatgtccatatcggacacgactcttatctctaacaaactctaagataccataagtctttacggcagacttttgcccaaacatatatctaagaaaattacataaaatatcctaattaatagatacaattgccttcccaggactctatccatgcgtggcaatcaccttgaagcatatcaactcaacccgatgtcgtataccaagtcgtattgtcggaatcggctgtatcacctgacctagtctaactcggacttagccgatccaatcgtagccgatccggactccagccgattcttactctgttt

SEQ ID NO: 57110 - DNA, 1196 bp, Oryza sativa
taaagtatatctttactcagccggatctgaacatgagacaaaggagatggctggaattaattaaggattatgacatgggaattcattatcaccccgggaaaggctaatgttgtagcagacgctcttagcaggaaaggctattgcaatgctacggaaggacgacagttgccattggaattatgtaaggaatttgaaagattaaatttgggaattgtcagtagaggtttcgttgcagcctagaagcgaagcccactctaattgatcaagttagagaagcccaaattaatgatcctgatattcaagaaatcaagaagaatatgagaagaggaaaagctatcggtttcttggaggatgagcacggaactgtttggttgggtgagagaatctgtgtccccgacaacaaagatttaaaggatgcaattctgaaagaagctcatgatactttatactccattcaccctggtagtacaaaaatgtaccaggatctcaaggaaagattttggtgggcaagtatgaagcgtgaaatcgcagaatacgtagcagtatgtgatgtttgtcagcgagtcaaggcagaatatcagaaacccgccagtttgctgcagcctttgaagattcctgaatggaaatgggaagaaatcggtatggattttatcactggtttacccagaacgtcaccaggccacgactctatttgggtgatagtcgacagacttaccaaagtggctcatttcatcccggtaaagacaacttattccggaagtcggttggcggaattgtatatggcaaggatcgtgtgtttgcatggcgtccctaagaaaatagtgtctgatcgaggcagtcagtttacttcaaatttttggaagaagcttcaggaagagatgggttctaagctaaactttagtactgcttatcatccgcagacagacggacagacctaaagggtgaatcagattttggaagacatgttgagagcttgtgctttagacttcggtggaagttgggataagaatctaccttatgcagaattttcgtacaacaacagttatcaagctagtcttcagatggctccgtacgaagcgctgtatggtcggaagtgtcgcactccgcttttgtcggatcaaacgggagaacgtcaggttttcgggacggatatcctgagggaagcaaaagaaaaggtgaaaatcattcaagaaaga

SEQ ID NO: 57111 - DNA, 1977 bp, Oryza sativa
attcgagttcgaatcggatcggcttttctctctccgagctcgagctttccatctcgtcgccggccgccgtgggccttcgccgttgcctcctagcccctttaaaaggacccccgagctctcctctacccgccgccaccctcgccttcgcctctcgtcgtctgtagagctctagcgccgtgagacctagcgccgccgtcgctccagccgtgcgccgccgccgttccagacgtcgccgtcgctcgggaagaccgtcgtcgtggtcgccaagtcgtcgccgtcctcgtccgcctcttcgtcgccgccgaagaccgccggagcaccgtcgccgccgtcaacccgaagagcgccgccgcttcttcctcgtcgccgtcgccgtccgttcctcttccgccgtcgctttggtcgccggtgagttcgccgtgccgtccgctacccgttggtgccttccgttcgcgccgccgtgccgtcgttcgccggcgagcatgtgcgcccgagccgccgagccgccgccgccggtggtgacgtcatcgccgacgtcatcgtcccctctcccgtgagccggtcgtggatcgatcgatctcggccgtccgttttggatcaagtcgatctcagccgtccgttcgcgtgaactgccgccgtgcgcccggtccaccgaaaccctagcccactgacgcaataaatccctttttccttttcaaaaataattcattattgcgtcataattcaattaaaatcaatttaagtgttttaatccgatttaatcttcaaaaattcataactaattcatcttagctcggatttagttggttcaagtctctaaatttttctaaaattgagatctacatgttaaaaatatccacatgtactgttcatgcttgtttatgtgctgtttcggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttctattcaactattgcatttattttcgaatgtcattgggtggaattaacctattgtttgttatagcccttttgttcttgattactttattccttgataccttgggttattataacttgactagttgagctctatatattgattcagctagatattaggtgtgattgcttagccatgcttagaaacattagcacactattgggataacttatgattcactattaattatttaatgatggcttaatgatagttcacgatggtcaatcgtgattggttaattaattaatgggacggctaatgccttatcatggtgggttgtgagctcatggttttgagagtcgtgctcatgacaattaaggaccggttcacgagtttcggttgtgaaacattaaccgtgccaaccacaagccagcgtgggcaatggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcttagtaaaagatgctataactggtaataatttgtttagctcctggtttgaaatgctatattcctggtttgagatagatctgtacagccgggtgtggttgttcagaatggttgggcctatacaacagggtatgttgtatagcgttggtttaatattgtttaattattact

SEQ ID NO: 57112 - DNA, 1875 bp, Oryza sativa
tctccacaatcgtcacccggcctaaagttaaaatcatgactgaacttttgctctcgatcgagtgcccccactaattcgtaactgttgtgtccagcttaattgttttgctcaaaacctgataaaattatatataatgcgacgagtacactttgaaaatatccctttttcttttctttttttttgcatgagatgcgtacaccaaattaagagtgtgtttagttcctgaaaaaagttgaaagtttggggaaagttgggagtttggaaaaaaggttaaaagtttatgtgtgtaggaaagttttggatgtgatgtgatgtgatgggaagttgaaagtttagggtagttgggggtaaactaaacacgccctaaattattaatgtgtgcaatctctacaggactagttcgctcggtcgcgccggccggaccacgtgatctcacaaaatctatgcacgaccccatcatgattatgagcttattagctagctaataaagcttggaggatgatgcaaaaagccgatctatcgggtctttacctagctaaggtagtgactcacgatcgagagctcatggctgcacatgggtcgtcacacagctctccattcatcgatcaccatccttcaattcattcctttctccgaaagcaacccatccatcgattttcccaaaagtccaatccggccgtttccatgatgcattaacttaaatgcaagcatcctgcgagatgagcgttgcttaattatttggatttcttgtggtcgaaacttttttagctgcagtggcggaactgagggggctggcaggggccatggcccctcccaataaaaacaaaattttttattatccccatatatcataggagattcagtgaacaaacaacagagcttttcactttgtgtatatctttgatccaagtgattcattcagttcattcaacattgataaagtgtgctctctagcttcaaagttctatcctgctgattttttagaacaagaggaagccaatttgagatgtcaattacgtcactatgaacttgatgtacccaccaatcctaaattttaaaatctgacatctgttgctgatctttgtcgtcgagtttgcaaactattggcttttatgtattgccaatgcatgaaaaaaaaagagaaaatgctaattttttgaactgtcaaaagccggctggcccccctttgattttctgtccagctctgtcactgtttagctgaattcaagttttaaacgcaacatgggtgatctcgtattttacggctaattattttatcagtggtaggtttactcgttgacagagatatttatggtgacttaattaatctcaaaatatatcaagatgtgccggtccaatctctcgaagattttcataggggtaggggtgtatgttgtgtatttatagggataggtatgcatgtatgtgtgtgtatttatagggataagtatccacacatatatgttaataaatatgtttgtactattttgcaaggtgtatatgtgtgtatccctagggataagtgtgcatgcgtatatatgagcaaatacagttgtactatgtttcttaaaagatgcaaacatccttataaactactaactccatctgagaataatctgtacaggagcaggatgtatcatatccagtactaaattaacttattctaagacggagggagtaataatttgtaaataagggtataattaagtgcgctgacacatctaagtatgtattgtctaaacctcttattacgcttccagttttttaggggaaatttgtaaaaacctgctgcaaatatcaccctttgagattccatcctaaaaagatgatttgttgcaaattaatatccccttttcctaagcaaggcaaaaaata

SEQ ID NO: 57113 - DNA, 821 bp, Oryza sativa
ctaatattcatactagctagtgtatatgggtttcatggtttgcgatcaccagaatacacgagcaacggtaatcggtgattagggaggatattgaatcaaggtgaattagggtgacgtcatttgggattttctttaaaaaaattaagataatggaagatgaataatatatctccacggcctcttcacctacgtacccgcatatatatgtatagatcaatcggttttaataatgcaatttcgccggcaatattctaaatattcgtcattaaataacagttaatatgagaccgatacgatcgatctggtattgaaaaagcggtagaaaagtacaacaaaaggacaagaaaaagagcacgattcgaccaggaaatgcaaaggacgggcgtcagcttggtctcttttgttgacctggataattatatattactaatacttacatgtagaagtaattaattaatatcttctttacgcacgttctctgaataaattacttgcacacgtgctctcttctctagaactatatatgtcactgttgatcgatctgtgtctcctagctagttcttggttaacgctgataagatcgatgagatgctaccatagtggaagctgcattgaaatgcatgagctaagctacttgggtcaacagtttcaagtgttcaacacctaccaattttattcaaacgcattcgtcgattttcacggttgcttgcatcggtcgtctgcatgcgtatcctgcggagagcgatgcgaattaaatatcgtcgaagaacaaatatggattagtactgtgctatgttattagcaaatcagggctgcaggaa

SEQ ID NO: 57114 - DNA, 1503 bp, Oryza sativa
cgagcgtgcgttgcttttcggctctcgcttgattcctcgcgtggtcgtgtgccgcccgcccgataccacccacaggcagccagagtgtgttgttgtgttgtgtcccatgcatccatgatcggtatggacaggcaggaaagcaggggttggacgacaagggtgattggagacaatgtgtgcgtcgatttccacgttgattaaggccttgttcactttgttatcaatttcgcagtgcgagcttgcgatcgacctcaggatactcaaaagtttaaaagtttttcaccatataaacttttgaatgatatattggtaatcccaaataaaaaagagaacgcagtcaacagtaagacgtccatggtaacttcgtcaatctcaagatatgctaatccaaccttctgaaaaatgctcatatggtataggaaaaataaagatagtcttcattgtccatgctagcccacgaaaccataatctctacgcccttaaatatcagggtagtagtgtggcgttttcccctttcttggtgttttcccctctctctccccactcaaccaacgctccctcctctctcccccctcaaccaatcgacgcgctctcctccttctaccgcggcgcggaaggtacgaagcggtagcaaagccaagcgaagcaacaacagaatattaatttgtcccgcacctcaaacaaaatactgtctagcttctagattttctgtatatatttaaatatgtacttactacatatatactccctccttccctaaatatttgacgccgttgacttttttaaacatgtttgaccgtgttcaaaaacttttatgaatgtgtaaaactatatgtatacataaaactatatttaacaataaatcaaatgatagaaaaagaattaataattatttaattttttttaataagatgaacggtcaaacatttttttttaaagtcaacggcgtcaaatattttggaaaacattttgggatggagggagtatacacataccggccggtagtctaacgtgttgggtagagatcgatataacatgaagcataataaccaagctgcacgtgaacacacacgcgaattgttgatcgaatgctgtcaacaattatatccgtgtgcgcgcgtcttaatctgtcctgaacccgatactgcggatgcgtgtatgtacgtgtacagaccacataatgcgaaaaaaaataaaatacatcctttttattatcaccaattttacatgaatatatatatatatatatatatatatatatatatatatatatatatatatatatatatatatatatatatatatatatatatattctataaatattaaaatattagaataatatttggtcaaaggccgttaaaaccgtttcagatgcttatttagttgtttaattggtatacaaaactaagggtgtgtcggcaccccttttcccaacccctctctcgttttctacacacacgttttttaaactgtttaacggtgcgtttttttgcaaaaagt

SEQ ID NO: 57115 - DNA, 1670 bp, Oryza sativa
tcaaggcttccacatgtcttgcaaggaggctaggacgagcaggagaagggtgtccactgtacaggttgatcgatcgatcgatcagagatcaacatgttgatcgatcaccctgccctcgcgggagcccgggtcatagcggttccagaggcgcttggttcacgcacagctcgctggtttgttttaatctcaaccaaatcaacggcttggaatataggactcaccgagttaaaggaaaattaagggatagattttattaacgccacgtgtcagcttaagagcgttttgaggattgccacatggcagcgttggagtgttttaaggaagtttaatggacttttagtatataatagatagatagatagatagatagaagatagatagatagataatagaagataatagatgcctgcgggcttatgatgtaataattagcactagactctcgtgtatgtgcatttggtatttcaggtatgaactcgtgtataccagactacttgatcttgggaaatggtattgtttacacgaatgattcctgttatcaaaacgggggtccatatattggaagagcgtgtgtagctaaataatcatccatagctatctttattaaaaattgaaaattactctactagtgaatagttgcatttatcttatccaatgataaccattttccattttttttttctggcggcttccaccagggttgtgtgggggagagggcggcaacgtgtgcggtgaagcggagcgaggctatagagatgatgtggtggcgtgcaggcgtggagacgacgtgacacgcagctgtggatgagccgaccaacatggccggcggtggcaggacgacggcgcggtgacagccgggcggcaataggacgacaatgggcacacaacaagaagaaggccggcagcgtgggaggtcggtgtgggcaacagcagggaggcacgagacattatgaaatcaccttcgatccaatacccttcaatgtgaatattatgaaattctactccacgaaaactccccaaaaaaaattggcactcaaatacagctccaagagtcaagaatccaaactgaaatatcatccatttaattcctcactttttataccaaaaaacacattttttttcctttattgcttcatgttttttgagttaaagataagcaacctgagcagaggagaggagctttgatcgaaatgcatctttacaggggtagcccggcccgataaggctttgttgggccgggccagtaaggagattactctcaccggcccagcaagcgaaatgcttccggtccaagtccaacacgcacccacctcaccctttgctgcggtctctctctctctctctcggcttcttcctccttgcgcgcagcctcgattctcgacttttcttgctgtggggagaagaatcgcgattgcgcgaggggatttcttgctgctcggagatgccgcggattccgctgatcaagttccccaagaggaatctcaagatcccatccccacccccaccaggtgctgctctctttcttcttccccccaattccaatcctttctttcttgtttttttttttttctgttctaggtttatagtgggggcatgatgtgtcgttcgggatctaaatccctttgattttcttcttcctgcagcggcgcaacctgcagatcagcacgcgt

SEQ ID NO: 57116 - DNA, 1628 bp, Oryza sativa
gactgcagtaggggatgctccggccccctttgccccccctgctgcgtccgtccctttgctcgtgtagatgtggtttcacgatagatctgagcttagtccggagtaatgttttgtggcttatggttcaaacggaagatattcttgtgttgattcttgtttgccatctagaacatacattatatgggattcggaaacactggacagagatgaatttccaataatttaatgaagaaggtttttttaatcttttgtcatgactatccagttatgccattcagatgcaacacggctgctggttaatttgatctgttcagctaattgtttactagtgacattttttctgcggacagttgttttattgacctatttactacatttgttaacattacattgatttctgcatttcttttattggaccaaatttctcaaaactacaattactttggcaaaactaatacaaaagtacaggtttaaactgctgtgtgcctgtatcgcagaactaaatattcccaattgaatttatcaaaaaaccaggtttaagacaatattaaaaaattacagtttaagtcacaatatatcaaaacattaggtttagcactgactctttccaaaaactatatattataaaagttccacaaggataatgtttttagagcagaatctctaaaatctgtatttttgtgataaatctgtgctaattaagtcttgtggtaacttcgatgttagatgtgtagttttatgttactatggcttaaatatgtagttttgtgatattttgtcatagcatttacagatatatgacatttacttttatgttcgtagacctggatgtgctgaggtagaataattagaaacctccaccacctacatatgcaccccaccaccaccaccttcttcaattctctatggcacgctttctcgtttggagaccatgccttgctggctgatttggctactcttttcttttccagagcctgtcaaccacaccaatttttatttttctcattttcgcaggatagaatattatgcttcttctatactgtgatagtgtgatgtttcctcagtgtatgattgccaaatgtcatttggatagctgtgctgttgtcccatggacaatacaggtgctggtgcattgggatcgacgaatttctgtccacaagctattcattttagttcaactttacctttttctatgtttgttattttgcttggatatgaacaacatatattgatttactgaatggaaatattctactgatcggtcgtttcataattctgatggaaaaatgtgttcataacattttcaggagttaaatcagaggcaccatcttcttccggggagattaaaaattaccgctttagatcagatgtgccttccccaccttcttatacggctgttggagggccagcttcactccttcctaaacgcaagccactgtcagaggaagaaattgaggctatcatggtatgtacttgttcttaagtatgtcatttgcaaatgcttgcaaacaaactttataacttggacaacttatttgtgcaaacatcaaaattttctcatgtgaaagtgacatcagtagatttctcatgaaaagtgctttcatgcactatatttatgatttttccat

SEQ ID NO: 57117 - DNA, 2374 bp, Oryza sativa
gtttaatctgcacccatgtgtgagtttaagttattgaagtgcatccattatccactggggaactcttggacaatttacaaacatagatcttatcttcaaactaaaccccgtcactgtcagtaatcctccgctcatatcatttatagattggatttgatgtgttttgcacttgttgacaggagtcagaggcttagtgtactcaccaatgtatcccaaaatatttctcatatttgtttcatcaatgcattgttctccatgatggcattcaaagttttctcatcaactgtatattcacataagcctcctctaacaggagtttcaatctaaggctttggttcttttctgcagcatctcatgcatcatcctcttgcacaaatgctacatcatgcgttcatcatcactttgagtattatcacctcaaatgctctctaccttcctttgacacacctctgtaatacatgcataatatttcacactattatgctgtatatgtagttatatatatatatttttctgtagctttgatgcatgtaattttgaatagcgttgttaaggatccatcattcaactcttcaatattgttatcctgtacaattattttgtattttggttctgctgcttgttctacagctttacgaactatgttctattctaacaggacaattttgttatttgtatttttttttttgcagcaaggtggtatctactgatattgcatccgatgaataagataccaaaccttttaaatggggtcactagagccatgtcgatatggaccttttcgttgtactccctttttggtgtcaggaagcagctgccctgatactcctttttttgagtattgccaaaatgaccaattcgtgaaaactgaacatgcaatgcatcggttgtttgccaaaatacattgatcatggagttatgccatgcaactcaactaattgtcttattccattgctccaaatgttctgagacatttgtgctcatccatgctgcttcagcaattaatgctttcatcaaaatatcgtgtatctgccagttggacgaaatgatgctcctatattaacgatagataatttataagcacacaaaatctcattgattagacaggctttgatgtgcttctctttttcgctggtgggggccttcgctgtcccagtgccgtgtaagtaagtaatcccatgtgatggacatatgaatagctctcattaatagttctgataattctttgtttgcacgtttttccttctttttttccccctgttggtatggtgtaatggtctccacatggtcacatgctctgttggaacttggaaggatttaggtgactatcggttttctatttgtttccgtagattctaactcgaaggtccatttgaaacaagaaaaacacatgatttgtggtatgcatgatgcgtgcatgaaattcaatgttacaggaattgttcacttgggttgctcgtgtgcataatagggaggtacatggatttggagagttgcatgaaggatttccatgagattgtgctttgcccccatgttaatgccagttataagagtggggatagttgtatggcagtaattctggattagttgggaatgagcatttgaacaattacatatgttacacttggacgaagagattagcactcttaggggcttatgtcttccccaagttattttttccaattacaaggaagatgcacacacactatatggattgggtagtggcagctccaggaattttcgttgcgtggttctatctcatactttgaaattgcgtaatatcaaaattgcatctattttatcaaaaatcttcggaggatttgaaagatgggatactcctatgccaaaatggatgatgatcaaaggaccatcctaaaaatacctctagaataggcactgggattgagactgataaaagttactcccaccgtttccaaatgtttgacgccgttgactttttatcacatatttgaccgttcgtcttattcaaaaaatttaagtaattattaattcttttcctatcatttgatttattgttaaatatatttttatataggcatataattttacatatctcacaaaagtttttgaataagacgaacggtcaaacatgtgctaaaaagtcaacagtgtcaaacatttcgaaatggagagagtattatgtaagagaatccccctccacactatacatatgtttgcgaatagatctttgaccttactagaactttttggtggggttccaaccaggcataataacttgtaattgatgtaatttgattccataaatctttttcgaacaaaaatatgcttggtttccaaggagacattctccacttccaatcgtcgttgttaaaaagaggggagggggtgcagg

SEQ ID NO: 57118 - DNA, 799 bp, Oryza sativa
attgtgcatgtgacagaaaatctcacatttttgttttttatagttcattatcatgcaagaatacgacgtgattaattgctgcaataaattcaatcaacaaaggggtgccgcgctggtgaccatcgcagccaccatcctcgatggcatgttctacatcacgcaggagttccatatcgaggaacaatgagggcctcgttatcaccttgccccacatcaaagccatgataatcactaccttcgccatcctagcctctgctatgttttttttttttggggggggggggtatctatcctcattgatggttttagcattgccattgttgtcatgctcatctttatctacatctcttgaatggtacaactggagatacgttggatcggcacattgccgcagttcatctgacggcatgctcctatcatacttcatgatcttcaccatgacgcttgcattgtagtacaactaacatgtcatgctcggcgtggcatggtatccatgcttgctcgttcgcaagggttggatgaaggaggccagagctaccctcgatatgcttcttgcttggaaggacatctcttgtgtgatgacactcatcattgtgagcctcggggctagcatgacactgtgatcgtgcactatgtcattcatctatccaatggcaacactaacttgaatgaacagctaatgaacatagtcatgttgtatagtcacgttgtatgggccggagtagggcctctgctgggtcactcctagaattttcactgatgataattgaagtaggtgcttgtattcataactttgggg

SEQ ID NO: 57119 - DNA, 1276 bp, Oryza sativa
atcacgccatgaagggagactacggggaaagagaactctcggaaggaaagcaataatgacggtagacaacaatttattccgtaaagcccatttcacggttctgcaacaatcttcattggtagctccgtacatcgaggagcacttggctctagttcgcgctagaaacatcggtaagtccgatgcatggattacacggcatcacattgatactttccccgcgtggctacgacaacatctcatgggtaacgagacgatcaaccaacaactggccttcctagcgaggggaccatctggctcgatcgtgatattccaaggatatgagatcaatgggtacacattctacacgagagcccaagacatgaagagcacgaaccaaaacaatgctgttcgtaatgatgccatgggacacgatgaaaaaactggcacgtattacggtgccatcgatgacatatgggaacttgactatggtcctctcaaggtccctctgtttcggtgccaatgggttggcttgactggtggaggcgtaacgattgatgacaatgggataacaacagttgaccttaacaaggttggatactcggacgaaccttttgtccttgccaatgatgtaacgcaagtcttttacgtgaaggacatgtctagcaaaggaaagaagggcagagggcctgatgagccgaagcgtcacgtggttctcccaggcaaaagaaaaatcgtcggagttgaggacaagactgacgaggcagttggatgggcaaccccctttcacggtgacgattgaccctagcatcctcctttcaaatgaagacaccccttactcacgtagcgatcacaaggagggaacaatagtgagaagaaagtacgtgcggtcaaccgtcaccgccgatgtattgccgtaattattgtgtacacgatgtaaactattttggatgaattgattatccaaataaatcaattgttgtatggcatatgttaattacgtacgattattagaattcttaacaattttaaatcatgcatatgctagttatatgcgataaatagaatttttaaaagttttaaatcatgcatgtggcatttacatatgttaattagaatttttaacaatttaatatcatgcatatgctaattatatatgattattagaatttttattaattttacatcatgcatgtggtatgtacatatgtaaagtttaatttttaacaatttaatatcatgcatatgctaattatatatgattattagaatttttattaattttaaatcatgcatgtgt

SEQ ID NO: 57120 - DNA, 4495 bp, Oryza sativa
aatggcagaacagtttcagagcttcaagggagatctgtacgagaaatacaccctgaaggggcagacactgaacatcgacacattcccgaagctaagggatcattgggacgagttcgttgcatataagacaggtcaacaaggcagacgatgatggaaagaaacaaagaaaatgccgccaagaagaagtaccatcaccacttggggtcaggcagctatagcatcgcgatgcctgttgattcaaagatcgaacacgccggcctgggagatctgcttagcttctgtgcaggtccaaagattgatgagatgcaggcatgccagtcagtttgatcttacaactgacaagatatgcaaatagtagatcaaaacagccgatcggctgacaagccgatggagtagttccagccgatagccgataatagccgatgccgataccagccgatagtgatagggtttaagcaatcggctatatgtccaatgtaaataatgatatgaaggcaatcggctgatgatgatgtaataaaataacaatataatcaagtagaaaccaatcagctagaaacaaaatataataagcactgatctgaggtttaaagcatacatcggctgcaggtccgatgtcatgaaatccacaagattagattaaacagtgaaacatttgttgtcatcggctaaatccaacttatatgtatgtgcaatccttatgagccaatgcaatgtctagataactcaaaagctgaaaccccgatgaaacccttattggcaatcaagaagcaggctagagattatggttctaagcacaacttagtagatcaaacttaactaatgcagcactaagtataaaaagaaacataatatctagacaatcaagccgttgtctgagttttcagggtggtagatgtctaagctaatctaatctagcaacgcgatttagccgataccggcagaaaccctaaaacgagaagcagccgatagagctaaatcgatatgctaagactagattaacagagacatatgataaataggtaggcaaatatatcatccaaaccagagcaatccaagaggtcgattgtactgatgcagccttgaacgacgccaatgtaaatgggaaaattgctggccgatggaacattggacttaccccttcgccggagatcgaaaatcgatgcagccccgcgtcaggtgccaagtcccgccggacgataaaataaagtagaaaaggtaaaaggtggcgatgcgtcgaattgtattgatcgtgaggatagattacatagaccccgggtgtacatatttatacccatgggttgatacaagtccttgttggacaagaaagaaactaacctaaagataaaaggaaaaatataaagtccttatcggacactaaacacactttcctaaaaataaaaggaaactaacaaactattcctaattaatagataaaatgccatgccgcatcctctttaaactcggtcacttagggataagcttcctttaatagattgatttccttaactgaatatagcaggaatccgactattggcgacttgataactcccatcggctgattccgagatactgcagccgataatgattctaagccgacgacgtctttgccgattaccaaatttcactgttaacaatgccgaagtgggaggagatggaggcaagcttgcttgagaggggtatcgaaccggccaccgctaaatggccggatcaatcggagttctggtactatgctcatggtggaacgctcaacccagttgatggctcccaggtcttcagcgatcagatatgcgaggctgcgcgtcgactaacggacgcagtggaagcctcttctcagggcacgttccgacccgacagagagaaggacgagctgtcactcgcgctgcagactcccgagcatccaggacgaacacgagggaaatgggtgattccttggaagattggattcaaggaggacatccacacgtacaggagtcggatgaggagcaagagagataccgaggcgaagattacagatcttgagtacagggtatcgagctacgagctcagcatgcaagaggaggtggcaaggaaggttgatgaacgcatggccgcacatcggtcccatgatccccagccgtacattcctccgcaatggtgagcccttcaggcaatggtagcagctgctcctcaacggggcaggtaggatcacagagcatggacgccatgcaaacctaggacgaaaccacctgccccgttgatgacatcgctcagcggacaccatgtgagctgcatattccattaagaacttatcaataaaggtaagctcgtagtttatagattttagacttgtccattcctcaagttgctgcttatatatgttgattactaataaataacctctcaccacgtgaaggtggcgtcgggcatggccatccgaacggacccttcagggacttaccactacaggccgattccagcaggatactccaaggtcaaagttgagttggtggaaggcgcgtacgaggacgtcgagttggactaccctggaggagacggtgagacgcatctacgagacacaagccacaccattatactatggcgcaagcggtacatcatcctccctaggcgacaagcggcgtctcgtgcaccatctcctccggttccgccatctcctcctcaggctcttgcaccgtctcctcctcgtgctccagcaccgtctccacctcaggctcctgcaccgactcctcctcaggctcctacaccgactcctccgcaagctcttcgtccggcaccttccaagtcaagggccccccaagctccaccgcctgcccccacaagggcaccgaagaaggcgaaagttgacgctgcaaaaaacaaggacccggggtatgattgcacgcaagaggagcttgacgcttatgtggcatcagaagtcaggagacaattgaagcctcgaagtccagaaaagaagattcttatagacccgagtgttagtaacttcttcaggggtatgtctgcacctcccaaggaggccataaagctatcggactatgagcgaacacttaagaaagcatcttctggaaagtccaaaccagtccctcagcttggagagcaaccaaaccaggagatcgagccgttggtgaccggtgaagattttggaatacaagaatttattaatgacaccgggctaactacggatcaattgctacgaggtgcaccaatcgaaaaggcggaagtgaaatacatgtacgaactcggtaaaccgcttgttaagcctgagcagctgcagtccctacccacacaaatgtacaaattccatcaactgtacatggagatgagcgccaccggtagagagatgatcggagcgtggatcagggacacggacttcttgtaaggagatgatattctctggatcaatttcaagggtatctacgaactataccagctggacgccctcgacgtctctattatgagttgctggattttgtaagtatcgttcagttagatttcttattacgtttcctttaattaattaggtccttgtatataagtagactatatataatatatacttccttttatcgttgtagaatggagattcaaagggcccgacggtggggggttttcgatactggattcatcgaccctcggaaagtaaacgtcgcaatgctcgaccaatatccgcaagccacagaggacaatctcgtccatctcctgaaggcgcagcattacaagacgttcatactattgccgtacaacacagagttagtttttactatcttcctatgacggagcgcggggctcctcaccgggagaccgcacgggcccccctttgccggttcggccgggggctcagggtgagatcccaagctctctgtgtatgtggaaagatcgcgacctatcgaaagagcatgaagcacaagcgacgtatacaggttcgggccgctgagaagcgtaacaccctactcctgtgttttggtggatctgtgtatcaaggagctacaaagtgtgagccaacctctcccttttcttctagctactgaatttggaaaaagtcatcctctttctctatgggcaaggtcctccttttatacttcaaggggataccacatgcacccctctctttccaaactggacttttcttctcttcataaatggacggagatttgcatcgttgctgtccgagtcgccttctgatgggacggcccacaactacctccacttccgccgggagcagacgcgtcgtggaattgtggccgcctgccgacgacatgaccggagtcagaccagtcacgtcggtcattcttgttcaccacgtgtcagcttagcaatctgcacgttggccctccttcacacaacattttgcctgtaatggttaggatgaagcctggcatatatctgatcaggactaacgtgccatctctgggaggtaacacgctagctccagctggggacgagcgcctagaagccctcgtcctgacgggacggggcgaggcgtgcgtcagaccgcctg

SEQ ID NO: 57121 - DNA, 2491 bp, Oryza sativa
atcttcttcgtcaggggccacatctccagggcgctctccatccgagaggccacgcggggcgcactcggcttctgtgccgacgacctcggggtcagagggcgacatgcgcggccttcccgcagtggcctcggggccatcctgggggtcgggggcgccaggcaccgtcggacaagcaggcggagggccagctccggccgtcgggggccttgggccgtcgttcggctcgggggcctctcctccctgctctctctctcttcgggcagaatcccgacggtcgcaaatcgcgcgcatcagcaagggaaaaccgaccgacaataatgagcggcccctcggctcgcgtttgccttcaactccgaggaggagtgcggtgacgacggtgcgtacgacagcgacggcgaggccggctacccgggcgcgtcggagtgagcccccaagcctccgccaatcttaatagcttttccttcttcttccgaggccttcaggcccccttcttgttataggctgatttaatctgcaatcaaataaagaggaaatttttgtgtcaatttcatttgttctgtgtatgagacgaggatggtctgtgccacagtccttctgtgtcttggcttgaacaagggctcgtgcccaggtcccagcctcaaacggcgcgggtcaaggctagtgcctggggagatccacatgtcgagactggccaggccgggaacgtggtgaccgagggttatgggtgacccgattgtgggtttttgccgattcccccccggagttcaccacgccccagggcacggctcggttctgggccccgtttggcgaatttagccgacccgagcccccgagggcaggattgagcacgagtgacctatttcaagccaagattcttcaaaaggaaataacagcacagatacagcctttaagaaatcgaaaatgcttttattgaaatacggaagagaaaaaagataaacccccggccaaccctgcacgcccgggggggtgcggggttggcccgagcccaagacctgacacccgacccccactaggggtagaagcgatgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggaggccgcgcgccgccttcgctcttccaagtagtcgaggtcagggagcgtcggcttccttctttttgtcgctcgcaggcctcccctttcgggtggccagcgaaacgccttcgacggcgaggacatgaccctcgtcgtcggaatgggccaacctcttcttcctcctcctgtcccgccgccctgaccgagcggcggacccgggggcggccgaagctgccataccggaaccgggggggttccaagtccaggcctcctccttgcgagccactcggtccgcgagctgaaaaagctccgcggtagtctggggctctttggaggcgatcttttcgagcatgcggttgtgccgcacacccctcctgaacgcgtagatcaccgcgtgtgcagggatgcatggtatggtgttgcggacttgacagaaccgctgaatatatgagcgaagtgacttatcatcccttcgctgtattgcgtgtaagtccgcttcttcacctgggcgcggatatgtgccctgaaagttcatggtgaactgttggcacaaatcctcccaggagtggactgacgcgggtggcaagttcattagccaaccccgcgcctgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctggtccctgcgtccgtgtcgaggtgacactctggacgaggaagcaccctccgttgcgtgggcagcacgtcggtcattacgccggcgctcgatgctggcgcgggcgtccggccccctacgcagatcttcccgggtcgaaggagtcgacgaaggagtggcggccgaatggcgaacagcggctgccactcgtcgtgcccttcgtcttgacgacgcggagccggtggtagcagcaccagaggccttggtggcggaagaccgcccaccagcatctaggcgctgccgtgcagtcatgaccaatttggccacatcgtccagccagcgttgggctggagactccgggtcatgggcgacgggcgggtgacgtaggagcgcgcccgcagcttggagcgcgcctggggc

SEQ ID NO: 57122 - DNA, 1756 bp, Oryza sativa
tgtcgaaactagatttcggcaataataaaagggggtggctatcaagctggataagtgtatgggtttggagacaaaggatttatacaggttcaggccttcttataaaagaagtaataccctactcctgtccggggatgaatccgccgagtgtattattgattgtatgattcaagaaaaatcagcatatgcccctaggggcgcccggaccccccttatatatgggaaggagtccgggttacaaaagataatctatatccctaacggaatatgaaaatataggtaagatacagtcgtaaccgactaagtttcagggtgtttccttgatacacaagttaagaaacaaacccaagatacaaataagatattctatctacattaggtatcctgtacccagttcgaataccatcgccgtgtagatatgggatacccatgatctccacagtagcccccgagtcctttgcagtcgaccatcgtagccttctcaaagataataatccgagtacttcaagctcttcaagccaaaatctgccgagtggactgtaaagggcgaaaagataaagaatatggtgcatcgaatagatgcacctaattaggtgtagcccccaactatgtgattagttaacaaactaaacatatagttgaatgacaaaataataacgcaattgtgcattatatgacaaaagcatatgcggcgcctaaataggcatgctagccgactgatttatagccacaataaaagaaatccgagtggtttacactctaaaaggttcacgaatgaacacacttgacaggcatccgaataaaaactctaaagattacccatcaagtattatgaagattatggtaataaataagtcgaatagcctaggccatgactatttaccatgaaaacaggcatataacacgccaaggaaatgactatagtaaaaacaagtcattcctagttaacccaaacagcttttgtagcctaaaaaagcctgcaaaaacagcataacgcctttctgtcgggcacctttttaatttgcattgcaataattccaaagaattatatgaccgcataaaaaggatttgatcagcattgggcaacactgttgtgcgcataatatcgccaaagcaaaatatgcctaagtccctaaggaacacaatgggccacgctgttaaaattattgggctgaagtactgttcaggcctaggcccattagcacctccgatacccttaactgaaaaaatccgatatccaagcgacgcttcgtcttccccgccggaactctcgccattttccccactccctgctacagtgcaaagctgcgccggcgaactagggttcacaactccggccaaatccacctccgaaaagtgcatcaaaatccttcccgtgatccaccgcctcaatccctcacctctcccaagccatccctcaaatcaaatcaacacatttgagtgaaaccaatggcggaagagagagaaagcttcgaaggccaatgggcgtcatccgacgtaacagaagagaatcttaaggagatggtggcgcacggcgttctccctgccaaggagatcatcgggtggcgaccagcgcacggtgaggctttcccgtctccggatactcatgagattgtggtcttctcgcatttcttctacggcggttttgctcttccgacctcaaaatttttccgcgggatcttgaatttctatggaatcagcttgcatcacctaaacccgaattccatagtgcatatcgccaatttcgtccatgctt

SEQ ID NO: 57123 - DNA, 1042 bp, Oryza sativa
ccctggatttcaaaatcatgaaggagaggatgtataaatcttctcaaatgcaattgtagtcagctactctcatcagctgccagtagtgccatataatgcgttcaatccgcctccgcaggtatgcatctgaaatcctcaatctatggccaaaacataattttatcttcatgctgagttgactaactatggaagcatcttgtgcaggaatatgcattgatgaagtcagatccaccagtctctcagcgccggtctcctcgccaacacaccgctcagggaggtggaggaccaacgatcagaccagatccgcaacctcagacctccaaattggctggtcaaacaggtcctcgcaaaagaaagctgatacttgatgatgatgaaggcgatgatgataaatctggggataagggctcgcctaataaacccccaaagcgtaccatgcccaggaaaaaactggctggccgtgcaatgccaaagatcagaacatcttccaggtattatacctctcgatatgattccgcttcggcatgtcatgctcatgaaaatgatgctgaatactgaaagaacactttgcaggaaaccatctgatatagatccatctggaaaagaccccgatcctgccatgacagaacaagatatatccaaggaccccgagccgactgctgaaaaccagccgactgctgaaagccagccgactggcgcccatgcttcgggcgatagggccaacccaagtgacctgccgccgactggaaaccagtcggcaacaactgaaacggcaacaactcaagagcccccgactggaaaccagtcggacgcaggccctgatcaagagatccccgaagcagaagcgcagacgacgacttcgcaaggaccagaggctggtaacgactcgatagctgggtcttcaggtaaagaacaaagatccctcacgccagctaggtacatcttcaggttagttgtcttctcaaacaatggcgatttaaataacctcagtgtatccgtctaatgtcttggaaacacatcaggaccatcaggtgatgacgaa

SEQ ID NO: 57124 - DNA, 1390 bp, Oryza sativa
ccagtttaactacaatgtaattacactatcgttacattataagtctctatataagttagatataaagttgcatatattattttaatacttatatgtaagttatattatagttatagtatagatatagtgaaattatgttataattatgctatagttagatttgaaagtttttcctaaaaaacttgtggcaattttttagatagtacctctatatttgagcgccatcaatgcgtagcctcccgtgccagcgcctcgccgccagctagccatcaagtagaagcgcaacatctggtgcactcaactccatccacgtataattgggttagagatggagagggtcagaaagaagagtggatcccctctcccctacgctagcttgctaacgtggtcatcttgtggcggtaaggcaccgcaacaagaagaataacatttggaaagagtctgccatagacctacgccgatggcagcaccgccacctcggttagactacccacgtagtcgccgccttaggccaactgtccgcctcgcccagttgcctcatgttgtcatcgaatctccctgcaacaatgccatgggccacagaccaatagcctacaaaactgccatcccagctggcgtcaccccgtcgttgttgcgctgggcttcggcctcctatcggcctccacctaccgccaccgtggacggcttactcctatgtcgcgtcgggtttatgctgtcgccggcctcggcctcccatcaatctcctactattgtcgtccacatcacgccaaccagggggcgcaccacctcgcctccatggccacactacattgcctcacctcgccttcatgccgcaccccgctccttctggttctagcagcctcacctccatcgctgcaccacgtcacctctccttgcactaatcatttcattgtgctcatgatctagttcatctgagacttaggtggtaaggatactattgaaaataagaaaactattggtgtagattaattgagtattcattattataaacttgaaaattggatttatctgatattttaaagcaacttctatatgaaaagcttccgtacaaaatacattatttaacaacattatttaatattttgaaaagcgtgttaaccaaaaccagctatcttaacttgaaaagaacggggccttggtagagggatccggatcctatcttcttatatagttggtacccactaagaggcatttactcctataaagtaagacatgcaagaagccacatcattaacaattttaagacatcagatcatatgagtacaaagataacaacagttggatcaagaaactacttattcatccaattaaatcatttattattagttatccattcacctccttttgctccatctcatagtcacacgta

SEQ ID NO: 57125 - DNA, 6270 bp, Oryza sativa
ctcgcaaaataattgcaatctgtgcaattagttatttattagccaatatttaatacttcatgtaggtgttcaaacattcaatgtgacaaggtgtaaaatttagggtgggatctaaaagggcccttaattaagcacgcgaaggagatgtagattaaataaatcatcgccaaatgttacatcaagctgatcgtttcttcctctgattttctgtttggtgcctactcctacctgcgtgcttttcccgaatttatagcttgacaaaacatcggaaacgcttgctatcggccatccgatgaaaaccaaaatatcggacacctaaacaatcaacgaatcagatgagctctctccctatacacactcgtaggcacatgcgggcttcctacacacactcacacacacacgcacacctctctcattctctcccctacatgcacaatcatgcattctctctctaatttatgtatgaggctatacttggaaacttcaaaaattttgttctcctaaatcatttacccaatttataatctaattataccgttgtaatcgttccaattaaatctttacaacaagaccacacatgattattttcatattaaatatatatgtgtttgatgtttcatgtgtgagaaacatgtgtttcacggagaattcgacattgttgcatattttatattgttatgttgcaatttttttttaaaaaatgcaaacggtgttgtttggatgtctcaataagtttttttaatgtttcactagtttatgtgtaaatgttgcacgtggtattatttgaacgtttcagtaagtattgtgtgatgttacactagttcattcacaaatgttgcacttgatgttatttgaatgtctcagtaagtatttcgtgatgtctcaatagttataacttgatgttccatgtattatatgagaatatttagttagaaatataattatatattttttattagaaacataagaatgtgagatcttgttttaaagatttaattgtaacaaatatagaggtacaatcaaatctcataaaaagataattagtttatgaagaaaaatagtttaaagttcattaaaaggttgtgtgtgcagctgcttgcgacagtgcatgcggcaggggagtagtgcatggcccataacaacatgcatgtggtagttgtgacttgtgagtgatgttagtaagcagggatgcgggcatccgatgttttgtgtattatcggacgtccgatccgtaggcgtctccacaaaacatcccgcgaattcccgacaacaagatgaatagctataacttccagatggtgtaccatccatctactgtaccgtctagtggcaaaacccctagctagttagcttcaccttaacaaagtttgattttttttatctttggaattcaattttcaaatagttttggggatctactcccatcaccttatgtgaagctctcatttcatgatcactaagaaatgtggaaaatctaattgttatattctgatgaattacatcgaccctctcatgggtgtgtgtgtgtaaataagactacataagagatagaggcttcgagtgcaatataagtaggagtagatttatctctaggattgtatctttatctctaactaactaacatcccccctcagtcgtaacgggagcaaagcgaacgattgcaactggatttgaaatcttctatttcttcattttcttcgactcaccatcatcagttgcatctctgatggacggtcctccacctggtgcatgcgtccccttcggtgtcgtcccttgactctcctctattccctcccgcagtcatagcgggagtgtcatagacgatagcgatgacacggatgctttgactagaatttccgtcaatgatttttgttatagacattcctcgatgtagccgatcatgaagtagccgtggttgtaggtatagccgcaaatagccgaaggcgaaaaaaatatttacgccatggtgtgaagacgagactgcaattgttaacatcttgcaacttgtagatgtcagagaatgccattggagacgtcttgtgaatgtcataggatgtcgttggcaatgaggccaccactttggttggtccttctgcatcgtgtagcggtcatcacaatagcgctgccgagttgacactactacagaaacctttttgcaaacgggccagagcgattctcgcatgcgccaaatcgtctgcgaaaatgtaaatctttgcatgtggccagggcacccgcatgcgaaaatccaattttcacatgcaggcgtttaagccgaccgtatgcaaagagaaaaaatcgcaataaacaataaattccaaaaataaaaaaacgaaaaaaaacctagtgccgccccccgcccgagctcgtctcagccgccgcttccgctcccatcgtcaccgtcgccgccgctatcgcccgagaccgccgctgccaccgccgcccccagatccgccgccgagcgccgagcgccgagctccaccgtagggcggcagatccggccctctcgaggatggcgctgcccgatccaccgccacgtcgccgtgcccgccgccgagcgcagagctccaccgtagggcggcagatccggccctctcgaggacaccgccgcctgatccgctgccgcaaggcgttgccgtgcccgccgcccgccgcctagcaccgagctcctccctagggcggcggatccggccctcccgaggacggcgtcgccggatccgccgccgcaggctatcgccgtgcccgccgtccgccgtcgagcgccgaactcctccctagggcgacgaatccagccctcccgaggacagcgctgccggatccgctgccctcgccgcccgccgacgccatcgccatgcacccattcccgctgtcagcgagaagagaggagagaacaaagagagagaagaggagaggagataaagagagagagagaaataaatggggtggttgttgatggtccttaaatcataatatttgaccgtcaatacctgcatataatgaaataaaacatggtatccaacttagtggtagggattattactaatcaattccactagtgttggtgaaatatgtgtatgcaggtattttaaggataaaacacacctatcatgcgaggaaacacacttccggtcaatcagacgcaagtacacggattgaagggcccacaagtcaggtgaaaccaccatggaacgggtcataactgccataaccgtcaccatggctcaccagtcagtgaccctgccaaaggagaagccaggagatggggcccagggttcggtcgaccaggacaccacaagctcctctcatgtcacgaccggaaatcacccaacaggcgttcctgacgtgcgtgtattattccttgtcccaggaggcaaggtacaccaaaagttgatacaatacagagtttaacaagcggaagcgtatataaaattattacacgggcaacgaaggcccagcacactcaaagacaacgaaaaacagcggaagactagggcgacgaccacaggcgcttgacggcaggcacgagctagacaccaaagccttcatcttccaggaactcctcatctgggcttgggaaaattaagcaagactgagtacaaccaccgtactcaacaagacacacccacaaatgcagaataaatgcacgggagtacaagggaattataatataaagggttagggttgcagtaaacagcatttaaagacatttagttgctcaaagctattttgtaaacacgatcctagaactaaacaatgttattaatcaaggccgtgaacccgcacggacctgccttaacccaaggcctacgatgattcagaccgaactggcaacccgaccctgggtcccagctcgtcctaagccaacccaggccaaccattccatatttagttgttgagcaaattttaagaattaaaacactgacttgggtacattgctaggcttgcccatatccgagggctcggctattcgaatagattatactctgatcagaggtgtacatctttacccacaagacacatcttcctcacgtgttgccacgtgccacataccaccacggtatacggacggaagacgtgacatagtttccaacccatcctagccttagacaagagtaccgacccaatcccgcctacggccggaacccccgggacaggcaggcaggactgagcccctagcagcagggcaccaaccctctgccgtatgacatctcgactaccgggccgcagctcgtgtagccttcatttgccctggagaatgtccatcgacccccgacttcatccatctccaatccgtgtacttttgtttatgactagcctgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataaaccaacaattccatagtgtccaaatgatatgagaatatcccaaagtctagagttgtaaaaccacctaaggttacctaattaaagcgaagcatctacctaaaattatactagggataccatgagtagagtgtccactagttgaggttttgtttgctctagggtgaacaagggaataataataacaataacaataataatatggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaatcatgtttattgcgtcagccgagggagcggacgcgcggaccgggtccacgggaagtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcacccgagggcggcctcgccggcgcggccgacgggagtggcgcgcacccgcgccccgatggtcgccgccggcgaccaacggcgcggcggagtggcacccgagagagaggaggaaagggggaaggcgaacggcggtcttcggctcaccccaagacggcgaaggcggtggaaacggcggacggagcggaggaagacggcggcgcggctcgggatgacgatggcgacggcgctccggcagtcgacgggcgaagcggagcggcggacggggtcgacggcaacacggcgaagcggacggaggtgtcgccgagtcgggaggaagtccggagcggcggcggcggcggaacggagctcggcggcgacggcggagagagaggagtacggcgcgagcacgaaatcgacggcgagagcgagcggcgagcggcggaaacggaggagcggagctcgggcaacgattttatagcgtcgggaggagagagggcggccgaggaggaaggaaaccggccgcggggatttcggccgccattgattgcgccggcgacgattacgggcttgactcgaacgaatccgagggagagaaagaaggagaagagggggcaacgggagacgggattgcggggcataattcccctctctgtaaggcgcgcggggaaggcgggatccggcgcgatccgcggcggcggcggcgatagggcccgggcgcggcggcgggcgcggcgggagtagggagatgacaggtgggtcccatccgtcagcgagagcggcgggcgggcccgcctgtcagcggcgcgcgcgcgcgcggggagccgatggccggggggagatagagagagagagggagggaatgggccgagccggcccaagaaggaaggggggggagaaaaagaacttcttttagggttttctttttataaaacctttttaactttgtttatttcttttcacttatta

SEQ ID NO: 57126 - DNA, 770 bp, Oryza sativa
actatctgcgagacgacatgctgttgaaagtcacagactttgacccgtggtatgcagccatcgtcaactttatccttgtgaggcatgtaccaccgggagaaaataagaagaggttgatctacgagagccgcaggcacttgtgggatgcaccttacttgtacagagtttgttcagatggtctactacggagatgcgttccggtagatgaaggcatgaagatcattgagaagtgtcatgctgccccatatggaggtcactatggagcatttaggacatacgcaaagatctggtagagtggattcttttggccatcaatctatgatgacacaaaggaattcgttcggagatgcacaaggtgacagaagcatggagggatcactgatcgggatgcgatgccactgacacacaaccttcaagtcgagctttttgatgtatggagcatcgacttcatgggacctttcccaaagtcctatgactgcgagtatattctggtggccgttgactatgtgtccaagtgggtagaggcaatgccatgcagggccgcagacgccaagcacgcccgtcagatgttccatgagattatcttccctcgttttggaactctggggatggtgataagtgacggagggtcccatttcatcaataagacctccgaaactttttgcaaaaacttggggctcaacacaatattgccactctatatcatccccagacaagtagacaggtagaaacgagcaacagacaaatcaagaatattctgcagaagactg

SEQ ID NO: 57127 - DNA, 1968 bp, Oryza sativa
aagtcgaaggtaacgccagctaacaatctgagcttctctccttataatgcaacagatgctcatcatgaatgtgttttgcagatcgcaagatcaaatctcaagctcagtttgacgtcctggttggtaagatcaagaggcttgaaggagcaagggataacgtcgccaacgccgctgcaccaattatccaagccatgttcctcaataatggtggtccgagtgcactcgacgcaaccgaaatatttgacaagctgagtgttgctccggaagtatatttcaaaaatatcaagaaagctggaagtatgggagctggcatggccttggcgatgacaaaatccttgtacccgagaattgaagtcgacaccattgatggatttgcagacgggacaagtgaagaagctgcccttgatcttatcagtaatgctcagagtgcggctgacaagatcgcaagtgatgttgtagaacaattccgtaacagcgaccttcagccgagcgataataactctgatgatgaaagaactgattctgactgagtgtaaatgtaatacatggaggctcaatttgtcaatactggtgtatttatgctgtgcttgatgattcttgcgaagtttttgatttcttaaaagtttttgctaagctttgttgagcctaaaacccaaagaagctattaaaaactttcagtcctcgcaaactaagtagaaaaaccaaacaaggcaatgataaaccaagtaagcaaactgaattgataaaaaatcacactccttattatgatgatagcccccgactgacaacttcaaggagaaaacttgatgtttgacagtcaaaatagggaaatacaatgataaagttaagcgtagaaacgacgaagatgttcaatgttccaagaattgtcgacgagagtgccgtcttcgcgcttgagtcgatatgaacccggccgggtaacttcagagataataaatgggccttcccatagaggagataacttgtgccgatctcgtgtggtttgaattttccgtaaaaccaggtcgccgactagaaaggcacgagatcgaacattgcgattgtgataacgtcgcaacccttgtaagtaccgagctgactgaatcaaagctgcttcgcggacctcttccagtcggtgcaagtcgtccactcggtcttcttcgtagcgttcttctcggaaattacggaagcgcaaagactcaaattcgacttcactcggcaacattgcctctgccccatagacaaggaaaaaaggtgactggcctgtggcccgactgggagtagttcgcaaggaccaaagtaccgatggcagttgttgcacccatttgccggcatagggttttagccggtcaaagacacgcgctttaatcccttgaagtatcatgccattagctcgctccacctgtccattgctcatggggtgtgctactgaggcgtagcaaatcttaattccaaagtcttcacaaaagtccttgaaaactccgccggtgaattgtgtgccattatcagtgatgatccgattgggtactccgaatctgtgcacaatgttgatgaagaaatcgcgagcgttatctgctgtaatcgtgataacaggcttagcttcgatccacttggaaaatttatcaatggccacaaagagatgcgtgtaaccgccgattgcctttttaaacgggccaaccatgtcgagcccccaaaccgcaaacggccaagacagcgggatagtttgcaactcttgagctggtagatgaatttgtctggcaaaaaattggcaaccttcacatgtgcgcacaattttgtcggcgtcggacactgcagtaggccagaaaaaaccctgccggtaagctttgccaacaatggtgcgtgctgcagcatggtttccgcatatcccagaatgtatgtctttcagcaattgtctcccttcctctaaagatacgcagcgttgcagaattcctgaagggcttttcttgtata

SEQ ID NO: 57128 - DNA, 1811 bp, Oryza sativa
ttcatactcggcgacgttgtgagacgccgaaaaatgtatcaaagcacataacttagtctttctccagtcggggaaattaaaaccactccagctccagtgcccgaaagtctttttgacccgtcaaaatgcatggtccagtgctctattttctccacgggggtatcctcttggcactcggtccactcggcgacaaaatcagctaacgcttgagacttgattgaagtgcggggcttgaatgatatgtccaaagacatcaactccaaggcccacttagcaatccgcccatttgcttcgcggttgtgcagtacatcgccaagtggaaatgatgtgaccaccgttaccgagtgaccttgaaagtagtgagacagcttcctgatagtaattaaaataccatataacagcttctgaacctgagggtacctcgttttggagtcggccaggacctcgctgacgaagtagattggtcgctgaactttctggacatggccttcttcctcacgctcgaccaccaagactgtgctcacgacctgggaggtggctgatacatacagcaacaacggctcctgcggatgtggtgaggctaagaccggtggcttggtgaggagttgtttgaaatcttcgaaggccttctgtgcttcgggtccccattggaaattatctgttttcttcagtagcttgaagaagggcatcccccgctcgccaagtcttgaaacgaatcggctgagcgccgccatgcatccagtcagcttctgacatctttctgggtacttggcggtttcatgttgaggatagcagtaactttctccgggttggcttggatgcccctatgagacaccataaaaccaagcagcttccctgacggtactccgaaggtgcatttttcagggtttaacttcatcctgaaggcgcggatgctcgcgaaggtctcttctagatccaagatcagatcatccttttgcttggtcttgacgactacgtcatccacataggcttcaacgttgcggccgatctgtgttgaaaagcatctctggatcatgcgttgataggttgctcctgcgttttttaatccaaacggcatggtgacgtagcagtatgccccaaaaggcgtgatgaatgaagtcttcaagcagtcggattccttcagtcggatctgatgataccccgagtagcaatccagaaaactgagaagctcgcagccggcggttgagtcaactacctggtcaatgcgaggcaacccgaaagggtctttgggacaagacttgttgaggtcggtataatcaacacacatgcgccattgccctgttttcttccgaactagaaccgggtttgccagccagtcgggatgaaggacttctttgatgaagcctgctgctaacagcttggttaactcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtctcggcttcggtttctccactttttgaaatcttggcagtgggcacttctccttcgctcactgtggttgcagccagtcggatttcctctcgggcagacgccatctcgcgggtttgggccatgtcgcaactctccttgtcgcatgtgacggcttgcttgatgtcgctc

SEQ ID NO: 57129 - DNA, 1109 bp, Oryza sativa
atcatccagggtcttggcgaagaggatattgagtgcactgccaccatcaatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccagggggccgccgaagatatggttgagctccttgcggtggtcttgaaatccagccggggtgtcgccgtcgtccttcttccttgacgtgctttgttcctcgtcggagttcttccgagtagacttggtgtattgctccgcgaactgcttgtagatgaagcactctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttacgttgttcagaaaatcgtcggatatactctcgaagggattctccggacttctggataacgttgtaaagatcgtattgtgtgccaggacgctcgaaggtgccttggaagttggcgatgaagtggtcgcgtaattcagcccaagatccgatcgtaccacggggcaatccatggagccaagatcgggcggaatctgctaaagccaccggtagatagttcgccatggccttgttgtctcctcctgctgcgcggattgcgagaccgtagacggtaagccacgattcagggttagtggtgccgtcatacttctctattccagtcg

SEQ ID NO: 57130 - DNA, 3158 bp, Oryza sativa
  unsure (1)..(3158): unsure at all n locations
nnnnnnnnnnnnnnnnnnnnnnnnnnnnnnnnnnnnnnnnnnnnnnnnnnnnnnnnnnnnnnnnnatatttagtagaacaacagaaaactcaagatctatcccctgaacaacaagattccaaaacaattcctatggaacccattattctaagaagccatgaagatccttcttcccactctcaatttgaggtatctagacctcaatctgaaacctatcttttgccttattcttatcctattacaactatacttattccaactgccaacaacgaacagcaaaagggcaattttatcaccactcctaaagataaggtagccaaatcctttgatattcccaacaattttcctaatactaatgaccagatgtctaattccttgacaaaaatccaagcgtcatcttacgataaattgacgctccaaaaagaagtttctaccttttataacaaaatcgactcttcggtaaacagagacctcgagagttatattaccagagtcatcaatacctctttctacaacataatcgatgatcctaaaggtattaccagatcaaaatttagattgttccataatgttctcttctccaagatctatatccaacctaatccaaataaaacactttgttaccattctcgaaccaaaaactcctttgaaagaaaatctcagaatcaaatctcggctgaagccttctgcacaaataatgaaatcctagtccataagcaagatctttttggaagcatatttgttatttctgatacaaatcaatttggcacttttaatcctgaggaagaaaggaccaaaagaaaacttaagattaatgacctcttccaagaacaaaattatactaaaaaggaattaagagacctaaagggtaaatttcgaagtctagaattacaaaataatagttgcatgggccaagatgaagaggttgtcaactccatcaacagttatgttaagcagaaatggtatgcagaagtaaggtacaaattcaatgatggattccaattcagctataagactttaattgattcaggagctgatgtgaactgcattcgtgaaggtattgtcccattcaaatactttgaaaaatcctcccataaaatccatgctgcagatggaaatttactaaaagtcaattacaaaatcccttctattcatgtttgcataaatggagtctgcattaaaacttcctttttgcttataaaagatctaaagcaaggagatattttgggaacgccattcttatccttaataaaaccctttattgttactgaaaaaggtatccagtttagaatcagagataaaaatgtgaagttaaaattttcttctaaacccgagcaaaccatgttaaactatttaaaggagattatcacacaaaaagagcaatttgtgagtgacatatcttctgaaataaaaaatgctaggatttcccaaacccttaattatccaaggtttcaagaaaaaattatactattagaaaaaaggtttataaaagatatatgttctgatttcccatcagctttttggcatagggggtagcaagctcgaattcttccttatatctctaattttaatgaagataagattcccactaaagcaaggcccattcagatgaatagttgacttttagaaatttgcaagcaagaaataaaaaacctgctagataaaggattaataaggaaaagttcctctccttggagttgtgcagctttctttgtagaaaatgctgctgaaaaagaacgaggagttcctcggctagttatcaattagaaacctctcaataaagttctacaatggataaggtatccaataccttataagcatgacttaatacgaaggattcagggttcaaagatatattctaaatttgatatgaagtctgggttttggcaaatccaaataaaagaagaggatagatataaaactgcctttactactccttttggtcattatgagtggaaagtaatgccgtttggtttaaaaaaaatgctccttctgaattctcggttataaaattcaatatgatcaagttcaaccagtagcaagagtaatagaatttgcagaaaaatttccagatgagataaaagataaaacagagttgcaaagatttctagggtgtttaaactatgtctccaatttttataaagatcttgcaaaaagacagaaagattttaaccgagaggttaaagaaaaagcctccagcttggacagctaaacatactcaagctgttaagaagatcaaaagtaaggtcaaaaccttgccctatctttatatcctagatcaagttgccttcaaaattatcgaatcagatgcctcatattatggttatggaggaattcttaaacaaaaaaaggattccagagagcagttggtcaggttcacctctgggacctagaatgaggctcaaaaaaattattcaaccatcaaaaaagaaatattggccatagtaaaggtcatatcaaaattccaaggagaattattgaatcaaagattcttgctgcgtatagattgcaaggcagcaaaagatgtcctccaaaaggatgtggagaacttagtctccaaacaaatttttgccagatggcaagcaatattatcatgctttgactttgaaatagaacatatcaagggagaattaaactccctaccagatttcttatctcgtgaatttttacagggctatggcacctaaaagggacttatcagcccaagggagaactacagaaagttcaccaaataagcataaatataatgaactaggaaatatcattcctagaacccctacagttcgagaaaagtattggaataattcatcttatatcctcaatatagaggaagtaattctgccattagaatttggagactctgatctcaatattatcaagattatgggaaagtatttcccacaacactaatattttatccctgaatatccacggaaagatcaaaattattatgagactattatgcgagacaagaagtgcacagatattccatacaaggaatggtgatgaattgggattcacaaaattattgatccaaaaaattataagtatcgatgattggaataaatcatcaaattctgatgcacccagaaatatatattgtacatcctgtacaaannnnnnnnnnnnnnnnnnnnnnnnnnnnnnnnnnnnnnnnn

SEQ ID NO: 57131 - DNA, 4262 bp, Oryza sativa
  unsure (1)..(4262): unsure at all n locations
gtgggataagtttgcaatcacaccagtaattgaagaagaaagtttcgagccaaaaacaagaaatctcatgtggctcaattaaaagaagatatacaagagaattattaaaggcaagacccgagttgacaaagggagaattgcaacttcaagtatatgaaaccatgtttaaaagattggaagaatcaccaaaatctagttccacatgcagaagtctagacgaagatatggtacaatacagccaaattaagccatcttcgccaatacctccttattactcaattaagcaagataatgattcagatgaaggaacatcagatttcaatccaacgcacatttagtcaaggtatgacgacagatcttgtcaccaagataatgaataaagatcctgtcatccccgacaaagatcactattcaagataaggaatctacactattctagataagataagcctatagtcaaaaggcgatattatgacatctttattgaaggtcaaaagcgtcatcaccaaagattctctccatgaagtctaaagggatatcataaactctttgaagtcaagaagagatatcatgaagattctctaccgagtgctatataaggggctcaccatcgcattccacaagcatcgcattattcacaagaacaacaaccacaacacatctcactcaaccattcctctcgcctctccaccagccatcacactccactccactccatctaagtgtttgtactatagtataacctaaataaaagactcatgagagtctaagtgtgagagtctatgtaagagtccttgtgagagtcctgtacctgtataattacgaacgtgttgtaccaagtccttggtgtaatcttcagaaggatctaccttcaacttatcaaggtatatgaatgaacacctggaccgttctatataaacctactatgttctaagtatctaatttacattatatcttgtacataattcatatttacagcttgtctttatttcctgtactgcatttatgtttgcataataataataataataataataataataataataataataataataataataataataataataataataataataataataataataataaattcaacaacctggattaccatccaattgccacataccaatctcacatccaagattgcatatagatactgcattccttatatatatatatatatatatatatatatatatatatatatatatatatatatatatatatatatatatatatatatatatatatggaatttatttttgaagtggttttggagatgattggaatttacaggtgaatctacaggatactgctgttatttcatgtgaccggtcagaccgggctgtgtatgccggtcagaccggcgcaacccgcggactgaccggctgaccctgtgtcagtttcggtttcggattgtttgtttggatatccgtgattgtttcatgattatggcttctagatggatactatatgtatgtaatactattgtttgctactaatgagtcaagttggagatagcttggtctcggaatatggtttctttgtttatttcatgtgtaggtgtctcgatgcctcgggagagtatttgcagtgatggaccgggagtcggcttggggataagacgacgtccgtggtggtcagagatcatgcgggatacctaggctagagttgatgcacgtggttgatggagattccatatggcatacgatggagttattgtgtgcgtatgggatgcggagtcgaatttggaaggagtccaaatttggtatgattggttatgtaaagtttgtgtcttgtactagagggtttcctaaggtgtttaggactcttagtatgagtttggtttgtggctttatactgccgacctcatgtataaatagagggggagcgtgaggcttccctgtatcgcttttgagagcaattgagttgagttttgagttagggtttcgagtttagtcgagatttttgtaaggagtgctgttggtgcactttgtaaacacagagagaatcaataaagtcgtcatctactttaagaattcttcgatttgtgtttcaccgggtttcggcggtctaaccggtaactcatcggcggtcagaccggcgacaagtcggcggtcagaccggcgggagcacggcggtcagactggcggcatccactcggtcagaccggcagttcaatctcggtcagactgacttccgtcgatttcgagggtaacttttatttctgctaaaagttttttggtttttgggtataccaaccattcaccccccctctgcttggcttagttcttgtgtttcgatcttacaagtggtattagagccttgtttttttctttggatttttatcgatctagagtttttgccatggctactcctattaggttttcaactaagcctcatgttttcgatggaacggatttttctcattggtgtagtaggatgcaatcttacattatggctgaagattatgatatttggagaaaagtttctcatccttatgtgattcctgaagctattaatactactgctgaaaaaactgcttttgaacaaaattgcaaagctcgcaacattcttttgagtggtatttctcgttcggattatgatcgtgttgcgcattttcgaactgctcatgaaatttggaatgctttgagtaactttcatcaaggaacaaataacattaaagaacttcatcgtgatattttcaaaaaggagtatattaaatttgagatgaaacctggagaagctttggatgactatctttctaggtttaataaaattttgagtgatcttagatctgttgattcttcttatgatgctaattatccacaatctgagatttctcgtcactttttgaatggtcttgatatgtctatttaggagatgaaagttacatctattcaggagtctgttaacatgtctactttgactttggattcactttacacaaaattgaaaacacatgagatgaacgttctttctcgtaaaggtgattctaagtcgagtgctttggtttcttcttcttcctctttggatgttgatgcttcttcatctaagtcttcttttcttgctgtttttaatgccacatccgatgatcaactcggacagattgaggaggaggatttggctttggttgctaacagaattgctcgagctatgaataatgctaggaacaggaaaagaggtgatctaaatcgttgctttgaatgtggttcaattgatcatcttcgtttgcattgtcctaagtttgggagaggcaaaagagaagacaaagatggtgagaagaccaacaacaacaagccgaagggtacatcccaagggaggaagttcaaggagaatcttaggagggtttttgatcaagtctacgccgcatttgagccatcaagcgatgtagatggtgagagtggagatgatgataagggaaagaacatctccggtgtttacgtcatggtgcgtggtgaatcggacatagagtatgaagatcatgaggtaagtacttttgaagaagctattaatattttgagtgcaaaaaatatgaagtgtgagaagatgtatagaaaacaggaatttatcattgaatctcttaattctgaaattgctaggttaaaatctcttattcctaatgatgatgattgcaaaaattgtgtggttttagtgaatgagatttcgaaaattagagatgttaatgttgcacatgatttgaaaaacaaatcttctcttgcttgtagttttgctttgcacacacgcactttggatgagttgtttttaactaaaaagttgttgcaaaaatatcaaattgcttttcatgctagtttgatgtttaacatgatttctctaaaaagttaaaacaacctcatgatgttttggattgctcaacatgtaatttgaataagatgaaactaaaagatgctttaggtcgtgttgagtacatggaagatgttgtgaaaaacaatgaagtgctttcttgcctcaaatgtcgtaaaagcaaaggtgtcatggtagattgtgaaaattgtgctaatttggaaaaagaggtttcttatttgaaaaattctttgctaatattttctgatggtaaaaagaacctcaacatgattttggatcaatcaaaggttagcacacataatcgtggtttaggttttaattcttatgcacataatactagatatcctcctgttgtgttaggtgttgnnnnnnnnnnnnnnnnnnnnnnnnnnnnnnnnnnnnnnnnnnnnnnnnnnnnn

SEQ ID NO: 57132 - DNA, 827 bp, Oryza sativa
tcggtcagatcggcccccagtcagacgggctgcacaccctctgtcagacgggcctcgaagaaatttttctgaaaattctcgaattgattttgcacgtggatatatgcctattggatcttctggtcgtgtgtctcagtactggattcctaaatttttattatcagctaacccctgtactgaggcttcgacttctgcttgtgtgttggctttggtggcaaggaaggagaacgtgtggatcgtggattccggttgttcgcggcatatgaccggtgataaaaattggttctcctctctcaaaaaggcatccaagactgaatcgattatctttggtgatgcttctacaagtgccgttctcgttacaggtttggttaaggtaaatgaaaaatttgaattgaagaatgtagttttgtttgaggacttaaagtacaatttgctttcggtttcacaaattgttgatgaaaattttgaggttcactttaagaaaactggaagtaaagttttttattattgtgatgattctgtgttgaatatttctcgctatggaagattgtttaaagctgattttgaaaatcctgtttcacctgtgataacatgtttggttgctaagtttgataaaaatgtgatgttttggcatcgtagacttggacatgttggttttgatcatctcactaggttaagtggtttggatcttgttcgtggtttacctaaacttaagaaagatcttaatttggtttgtacaccgtgtcgtcatgctaagatggttgcttcttcatatgctcctattgtttatgtgatgacggatgcaccaggatagttattacatatgg

SEQ ID NO: 57133 - DNA, 914 bp, Oryza sativa
  unsure (1)..(914): unsure at all n locations
nnnnnnnnnnnnnnnnnnnnnnnnnnnnnnnnnnnnnnnnnnnnnnnnnnnnnnnnnnnnnnnnnnncctgaaccagtataatccttgctttctgtttgcttgatgtcgtactacgtagatcctcgttccaacggaccccaataccctctatatctggtctagggtatcccccgtcgacatatatatatatatatatgggagcgtatcctatgcacacaggccctcgcgtatatacaccgtgtacaccaactaaaaattatcacaaacaattctaggaaaattcatacatgtactttcaatagtattacatctacgtgcaaagtcgcatcttcaaattcattctacatagagaataacaaaaaagataaaattctgacaaaattgcaaccttaaaactgtcagattttttgtttttttttgttacggctaaaatataatgaatttgacgttaagattttaaccctaggtgtaatacaattgaaagtatgtgtatgattttttctagattttttggtgacattttttagttggtgtgtacgtgtgtacacgtgagggcctgtgtacataggatatgttgcctatatatatagtagctctattatatacccctcccttagaataactattctacaccccctccctaccagtccagcctagcccacacctccttccctccccacgggcctccctgcctcctccccgcgcgcgcctccctcccttctggtgaccccgcgcacgcctccctcccccttttttctctctctcggtgctactcttttttttctcccttctcttgcggctactccttccaatctccctcctcattttttttcttttttttctctccctcctcttcccggctcctactcctaatctctccatccggtttcttttttctaaaaaaaagaaaaat

SEQ ID NO: 57134 - DNA, 1355 bp, Oryza sativa
  unsure (1)..(1355): unsure at all n locations
gaatttacttttgtatgtctaagaagtaatttagtgatatccaaaagtgaaagaggatcggatgtgaaggaggaatcgagatagagattgtcccggaaacagagtgaaaatcggctgaagtccgaaccggctacgactaagatcgcagagttcgagtcgaacgggttagccattgagccgaatccgacaatatgacccagcatatgttgtcggtttaggttcacgtgcttcatgatgatttccacgcatggatagagtcctaacaagtcaattgtatctattccttaggatattttatgtaatttccttagagatatgtttgggcaaaagtgtagtgcaaagacttatggtatgttagagtttgttagaaataagattagtgtagatatggaacatattttgtaattntggccccccccccccgaaattttttatttttgttttatttgtttgatatttttttcatgcttagggacacacaagaaccaactatagaaaaattgaactcaaatggacgtaatatgtgacatgtagaatttttcctctcctctcctctctccgaactagtgcagaggagagagatgtgcaacttttttatttttattttattttgttgatattttttacacacttaggaattcacaggaaccaaccacgtaaaaaataaactcaaacggacgaaatatgtggcatgtggaattttccaaagctccaccgaaaaacttctctcctcgaaaacacaatcttgcaagcggaatttggaggttttaatatcgccgaacccggcaaagcggggagaatcggatgtaacattttctgtagatgtccgtgcatatattatttgtctgattccgagtccgtatgagaaagttacgcctattttaatagatggcatattttgtccgtttcggtagagttttggaaaattctacatgtcacatattttgtccgtttgagtttattttttatacggttggttcctatgttctcctaagtgtgaaaaaaatatcaaaaaatgaaataaaaataaaaaaattgcatctctatgtactatttaacttatatatgtcatttcatgtggttatattttgaattagattaagtaatttcatatagtggtagagtgcattatgtttaacatgctgatcaaagggttttactaaaggagttatggtctaattttagtgaaggtgcaaagtagactaagtggtatgctagatattttcagacttagctaagtggtagttcgagtttaaattttttttgtggttggttgtatcgtgatcctgagtgtgaaaaaacatccgaaagaataaaataaaaataacaccgttgcaactccatacaaagaaaca

SEQ ID NO: 57135 - DNA, 1151 bp, Oryza sativa; identical to SEQ ID NO: 16870
  unsure (1)..(1151): unsure at all n locations

SEQ ID NO: 57136 - DNA, 1181 bp, Oryza sativa
  unsure (1)..(1181): unsure at all n locations
atataagatatatgataactcgtcgaattacataaacaagattaaagtatcatgaagatggaagcactaatcccgagaacgcaagccaccataacaagttttacctcttgttgaagatcgaaacctatgcagctcaacctgaaagcaagaactcgtcgaaacaaaatgaaaataaaagagtggcgatgcgccgagattgtattgaacgtgtgttagtttgattacatggggctcggatctatttatacccgagaattacaaaatatgttcatatcggacacgactcttatctctaacaaactctaagataccataagtctttgcaacagacttttacctaaacatatctctaaggaaattacataaaatatactaactaatagatacaattgccttctcaggactctatccatgcgtggcaatcgtcatgaagcacgtcaacctaaaccgacaacatatgttgtgtcatattgtcggattcggctcaatcggctaaccccgtccgactcgaactctgctgatcttagtcgtagccgattcggacttcagccgatcttcactctgtttccgggacaatctctatctcgattcctccttcacatccgatcctccttcacttttggatatcactaaattacttcttagacatacaaaagtaaattcaataaagtctaaatgtaatttacatatattatagaagtacctttagacaaaacgaaagtaactttgtcataccattaggggtaattccattgtagggataaaaacataactctatctataaactaaattaattagcacaaactatggaattgactaaaccaataataggtagtcacctctagcattatgaatgtataggaagtaatttaattaaatctaaaattatgaatgtataggaagtaatttaattaaatctaaaagtactctaaaagtaatttaatcaacactaaaagaaacctttaagtgtggcgggctggcgggccggggagcacgccacgtcggattttgcaaagaaactctcatatttgttcgtaattccgtataggtctctcagtaacgtatttggagaggagaaatcgcggataggaacctatatgtaaaaagtgaaaataatannnnnnnnnnnnnnnnnnnnnnnnnnnnnnnnnnnnnnnnnnnnnnnnnnnnnnnnnnnnnnn

SEQ ID NO: 57137 - DNA, 1481 bp, Oryza sativa; identical to SEQ ID NO: 16875

SEQ ID NO: 57138 - DNA, 5762 bp, Oryza sativa
  unsure (1)..(5762): unsure at all n locations
nnnnnnnnnnnnnnnnnnnnnnnnnnnnnnnnnnnnnnnnnnnnnnnnnnnnntttttcttccccatacccttctcctttgtcttgctacgttttcttttcttcccaaactcattgcttatgtccttgaccatattgtggacctcatctgcggacaaatctttgggagcaggctgaagttctctcttaccattaaaaattttcttctttcttctaaatgtgtgacgtagcgggagccacctccggtgacccatgtataccatctttcgtgatttcttcagccaccggcttcgtgtatgttccttgcaatcggagcatgccttctttccttttatagtttgtccggaaagattaccgagtgcaaggtagttattaatggtgcaaaacaatagaactcttagcttgaagttctcctgaccatatgcatcccaagtttccacaccttctttccaaagaatctccagatcgtcgatatcattgccgggttgccttggaccttggattaacaagcacaacataatatatttccgtttaaagcataaccatggtgggaggttatagttcgcaataagaactggccaagtgctgtgagtactactcatgtcaccgaaaggattcatgccatccgtacaaagacatatcctcatgtttctagggtcagcagcaaagtctttgtgttttcgatctatattcctccattcaatcgaatccgctgggtgtctaagcataccatcattccttctttccgtggcgtgccaacgtactaacttcgcttcgttcgggttggcaaagattctcttgaaacgatcaatgataggtagataccacacaacctttgccggaccacccctctttgacttatttccttcgtcagcacttttctttcgcttgtatcgagaagccttgcagataggacaagcatccaagtccgcatattgcttgtggtacaatatgcagtcgttgggacaagcgtgaattctacggacctgctttgcttcgtatgtcgtctcgggcaatgtgttctcaacaggaagcatagccttcaaaattcctaaaagatctgtgaaactcttgtctgtccatccactacttaccttcagcttcattaggtccaaggtaactgacaacttagtgtgttttgctttgcatccagcgtacaaaggcgtctcggaatcacttaccaacctgctgaatttcattccatctctctcattctgggctgggtcctcaacgtcacgtaacatgtcttgcagcagatcgtgatccacatcaaccatttcaccgcccaatggagaaggtataaacatttcatgctcattttcatcttcctgattatgcgcaccacttctgtctgctgctgctccacttcctgattcttgctctccatacttcacccaacatgtatagccctccatgaattctcgttgtatcagatgaccgtgtacgtcctctccgctatcaaacatattctcgttcttgcaatctgcacatggacaacacatataatcactgtttcttcttatccgatcctcctccgcggcgttcataaattttattacgccatttcggtactccgtagaatgacgtttcaaatttttggcatacatccaacttcgatcaattgctacaaaataaaaaaaacaaattagaggcacatattataagatcagtattgcaaaagtaagacgtgatgaaattgctcaattaatgatttatattactcacttgattgatccattttgatcacttttgggaatttaatttctgttttccttggaaaaaggacaaaaaatgcccccaacagcctcccaccaaaatagtgaacagtgggatacagttacactaggtggtggggggtatttatactgtgcaacaaatatctgtaacggccctaaaacaatcaaccgtgacgggcatacaagtaatctctatcgggccttaataaaaggccatcaaaaaatagtgtcatctgtgacaggcaataaacttatctcaattgggcctctagttggagcccatcacagatgaccctcatctgtgacgggcttcttttagggcccgattgagatatggaaccctcatctcaatcgggcatcaactataacccgtcacagataagtgtcatccgtgacgggctttagttttatgccgatatactatggctgtgcgaccatatctcaatcgagcgaaacttcggcccgattgagattacttccttgtgacggcccgcaaattccagtcttgttatgggccgtcacagatggaaggatctgtactagtgtcccatgcatgacggtgatggtggtgtagatgtgtgtgggcatcgacaacggtccacggcctcgttggtccgtgcgccggtgttggtgacgtcatcttcatatagactcttcccgccctgccatttagcctcgtcggtggaggtaaagatggtgctcgtagtggggactagcatggcattggctggggtgagaataagatgacggtgtcggtagtggtgctgagctcgagtatgttcatggtggccatgaagaggtcatcagcgaaagcacaaatgacatcggtggtcacaaagaagtcatcttgatattgctaggagtaacagagacaccagtggagattccaagcttgtggtcacttgcggttggggtagaatcacccatctagcctagatggcactggtcgaccattatcatggtacatgagtcagcctactgatcgctgcagcacgcacttagtattgagtggttttatgggatgttaggggcatagcctagcctgggaacgatgagatgcgttccaggagctgggtggccctcttgtatatgcgccgacaatcggggctgaactcaaatgatgttgagccgtctccgatcgtagtgacttgactcgggagtgcgccgatggcggccatgaagaagccgtcatgtgtatgggcgctgcggagtgatagaggcaccggtggggatgccgagttcgtgatcactagacggtgaggtgaggattcatgtgaggatgacactggtggcagcagcgagtcggaggacttcgccggcagcagacgaacggtggcggggcatacatatatataactgtttcgttcatcgaacggatgaggttggcgagcgtgacgccatcgtcgttggcgtgaggatgactccggtagtgacgatggacgtgaggtcatcattagccggcggatactccaagcacgttggtgataacagtcggcggatccaaacttgcacgttggcgacgaatgcgcgattggcaccggcaacggtaacaaggccgagcttgtcatcggcagagaaacgaccggcgccaggacgatgaccagggacaggttcgccattggtggcagccaggagtatagacgccgatggttgatgaccacaccgacggcagctccaagcttgagagacggtcggcaggggagaaacggtcggcgccggcaacgatgaccaggatcaggttcgccatcggtggcagccgcgaggataaacgatgatgattgatgatgacaccagcgccgactccaagcttgcgcccgttgtcggtgaaggcacggttggcgccggcgacgatgacggggtcaagctcatcatcagtgtcagccatgaagcgaacacaggaggtcgacgatgcgcgagcacatcaccggtggtgacggcaggagtgaagacgccttgaccgtgcgggccggtgtgatgaccgacggcagcgatgccatgatatctcccaacagaccaccgaacctcgtcatcaccgatgatccgccacccttgcgtgtatgctagctgaaatggagaagacaagagacaaagaaacaaatagcattacacatggcaggtagcagcatcaccgccatgtgctgccgatcacgacgttccacctcttcttctctgtatgtgtgtctgctctcggcggcgatatggcggcacaacttgtgctgcgtgtgtgtcagtctctcttctcgtatgcctctgcgtttctgtcttctcccctcctccttagcacgcctcctcgccggacgccgagatactgcggccaacgtcaccggccgccgagcacacgcgttcccgccggacgccgagatactccggccgaaatggcgtgtgcctctctctctctctctctctctctgtgccttttcgtgtgtgtgttctgtctctgtgtgttgtgtccctgtgtttctcctgtccccctgtaaaatgaaatggacaatcttttataggggtgataagtcggttcacaggctagctcatacatggattagtatctgctcaaccagccagccgcttccatctataagccaaatttccatttagcaaatatcatgattatgataattccattgtattgtgatatgattattgaagcttccattctatggtgatacggagagtagtatttccatgtgaaatctcaggtgcttgctgctattatctgtttcgtttccaatctgacgtgatatggatcaattttccttgtatacttatacgctcacgcactgctcatagaaagaaactttcatatagagctatcttgcccttttgatttccttggtttccatgcaagcatgtacgtggtttccatgcatatgatgtgagagattaacggccggcaaatcatgtgattaacttcctctaatgacagtgatacagtggcatatgcttccattcccatgaaaacattcacacctttttccttccatcagccaaccatgaaattggatcgatcaccctatatcaaaatgtcgcgagtacgtatatactagagcagccgacggcaagtgtctcacaatattcatacgtatacgccatgtacgccaggttgtgttattagtgataattaatcaccaatttcgttattatatcgccgttcccgaaattaatactttgacacacttcatttctttcatttataaaaaaaatgtacaaaatatcgtcgaacataaagacagaaaaatagcagttaaatctataaatgatagccgatcggccagttgccgatgacatatcatctatctttgagccaatgttgtatttgagtcgatcgcaaatataaataaacaagaacgaactaaatctattcgatcagctgtggttattaatgaaatataatcctaatatcgatatatacttaaatcaaatgattgggatagatcggtcgccatgccgagacaatataaatcacttagatcgaaatatatattaacaagaagattataagcattcatagcgtagtcgattagatagatctagcatgtatcggctaatacttcgatacaactctatattgagatactaagacaagcagaatataccaaacaagaagcttaatatacctaaatgcagtaatatcttaacataaagggcagatatagcatatcaattaagcacataaaatatgaagctaaatcaggtaagatcggttgaaaccccgacactaccctaatcggcaaccaaaagcaggctagagattatgattctaatcacgacttataagatcaaactcaactgatacagctataagtatgaaaagaacaataaaaatctagacaatcaagccgttggttgtttcataggatggtagataccctatataatctaagttaacattgatatttaacctaatcggctgccttccaacgatagatgttagccgatttgaaggttagataacgatattgtcagannnnnnnnnnnnnnnnnnnnnnnnnnnnnnnnnnnnnnnnnnnnnnnnnnnnnnnnnnnnnnn

SEQ ID NO: 57139 - DNA, 2708 bp, Oryza sativa
ctatacatcgctagatatttttttaaaaaaaatactttcaatagtataattagtgtttaattatattaaaactatcatgtaaccaatatataactcgtatataacttaaaaaaacacgtttgtacttagttggctagcaccttgagcatccactttcaactgttgcaagttttttttcccaccctacatgactcgaagcaacccaacatttagaaatttgaaagttctagaagaccaaaaaattttctaatgtttagtgattccgataaccatcgcaagtcatcaataatactttatgtgattgatcattgatacaaaacaaatccacccgacatggtgtcagaaatgttgtagccataaaattgcttcctcattttttttgcatatggttcgtatcgccgatcagacagatgacataatagcgttgcttaattatacaaatagcacgaatacactaactaaattatttaccctactatagtttatcaactgcagtcctatagaaactttattcattaaatccaacgacctatatcgtccaacccaacgctccaaatcatctcacgttccccctcccctctctcccactttgcctgcacgggtcgcacgccacccccaccatgcgccgtatctcgcatgcgttgcaccaaatcctagctcaagtatgccgcagcccgcaggcgctgccgcgccatgccccccgaccctcttgccggtctcctcagcgccaccgtcgcgctgaccacatccccttctgtaccgcggcaccaccgaagactgtgtcgtggcaggcgtagtgctgggggacctacacccacacccagccatcgatgagctcctggaggtggagggcatctctcttgccagtggcctgacttctccctcctcggctcctcacctacgccgacctcctttcctccgcagcctacctcggagtcacagattgtcaccaccaacaaggtcagttcctatcacccctgctccacttcttgaagagctgttccatttgatgatttttgtggcagcagagcatatatgtgagcctgacagggaagctcgaggacgtcatgtggcagccatgcaggtggccaactcgacgatggcaggcacatcaggcacaactacaagagattttatgataagtgacgtttcatttacgtcacaaacagtgaaatttacgtcatgttatgtaatctgtgacattcgtcacctatcatgcgtctctaatggcgttctatgacgaaatcttattttttgtcattaatctagtgacgattcttctgtcgtgatagagttatgacatccattttcgtcaccatcaagcctaaaaatcgtaatgagattctatgtggcctattaaggtccatatagtgagcaacttgtttatggggtagacctattgtaagtccaattagattttaataaattcagcccaattatactatatccatccatattaagtgggccatacatattcaaaagggccaataggcccaaccattgcaatgaaattgaatctaggccattgtcacgcccagaaattcccgaatagaattccaagcagaatgtgcattagaatccccgtccaggaccggccgaggtacataaacgacaaagtttacatacagatccacgtcttacaaatattataaaagtcttacataaatgcagcggaaaattaaaaggcaattggagctaagcctcgacttggactgcagcgggaacaccactccacaggcatcctcgacggcacggacggagtctactcctcggagaaacaaccatctgacgcatactcaaactctggggtttggggaaaatagagcaagactaagtacaatcaccgtactcagcaagtcataccggaataggggtatgatgcagggaattatcaaaggatagccatagaggttcttttgcataaagcgagcatttataaacagtagttgaaagaagaaaaacagttgtagtaattaatcaatattaatcattcactgttcaacgctacaccacgttgcaacaggcccaaccatccacctgaactatccaatttcattagctaactaagggtgagactaatcacggtgaatctggttgaccgcccataaccgcgggcacgactatttgaatagttttactctgattagaggtgtacaactgtacccacaagacacagccccacgacacgttttcgtgtaccgacatgccaccacgacataccgaaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccaccccgctccatcacacccacccttgcctagatgcgtcagctagaggaaagctacactacaagcccagccgttgcccacgctggcttgtggtaagcacgataaattcttccagggtttcccgcgaaccggtccttaattgccatgggtgcgactagcaaaaccatgcacccacagcccaccatgtgattcattttaattaaccaacaccgaagcggtgtcactaatccaacaataccattagaaccaacagtctaaacattaataggattttccccattatgtactagttgaactaagcatggctaagcaatccctagtccaaagtctattcatgtta

SEQ ID NO: 57140 - DNA, 824 bp, Oryza sativa; identical to SEQ ID NO: 16877

SEQ ID NO: 57141 - DNA, 1159 bp, Oryza sativa
  unsure (1)..(1159): unsure at all n locations
ggaataagtatagttgtaataggataagaataaggcaaaagataggtttcagattgaggtctagatacctcaaattgagagtgggaagaaggatcttcatggcttcttagaataatgggttccataggaattgttttggaatcttgttgttcaggggatagatcttgagttttctgttgttctactaaatattctaggaaattattctctgtggatttctcataagtgctttctggaagacaattttttcctctgatatcctgagattgttgaataagtttaaaaggagaataagtaatataagttttactggttgacccataatctgaaaagaccttaattactgacttgtcatgttcttgttttctctcttcattgcataccccttttcctttcttctgggtcttaaaaaattcttcaaaatatataatctggctattctcatactagtcaaagaagaaaatattcctcctctgttctctcatttcgttatgccaaacttctcttatcttcattctgaatgatttgtcaacctcttctagatatcttttagttttagttctatttttggggagtcttagttctctcataagcaattctttgtcaatttcaaactcgtcttattctatggcaataacaaagccaacatcaagctcgataacattgatatcgaagtctgagattgaaggttcgtcggagttgtcttcataggtagcatagacaacattttgaggttttgtcctaggcctagaatctagactgaccgaaggtctggactggagaaaggctttctgttgtatcaaaatagatcacatcgtgtcttaagatgagatttttttttcgaatgtagaaaatgctactgtatcgagacatcctaatagatcaaaatacaccttatacttcttaaaagtaggtagcagtaaatcctaccgatggccggccacgtctgtgcgactttgatgcggcgaggtggggaggtgagcaggggctgcatgcctgcaagataattaacaaggatttggatggtgatttgtgatttgtgatattggattcttggatttttggttggtgatttgtgctagagtatagatgacggcagtggnnnnnnnnnnnnnnnnnnnnnnnnnnnnnnnnnnnnnnnnnnnnnnnnnnnnnnnnn

SEQ ID NO: 57142 - DNA, 2973 bp, Oryza sativa
gtctggactggagaaaggctttctgttgtatcaaaatagatcacatcgtgtcttaagatgagatttttttttcgaatgtagaaaatgctactgtatcgagacatcctaatagatcaaaatacaccttatacttcttaaaagtaggtagcagtaaatcctaccgatggccggccacgtctgtgcgactttgatgcggcgaggtggggaggtgagcaggggctgcatgcctgcaagataattaacaaggatttggatggtgatttgtgatttgtgatattggattcttggatttttggttggtgatttgtgctagagtatagatgacggcagtggaggttgttgctactgtctgatttgatttttttgggggggttttttaagttttctgatttgggttgcatgttcgtctctaaggaaagcaggtagacatctgctcaacctttttgtttattatttttggaaagcaatattgcatattatatttcttccatcttgcaagtgcatgctgtcgtgaacttattttcaaaatattgagctacttgcaaaggagcatgaattatgatttatgattggtaatttcgggattagtaaggattcttgattcaattgagaggaacagatcaagtgagctgggattgttgatttatgattggtggttagtcatactaactaatttctggtctctctcacctgtcagctccacgagtaaaaatctcagtatatgtgctttttttccatatatctatttttttaagatctctgtcacctgatttctgattggggcatatatctatctttttttttcatatactctgcaaatttttgttttgggtttctagttcattatacgatatatcgtttgtggccctatttttacaggtaatatcaaacccagagtgtcatttatagatatgtcatgctcttatcgtcgtctagagttatattgttggcaaattaaaagaaatgaggtaatatcatgcatagaatattatgtattttaagtagataacatttgtgaaatgtcatttggaatgtgtacaaaatttaaataagagcacaaaattaaagtatcgtgcgggttataccccttctggttcagtttgctgttgggcagcaccggaagtttctggtgccgctgcttttctgtggatcttgaactattttcctcccattttttaccggcaagattcatatgtataggttctcgctctgaattttacatgcattttcagatttagtgataagtcacatgtagtagttctctttactttttggcttttggtgctcggggagataaatttcgatgttctcgttactagtagcttctgagatttaagtaaatatgtcagtatcttgtgagactaaatttccccgttcagaagttgataggctcactgttttctgaatttttcttgttcagtagtgcacacaaatgatctttctttgaatccgccatgtggtttagcttttgactgaatagtacatacttcgtgatcttttctccttggatggatcttgtgttctctcgattaacaagttcagtatttttttttctccttgtttatatggtcaatttatttggcatcaaagctctacatgttgtgcgggttatgggatatagagtattattttctcgatgtcatttgaactgggacgagaaacctgctgacaagcttgcgtctatgttgatacggagtatattatattttgcattttccctctatgaacggatgaaagttcttggttgcatgaaaaagaaaatctcttggttgatgatattcccctgaatatttttatatgctcccttgattttatatgcttgcacagatgacagatttatgttcagctaaatgtcagcatggagatataacagagatacaccatttatgaatgattttttggaccggcgaatgagcacacataatttgtgcacactttaggttgtcattttgtatatttcacttttggacatcacacggtgaatgaacaaaatatcaacgggggtaccggttgtttttaataataataactagcatggtggcccgcgcagattgcgcgggctagcatcattatattttctctcatataataacatatatgttttatcaatttattattaaaatatattcaaatgacaatataattttaaattttactaactttacgaaactactaatctgtatattcatattgtattttatatacgtgttagttattaattatttttaatatcaaattttagttatttacaaattatattcctatatggactctagactcgtctttcaatattttttattttttaattccgaactttcgttatctataaattgtatttatatataaactctatgctcttcttccaatattatttatttttaattctgaatttttattatttctaattgtatttccatgtggactctgaacatatctttcaatattctttaatttttaatttcgaatttcagttacttctaaattgactttagactcttcttcccatgtttttttaatttctaattttaattagttgtaaattgtatttttatacaggctctatactctacttttaattttattatgtttattccgaattttagttagttttaaattcctatatggactctatgctctacttctaatattttttatttattcattccgaatttcagttattctaaattatatatttctatatagactctatttttctttttttttgattaatatgagaatttctatgccgtaagagcaaacgtggaggctcttttttctattcctttaataataataataataataataataataataataataataataataataataataataataataataataataataataattataatagatatacttgcataatacatgtcacttttgaatattatcacatggtaagtgaatataaaaggccaaatctttatatgttgtaacggaatgagctctact

SEQ ID NO: 57143 - DNA, 2434 bp, Oryza sativa
tatatatatatatatatatatatatatatatatatatatatatatatatatatatatatatatatatataggacactcgtatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattattatgtatttgggggaaatttgggggccccctttttaatttttatacctagaatcaaaatctaacaaaaacaagttcaaattcagttcaaacttgctttaaactagttagtaaaagagttaatgttaatacctaagtaattgaaaaagtttcatactcatttgaattgggtatatactcaatttcaacaatggtgcccgggcccatggagcaccaaaaaatatatctatatatatatatatatatatatatatatatatatatatatatatatatatatatatatatatatatatatatataatacgtaacaaacactagatgcaacttatcatctccaaaaccgaccagcaaaaacttctgaaaactagaaaaatagaaccctggcagaaagacgattccgttttcgtaggtctcgacgacaacaagcacatgacgacggcgacggcagtggtacaaaacgtgactagaaactcaaaactctaaacggactagacactaagaccagcaactcgacgcgacgatgcaacgcaaaactcaaaaaagcaaaaactgaatgaacaatgcaatggcacaaatatggctaggcacaggatgcaatttttttgaatggtaattttcttgttataggtagataaaaactcaccaagcaacaaaagctctgataccacctgataaaccctgaggttcacttgaagcaattcaaggtggtggttagccggttctttggttaagttaataataattacgatttggaagaaacattaacgaccccactacaccggtattaaacgttgttgtgttgcgccttagtgatcgatacacctctctgtgggttgttgatcttgccggtgcagatgaaccttattcttgcaagcaaatcgaagaaacaagcaagaccaagataaaagcattctgaattgcaaataggaatcgagttcaaatgataagttggggattctgtaacgagcaaaccggcgatctaaccgatcacgggattacccggcaaagtagcaaagctaaactttaatctaaacaaaacccaagaaatcctgaaggggtacctaactatttaaggaggtgggacgatgacctaggggtccctagggttgtgctctatctggttggggcgcaccccacatgggccccacttgggccagggtcccattggcccaatataggtgacgcggcaccttgtttctacgattgccgtcgactgagatggaatctggggacaagactggatccattggaaagaggatttggagggctttccatcaagtactcatggacccaaaacggagctcgtatgcaaatttggcggccgcttgaagtcagcagtgtagcaggtagccgaattggattccagaactttgtcaacttgatcttgatgttaactacggttgtatctatagtagccatggtcacatgagtgaaatggctgagaatgggaacatgggaacgttggtgttaaatgtgcctatatatacaaatgttgcataggggttacaattgtaaatgtgcgttccaatctcttgttttttatgcctagctactgttgacggctgttgaccaatctaattggtcactgtttgcagcctgtgccgttccaaggatgctctaccaatctcagcgcatatcaacggctgtggacgtgggagcatatgctcccatggtccaaacgacattttcatatatactagagggtggggcgcgccaatggcgcgccgtctgtgcacagttaggttaaaaagaacaggtgataattagaatagtcgaaagaatgcaggcaaacacgaaaattatcgtcagaggtaagcacacacagcgctctggattacatacgcagagacattgcatgacatttctatgttcattcaccccagtgctaaccgaactaaacaagctgaaataggagacattgtatggcatttccatgttcattcaccccagtgctaaccgaactaaacaagctgaaataggaagcctaggttttctttggtagatagtatatcaagcttctagatagtatgtacatacgaagtgcacttatgctggatcatatttacagtagaatagtgaccatgctgcctgcaaaacaaacatatataaattgctataagtattcagtagcactataactgtaaaaatggacagttttaaaaaaaacca

SEQ ID NO: 57144 - DNA, 1478 bp, Oryza sativa
tgctcacaatttctatgtggctgctgtagtgccaaataaataactgagataataggcactattaacatgacaactaaattgtaatagaaattgattggggtgtgaatttaatactaatatgtactggaactgaccacaattaatagattttgagtgtcaaactatagttaaaagtaatacaaactgaaactataactatagttcgaaatacacatactatggaaaaaacgtgatataatacaaatatgtacttgtacctgatacataaacagagttaggaaacaattgcatcaatgcaaaataaaataaatcaggaaatgtaagtaggaacattactttggtatcgcagtcactgaggagcaaccaccagaatagctagatcaatatggacttgctgtcctatgatagtgagagcatgataaaaactaacacggctgagatgggctttattttgcaacagctgagctggcagactacaaagcaaattttgaaaaaaaaaaagagaaaaaaaagtgacatgtacaagtcaaaagcattgtgttgttcaatgaattttgttgcaacattacctcagtttcccatggatcgatattcttcagctcagctactgttttctgttccactcaagccagacaccgtgatgcgccaaaagattcagccatgtggtatgtcaattactgattttaaaaggcgccatttcatagagtgcattgaaaagaacagacaaaagccataatcaggatggaagtgcataccaaacatgtgtatgtgtaagcggatttcatatagaaaaatttccatcatatcttgtctaaaagcaaatgaaatatgatgcagcaaaatttatcaccactccacaacaatgtattgactaataagaaacaatccgaatagctatttcctggtaatatatagtggtagtattttacgacaaaattacagatatacaaaaggcacatttttataagtaaatcaggctaatggtacttattctttttattgtaatgggtgtgtggaatgtgttacaacacatcagaccgattataatttataaactgtgtatgatattacagttatatatcagcctagatgatatatacagttatataagtaattataagctggttatttcattaatatatagctgagccaacctacaaattaaaaccgaaagtatgacagatctttttacttaaattgaagtgccatgtgtaattaactcgacacaacctaggggtgacgggattaattaattgatacttactattaatctttgtagtgccaaaaaaaaattcccctctggcttgttagagacgacggacctggcgtagtcctccacggtgatgttcttctggtagtggtagactggtagcacacctcgcagcctcagaccatcttgttcagcggctcttagattgaccccagcatggctacgtgatatacggtgacccaccattgcccgtgagaacactggttat

SEQ ID NO: 57145 - DNA, 7055 bp, Oryza sativa
  unsure (1)..(7055): unsure at all n locations
cacaggcgatgaaatgcctgatgacgtgcaaaaaagaacaaaaccaacaaaatccccccagggagagaagcaaacctaggaaaaactggccctttggttcatcagcctggagaaaccaagaggcacatagacaagtgcattgtaataggaagaactatgattcaggaagggccaagaacaaacccgggtggtgtgcctcctagatcggccgcccgccccatcgaccttggctccagattcgccaccatcctcagatcctcttctttccaccacgccattggctacttgcatctaatgccgctgctcatgaattttccatgtgaaaagactaattatgacttataccttagtaatatcttacttaaatcaagcatagtagcatcttactaaaaccgtaagaaaaatgaaagtacaaaaaaatctcgagcgaaacaagacaatcccatgggtgtaatttttcaacttgcaagaaaatttacccaagtaacaatacgctaatatgtatgaactatcaatttctgacctaaaaaattaccagcactacaagattaaaagtgaaaattgggactggcaaagctgctagataaaaaaaatccaaagcaatgccctatagaaatattaggatatcagaaaaatgaaccaatagataatgttacaccattgggaaaaattttatcattggcaacgccgttgtgatttaaatagtagaaaaatgcaatcttggcaccatctacaaaataactcttcgtcttcataacaaaagcacatgtaaactaatgttctactattcaatccatcagtacattaaattagcatgaatacatgttgactaaaaataaatatgctgaggtttatctaaaacaccatttcatttgaagcaacacaattagaggataaaacatatggcatcccatattaaatatttccatggtttcaacaagtaacaacagcatttgcacctagataatccaaccaaatcactgaaactcattctcaagaaatgcaactaaatggaaattttgaaatagcacattattctaccatggtgtactaaaataaatttgaaaaattctaaatcattataagtaattcatgctaaaatgaattttcaaccacatgatataaatcaaacaacatgataatttaaatatggttacaggtaatgacaagcatatcatgtatataaatgctgggggcgccttggcacgcctcctatatatagtttgctcgaattgctgtttcgagcagtggtacctactatgtattacttcgtacataagaaagaaaaatgacagaaaccttaaaggtgcattatttgaatgataaatagtcagactatgcatgagtcgctgcataaaattggtcgtgcctgtgattacattctgtgttgacaacaaaacatgcaagtaacagagccctgctaaatctacatgacaagtaacaattacacaagtccaatggattgacgagataagagtattagtcaatagatagtccagacttcagagaatatatatgattgcttccaagcgcttcttaacgtagaaatgggagatgcaaactgctccaatctgaatgctattggttgccacgaaatctatccatctcattctgaggttgcaatgaccatctattgacgtgagtatggtggttgggtctcctccagcttgtacttgaatggtttaatttgaactggcttagtggccatatgtcatgttgaatactgtcttgtgaaatattggtgagaaaagcaacagtcagtttggcatgttttcaaacttcgctgctcaatggttgtcttgttaatggttaccgtctaaaattttttagaatggtcaaggactttttgatatttcctctatgaagcttcttgtgtcacttcgtaggttcctcaaatgggcgttcagtttatttgttcttttaatggatacactgaaaatagataagatatgaaaatcgatttgaaatacatatgtgcgtggatagtttgaaaaaatatgctaagctcacatgaatttttgtaactgcattgatcatcacggttacataatttatctgtgtcgccttcagaggatgcttctgtaatgtaacggaggaggattatgagtaatataactgctatatgaggtactaaaggcaataataactttataagagtagatcttgatctgcgtgattctaaatttatttgaaacgtaaatgcgcaaggatagtctggaaagtggaaacagatgataaacttgcatggattttgggaactgcattgaagacgttgatctccaagatatgaatccattcaagaagaaagaacgaacggatagggccgaaggaggaagatttaccaagatgagtcgaagagggtggctattcaaccttgacgaagtcagcatgccaattttttaggtcgagaccaacacctcagcagcgtcatgttgctcctttccagctcctcctcaccacactggctgctggcctgcatcagcatgtcctccgccgccctagagtgagggctgccaacggcagccatcatcttcttcaccaataccatcaccttctcgaatggatctgctcctccttccccgcgatcgagggagaccgggacagcaatacacacagataagatcatatatacaccttctttgagccaccaaacagcaagcatgtgatagctttcttgacatcagaatgaccataaattcaagggccaatcattgagcaaatcttggcatacgcatttgacctctgtacaaattcttagaattccatttcctacaaaccaacaagaaaattaacgatgtaaatatgttgtagcacccttcaacaagaaacttggaattttggaaagcagactacctcatcaagtgtaaaatttgagggaccatttgagttggcatctagggaggtaccgtttgtctatatggaataataagatttattagtacaaggaccatttgagttggcatggaggaacatggactcatggagtacaaggacttcaccttgcaatgaggcattaaggaccaatgatgttttctcaacaattgaatatgtatattctgttttatccatccaacatataaagctgccatattgagtttatattgcttacaagttatacccaaactccgtacaagttactaaacagaatatgtacaggaggcgcgttgttctaatctctacaataataagtgactcaaactgcacattgattgattaaaaagaattgaaagctttcagcaagcaagcagatcctatagataattgttaccttctgaaaaactggatatccagctttaaatcttatgcaaaggaagaccattattggctagaatggcccagctcttgtcacaagaatgggttgcataggaatgttaatatctcaaaatctgttcatgttggaagagatggagttagtttttgttcaaaaccaaaaattagtggaactttaaataaaggcaaaatttgctaaagaacatctaaaatttgtgtaattggctgaaggacactgcaaaatcgtgtcactgctaagggacactacaaaaatgatgtaattggctgttggacactggaagcattattttatcattttcgagcaaaaagtggagagagaaattttaaaaatacaagtttgcccctgcctcttaattgcacaatccaagcgctggttcacagccaagtacacacttattgtggatgagctgccgcttgagcaggtgtgaggtgaggtgcgtcattgccgacagtcaggggcatcattgccggtggggaagagcgctaggcccaaaattaacctctttcaacttgaagtacaaggcagcgcagagcagtagtatcccaaacgtgggggtgtctcggccagcaccgccgccatgaaagcttttccagcgttgcgaccaccatgtcgttcgccgcctccgtatttggcttcaaggtgagcacgaagccaagtcgaatgatgggtgggcgcagaagaacgccgcgtgcgattgtgagtagagctgctgatgatggagcaggagctcgggttgcaaaggggaaacaaaatgtaaagctcgataccaaattttccgcatcgccgccgctgccgcttgcattggaccattgcctcctcgcgtccggccaccccgccgtcgctgcccttcctctccctgacgcggcccccacctccaccgcttcctctccctaaccctgtccgccgacgctccaccatcaggtcggcctacaccgaccccaaaaacccatcccgtttgttgctcaatattgagctgaagcaagaagaagaacagtgccaggggcacattcgtactttccacggtttttctctctccattagcatcaaatataataaaataatagatctagtgcccagcagccaattacaccatttttatggtgtccctcagcaatgacacgattttacaatgtcctacagccaattacacaaattttggatgtcctataacaaattttgccttaaataaaatactccatcggaatataatcaaacactgaaaccattgtaaaagccaatatgtcctatgtattacatccactacgaagcaatattcgacgagtacaatggaacttagaatctcaatatatgaattacaatgtatcattataaatttcagttgctttcaacctccttgcagttttaggagtaggattaatacatagacatggttactctaaacaaattagcatgttaccgcactttaaaataaactaaagcatagttaaaaacacccatccatgacccgcatgatatattccaggttagcaagttaaatataagctcaggccctcctatataaagccgtggcattttggttatcaaatttacagaaagtagcaacgaacacagaaatgtcaccttggtctaccaaaagatgcggtatcagatgggacttttgcaggaagatctgggtgtaccttagtgcaaagcttctcagcttgcttgtaatctttttagcttcaacttgcatgcaacattgttcaagtcacgaggcggaggcggaggcggcgacgggcacgcggcggttgtggcggccgtgctccgagatggggtcggcacgaggcggaggtggcggcgccggaagaaggagagggagaaggtgagtcgggaagggaggagagagattgggtaaaaccccgggcgaaacccccccccgagagggaggcaaaggtggcggcgcgagacggcggcggcggcgcgaggcggaagagggagaggaagagggggaggcggtggctgcgcgagacggcggccgcggcgccaggcggcatanggagaaggagagggaaagggggaagccgaagccgccgctccaggaatggggaccgcgcaagggggaaggtgatgtggccgcnccagggtggccggcgctggcgctcccgaaaggaaaaaggaaaggtgccggccgcaacccgaggtttggggagttaggtagtgggcattattttgcgaaaaagcccctattattttcactttttacatataggttcctatccgcgatttctcctctccaaatacgttactgagagacctatacggaattacgaacaaatatgagagtttctttgcaaaatccgacgtggcgtgctccccggccgcccagcccgccacacttaaaggtttcttttagtgttgattaaattacttttagagtacttttagatttaattaaattacttcctatacattcataattttagatttaattaaattacttcctatacattcataatgctagaggtgactacctattattgttttagtcaattccatagtttgtgctaattaatttagtttatagatagagttatgtttttatccctacaatggaattacccctaatgttatgacaaagttactttcgttttgtctaaagttacttctataatatatgtaaattacatttagactttattgaatttacttttgtatgtctaagaagtaatttagtgatatccaaaagtgaaggaggatcggatgtgaaggaggaatcgagatagagattgtcccggaaacagagtgaagatcggctgaagtccgaatcggctacgactaagatcggcagagttcgagtcggacggggttagccgattgagccgaatccgacaatatgacacagcatatgttgtcggtttaggttgacgtgcttcatgatgatttccacgcatggatagagtcctgagaagtcaattgtatctattacttaggatattttatgtaatttccttagagatatgtttgggcaaaagtctactgcaaagacttatggtatcttagagtttgttagagataagagtcgtgtccgatatgaacatattttgtaattctcgggtataaatagaccaaagccccatgtaatcaaactaacacacgttcaatacaatctcggcgcatcgccacccttttattttcgttttgtttcgacgagttcttacttttaggttgagctgcatcggtttcgatcttcaacaagaggtaaaacttgttatggtggcttgcgttctcgagattagtgcttccatcttcatgatactctaatcttgtttatgtaattcgacgagttatcatatatcttatataatctccggcaatatcgctatctaacctacaatcggctaacatttgttactagaaggcagccgattaggttaaataccgatgttgacttagattatataggatatctaccactctatgacatatcttatgacttgattgtatattgtccttcttttcatacttatagcttcatcagttgagtttgatcttatgagtcgggattagaatcttaatctctagcctgtctttggttgctgattagggtagtattggggtttcagccgatcttatctgatttaactacatttatcctacatgcttctttgacatggtaaaattgccctttatgttaagaactcgttgcatttaagtatattaagctttttggttgatatattctactcgctttaatatcctaatataaagtagtatcggagtattagccgatacatgctagatctatctgatcggctatgctatg

SEQ ID NO: 57146 - DNA, 1363 bp, Oryza sativa
catgatcaaatcaactggcacgctcacacacccaaaggcaagttttggacctgcactggagttaagcagatcacccaggcctcgtgtttttacatcaacacgcttttggcacgcctagtgggaccgattagaagtcagaaccgcaacagcattctctcatggctgagaaaccaccagcatcgccatcttcggctggcaaagagacccctaccaagaatctaaagtctggtgcatttgaggttcacgaaggaaacattgcccccgtcactatagacaagctaacacctgagtagaagaatgagctcaatctgatgatgcagcaaacacaacaccaattcttgaattcattcatggagacccgtaaaggaacaattgttcagaggtacaagatgaaattagttgctgatgttcctaggacaaattcttccaaggatggagaagtacaacaggtctcagatggtacaactcaatcaggcgataaaggcgctgcagatggctcaggtgacaaaggtggtggttctcaaggggctcaaggtgatggttctcagggatttcatggtgagaatcttaaccaagatggcaacacgacacagctacagtttaacaacttccaatatcggattgactatgccctacaacatgctttgattaatcaatctggaatgttagtcaacactttgtcaaacatggtgaagtcgatggttgatggctcaatagctgaataccaggctacaggaccggtttatttgccaggaggtgttttcccaaactattggcccttgatcactaataatcagccagctgttcagccaattcctcccaatgcaccatcggctcaaccgacagcaccagtatcggctcctgcaccagctacgccatcatcgacaccaggtcaattaattaatcctcgattgttggtaagagagcagccatagcatagtggacaaaatgtgaatcggctaactcaagaccaagttgcagctatgtttttaccacctcagcctactgttgacctagtccagcaacagccgattcagcagacgccaccaaggcagcaggttgtgcagccgattcagcagacgccaccaaggcagcaggttgtgcagccgattcagcagcaaggtttgctaaatgcatcggccgggttcagaacacccgacaatcagccaaggcagcacgctgcaaatcaagttgtcccagagcatttagttcataatgtgcatccagatcaaacggtgatacctcaagtgattcccgaacatttggtgtgcaatatacagccaaacttccagaattatcaagggggcaatttgaattatcaatatcagcctccatcaccgcaagttcagtatcaataaggagg

SEQ ID NO: 57147 - DNA, 1254 bp, Oryza sativa; identical to SEQ ID NO: 16885
  unsure (1)..(1254): unsure at all n locations

SEQ ID NO: 57148 - DNA, 1479 bp, Oryza sativa; identical to SEQ ID NO: 16882

SEQ ID NO: 57149 - DNA, 1033 bp, Oryza sativa; identical to SEQ ID NO: 16883

SEQ ID NO: 57150 - DNA, 2687 bp, Oryza sativa
  unsure (1)..(2687): unsure at all n locations
cccttttgttttctattagatcgatctatttctattctaatggaggatcatccaggcgatctcgcagtcatccgcagacggcgtcatcggcaacctcagttgttctcagccggcgtcattgtcaaacatacgttggtacttggtaggtcagagtgggccgggatggtgttatttcatcgttctgccgtcagctcgattccaggggtcggtgatgcccattcggatgatccctgggtgttgaatgctgcatgccatgccgttcctcattcttttctgctagatcgaattcccattactgctgctaaatggcagtatatatatggcacatgattattcatcttcgtgctgccaagccgatgataccttgatcgattactcagtatgattacatactgctcgttcttctacaatatgtactgctcttttttttttggttatatactgtcttttctacctatgatatgatatagtcagatgtatatactaagtaaaagatcatatatactgctttctttggagaaaaatatacgtactaaaagtacttgaaaaatagtatatactgctccatcgagaaatgtagtatatacaactaaaaatgactatgaacatggattaatttgtagtatgtactgacaaaaagaaaagtatgaacctagatttgtagtatgtaatggcaaaaggaaagttgtatcctttcattctaagtagaaatcagtatatctcaattcataaatcagtacatactgattacttgaagaaatcggtatagcccagctcttgaagaaatcagtgcatatccactcagacaaaaatcagtatatactcattccaagataagtcagtatatactcgttttaaaaaaaatcagtatatactcattccaatatatgtcagtatatactcattcggtcgttccaacagtatattgcagctaccaatataacacaaagtagattatactgaccaaacataaaaagtagtctacgtggtatatactgagcaaccaaaaaagcagtataaactcctttagccacgatgatgcagtatacactgaccaaatataaaaagtaatatgttcagtatatactgaccaaacaaaaagtagtatgcagtatcaaacaaaaacgtagaatgcctaatatactgagcatacgaaaaagtagtatatgtctgaccaaacagaaaagcagtatatactcattcagtccggatcgatgtagttggaaagaaaatttcaaagcaactgcgtgccaacgctctctccattaaaaaaggggagtacataacacctaggtgtacagagagtgtctgtctctctctatctctctatatatatatcncngatgncaactacttcgtcatagaataataataaannncccctttgatttnacaatctcctccttgatgaacacattggcaaactcattaaaaatgttttggtgtttggaaaaataaaaacaaaaaaaggggttttgggggggggttttaaaaaaaaaaggctacactttcgtacaaacgtacacatcgtgctcaaaaatccaaaagaaaacttatccccctttgtaaaagaaagaaattcccaattgaaccaacaaacgtgctcttctcaacaactctccaaaaattcaccttgcttcttctaaaaatccaaaaaattttacattacttctcccccttttggcaatgatttcatcaagcataggaattatgttcattaatgttcaaaagcttagcatacatatagcatatcaagtcatgtgttgcaataaaaagaagatgaacccatctataatataacaagcatgtattaaagtataaccatgaaccaaagattttacaattaagcttgaatcaacaatcaaaattcatgatttcaaacgatttataatgcaacatcttaacaaatacataggttgaagaataaacactaaacacatatacctattgcatttatcactctttctcaaataacctttagcacaaaataaccaagagaatttttaactttttcttttcttgagccttttttctcatatttttctcttttattccggatacgtccctgtcgtcaagacagtttccagagattcggcacctattattttgctcacatcgaatacgtccttgtcgtcaagactgtttccaaagattcggtattcattttttttcatatttttattctctttttcacaatgagcaattaaagctatttgaggaataacaattcaataaagcatatatatagagtatttacaaatcaaaccatatgctagcatcaacattgcattttttttaattcaagtatagaatttaagtgtcatgcatcatctcccttaagagcaaaatctaaatctcatgaaaaaactagaatacatacaagctatgctagagacaaataaaccttcaaagtattgctagcatgcacaagaaaataccatatgcataaacaaagctctcttttatcaatttttctcattgtcatattatagcttgataaaaccatgaggtactaattccccctcaaaacatgccaaaaggatgaattatgcccaattcaccatgaagaaaagcaaatcgattagaatccaaaggtttagtgaaaatatcagcaagttgcaactttgtgtccaaaaactgcaattcaacatctctcttctcaacatgatccctcaaaaagtgaaaac

SEQ ID NO: 57151 - DNA, 4763 bp, Oryza sativa; identical to SEQ ID NO: 16887
  unsure (1)..(4763): unsure at all n locations

SEQ ID NO: 57152 - DNA, 1105 bp, Oryza sativa
tcacatcccaagctaacaaaggagcatggtacaagaatagcatggctataacagtaggtaaacattccatagtattattgcaaaacaatgcagtatttgaaggaaaacaatagaccatttgcaatataggatcaacatgttcaagtgacaagcatgacttgccttgctctgctgctggaggaacctcggcgactatttcaaagtacaccggagcgtcgggagagccggaatctaagcgacatacaaagcaaacaataaaaacaggctataagactattgaaatagagaacaaaaccatttttgatggactctacaaatttttcttgatttactgagacttgaatgggcttaaacggagctcggatgaattagatatgaattttagaagattcactgtgtttttactataaacagaaaaatccttaattgaattattgcgcaataaataaatcccgggagagagagaggggcggcgccgacatgcgggccccacatggcagtgactcgggggggcggttcacggtggaccgagtccacggaccggggaaggcgcggtgcaccatgtggcgctgacgtggcgccgacgcggcggccacgcggcagccacgcgggcggccgaacggacagcctcgatctaccgcggacggcggatacgggtcgcggccggcgcgcgcgggcacggctcaagccggcccggcggccatggcgcttatagcggcgacccgaggcggtgaccggcggcgaccggggaaagggtggcgcaccacgtggcgctgacgtggcgctgacgcgacagccacgcgggcggccaagcgtggagtgggttccggtggcggattccgacggaggaggggtggacgggacggcccgcacgacggcgtcgacggcgcggctcggcacggcggctagcggcagctagtggcgaccggagcggcggcggcggcggtggagaggagggcgacagcgctagggcgatagagggcaaggggaagcttggcgaaatggggaaaaagagagaggggagagtggggatgcttaaataggggagagggagctcggacgtggctgggagaggcgggaatcgccggccaacgtgggggtagtg

SEQ ID NO: 57153 - DNA, 2010 bp, Oryza sativa
agccacctcagcatcgccccgccacgtcggcggtgggacggcgccaaagaggctggcgccgtcctattgaacgacggcgccagccactctggcgcctcgaaaaggaccatttttgggataagtttttctagagatctacttgcgaaataagtttttcaaaaggaccaaaatatgaaaaatccagtatatttgtcgcatacttaattagccacggatatatatataacgaaaggatttttcacactatgatatacttatgagaaaaattaatatactgataagtgaagcgctagttttgcatgtgtgggagatgctatatatacagatgcatgtcaatacattaactaaagtagatatagaatacataatctgtagtacttaaacataagttctacggctctattgtatactttaatttagacgtggtcaaaattaaatttacctaagctatatgttatctgaaaaatcaatttttatcacgcgcatttagacaggtgtgtacccaactagaaatgggtatttttccaaaatatgcatttcagtgggtatatgcacgtactcaaatcttgatttcctggaaccatgaggtcccaattcatcttccttgcctaatttattagtttgtactctacaatatattatacctagtttaatagtatatatatatatatgtgtctatatatatatatagtgaatctattctacacccccctcccatgggccaatcccacctccccacccttcctagggcccaaatcccctctcccatatcagtcaaaggctggtcaaaaccccctcccgccggtcagacctcggtcaaacccgcccattgactccctcccccgcccaccacttcgttgttcacgtctcgcaggaattccgcagtaacataacggtcattgtgcagtaacatgacaactttcttgcagtaacaacatcgaaaaatagtcatgatggatacatttttttatgaacatcatggtgcagaccgattagaaaaattctatataacgtgggagatattgctctctaaagattgagatttactttttttaagttctcgtctctttagaacggcgtagtaacgcgatgatcaatgtgcagtaacacaactactttccgtagtaacaacgttataaaagcattattgtctcgatcatcgtgtagtaacaggattattgtctcgttgtaacattgttttaaagaattatggtgaaaacagttctaaaaaataatatgtgatgtgagagatattattgtttaaagattagaattctaaaagtttacttgtactaagcttgctactatgtatctttgtatggacaaagagaagtattttttagcacttgtgttttgcacaagattgagatttaaaaatttagctatgcacaagcagtggtactgtagtagtacctttactatcatatgttctctattactgtaatttcatcatgatgttactgcaaaacgtgcagtaacgacctataaatttcatagtaacgacttatacatttcgcagtaacgtaccatgttaagcacttctgcgataatgctagttccaaattaaagtaagaagcttcgatttctatagtaaatataactgattcgaacaaacatataaagcaaacaaacgataacctgtaatcacttagtgtcataaggtgaattggttaggggagttttccgtgaaccatgagatcatggtttcaagttttaaattctcttaatttatttttcttttttttagaaaaaagaaaccggatggagagattaggaggaggagccgggaagaggagggagagaaaaaaaagaaaaaaaatgaggagggagattgggaggagtagccggaagagaagggagaaaaaaaagagtagccccgagagagagaaaaaagggggagggaggcgtgcgcggggtcaccaggagggagggaggcgcgcgcggggaggaggcagggaggcccgtggggagggaaggaggtgtgggctaggctggactggtagggagggg

SEQ ID NO: 57154 - DNA, 5354 bp, Oryza sativa; identical to SEQ ID NO: 16891

SEQ ID NO: 57155 - DNA, 3260 bp, Oryza sativa; identical to SEQ ID NO: 16892

SEQ ID NO: 57156 - DNA, 2737 bp, Oryza sativa; identical to SEQ ID NO: 16893

SEQ ID NO: 57157 - DNA, 2796 bp, Oryza sativa
ccgcgaggcagaggggtggcttgacgaggtggcgtccgctgttcaggctgttccccattagcgccgcctgtcggcggttgttctggtggtgccctggcagcggcttcctcgaacgcgttactgaggttggccactgattcccgtagtcgtttcatccactgatcaagatcagcgttcaagacgggatcataaggggtttccctcagtattgcattgatggttctgatatgttgggcctgcgtagccaattgatcctccgcttccgtgttgccgcctgtagatgtgctggtcccatcaatagcgtacacgttgcgtgctgtacttgttgatgatgaggcctggtcttcgagcagatgtaggaagacggctcgtgggggtcgatatcgattaccccgacgaatcgatctgaaatagtcgccactcctcgctccttgtccgcatctctaggggagatttgtgactgctagaccttaggaggcgacgtcctcatggcactgagaaggaccttgtagctcgagaggtcgtgagtcttgccttgtgaatgggacaatagacatcacgagtgggggaagtacgttgaattccacgttatttgcaggcacggatttcagcttgtacgtcgggaaaaaccgagcaagcttgcaaggtgtgccttttggtcttgtggataggacaccaggtccttgtcgcctcggaagttatccttgtcggctcgtgcttctcgtcggggagacaagatttggccgtgttaggatccttctcgggctcaaatgtgggcgatgttccgttctccgcttctgcaggaggatctttcgacgtggagtcgaccggggtcgtaaccacgccattctcgctcctggtaattgctgggccattcgagatcggcatcgtggtgtagaccgggaagacgatttcgccgacttgagtccacaccagcatcgttgaagttgaggctccttggttgatgccggggtcgacgctgtcgtcgaagaggcttgaagtcatagtagtagaaccttgagcaccaagtcgccctacctggcgcgccactgtcaacggaggatacccgtagacctggggtccgttggaacgaggatctacgtagtacggcatcaagcaaacagaaagcaatgattatactggttcaggccccttgataggtaatagccctaatccagttggtatgggattatatgatggaaatcacataatacaaagggaataacagaactcgatggtaccgacgagagagtagtcgagttggttcgactagatctcccggcgacttggctcctatgcgctccggcttcgtagctgtggtggatgtgtttgcggtgagattcgatgccctaggtcctgcccagggggtcccttttataccgcgggttagttgatctccaagtagaactcggagatatcggacctctcacgatatggtaaagacccggtcttgcccgagtaggactccttacatccgtggattctgtttctatcacgtgatagatttccttaacatatactggaactatccgtatacgcgtgggtataccgtatcaatactcatcgtacgtctaaggatagagggtataccttatccgtaaccctgacaatatatatatatatatatatgtatatatatatgtatatatatatgtatatatatatatatatacatatatatatatatatatgtatatatatatatatatatatatagacacacacacccctaataaaaaatacgtaaggtttccggattttttttccgtccgtcatcctgttcaaacgttgctaaaatcatttttaatcggctcaatagtcgagtcggaccattttcaatctacttcaaaatcacgattgatatagaatatgtattaattgattgaattattgaacacaactagcagcttgccaacttggttagcggagtgaaactttgctttggccagctgggttcgattcccaccaccctaactttttacatttataggtggtttcacttacgtggcatcctagtcaggaaaaaatatatatatacgtgaggtatatatgggtggtttcactgacgtggcatatagtcaggaaaaaaaatatatacgtgaagccgatatgtcagctgcacatttcttccccttctcctcttttctcttctctcttctcttcttctttcttcttcttcagtgagggatctaagccggccgaatttataggtggtttcacttacgtggcatcctagtcaggaaaaaatatatatatacgtgaggtatatatgggtggtttcactgacgtggcatatagtcaggaaaaaaaatatatacgtgaagccgatatgtcagctgcacatttcttccccttctcctcttttctcttctctcttctcttcttctttcttcttcttcagtgagggatctaagccggcggccggtgggcggagcggctgcgggcccacggcagacgagcgcaccggggcggcgaggagaacggcggaaaaggcgggtgaggcgggcggcgaccttgctcccgttcgcgtacgtggagttcttccgaccttgctcccgtccagcggtgcgtccagggcgcgcccggcgccgtggagttcctcctgtccgtcgtcaaggagcagcacgccaccaccgtggacaagacgacgtccacaccgctggttcgttctttccaggaagagactacgtgtggcgtgcaggatttggcaaaggtgagctcgccggaggaggcggctctgagcatcctgcatgcttaagctcttcttcttcgcctgttttcgcatactccttcgcc

SEQ ID NO: 57158 - DNA, 2658 bp, Oryza sativa
gaagtcaagagagaagagagaagagagaaaagagcccagaagaggaagaccagagaagaaaaaaataggcaaaatttgctaacagtacattcaaaaaacgtgtaattagctagaagacatcgcaataacgcgtttttgctgtagggactgcaaaaaattggtaattagctgctggacacccgcggaattattttattatatctaaaaaaattagagagagaaacagctgtgtaagtacggttctactccctttgtcctataatataagggattttgagtttttgcttgcattgtttgaccactcgtcttattaaaaaaaattaaaattattatttttttgacttactttattatccaaaatactttaagtacaacttttcgttttttatatttgcacaaattttttaaataagacaagtggtcagacaatataaatacaaactcaaaatctcttatattatgagacgagggagtaccttttgattttttttctttttcttttttgtttcttccttatccttttctccctctctcattctttctctctctctctctctgttctcaaccgctgccttcaaccttgctcgccgccgcttcgcctatcgtcgtggcgctcgctcacctgccgtcaccggtgctactactccatggcttcatgtcctgcaagcgaaggaggaggagcaaccactggtgttattgtttcacgacgaccaccggcgtgaaagcggcgccgaacgagcagtctgtggcagcctacgagtgcagcgtgctcatgaccgtcgcgccctcgaggaggtcttggaccgccttggtgtagtacgcgcgcagccgccgcagcgagcggcggtacagcgccactagccaccgcacccgcagccgccggaacgcactgaacagccgcctccgcccgccggcgccgacgccacgcctcgcacggtcacatggcggcgcagcggcaacttgcggagggagggagcggtggtggcggcggcacagctgctgcacgcggagaaaggaaacgacagcggcggcggttgcttcttccggaaaatgggagctgcgacgatggttcctatgcgcggagaaagggagcggcgacgacggcgcagagggtgcacgtggtccggtgcgcggtaacgacagcgcaaagggagcggcgatggctgcgctcgagaaagcggcgatggcagcggcgactgctgctgccctcggaggaaacgacacgactctgctgctgcgctcgagagagcctcctctctcttgctctttgcttggcgatgagaatatgtgattagtgaagactaactaatttgaggcaagggtaaactggtatttaatgcttgtttctctctcatattcctccaaatataataaaataatcttgttggtgcccatcagctaattaccagttttttacaatgccctacaacaaataaacattcttgcggtatcttctaactaattacacgttttttagatgtcctgtagcaaattttgccaaaaaaaatatgcagggctgacatgtgggccccacgtatttttttaattatttttgctgactaggatgccacgtcagcgaaaccacccatatatactgcctagggagcttgagtgaacggttttgtatagtttaggggtggagatttctggttttgtggttaagggacctcagaaaatctcgctgttaagttgagggacctccggtaaacttattcctatgcctaacctttttcactgagtatgggctggcctctcatatgctgcactaccgttgcactgagtatgggccggcctctcatatgcctaaccttttgcactgagtacgggccggcctctcatatgctgcactaccgtttaaaaaaattgaacactaattattactcagaataagtctattttgcctctcacatctcaaattctatttaatcccaatttttttctctctgccactagcacggaccatgcactgaaaaatcaaacgtttaacaccgctttcttcaacagatattttatgattcagaaatcttataatgaatcaattttaatttgaaaattaaacatctttttttttcgtcatcaacaaaacacgacatattagagtccgcagtacctaattaaaaaaataagtaaagcttccggttaatcattcgtccgtcgttaagcatgggcccacacaatattttgtcgctaatccacaatccgtaagcgtgatggagatctcttacacccacaaataaaagagaaaagaaaaaacagaaagctagcaagcagcccaaccaaagcagtataaggccggcccagcagtctcaacccaacagccagcccacataacagaggagcaccagccagcacagtactgcacggtactgtagcaaccgagactgtagcatcgtggtactgtaacacgaataacttccccacagcttgagaagcactcaagcacctgcttaaatatgaggcttgcacgtcggtataaacactgaattataaagtttggactcacgtgtaccagagatcagataaaaatagatgctattttactatttaaaaataaaataaaaaacaacgtaatcaccaacaaaatgatttactttttaaaatataaaaaacaatcgcatgctttttttttcaagaaaaacacgtaatcaccaacaaaat

SEQ ID NO: 57159 - DNA, 6050 bp, Oryza sativa
  unsure (1)..(6050): unsure at all n locations
nnnnnnnnnnnnnnnnnnnnnnnnnnnnnnnnnnnnnnnnnnnnnnnnnnnnnnnnnnnnnnttccggttaatcattcgtccgtcgttaagcatgggcccacacaatattttgtcgctaatccacaatccgtaagcgtgatggagatctcttacacccacaaataaaagagaaaagaaaaaacagaaagctagcaagcagcccaaccaaagcagtataaggccggcccagcagtctcaacccaacagccagcccacataacagaggagcaccagccagcacagtactgcacggtactgtagcaaccgagactgtagcatcgtggtactgtaacacgaataacttccccacagcttgagaagcactcaagcacctgcttaaatatgaggcttgcacgtcgttataaacactgaattataaagtttggactcacgtgtaccagagatcagataaaaatagatgctattttactatttaaaaataaaataaaaaacaacgtaatcaccaacaaaatgatttactttttaaaatataaaaaacaatcgcatgctttttttttcaagaaaaacacgtaatcaccaacaaaattaattgtgtttgcatcaagattgttttccgcgtcaatttctcattcgccgtaggacacctaaccacgtcactttttttttctatttatcgtacgatttccttctgtttttttttagtgaaaacgattctgctactggagtgcagtgagcttgatctgatagctagctaaaaatatttcttctactatgggtactctttatgatataaaaaagtgtttatcaatatcaatgacaaaaaaataaccgtacattgcaactgactcatgataaaaataaatactttttatggtttcaaattttagtattcactataaaaatccccgtgcattgcaatggatgagagttattttaatcttattattgttatactgtttaattaatgtgaaattcactatttaaatttgcttagatatatatatttttagaaagtcataagctgcaattaggagtccgatcatctcaagctagcatgcgagtttttttaaagagatttcttatacgactccttctatgtttccaaaaacgaacaaacttaaaaactaactcaaatacgaaaatgtatttccaaaagtaaacgaagttaaaaaccgactcatacacggatgacgtactaaagtaccggcaaaaaaatttatttttttatattatagagattttatagtggtattaattgatttcttataataatccatgtaagtggatttagagcattcttgcaccgggaatattcgatttgactatgaggagctcaattaaccttggtggctttacactcctcccacacacccattactactttttcttttttttgcttcacccaatgcaacgcatgggcattttgcttgtgtgtgtgtgtataatgcagattcgcactcgggttcatatgtacctacaatctacactgttgatgtgttccaagattcctgctgcaaaatgtagctaaccttaacgaaatgaatgcttactatagggagaaaagataattaggattaggttggttcactatatgtataacatgtatgttgcattttttaccaaataaatttttcaataataatcatatataacatttatatatctagtgcattgtatttttctaacccttattttgtttataacatgatatttagtcaaaatgagaaaacaatatatctactatatcaccaaattgtcatcttgcaaaaatgatatttccaaaatgatatatatcctaccatcaaaaactacataaacaagataatttatataaacaaggtaaactacataaacaagttttgcataagaaatacaaaaattatataaacaaggtattttacacttgtaaaaaatatagtataacatgtatgttacattttgttagcacctaatatactagccttgtgggtacatgtgaacttgcgtgcaaaaaatccaactcttatatatatatatatgataaaagtaacttagtatataattaaagtgatttacaagcataaatatttttttcatcataatataatcatgtaagatcttgatgtacagatataattgcaacgaaacgatgtaatcgggtcgtagatcagataagtaatttaagagaaaaaattatttgaaatttagatgggtaatgaggatgcaagtggcaggtgctactacttttagtaagaagggtaacaagttgattacacactgcactatttttggtaaaaagcatggtcgctggttagcacaaccgagtgcatgcgctccctgtagtcgcatccataagaaaaataatcaaaaaaaaaaaggaaaagtactagaacgtgaggattttatcagccaggcctccgacattgttgctacccaccaaaaatggccaccatcgccccgcttctagtgtggcccttccctctcccgcgttcatctcactaccgctagttccatccccttctccacttctccgaggcgattccccttctccaatccattcattccaccctcttccgatccccaaccgccgctggtccgtatccattccactctcctccgacccctaccgctgccggagtgctaggtgcgtcaggatctaatccctctttgtgtgcttcgtttcctacggcaattttgaattgtttatacaaaattttggggcgcatgatttgacagtgagaccgtgatggatcgatcttgaggcgctgaacgtactgcttgccaaaatttctcggttttgcgtcgtggtgcgggtgtgtgaggagcgttttgcattttaattttagggtatgaatattgacttgtcagtgcataattatatgaaatcatggaatagcattttgtagaaaaaaagaaaatgtgagtcctaggcactgttggcatgattgatagaaaactgtgtacattttttatgatgcaaggtcaggatcatgtgatgagtattaaaatcaggttatggattttcttttcacattatattatctgtgcattcttatgtaatagctttcttgtttatttgacatttatagttatccggtttgatttccctatctatctattgtgataaaaaggatacatggcagggtaccttccctggcccttttcgtcatacttgtttggcttcttgtctcatatgctctttttgtcttgctatatgcgatatgatatgatcatcggaccatggctatctaacagttctagatgctgaaggatgttggttccatggcccacaaatcccaattagttttttaaggatgttagtttaatgtgcatgtgtttgtattctatgattacaataggcttatccttactaggaaaatcctgacacttgtactgttattggttattttaagagcacgataacattattcaggtattcatctgttactattgttccagtatattatgggcatcacatgtcttgactggttatatctgtggcccatatttatcattctgatgatttaacatttactcatgtattcctctatcagggcatcacacgatgagtgttgcaactgaagcatgcccttcaccaaagctacacacaagactaaggctgtgggagtttgcagaccgttacgtatttgaaccagttgacggtcttgctgatttgttcctgtcagttgatcggacaaatggatcaatgagtctagtggaagagttgccacctcgtggtccctctacaaatcctaaagttagaatagtttttggtgtgattggagtgctcaaacttgcagttcggtcgtactttcttgtgatcactggccgtgattgtgttggatcctacttggggcatgcaattttcaaattgacgggactaaaagttctgccatgcaataactcgttaaatacttcttctgctgagcaggtttggaagtgattatttgggccttatttacaatttctttccatccatattccattagtcattccataaagctcttgcagaagaaaatggaatcagaattttcggaacttctggatgcagcagagaggactataggcctgtacttctcctatgatgtcaacttaacactaacgtgggtacctcaatgaatattatgcctttttttttcttgcaaacatttgcctgaagtgtatagagggggttccatctttcttttttttttgttatcttcctcttctttcgttttaagttggttaagcatttatctctgccccttatatgttgtagttcacagaggctgcatgatctaggagatcagtttaagtcacttccactttggagacaggtttgttgcctagctccttacataattccgtggtttgcttgtgcatgaaattcctgatcttttttatcctttcttatataatctgcaagcttctatagcttgtcctcaacatcttcacatgatttataccgctttccttattatggaacctaattgtatatttggttattacttattagatcagtggattacacttgtgatgtagaaagatggaattgaagttaaaattttctaaatgcaatgtgtttcatttggccgatatttgttttttagataatggaagctttattaagactcagttaaatacaccaagatgatacattccaactgagtccacccccggcctctgcatagaatgcacacaaccaaaaaactggacctaagaacacttccccatcacaaaacatagaaactagtggctatcaatccgtagactagatcgccacccatgctcctgggtaaaaaactcctgtgccacctaatccaaacgttgcgataccaccgcaatagtatcccgaagtccctgtttgtggaggatggcccaggagcgtagccaccgggtgactaaagtagtaacctgcaaaggagaagacaccaccttgttatcaaaaattacctcgtttctgcttagccatatggaccaacaaagagatgctgcacccatcaaaagcagatttctcatgtctttaggaacacaagtaagccaacgcccaaacaagtgagtaatattttgaggaggttgtatgttcgaagccatatgaacaacagaccataccaagcgagaaacacgacattgaaaaaacaaatgttgaatggtctcttccttgtgacaaaagccatgttgaatggccgatatttgtagttgcagctaaaaatttttgatgctcaatttgtggttaatattttttcatgagaagtcacgtgtgacaaaattgtaacgatgtgattttccatttaagaaactcaatttataataccacacactcctagttagcatattccttcctgagaaaatagctatcatacaaatccaagcgaaatgaaccaaatgcatgaaagctatatcggaacatgtcacacaatagattcttacttaatttgtaaattatagtttctagttttaaatagactgtcaaatggaagattctcagttcaatgaacaggtccaagaagcaagcagaagtccatagcgtacctagaataaaatattcatgtgcttcagtttaaaaatattttctagatgtacaatatagtatgtttgcttttatttccttgtcctgatttcttaagaaggatgtggtgggagaaattagcaaaagctgatgttacattttgatttttccgtgatgacatttgcaccgtattttagaatattgctaacactgtgcccattggtaatgattctactagcatcctgcaaaatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 57160 - DNA, 1081 bp, Oryza sativa
tatcggagatgaagataaaaccgaagcagaatccaggatggagatcgttacggaaacagagcgaggatcggctaaagtctgaatcggctgcaatcaggatcagcagagttcgagtcgaacaaggattagccgattaagcctattccagcaatatgacttggttcacgttgtcggattgagttaatgtgcttcatatggattgccatgcacggattgagtcctgaggaggcaattgtatctattaattaggatattttatgtaatttccttagagataagtttaggcaaaagtctgccgcaaagacttatggtatcttagagtttgttagagataagagtcatgtccgacaaggacatattttgtatcttgggtataaatatgacccgaacccatgtaatcaaataacacacgttcaataacaatctcggcgcatcgctaccctttacttttcgtttactttcgacgagtttttgctttcgggttgagctgcattggtttcgatcttcaaccagaggtaaaacttgttatggtggcttgcgttctcaggattagtgcttccatctttatgatactctaatcttgtttatgtaattcgtcgagttatcatatgctctatataatctctgacaatatcgttatctaaccttcaaatcggctaacatctatcgttggaaggcagccgattaggttaaatatcaatgttaacttagattatatagggtatctaccatcctatgaaacaaccaacggcttgattgtctagatttttattgttcttttcatacttatagctgtatcagttgagtttgatcttataagtcgtgattagaatcataatctctagcctgcttttggttgccgattagggtagtgtcggggtttcaaccgatcttacctgatttagcttcatattttatgtgcttaattgatatgctatatctgccctttatgttaagatattactgcatttaggtatattaagcttcttgtttggtatattctgcttgtcttagtatctcaatatagagttgtatcgaagtattagccgatacatgctagatctctctaatcgactacgct

SEQ ID NO: 57161 - DNA, 836 bp, Oryza sativa
  unsure (1)..(836): unsure at all n locations
nnnnnnnnnnnnnnnnnnnnnnnnnnnnnnnnnnnnnnnnnnnnnnnnnnnnnnnnnnnnnntgggacgaaaaagactaagtcaagctactcttctctttcgaggacacagctaattaagtcaatccgaatacaaggagtgaaagagactaagacgcaaacctagggacgtcatcgccatattcgcctccgcggacgggctttgactgacctcttcccgcggcacaaacggctcgagtgcaagcgccggaacgaccaccggcatattaggctgcccgcgctgctggacatcctcaatatcgatatctctacaacgacaacaaagtactcggaatcacatgctaagaaaacgagggaaacgactgttcagataagagcagtttgcatccaacaaaggttttacagcatgaggattaagggtataggggaaaacaaatatcttactcttcaaaaagggggaggacggactcccccaagtcatcgacttcctccaccacacccttgcgcgcgtcatcggcggccccctgatccaaagccttcttaaggtctagatcagggtgtgccagcctcacgcatgcgaggacatggcacgccccggtgtagatcctattggacgtctcctccccaatcctggccgcatgcttggaggtgatctcctccatcgccgtagccagttccgcgagtgaggacgtcagcgagaactcgtcagggttcgccgggatggtagtcgtgacaccacactcgccggcgagttggtgcangccggtgtgcgatatccgcagcgagcctcggatccttgacaggttggtctcgagcttcgacatccggtgctcaagt

SEQ ID NO: 57162 - DNA, 933 bp, Oryza sativa
  unsure (1)..(933): unsure at all n locations
atatatggaaagtcacatatgaaccgaggtgcatctgcaccatgaatctagaccattgaagaatgccaagattcacgcatatgtatggacttgtgcctatattcgggtgtgtgctgaacgcattaatcaaggtgaaaagctagtacaggacggcatgcatgcacagtttttttttcgagcggccgataatacccttcgactccaagctatctgatcaactcattttttggtgtcctgttgctttgctcgagtagggtcggataggacgcgatgacccttgtctttcatgttgacctgctaggggagacagggaagtacacggcgagtgtgctgctacgtgcaggttttatcatagtaggtgaaaccccgcgcattgctgcgaaaatttagtatgataacaataaaaaaaagcgtgtaagatagctagataacatcatattagtaaattaatgtggtttatgataatttaaatttaaatagtacgtagaatggtgattcaaacgtaaaaagtaaggtgatatgactttaaggaaaaagaaaagtagggagatagtttggacggtagattaatcatctaaaggctaaaaacaattgatgtgatatgacttaattagagaaaaaagagaaagataatttaaaccatagattaattatttaagcactaactaagtgaggatgaactatataagtatatatgatatcataaaacataataaagatatacattgaaacattatgtgaattatgttggatgataatttaacatgtttgtatttgaaaagcttttaaattataaaaactataaaaatatagcatgtttgcatgatgtttaaatgtgatgattgttagtggataatgatgtggcatcttgttaatnnnnnnnnnnnnnnnnnnnnnnnnnnnnnnnnnnnnnnnnnnnnnnnnnnnnnnnnn

SEQ ID NO: 57163 - DNA, 1157 bp, Oryza sativa
gacatggattcaagccatatatatatatatatatatatatatatatatatatatatatatatatatatatatacacacacacacacatatatgtatatatgtgtgtacacatatatatatacatacatatacatacatgtacatatacatatatatatatatatatacatacatgtacatatatacatatatatatatatatatatatatacatatatacatatatacatatatacatatatacatatatatataacatattgtcagggttatggataccacatatctaatagtcgtcgtcgccactgccggtttccggtgaggaggttcgtcgctgccgtcaccgccggtggcgtggtttcgtgtgtaatttattttaatctattcttatattttggcggggtttcggttcaactgtttcgcaggttgagtactataacaatttttctttgtttgtcaagaccttaagacgggaatggatcctactaataagttgttggttcatcctcctagtgatccaataactgtacacgtatgtatatatgttgccacaggatgatcgggagaaaatggtctggtcgtgggtagaagaagcaccagttggatgcacgcgctaggagctagtaggctgttattcacattatgtgttcgatcgatcgagacaggattagttttttgaactgatgttcttagacagtgtattaactttaaaactaatttgaatacaataattctagagtatataaaaagcttgtgtcggataccttgatcgcatctatatgatcacagatttttctagaataagaaaccagctagttttaaacatttgtgttaatcacttatcactgattactgaaaaataattttaaatgtgaagcactaatattaagtcgaatagactcagtcagacaggtttcaccacactcaattcgcaaaatatccaatcatgctttcaaattttagcggaagtttccaagttccatatgcttcaattgcatcggaattaggtatatttgtctggatttttcacattttgattcttttgaaaaacttatttcgcaaatagacccttgaaaaaacttatcccagaaatggtcctttttgggcaccagagtggctggcgccgtcatccaacgggacggctccagcctctctgg

SEQ ID NO: 57164 - DNA, 3185 bp, Oryza sativa
  unsure (1)..(3185): unsure at all n locations
nnnnnnnnnnnnnnnnnnnnnnnnnnnnnnnnnnnnnnnnnnnnnnnnnnnnnnnnncacgttgcagcgactcgatcggtgtccacggcgcaggcgctcagccgatcggcaaagccgaaggtgacgaccaatccattggctcgctgaaatcatatggtaaaggcaaaaagcggcgctggagacatcacagcactgcttacagcatcgacaacagcatcgtccaccgtacatcaatagcatcgttctgggggtaggtactcccgttttgattttcttttctggaaaaataattcccaaaattcttaaatccatgcaaatcgatcggaagctacaaccaacatctcgcataaatctggtggtgaccaatttacccagccattcggtatttacaggttgggtgcgtctgccccgtcagcggcggcgagccgtcgaaccctcttctcaagcggctgacaccaccagcaagaggaggctgcaccttgagcatgtagctatccaggggcctgaagcgttcggggtttatacgcgagcggagcgccggcagatccaaccatgcacatgtttatacccaaatttgacacctatgattaaaataggaaagattgccaaaatttagaagtctaccggtttcctccgagtgggccggtctgactgccgtgtgttgggcggtcagaccgccggttgagggccagtcagaccggcggagtgtggccagtctgaccggcaggtccgagtccgactgtgtttcgtcaggtttcgaggtttccttgctcaggaaggcatgttttgggtttcctttagtttctaccccgagttggacgtggaggagggcctgtagaggacaagaccaacccctatataagggacatggccgattcattgtaaaaaaccaatctacaataaatcaatcgaatcgtttttcatattgcttttagttttctcttagtttatccatctttgtcggtttgcgtcgtaaaccgtccgccgccgctgccagagtgcgacatctctttgtaggtttgtcctgaaaaccttccgttttgcccacgagacgggtagttatctagaaatcggctccgctagccggtttagttattaaaacccatctagatttagctctttgctagatcgaggtggttggcgactctaggatcaccgcaagacttaaggtgctgcgatcgtgcttgttaacttgtcaaaaaagttgccaacatgatttttggcgactccgctggggaagagatccgttcatcgtcaactcaacttcgatttcgccatgatgaagccgccatccaagacggaggtggagccatccaatatgataccggtcacattggatgatttcgtaggagaagaccgcaaagctatggaggagtacatcaatgaactcacacgggagacgttgatgagggcaagcaccaggactcgtcaaggtgtgatcatcaagcccgggccacgtcctaagctcgcccccgatttggtaagcaatgatgaggtaacacaatctatccaacaacaagtagcatctacaatagattcatctatgattgcttttaaagataagttagatgcaacttttatattgcgtttgttttctttatctttgtccggtaatgcttttacattgtttacttctttaccggcaaattctattcatacttgggctcaattagaagaaaaatttcatgattatttctatactagagaaactgagcttaggttatgtgatttaacatcggttaagtaaaaatataatgaacctgtcattgattatattaagagatttagggatgttagaaaccgatgttatagcttgtcacgaccggaaataacccaacgggcgttccttacatgcgtgtattattccttgtcccaggaggcaaggtacaccaaaagttgatacaatacagagtttaacaagcggaagcgtaaatagttaatttattacatgggcggcgagggcccagcacacatgaagataaacgaaaaacaatggaagactagggcgacgaccacaggcgcttgacggcaggcacgagctagacaccaaagccttcatcatccaggaactcctcttctgggattgggaaaaattgagcaagactgagtacaaccaccgtactcaacaagacacacccacgagtgcaaaataaatgcaaaggagtacaagggagttataatataggggtggttagggtttgcagtgaacagcattaaaagacacttagttgctcaaagctatttcgtaattacgatcctagagctatacaatattattaatcaaggccatgaacccacacgaacctgccttaacccaaggcctacgatgatttggaccgaactggcaacctgaccctgggtcctagctcgtcccaagccaacccaggccaaccatttcacattttagttgttaagcgggttttaagaattaaaacactaacttgggtacattgctaggcatgcccataaccgagggcgcggctattcgaataggttatactctgatcagaggtgtacatctttacccacaagacacatcttcttcacgtgtaaccatgtgccacataccaccacggtatacggacggaagacgtgacatagtttccaacccatcctagccatagacaagagtaccgacccaaccccacctacggccggaacctccaggacaggtaggcaggactgagcccatagcagtaggacaccagccctgtgccatgacatctcgactaccgggccgcagctcgtgtagccttcatttgccctagagatgtccatcgacccccgacttcgtccatctccatccgtatacttttgtttataaccagactgagccacaaactaagccttacccactagacatgtggaagtacggtagtgctttgcaacagaggcacgagcttaatccttatagtacccaaggtacgacaaacaaaacccaaccacgcacctcgagcccagcctaaaaccattttgggggttttgaatagagggggaggtatgtgtccaattccaccataatccaaccattccatagtgtctaagtgatatgagaattcccaaagtctaaagttataaaaccacctaatgttgcctaattaaccagcgaagcatctacctaagttcatactagtggaaccataaatagagtacccactagttggggttttattttcctagggtga

SEQ ID NO: 57165 - DNA, 2540 bp, Oryza sativa
  unsure (1)..(2540): unsure at all n locations
gggttttattttcctagggtgaacaaggtaataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcgcttttccaaacgtcggcttcaacctccacgtagagcggatcttccgaagctacagcgtctacacgaccaaagaaaaggaaaaagtattttactctaataaactccatataacaagcaggaacaaagtacaaaaatgggttcttgacttcttgaggaaaaattagagacttgaacggtccaattccgagttcaaatggccaagttatggccatttgaagtttatatgctctttaagtgaatatttgcgaatttcttcatttaaattttaatttaaaaaggatttattgcgtcagccgaggggagagcgcgcgcggaccgggtccacgggggtggggcccacgcggcagcctcacggtccacggtggactgggtgcacccgggctcacaccggccggagccgtgggccccacgcgtcagcctcactcgagggcacgggcggctgacggccgggccccacgcggcggccactcggcgcgcccgaaggcggccacgacggcgcggtcggcggcaggcggcacccgcgcccctatggtcgccggcagcggccataggcacggcggagcagcggtcgagagaggggaagggaagggggaaaagaggcggtggtccacggctcaccctaggtcgacggcgacgacgaaaaaggcggccaaaacggaagaaggcggcggcgcggctcgggtcgacggggtcggcggcgttccggcggtcagcgagctcggcgtgggggtggacggggtcgacgccggtgcggctaacccgaagaagccgaccccggggcggaagacggtcctggcgagcggagaagcccgcccggaggtcgtcggcgacggagaagagagagggcaacgacgcgagctcgattccggcgaggagaaggcgcggcaaagggtggaaacgggcgaaggaggtgcggggagggtttaaatagggttggaagggggagaggccggccggaggggaaggaaaccggcgcgggaggtccggccgccatcaatggcgccggcgagatttgcgggggcaaatccgcccgtttgaacgcgagagagagagagggaaaatggggggaaagggagaggggatcccggggagtgatttcccccactttattgcacgcggggacggcgggatgcggtggatttggcggcggcggcggcagcgcttggcgcaggcggaggcggcgggagcggcgggaggaaggggatgacgggtgggccccacccgtcagcgagggtggcggacgggcccgcccgtgtgcggcgcgcgcgcgggaagggaggccgaatgggccgcgggggagaggagggagagggggggagagatgggccgggccggcccaagggagggaagggggactttttagggtttttctttttataaaacctttttaactttgtttatttcttaataattattatttgtgctctgaaaattccacgaaaatttatttacgcattttaggcttttaggaaatatacaaaaatcctctaagccttatttgacttttaactttgcacattttaattgttggaggctttcatacggattttaattattctaggcataatttagagaatgtattttagagtcgttttgggacgtgacacatttgcactcaatggcttttacaccatcagggggatcaaccaagctccaaactttattgacatgcatggattctatttcggagatcatggctccaagccatttctcagagtctggtcccaccattgcttcctcatagggagtaggatcgtcgttgtctaacaacaatatatcacgttgtcctgtagttaacaacgcataccttgcaggtgtacgccgtatcctttcggacctttgtgaagccggtgctttcacaactggttcaacaacaacttattcaacttgttgaacaacatcttgctcagcttgttgtggttgtgtggacgttgaatcgttttccggtgtttcctgaatttcttcaagtcgcaccatgctcccactatcctttcttgaaatgaactctttttccaagaaaacaccgtgtcgggcgacaaacactttgccctcttcccgattataaaaataatatcctttcgtttccttaggatacccccacaaagaagcatttatctgatttaggtgtgagtttatccgattgcaaacgttttacatagacctcacagccccaaatctttaggaaagacaagctgggacgcttccctgtccatatctcatatggtgtcttatccactgattttgatggaactctgtttagtgtgaacgcaactgtctctggagcgtaaccccaaaannnnnnnnnnnnnnnnnnnnnnnnnnnnnnnnnnnnnnnnnnnnnnnnnnnnnnnnnnnn

SEQ ID NO: 57166 - DNA, 753 bp, Oryza sativa
  unsure (1)..(753): unsure at all n locations
gagcaaccacgccgaagaagaagctacctgggagcgcgaagacgagctgaaggcagcccatccagatctcttcgccagttcttccgaatctcggggtcgagattccgtttaaggggggtaggcttgtcgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtccttttcccccccccttcctctcttgggccggctcggcccagctccctccctctctctcctctcccccgcggcccatcggccttcccccgcgcgcgcgtcgctgacaggcgggcccgcccgccaccctcgctgacgggtggggcccacccgtcatcccctacctcgcgccgcgcccgccgcctcgcccgtgccctagcgccgccgccgccgcggattccgccgcatcccgccgcccccgcgcgcaataaagagggggaaatcactccccgtgattccctccctctttccccccacttttccctctctctctctctcggattcgtttggaaatcctcccgcaaannnnnnnnnnnnnnnnnnnnnnnnnnnnnnnnnn

SEQ ID NO: 57167 - DNA, 1169 bp, Oryza sativa
  unsure (1)..(1169): unsure at all n locations
ttaaaatttaaatgaagaaattcgcaaatatacatttaaagagcatataaacttcaaatggccatatcttggccatttgaactcggaattggaccgttcaagtctctaatttttccttaagaagtcaagaacccatttttgtgctttgtttctgcttgttatatggagtttagtagattaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatacctatttacctttgttatgaccttattattgttattggtattatttctttgttcaccctagattaaacaaaacccgaactagtggacactctactcatggtaccactagtatgattataggtagatgcttcgcttttaattaggtaacattaggcggttttacaactctagactttgggaatgttcatatcacctggacactgtggaattgttggagtattgtagaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtannnnnnnnnnnnnnnnnnnnnnnnnnnnnnnnnnnnnnnnnnnnnnnnnnnnnnnn

SEQ ID NO: 57168 - DNA, 1464 bp, Oryza sativa
  unsure (1)..(1464): unsure at all n locations
nnnnnnnnnnnnnnnnnnnnnnnnnnnnnnnnnnnnnnnntactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttcgaaataaaaatcctttgtatttgtgaaaatcctctagtctctctctgtcttgctgcttcatttatcgccaaaatctgacctttaaaatgttgcttttctttttgtttttgtttgtagatggccggcagcgtcacccgtcgtggtttggacatgactggtttcgtcttggagctgcggggcatgtgcgtggccgtggggtatccacacggagtggactaccaggccaggccgcttctggagcaggagggtgacgatgcagagccccacgctgcttgggaggtcactgcagtgatcctcgctggctctcccgagcggacttcgctgacagtcaccgcgggtggagactccttccccgccgcttgccagagcgccgctctcctcgccatcggcactcttcaccagcgctacccggacgagttgcagcactcgccctaccgctaccaccctcgtcgcggaggagcccgcgaccacgccaccttccgggatgctagctcggaggatgacgctaccatcgtgcacttggcgcgcatggtggaggcgtacgacgcggctcgtatcgacttccatcagatggtgcgccgtgggatggtcgagaacaacctgaagatcctggagctgcgtcaagagaacctgcagctcaagaaggacctggacgcagtggaggcgcagctgcatcagctcaagatcgcccagggagagatctgccgccccaagcgtcgccgcgtctgccgcagcctgaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacagaggatgcgctgttgcttaccttccgtcctggcccgtcgcagcagtagacgagcagttagtaggcttgcgcgtgtgttctttctcgtttgtcttcttgttgggttgtgtggggcacggttatgccggtgtgtggtgtaactgtgtcggagcctgtctttattttattcgcctaagcaacttgaa

SEQ ID NO: 57169 - DNA, 1938 bp, Oryza sativa; identical to SEQ ID NO: 16897

SEQ ID NO: 57170 - DNA, 1125 bp, Oryza sativa
agcagacgccaccaagcaagcaggttgtgcagccgatccagcagacgccacaaaggcagcaggttgtgcagccgattcagcagcaaggtttgctaaatgcatcggccgggttcagaacacccgacaatcagccaaggcagcacgctgcaaatcaagttgtcccagagcatttagttcataatgtgcatccagatcaaacggtgatacctcaagtgattcccgaacatttggtgtgcaatatacagccaaacttccagaattatcaagggggcaatttgaattatcaatatcagcctccatcaccgcaagttcagtatcaataaggaggatcggctcagcctcagtttgctcctcaatacaatcaattcgagcccgtgccacaacaagcacagggagtgtctcagcaaaggcaatgggccgatatgattgcagatgtgataagagaacagtttgggctcaagccgaagaatgctggaaacttgtatcggcatccataccctgagtggtttgagagggttccattgcctaaccgattcaatgttccagatttttcaaagttctcaggacaggacagcgtttcaacctgtgaacacgttagccgattcttagctcaatgtggggaagcatcggctgtggatgccctgagggtcaggttgtttccattgtctttgtctggatcggctttcacttggttttcttctttgccatgtggatcaatcaacagttgggccgatttggagaagcattttcatagctatttctatagtggggttcatgatatgaaactgtcggatttaacggcgattaagcaaagacatgatgaacctgtgcaagattacatccaaaggtttagggagatgaggaataaatgctacagcttgagtttaactgatgcctagttagccgatttggcttttaagggtatgatagctccgatcagggagaagttctcgtctcaagactttgatagtttgtcacatcttgcacagaaggtaactctacatgagcaaaggtttgcagaagccaggaaaagctttaaaaaggtcaatcatgtctttccctacatctatggatctgatgatgatgatgatgatgatgatgatgattctgaaatagctacagccg

SEQ ID NO: 57171 - DNA, 802 bp, Oryza sativa
ctattctctcaaatgtttattgaatgatgtttatgcaaataagctatagtatgccatcctttgttatcctgtgcacttgcatatttgctgtgtggcttgttgagtatgtcatatggtcattcttgcaatattcattcatcagaggaggagtacttcagtgaaggtgatgattaggaggattaggctttgttcatgatcaggaggattaggctttgttcgggtcaagttgcttgtggagtggagtcgccatagctgtttagtcttttgtttatttttccgctgtgtagaattttattcttttgagaggaactatccacctctataatattttattattttgcgaatattaattagttgtttgataggactcaattatcaatttgttattgtgtgcctcggctgattcctggacgaggatttaacacacatgtaagcctttggaattttggatagaaattctgggcgtgacaaccttccccacttcgccggcgcaatagggccccttcctggccacgactcgcctcccccgctcctatttaagcacccccgcatctccctctcttctttccttttgtagccgcactctcccgagccatctatcgccgccgcaccgtttctccctagcgccgccgccaaccgccgcctccagccgccgctaatcgccgctagggctgccgccgtaccgcgccactaccgccgtcgggttcgcacggccgaggtccacctcgtccacctcccctccgtcgagttccgccgccggagcacgcttctccccacgcgccggtgagcatctccattaccc

SEQ ID NO: 57172 - DNA, 2881 bp, Oryza sativa
  unsure (1)..(2881): unsure at all n locations
attcacctaggcacgagaggggactgcccgctgcgttgcgaggagtgggggtgaaacatgaggtgtggtgcgattggttagagggggttatgcgaagggtcctgtcacagcctctttccggtatgtcatggtggcatgtcggtacacgaaaacgtgtcgtggggctatgttttgtgggtacagttgtacacctctaatcagagtaaaactattcgaatagtcgtgcccgcggttatgggcggtcgaccagattcaccgtgattagtctcacccctagttagctaatggaactggtgtagttcaggtggttggttgggcctgttgcaacgtggtgtagcgttggacagtgattggttaatattgattaatttctgcaactgttttactactttcaactactacttttaaatgctagctttatgcaaaagaacctttagcctcctttggttatatcttgcatcataccttctcttccggtgtgacttgctgagtatagtgggtagtactcagtcttgctctctcttccccacaccagagctgaagatcttcctagttggagccgtctcgttgaaggttggtttcgtcgctgccgtcaaggatgcctgtggagtggagtcgcctcgctgcaggagtcaagtcttcaggcttagctcgcttttatatttttcgctacatttgtaatcttttgtatttttctaagacgtggatctgtatgtcaacaattgtcgtttgtgtatcctggctggtcctggacaggggtttaatgcacattcagcttagaaattctggtttgtgaatttctgggcatgacagcttccaagcgaagatgtcggagttcacccgcaggaaggagatgagcgcgctttcctatttggcatccaagttgccgccaatcttggcggtcttggacggatcatcgccaagggtgatgtccttgacgggtacctcatcgcccgaggtaatgcgcttcttggaggcgtgggatgcggaggcctccggggatccaccggcctccaccggctcggtggccgccgccaagctatcggcgcgctgctccgcacacgccaaggcaatcttgacgtcgccagagatggtgatggggctgttggggcccggcatcttcatctggaggtaagcgtagtgggtggcggccttgaacttgaccagcgcgggccttcccaggaccgcgttgtagggcaaattgagatttgccatgtcgaagtcgatccgcttagtgcggaagttggtggagtcgccgaaggtgactgggagctcgatgtggcccaaaggccatgtgtgccctagtgtcatgccaatgattggcaacgacggctgaagcctcatccccgcggccttgagggcatggaaggccgcatgggagatgatgctatggctgcccccccacccccgtcgatcaagacacgagggccagcttccctccatgggcgagcaccgtccgggtggtcgctctggtcgaatgtgagcttcacttccgaccatcgcgcccgccgcgccaccttctgggttgggacagcggccagaagctcatgcctcatggccttgaaactgcgacgggaggcgtgagcgcaagccccccttgtcgagtgtggcgactgtcccctgaggtacctagaactccatatcctcgctgtcgtcatcgtcatcgacgggggccttttccttggcctactctcgctggttgccgaccgaggtcgcggaggccttgccctccaggagaccctgccgactttgcccatcggtctttctgtaccgatcggacaagttcttgaccgtgcggcaatcaacgagactgtaccgataggtgttgtgcatcgagcaccacttatctgacgaacggctttcgctgggggtagtggcggtgctcggcttatcgacggtggcctttttcttgcgcggggtcgggaagggttcgtcccaacaaagaacgtggccctcgcngtcagagtgggcacgatgcatctcttgggaaggaaaacctttaggccacggataagcttgagatatcgactctggaggatgagagaaaacattccacatatgagcatgaaagtttctctttcaaaaacccctaggattcatgctcacaaaaggaatcccagaggaccacttccctgtgtgaggaccgcaaccacctttcggtcctcatttctaacatgtatagaggtgtggttgtggacgcttatatttatcacaaatactgcaaatctcgtacttgtttgtggcactaatcttgcagagtgatgtcccaatggtcgagcttgtgaccataaacaaagcactactgggagatagcccggattaatatggtaagtttcctttctaataaaagcaagaaccagttcttaggataatatgcacctttgggtattcttggccgctaaccatttcaggttgagattaagagcgagggtcatacaatgcctaagaacatggtagctacttcaattgtacactttggtgacccttggtattggaacacactctataggagaatccgacatcacacacttggtttttgatgtcttgcgacacaaaagtccaagtgtgaggtggagatcgacgagcttttcatgacaagttccatcaaccaaagtcatcttggtttgaacttggttttagtcctagcttgctagaaaaaaaaaagaaacaaaaagataataaaaaaagaggagaaaagagagacagaagaaaagaagaaaaaatatgggaggtgaagaaaagagcaagagagctgacgagctacatttggatcaaaaaccgcattaagtgcgtgtctttgaaatatggctgtacacctgggtagtagcaatcatgctgcctggctatatctagtccctctctcgagctcatgtgccgtctt

SEQ ID NO: 57173 - DNA, 987 bp, Oryza sativa
  unsure (1)..(987): unsure at all n locations
aannnnnnnnnnnnnnnnnnnnnnnnnnnnnnnnnnnnnnnnnnnnnnnnnnnnnnnnnntctatttgcatatgctctgttttgggtgctcgcacaagacatctataggctttttaaattaagcatggtgcttaggttaaaatagtctggtttaatcaaattggacatggagtttagtttgactaatgaatttcggagttaatatgttcatagacattggatgcatatcttttgtgaactaacccactgcaggaaaatattcaaattgacgggtgagtccacaagtttaatttacaatgaaggtaggtcagggcgggaacaaatcaattgctgacatgaaaaggagacacatatcacctatcaaggtgcatggtgcgtatattactaatcgctccattagcatgttcatgcaaatttacctcaaccttgtatgagttgtgcttaaatgaaaatttggtgaaaaaaaagtgatttcagaataaaggatgtctctctcgaaaaataaaataaaatgttggcaaacttgtgggatccatgcttcttaagttttgaatccaattcctttttagcgtggatgtgaataattaatcttgaggtgacgacaaaatctttttaaatctttgtagtgcttcgagtatttttttgtccaataaccttttgcaggaaataaaatgacaatcaaggagcagtgtacaataacttcaaacacttatatcatgctccttggtccatttgaaagagatgcacaaggaaccaagtagaacaaatgcaaaactttgttacattcgatttaattctaagcctggtaagacctatctggtaagaatctcatacaccatatgcatcctcatctcatgtctccatcctgctaggatacccaacatattcattgttgccataaaataaaaataaaaaaatgattaaaaaacaattaaaaaataaaataaagttggctccttggtcttccaaccaagtgagtcatttttg

SEQ ID NO: 57174 - DNA, 1325 bp, Oryza sativa
atcccgtcctagtaatcctccatgttcggatacatcatagagctataaccggaaccacgctggcagaccagcaagggtcggtgcccgaagcaacagataggaaattacctttgcttagcttagataattaaaacacatagagagtcctctctagcctgcctacctatagttgttctccttggatcgtcttagccttaggtagattacacacgttccctgagttcgatatccttttgggtcacccgaaggtgaagtgctacatcggtattccgtgcgcttgcgggtttatctatggtcgtaagaaataccaacaaataccaacattggtctctgctgtttccggatttacctaggcatgagaggggactgcccgacttggcacaaggagcgggtgaaaccagaggtgggcatgttcggttagggagggttatatgaagtaccgaagtatcgcggtggtacttcggggcatggtagcatgtgtggaattgttgtgtcttgtggatacagttgtacacctctaatcagagataaattattcgaatagccgtgcccgcggttattgggcagtcagctagctcaccgtgattagtctcactataataatatgacttattttactgatgtagttctggtggtttggttgggcctgttgcaacgtggtttagtgttgggcagtgatgatttaatattgcttaattatatatattgttttactttttcaaaatatgatttataaatgctgcctttactgcaaatatcttgcatcataccttcccattggtatgacctgttgagtatggtggttggtattcagttttgctttatttttccccaccccagaggcagagattggttcagatggtgagttctttgaggattgagcttgttctggacgttgaggatacatgtggtttctatggaggatgctacacttttggtcgtaaagattaagtttagtttatttgtttttccgctgcgtttgtgagaattatttattatttttgtaagacatggatctgtttatcaaattgtcgtttgtgtactctgggtggtcctggacaaagattttaatacacattctgtttaaaattcgggtagcgaatttctaggcatgacatcaacgacaagaagctacagttctcgactatatgttccgttgtttccctactaaccatagagtcgggggctacacaaacacaagactaaaaattcaacagacgttatatcaagatgaagcaatcaatcaatcatggagttctatggaatcaactttgggagtcattagactcgtcatcgttttagagcaggcgttttatttgaacaac

SEQ ID NO: 57175 - DNA, 992 bp, Oryza sativa
tggatcactaacatcatcatcttcatcaccttcctatcatgcctccaaaacctagcctactctactgccgttcatgggcaacttcgtcttcgtagccaaccatctctgttgccgccggtcatgattaccgcaggtcatctaccgttgtcgactagtttcttcgtcttagagggtaaacatactgacacctgtcgccaaaagacatgcaggcctgttcgcaaaaaaagagttcaagatgataaaggatgtgctcaagattgttcgtcatcgacccagcactaaccccgtgcaaattgaaactttgtgtatctcatgctctttgtttctttaggagtcctccaaaatctatttctgaaagcttccatctcagaaaagtgcctaggtgcaatccatccctattcgttttaacacggaaacaaaaattggatcaatcaaaaatctttttctaaatccttgcatgctggattttattggatttcatttctcgttttcctgttgtgtttgggacaaaaggacggatgtctgagaatatgcttgtattttgaattcaaaatattatttatgaaaagaaccatgattaatgaaatatcttaatatttgcaaataccaattatcttcctaaaaaccctttaatacatattagaacctctctgatgtatttgctttataaatgaagttatatattacaacattgggggaaaaatcttttacggggtaattctttgaaaatactattttacaaaggaaacataattttgattatttgctatgaatccttgaaaaggaacaagccatttggagaataacttgcaaatgacatctattagtaaaataaatccctaaaaggctttaaaaggaaagtccttctcagacaaagtctatctttcctccttaaaaggcctagcccagcccgcataatagcattcgttattatccgagtatgtttattttttttaaccaagatctagattaaatccattttcttaaatagt

SEQ ID NO: 57176 - DNA, 3354 bp, Oryza sativa
  unsure (1)..(3354): unsure at all n locations
nnnnnnnnnnnnnnnnnnnnnnnnnnnnnnnnnnnnnnnnnnnnnnnnnnnnnnnnnnnnnnatgacattctaaaacaatgcaatttaatagaaagcaggggattttataaaataggttcatcatgatcaatgttgtatgtatggcttgccttgctcttgagctgacggaacctcggcaaccacttcgaaataaactagatcaccggaactgccagaatctaaatgacaaacaaagcatacaagaaatacaaccttaatcatttattacatattaatgcccacagataaatagatcaatagaaatatatctccggtaagcaagcctcatgaattagcgactcaacgagccaacacttcgtgacacgggaccatccaaacggtcaactgaaccggcgactcagaacgactctaaactaaagaacgactcggaatgaccgaatgaactaaaactttggtaatactacgtccgagcgaatggttcgcggcttaacgaacggctgcagcaaaatcagcaactaaacacagtttgtggcaacgactcggtacggcaaactaaaggccggtaacgactcaggtttatgactatggataggcaacttggctaccaagctacggatagcggctagggagaatctaacatgatgacgcacgggaatggcacagcagcaagtggcggcgacttgcaccagtggggggcggcgatggctggtgcgcggcagggacggcatggctgcggcggcagcagcggtacggcgcagcacagcaacggcggcgacacgaacagcagcgacgtggcagcgatgcacggctggcagcaagcggtgcacggccggcagaggcggcatgtggcgctaggcggctgcgatgctaggtattggcggggctacacaattaggattacaataacgacgctaaaagaattaacacctaaaccaggagatcacttataggttcctcaccaaacagagacgatcggcgaggaggagatgacaacagcggtccggcagcaacacacggagacgacggcgacactagatcaaaacctaggacggagtaaattagaatatagatagatagataatggcggtagccatgacatagagagggagaacgaattactggcgatgcaacggcgacgatagcgactgtcacacctagaaatttatcccaaatttccagactattttgtgtattaaatccctatctaggaatcagccatggtacacaaaacgacaagtaatatacagtttaaaacataaataaagagtaaaatacttacagaagaggctcagtcctcacaccaaaagagaactatagcagtggaaaaggcgatcctagcgggggcttcggctccactccacaggcaaaactcaactggggtctgagccttggtcctctaaattcgtgttcagctcggaagcacacacttttaatagggggaaatagcaaggctgagtacaactaccatactcagcaagccacaccaaagatgcagacgtgcaaggggattcaaggatagcttgtggctattttcataaaggcagttgtaaaacattttattgagcaaaacagtaaaaccgtagagtaattaagggtataataaatcttcactgatcaacgctacaccatgttaaataaggccaaccaggccaccttgactacacagtgcattgggtcgatttgttggggtgagactaatcacaatattctggtgggtcgcccataaccacgggcacgactatttgaatagttttactctggctagaggtgcacaactgtatccacaagacataatccacttgcatgtcaccgcgccaggcctgacacgacaccatgtcaagtgattgtgacaagacccttcatataaccccctctgaccaagcacaccacacctcaggtttcacccccactcctcaacaagcagcgggcagtcccctctcgtgcctaggtgaatccggaagcgacaaaggccgtcgcagggcccatcccgctccatcacgcccacccttgcctggatgcgtcagccagagaaaagctatacttcaagtcaggcaattacccattcccgcttgtggcaagcgctgtatgtcttccagtgcatcccacgaaccggtccttaattgccatgggtgtgaccagcaaaaccatgcacccacagcccaccattcagtcgcattttagtttgataattatggccatagaaacatggtcggatgtctcgagcacgcaactcatcatgatactaagagatctaaaactgtaattatcccatcaaccaagctagtggtaactaagcatgcctaagcatatatgattttagctaggtcaatgtaagtaacacaagctagtcgaattatcacccaaggttgacaaaagatggatatcaaataaacatggcacgggcgagcagataggtaaaccctaatcccatgtaattagcaaaacaatgcatatttatttgcaaatgataaaacatttgtaaaagtaggctcaaaatgctgaaggggaatgtgtgacttgccttgctcaaacaatcttctaaactcttttcttcgctatcgccatcttccggaacggcgacatctacgtgctagaacgcaaaaaaaggaaaaaacactaataaaaaccaagtaaacagtacataaaaagtaaacaaacatgtagatctcaatttgagatgaattttgcaacttgaatggcccaatttggagttcatatgaattagttatgaattttggaagttttgagccatttaaatcattttctataattattatcggtttatggcgcatttattaaatattttcccaaaggaaatggtctaccgctaacgtcagcaaggggagcaggcaccgacaggcgggccccacgagtcagtgagtcaagggggcagcccacggtggactcggtccaccgtggcacaagcgcgtgcgcacttaacaaggaagaccacgtggcggccatggcggcacagcggggtgaggtggtgctgacgtggcgccacgagggcaccgacgcgtggccgagggggaacgccacaaggacggcgtagatggaggacgagaccgatccaacggcccagatcgaccacggcgggggccaaggggaggcggccagcctgtgtcggcgcgggagcggcgctcggcggaagcggcggcgacagcccgccaggacggccaccggcgatggaggcgcgacacagagcagccgacgaaggggagatagagggagagggagagtatgctcaccgaggggcggcggccaaaaaggcacggaggcgagcggttgggcggcagcccgcgaagctcggcggagggagttggcgatgctccggcgatggcggcgctccggaa

SEQ ID NO: 57177 - DNA, 1453 bp, Oryza sativa; identical to SEQ ID NO: 16898
  unsure (1)..(1453): unsure at all n locations

SEQ ID NO: 57178 - DNA, 2790 bp, Oryza sativa
caacgatgtagtcttccgccagcccgtctgccgtatcatcaaccgagtacgcgggggtaagttctcatcggctagatccttctttttcgcaatagattggttttcctcttccttatcttattttcccctttctctgttcttttggatttgtagcatctctccaacctggttgcaattccaagcctatcccatgaaaaccattactttctcggcccaatcggcaaccttgatcctactgagttcatcattggccagaccaatagaattcctttcagattagccaacccaaatctaggtcactggaaaaatacttttaaatcttggccatctcttgagaaaacttcacctgagaagagctggattacatggtacaagcgcatgtcgactagcaagaaagttcactgggacgaaatcggaatcggccaagcgcttgaccttaccatagccaattcagctaaagatgaacctttaatggccgccgccaccacctatttctggtctaacaccatcaacgctttcttgttcaactaagggccgatgactccaactttaatcgacatcaccatgattaccagattagatataacttcatcggctaaccctatgagtctgaacaccaagaatcagtatgactttaggaccaagagcataggcggctggtccggttatgtagcagcatatatgggccaaggatctgtcactccccaagagcatgtagcttttctgcttatgtggctggagaaattcctcttctgtggatcaagctgcggcctgcaactaactggcagtttgtagccgaggccttggaatcaaagagacaattccccttaggcaaaatcctcctcggctatttgtaccaaatgttgaacaatgcatcagctaagatagccgtcggctcagtagttggagcaggtggaccatggtggctactacaaacttggctaaacctgacggccatgaaattcgtcaatcggccatctatgacagaagccgaattcccaagactagagccaatcatagaagacgatggggaggaacgcaccaaccgtagatgcacatcctatggagaatatgcttccacaccagccgacgcaggggcaaagctatcagctgaactgcttaaggactagttctgtaacttttatgagggctttcagaaagatgctcgaatttggttccctacgaagactcagcacttctagagcatccatcggactttagatttgaagacatcaaccatgaaagataccaaaagtccagagaagtcttctcggctgcaatcagcccatgcatccttcctgttggcattcatcaagggaggaatattcaagtctcttatgagttctatcatccgatgagtgctgccagacaacttgggatgggtcaactaccaatcggtctgttctttgccgataaaattcaatgccgaggggaaatttcatcgaccctaatgatggataggctgctcaatcttcacggacctcctttgggcagtattgaaaacatagagttggcaacctttaggagcagatcatttgacaaatggtggggcgaatggaagctgcatctgttccatcaatcggcttctatgtacatgacagatctcttcccgaacattgtccctcaggtatatcttggctttaatctcgcttgaataagtgttagctgattcacaacttgactaattttcttttctattttgcagacaacagaatcttcccctccacaccaaagcaatagtggcagagacatcgaatatgtcccaggtctaattccaaatggaggtgggccatctacccccgtcatcggctatcatgcccccaagacttcaactcttctccaagggcttattagagaaccagccgataccggcaaaaagagaaaaaccagagcatcggctgtagacacatcggctctagccccaaagaagaaagctaagtcaaagaagaccaagccaaccgatgacttgcctgccctagatccatccattgaacaagctctggatgaagaagagattggagaagatgttgatcaagctgcagccgaagtgagcgatacagagaaaacaccatcggcttcgcccaagcagacccctccaactccttctgccccagctcatttctcgagggtaaatatctttccctggttcccttttataaccattttatcctcagccgattacttattaatcttgcctttgcagaaaaagagaattgctatgaagaagaaatcggcagcaacaactctcaaaccggctccaccagtaagatgttcttaattttttcaccagttgatctcagccgatcttgtctaatacttgtctcttttcagcctcctcctcctccttcttcccctgtacagcaatcatccagtgaccaaactccatcggctatagggagtcaccatgttgaggaagaagaacaaccagccgctcctgctatcccagtaagtttccctttgatacaagaacttagatcggctatgtctatttagctcctaactctcttgaaattgttcttgcaggtcttagccgatctattctcttttgacatcaaggacaactttgatgagacagaagaggacaccacaagcaaagccatagcccccttatccaatgatgtgaagaaaactcttgaagatatctctcatcggctagaggcatcttctttagacagcttggtggtcgactgtggatcaattagggctcggctacacgaagttcaaactctgattcctgaagaactagccgatgtccttactccagctgcttatttttaacagcatcaattc

SEQ ID NO: 57179 - DNA, 4650 bp, Oryza sativa
  unsure (1)..(4650): unsure at all n locations
nnnnnnnnnnnnnnnnnnnnnnnnnnnnnnnnnnnnnnnnnnnnnnnnnnnnnnnatcgctagttgaattggggtccaatcatatgcgttcttatcaattctggagttcaggtaatgacatgtactccatttaggtgttatgaccagatggatccaatgggcactgcggcattaatatagtgaaagttaattaagtactcaagcaatatgtcatgctgttgtgtatatttagttaacacacttactattgattataggcacacataatgtactccttgtctcggcgggaccacaaggtgtcgtagatgtagttgaccattccttgacggtcattctggagatttgtgacagtgaccacttgtggatcaaggaaggcaacttccagtgcatgcttctgacaccattgacaacttaacctacacacaggatcaacaatcttgtaagcaagttaaaccgattgttattaccagaatgagttgggcgacaatatttacaaggagtagcacttaaggaggcttgtgtccaccgctcggagcctgtagaggtcgaaaagatccttaaagtcgaccacgacataatttgttggaccaaggaatggctttccatcgtgctgtccaaggatatcggtagctttacttggcttcctggcgttagatttctccatgtagtataagtgaaggtccttgcaagcggtgcccattgcggcaagcacgtcatctccaaccaatggcatgcctagttggaactcctgtggagcgacgtatttcttcttgacctctttgcccttagtctcttcctggcccttgcccagatctagctttcttggagctagaagcgaggcctgcacctttcctcctcttcctctcccctttgcttcgggtttatcgagagtaattctctgaggggaagagtgtgccttcctgctcttcttcatcggtgggggttcatgaatcgtcttgctgtcggcctccgttcggtcctccccaaaatccgtgtcgtactgcatctgcacatcgtaagattgtgcatgacgatcttgagcaggaggggctgaaggagcagaggcgggtctctttggtggacgaccgcctggtgcaatggttggcctcgctgtaaccctgatctcaatgaggtccttgggccattggatgaaggtaccacgggcatttcctagtgagaggacctcgtcgttcggtggatacttcagagggaacagctcgtatttgggcttcaccgagtcgacttgaacttttgcacagtcggccctgagttgcgctccatgcactcttgtctctggggttggcttgtacgcaagtccctcggctgctggaacagtgaaggtcagcatcaccctaactatgagggtgcagctcgttggtttctgcgatagattaatcaatttttttagaatattatatatcatatggattcgtccctatgtctttcatgtattgagtaagttcacggttaccgttatgtggtcgacggtgctgtcgaccgatgttggattttccgccaactcagttgatgtgcaactgctgcgtttttcgatgggacttcctaactctttgtgcgcagcagcagtggcggcctgggggatctgttgctcttctcggatctcttgcctaatcttggccctcatcgactcgagcttttcgtcgaattcatatgtcagctcagctcatatcgactcccggatcttggcttcaaggcgtgcatctttctccgccttgttggaagtccccttcttgtactgccacgcgtagtctggaaatccatacttccagggaacagaagacccaacgccccgtgtccgtccacggtgttccttgttgcccaacgctttcgtgaggaggtcgtcctcgcatctttgagagcaggcctcttgcgaggcttgttgctcggcaaccaactccttctgcattacaatttagtggggtcaaataaactgcacgatgggaaacaatgcgaacatctagtttgactagacacttactatagcttcgtatactcgttgatcttctgcatttggcatgaagattgtgccatcatcatgtttctggtacctagccctggcccagttcctagcccgagggtgtgggatatcgccaaacacgagcggtgtgcacgattcctccgcttcttcatcctcacgctgccattcctcttccttaccggcatatccggcggtaccaagccggtgcggatgctggttcttggtctggagcaagcgatatgcctcgcttctagctttggactcgggggtcgacttcttcgcatggaattcctcccagacctgttctgtgatccaaggaaatttctctcttggatctggatttgccgggttgtagacgaactcaccgactagcttagtcttgaagttcttccaagcagtgcccataaccttgaaagcagcccgcctgagacggtcctcatgctccgcaggataatcaaagctctccttgaacgttagccaagcaatgtccttctctgcgaccggcacgagcttgaagtcgtcttgcagaatactgaatttctgcctccctatgaccccgcagatagacctaaatcggctcaatattttccttggagatgtcggcaaccctacggcgtccaccgctgttatgcggaaccgttccttaggaattttgttccctgtcctaggagtacgtgcccttgaggacccactagttgtcgtcgacattggttcgccttgctgagacattgtctacttttttccaaaaaaacaaagaaaacacaattgagtgctacaatctattacaatctattaaccacatttcacaataatttcattcatgcaccacatttcatcccaacataaataaaccacatttcatcccaacataaataaaccacatttcatcccaacatgaataaaccacatttcatcccaacatgaataaaccacatttcatcccaacataaataaatctcatttcatcccaacatgaataaacccaacatgaataaaccacatttcatcccaacatgaataaaccacatttcatcccaacatgaataaaccacatttcatcccaacatgaataaaccacgtttcatcccaacataaataaaccacatttcatcccaacatgaaccacattgcatataaataaagttaaatgaactacatttcatcaatcactacaatcatctatcacaaaattcataaatgcaccacatttcatcccaacatcgacatgtctcactcacagttcaatcacatatcatccacatccacatttcaatgacatgtcattcacagttagcagagggcggcgcgatggaggactcacctgaggatggccggtggggctcggtggcggcggcgcccgggctcggtggaaagcggcgccggtcggaggagacaccgatcgggcaggtcggcaccgggcgggcggcgtcatgctcagtgggggtcggcgacgtgggtcggtgaggacgcgggcggcgacgacgaggaaggccaacaccggtccggtcggtgtaaaggctcggtggcggcggcggcgggctcgggggcgggggtcgtcggtgaggaggctcggcggcggaggtccaaatggagggccgaggaggctcggtggtgacggcggcaggcttggcgagggaggacgactgcggcggcggcgggctcggtggcgacggcggcgggcttggcgagggaggatgacggcggcgctagggttctaaggaggcgggaaactgtagcgggacttagaaaaattttcgatccactctgagaaaccctagttatattagagtgatgagtcatctcaatcgggctttgccgtagggccagtcacagatgacgcatcggtgacgggctccatactaatgcccgattgagatgacattcaggcccgtcacggatgactcatctgtaacgggccctaagataatgcccgatagagatagattaatctctatcgggcttgaactaaggcccgtcaccgatgactatttttccatttcccaggtaagtctttatatttgtgagtacaaaatatatagctgctgtataataatttattttattagttataacacattttcggatagtaaatgatttcaaatcgaaatatggtcaacaacaaaattgtagaggttatcaagatctacaacttttattttggtcatttgtctatataactttgtttccaacagcttgaaattgattttgacaatatgacaaatataatcaacatttgtaaatactaaatgatttgaaatggaaatatggtcaacaacaaagttgatcctctcatcaagatctataacttttattttggtcatttatctatataactttgtttctaacagcttgaaattgattttgacaatatgacaaatataatcaacatttgtaaatactaaatgatttgaaatggaaatatggtcaacaacaaagttgatcctctcatcaagatctacaacttttattttggtcatttatctatataactttgtttctaacagcttgaaattgattttgacaatatgaaaaatataatcaacaattgtaaatactaaatgatttcacatggaaatatggtcaacaacaaagttgatcctctcatcaagatccaccacttttattttggttacttcttcatccgacaaagtgat

SEQ ID NO: 57180 - DNA, 803 bp, Oryza sativa
agccatgtccgctgcaaaaatgacagaaacaaacacagatatccaatatccccagctccccagcatcacccattcatacatatgcattaacatacacagacatcaacatatttcacacaaccacacattcaccgccatctcatatttcacatccattcacatatttcacatccattcaaatatttatcatatttcacctgcaaaaccgagttaattggatcaaatatttatttagcaagtcttaacataaacatatgaaatatatacataaatataagcatcacagttacatcatcacagttgcataataagtgttcatcattgcctaaacatagaagttcaacattgttcatcattttagtttaagcctaaacattcctttggggttaattatttcgcggaggatgaagctggctatctcctcgcgaacctcctcaaagctggtagtcagagacttggttattgtgccctacattgtcataattccagattagttgatcgatcatatataagtactaaaatgtagttagtctatcacaattgagaccaccgacctcaaactcagccaaagtcttcaccttttctctatacagaagtcgcatgttgtggcacacatggaattcgcactggtcacctatttgttgcttcaccgggaagtcttttttgtggatgagggtgtcatgtcctgtcttcctgaggcctcctctttgcacgtattgggcccacgcttcatctatcgctagttgaattggggtccaatcatatgcgttcttatcaattctggagttcaggtaatgacatgt

SEQ ID NO: 57181 - DNA, 1410 bp, Oryza sativa
  unsure (1)..(1410): unsure at all n locations
gatctaagccggcggccggtgggcggagcggctgcgggcccacggcagacgagcgcaccggggcggcgaggagaacggcggagaaggcgggtgaggcgggcggcgaccttgctcccgttcgcgtacgtggagttcttccgaccttgctcccgtccagcggtgcgtccagggcgcgcccggcgccgtggagttcctcctgtccgtcgtcaaggagcagcacgccaccaccgtggacaagacgacgtccacaccgctggttcgttctttccagaaagagacgacgtgtggcgtgcaggatttggcaaaggtgagctcgccggaggaggcggctctgagcatcctgcatgcttaagctctcctccttcgcctgcttccgcatcctccttcgcctgcttctgcgccgaccccgctgccgatgacctcatcacgccattcccatacgcgtcccacccgccgccctcgtctcctccgccattgccactgctggagcttgagctggtcgtagtagagcgcgctcagcgcctcagcaccacctaaccacaaaactgttagtggtgtgcatgcatagcttagttagctgattagttagagctagtcaatacatgaatgtgttgcatgagttgtgtggcagttagcttcgtgcatgcggccagctagtggctgccaaattaagttgatcgcgtgctgcgtgcccgtacgatgtgaccgaagtttgttttcttagctataaaagtcatgtaatctcggcttccggcttccgactccggccgttcatgccgcccgaagatgatgtggcgcacgttgtcgacgttctggacgcgctcaccggcgccgtcgagcgcgatggtcagcaggtcacccgcggtggcctgctcgagcaccgccgccacgcgcgcggggctccaggtcgcggcacgtattgggagccagcaagagatgacgccggcgaaaccacccgccactccacctgccaccgccaaccgctgccgctcgctgcccgccgccggcctccctcacccaagaagtcaagagagaagagagaagagagaaaagagaacagaagaggaagaacagagaagaaaaaaaataggcaaaatttgctaacagtacattcaaaaaacgtgtaattagctagaagacatcgcaataacgcgtttttgctgtagggactgcaaaaaattggtaattagctgctggacacccgcggaattattttattatatctaaaaaaattagagagagaaacagctgtgtaagtacggttctactccctttgtcctataatataagggattttgagtttttgcttgcattgtttgaccactcgtcttattaaaaaaaattaaaattattnnnnnnnnnnnnnnnnnnnnnnnnnnnnnnnnnnnnnnnnnnnnnnnnnnnnnnnnn

SEQ ID NO: 57182 - DNA, 876 bp, Oryza sativa
  unsure (1)..(876): unsure at all n locations
ctggatctttcgatccgctggaaccaccactgtaatataattgagattattactgtagtagcataaattgccatgttagaaatagtaattattttaacccatatatttcataccttaatttgttcatgtccaatctttcaagcttcttcaatataggtttaacccaagactgatccacggcactaacatttctcatgaaaggacgagtagtatttattaactcatggtagacaacatataccggcagtttcccgtattcatcaccttccagtaggaaaaatggatgcacctgcaaaaagaatatatacaaactggaaagggtcaacagtaattaaagtttgtaactaaagaatgtagtcaaaccaaattgacaaattctacaaaacagctttaaaccagtcactgtgagattcatgcgttcctgttgcatgagacaactattatttgcagctaatatccagcatatctaaaatactttgtcgacaattacccgagaacaaactgcatactctcagcaaagcatattcagcatatctaaacagttcaagtagcaactgaaagtttcattggcttctacatctagtaaaaagtttggcacaaaaaactgctaccttttggtttggttaagctggctaatgtttcattcgccagaatcatctcaatttacccttgccatttatgcttgacactatagcaaaactaatctgatagattgcagaagtcaatacctgcactagttgtgccctgtatccaaccgtatgataaccattgtgatgcagcatcctctcagcgagctggttaccatatccaacacatannnnnnnnnnnnnnnnnnnnnnnnnnnnnnnnnnnnnnnnnnnnnnnnnnnnnnnnnnn

SEQ ID NO: 57183 - DNA, 14732 bp, Oryza sativa
  unsure (1)..(14732): unsure at all n locations
nnnnnnnnnnnnnnnnnnnnnnnnnnnnnnnnnnnnnnnnnnnnnnnnnnnnnnntattggatatctgtgtttgtttctgtcatttttgcagcggacatggctagcaaaggcctgaggctagccaaaaaacaaaatttattttttttgtggattatagtcatctgtgatgggccacaactaaatgcccgattgagatgaggtcatctgtgacgggctctagcttaggcccgattgaggtcactagtcatctgtgacgggatctagtttaggcccgattgaggtcagcagtcatctgtgacgggctctagtttaggcccgattgaggtcatcagtcatctatgacgggttatagtttaggcccgattaagatgagtatcatctgtgacgggctctagtttaggcccgataaaggttagtagtcatctgtgacgggcgctagttgtggcccgatagagataggtcatctgtgacgggctatagtttgactggtcgtctgggtcaaagctatcagtgatgggctttacttaggaaccgattgagatatattcattcgtgacggccgtttgcccgattgagataactcttcacatcagtgacttctagcctgtgacggacgctgtgcccgattgagatggggcttaccgcccgattgagatgagggtatccgttctagtgggagaatgtgaagcaaagaccaacgacgaccagcacagcttaatcagaggtttctcacgagtttaactcgcgagagtaattaaccaggtgtcttccgagaccctgggaaacaggagaacacaatcgccaattcagatccaccttgcctacaggccatagagagcatttgaccaaggattttgtattttttaattctttgagaattataataaatgcattttccttcgtctattttatttgtgtacttagtacactgcacgcccgcgcatcttattttattttatttccctgtgcggagggacgaaaatttattttttctctccaaacactttatttcttgttaattgcagaatcaaatcaactggcacgctcacgaacctaatggcaagatttttggacctgcactggagttaagcagatctctcaggcctcgtgtttttcgcatcaacacctatatgccattttatgtaaaaaaaaatgatcataaaaatccaggtttggttagatgaaagtaaatgaatagttttggtactggatttttggatggtgctctaagagcatcgccaacagatgctcagcatggcttctaatctcaaaattttggttgttttaagtacaccccaacagttcccctcactaacttgcaaatgaaatccccttccctatccttctcattcttcactaatggggagcacgccggtttctagtagcacgcacgagatgatgagagtgacacacgggaagaggcgggagcgatcacaggggaccgatagtgactttctttatccattggtagttttcgggcgaaatattttttatattagtagatgaaacctcgtgcagaagtttagtatgattacagtaacattaatgtgtaatataacacatctagatactggagaaaccatttttgatcggttgccaaaaagccacaatagtcccggttcaactaaaaaccggaactaaaaaccatttttagtctcagtttaaaagtgcacggggacttcatgatctttagggcctatttggcacagctctatctccagctccaggagctcagccaaacagtttcagatccaccaaaactaggagtggagttggataaaactctcacaaaatgtactagagttgtggagctgggtttaggcagctccacaactccactccagactcaactcctagagttatatttaggagttggagctgtaccaaacaggcccttaatcccggactaaaaatcatctttagtcccggttctatttgtgttagacaacgttagagcaccgagaaaatagatctttaatcccggttgatatcaccaactatctccctcccacgtcttaaatatatcgaaccaccatagacttagactttctcatctttatctctccactatctctttttcctctatccttatctctttccttcctctaactccttatctctttcccctatcttttctcagcgtaggactaaaaacttgtttcacaaaactacagatttaatgccttcatttatcataaaactatatgtactttgcacaatatatcacaaaactacagatttaagaacttgtttcacagaactacaaatttaatatcttcatttatcacaaaactacaggtttagtactaaacttatagttttgtgaaacctgtagttttgtgataaatgaagacactaaatgtatagttctatgataaacaaatgcactaaatttatagttttgcgaaacatattcttaaatatatagttttgtgatagtttgtataaatctgtagttttgtgataaattgagacactaaatctgtagttttatgaaacaagctcttaaatcttaaatatgtagtttttttgataaattatgcaaaatacctgtagttttgtgaaatttactcttaaaacttttacatgtgttcttaatgacttgaacgccaatgttgaaaatgaaactacgataaaaaaaaccctcaaaattaactcgaaaattaaattttaagattcacattttagcatcaacatatatcatcaacatatatgttgtagggtaaaagatgtggcccttgattggtaccctcggtcacaggatcttgccgccgcaaaggccgttgcgcgaagctgccaacgctgttgcagccagcgccgccgctgcactgtagccatcatgtgaaccgccagtcatctctgcagcttccacttcgctgaatagattcaagagcttatttggatagattttagtatgcaaattatttgtttacggaaagttggcagtggatggattttgtttgaaggggcgatgcatgattgcaatggtagcaagattatcttccgatcaacatttgattagcagtaatcatctaaagcctaacccaatttttcctcagacagctgtgcgaaaccaaacaatcaaaagagacatgctgcctgactaggcaaaattcatcatctcgggtggctctctggcatgcaaaatcctcaggcatatggcaccaagacaccagccaaacaggcctttaaacggttacaaagttctcaagcttgacaaatggatggatatgatgaaatttagactcacataaatgtctctgcttgtacctacagtacttctgctatggtaagtaataagaggtagggaaatatgatactgaagattgtcatgttatcactccctgttcctctcattacgtatgggacctaccctccaaagaatagcttggttaagcacatactgtcatttcttgccttttcgagccaggtagcgctcgcgagctgcctgtattttactgtccacgtcagattgtttaacatccattgctttctttggggagcttacttgtttatcctctagaggttctggatctttcgatccgctggaaccaccactgtaatataattgagattattactgtagtagcataaattgccatgttagaaatagtaattattttaacccatatatttcataccttaatttgttcatgtccaatctttcaagcttcttcaatataggtttaacccaagactgatccacggcactaacatttctcatgaaaggacgagtagtatttattaactcatggtagacaacatataccggcagtttcccgtattcatcaccttccagtacggaaaatggatgcacctgcaaaaagaatatataacaaactgtaaagggtcaacagtaattaagtttgtaaactaaagaatgtagtcaaaaccaaaatgacaaaattctacaaaaacagcttaaaccagtcactgtgagattcatgcgttcctgttgcatgagacaactattatttgcagctaatatccagcatatttaaaatactttgtcgacaattacccgagaacaaactgcatactctcagcaaagcatattcagcatatctaaacagttcaagtagcaactgaaagtttcattggcttctacatctagtaaaaagtttggcacaaaaaactgctaccttttggtttggttaagctggctaatgtttcattcgccagaatcatctcaatttaccctgccatttatgcttgacactatagcaaaactaatctgatagattgcagaagtcaatacctgcactagttgtgccctgtatccaaccgtatgataaccattgtgatgcagcatcctctcagcgagctggttaccatatccaacacatagagctctccttaattttctataatcagggtcactcttccgctctttctttgcttgcacatctgttgaacctaaatttacaaaaaaagaggtaggtttagtagtttttgatatacgggccaaacttaaacatagtagttgagtgaacattggaatacgtaatgcgctgggctctggatctattacatattttggttgcaatacgagcaagatgagttcaggttatattgcatctgtagtcgagcactgcatggatattactgaggttctagaggtaggacgtacatcttcatggagggcatatgtaacaatatctttgtggtagttcctagaagttaaaattcaaaaagtagaacaacgaattgacaaaagaggaaaaaacagctcaacaacagaggtgtcccaggaaaggaagaagcaaacaggtagtaggtttttgaaagggtgggtacacaataaaacagaaactagaattactgatcaccgaccttttgcaattttttgaataatctgacttaattggtttctcacatctttgctgaatttcatgcctctcacctgcaaaagatagttctgtgatctacattgtaatctaatgtctagaaaactatctagggggtataaagtctgtaagtatcatgacaaacagtatatgcaggcatatagatatgatgatcacacaatgttatccttgttatatgtttcaaagtttgcattgctagcatgaaaactataaatgctaaaaggcaatttaagatgggaacgtatcatatgcacacaagcttccggtgcacacttcatgcacaccaactaacaaatatctccaaaaattctagaaaaaagtagacttgtactctcaattgtattacacctatgtgtgaaatctcatgtttgaattaattatttttagacgtaacataaaagacaaaattctgatagtatactcttatacctgacagttttttctttttttgctacggctaaaatataatgaattttcagatgagactttacacatatgtgtaatactccctccattcgaatttgatcaacctatttcacctgggctccagactaaggaacacttgcatgcaaaatgagaagacgagcagccaatttttattcaatgaagcatcctatttttgctcaattgattggcttgaatgagaaccgaagagccaggcaatccttgcatgccaaagcaataaatctgcatgcaaaactgattggctagcatgtaaatcaaagagccacccaatccttgcatgggaaaacaataaatttacatgcaaaactgaacagctaccacatccttagagcaagttcaatagtatagctcactactagctccaattcatctatagccaatctaatagccaattcatacaatagttgcttactatactattaatatatggtcccacctgtcatacacacattgtgtcttggagtccgtgctgcagctggctacaaatctgtagcccgctgctcttctctctcatcatttatctcattaaaatatgtttatagccggctaatagcctgctattgtacctgctcttatgcactgatcaattctgaatgttttgcttttgcacttatcaattccaaatggagggagtactattaggattgcatgtccaattttttctagaattttcgaagacatttgttaattgctgtgcacagagtgtgtatcagaaacttgtgtacataggatatgttcccatttaacatgacatgcttcgatgacctatttaaaataaaattcaggtattatatcatgctttgtgattcggcttgttctatgcaggaaggtccaacacagttgcatttatttttgcaacactagtacttaataattttattcctttcactgtatcatattagaatcaaaatgttattttcattcacctgcaactcatgatctgagcaccatcttggatcatagcctgttcgatcccaactttcaaatatctgaagcaactgtatatggtcgccccaaccagaaccatcaggaagctcttgccttttcctctttccctccatgtctttgctgtaagggtgcaataagttcaccataaaattcaatgtgttacagtagcttagatgaattacaaaacaaaatgcccaccttctagttgaccggaatgtgatttcagctgacagaactgcagcaacagtcaatgcctgagatagacatcccaattcgtttgcttcaatcaaagtccttgaaagagaaggctcaagagggagctctgcacacatatcacgggacaacatatcttgcataagtccataagttacttgacactagaattttgacgtactggttcttttctaaacaacattccagcaccatcaaccctggtgcagctgtgcgacgctggatcccgacgtggccatgggtcaacatcaggtaactggagccaagggttattggcaccaagtctttttaggcagaagggggtgcgttggctgccacaaaaatttggcatcacccttgcacattgtgtccatcacaaataatttatctatcagtggcatacacacaaatcatatccaacaaacagaattcatcgggatgtgaataagagtcgatcatgaagccatcataatttatcacacactcacaatttcagcatcatcgctacccagtacccactaggttctgttatgtactccagtacagataagcaattgcaacatttctagtaaaggggtaggaataatatagctacttttagatgggtacaaattactctgtgggtacccgttgacccactctagttcaacaaaagtaaaattggttttgttgaaccagagtcagtcaacaaggtacaaacagagtgacccacacccacgtcatactcctatatctactacaagcaccatatttagtctagcaaatcatgtcgcgtacaatcataaaatacaatagcatgtaatgggcattactaagataagggccttaggcatagttgacccaagtggcacattggcaccatggaggctgtgtaccacaagggcaggcaagaagatggcgagactaaagacacttgtttatctcttgcttaatgaacagaaatacagccccatccttatattgcctcttaagaaacttatatctaagatcatggtaataaataactcattaatctaaattaaagcaatcacgtgagcttcatacgtttgaacagtaaccacgcgggtactgttcatgtgcgcaatgctgctggacctggagatattgaccactgcttttatatgggaactaatgggctcagatgacataggtaaacaattggttatcaagcctagcaacatattgcaggatttaagaagttatgaattacaagtaaaaatctcacaacagttttctcatataccagtcatgtaagaatgtgacctgatggaacactggcatgtgaaaagaatggttttcgaatatatagttgacaacttgatacttcttccttccattataagtcattatgggtttgtcctaagtcaatcttctattcttctataagtttaaccaagttttacagaaaaatgaatagcaatattttcaacacaaaacaaatatagtatacaaatagtaatgaaactaatttggtgttgtagatgttattactttttttctataaacttggtcaaacttgagaagtttgacttatgacaaacccaaaatatcttacaatatgaaacagagggagtattagacaagttactagttgcaaatacaaaattttcccaataaatatcatatatctagaaaattagaagcagatagtacaaaactgtggaaatttccagatcattacaaaagcaacagcttgttcccaagacaggttctataacattgtggagatattcaaattccaaacattatatagacatgtaaacggctcatactcaagacaaaacaagaggaaaactatggccattgcacagggaacaaatcttactacacaaaaactcaccagacattaaaaaactagacgtgcccacgcggcgacacgccgcgctcaggcaattactcgtttcacttcagttttatttggcctaaaagaatactaaaaatattttatacacatgatgacaatccacacatggctaatgtaagataaaatatcaacttatagaaacttgatgatcgcacatccacacatgatgatcacagcacaggttaatatcaactatcatataatattgcttatagaaacttgtaaacatgcatatgtgccgtgattaactaaaaaattcactctttgttgtaaaaacccctaaaatccaaatatgctttccgttcgctctcatgtggttccatattagcctgttgttccacttcaaagcattaaagcaagcatagatatagtacgttttctagcttagtaaactagtctatgcccaacaagcatcttgcgagaacaaatccatctggttcattgctttatcagttgatcagataacagattaggaatggagttttccttgacctggaattgcacttagataagtgtaagaaaccatggcactaccttgaaaccgaaaaaagtgcactatacactcctgaaggctgcttctggttggaaaccagtggaaaagacaaaactcgagatactatattttgtagtgtaaaattttgatacctcgagatactaattttacataaaaatttttggtacttcaacatatttctcaaggatggtacaaaaaaacccaaactcataatcttttaaattccttcagctcatggatgagatgagaattattgagatttctagccctgtagacatttcaggctacctggcatggggtatatgtggacggattcctgctgctaccttcatgctcaatgaagaggcaacaatagaatcatcagaatcatccagcacaaactatatgtagcgccaagcaaccagtggcatacccgcataagtgcaaagcaaaattaagagaacgatagcaattctatcggagaacacactgtgaagtgtgaacacaaaaaggatttgagtcaacgggaggaaaaacacacggttgtagtataaggaaaaaaaactgtacaaattataaaagtaaaacaagaaacaataaacagaccattgccagcttgaagatcaaaacaagaacggcaccgaacagcagcacaacgcgacctagcaaccgaagatgacaacacaacgttgattaaggaaacgtaacatacagcaagcatgaaaaactttgggacgatcaaggctaaatatatgaaagggaaaaagaaaataagaaataggagtagaaacaaaagggttgggagcagccacgtaagacagcatgggcacacccacgaggctacacacacaagcgcatggcaccacgtgcaggacgcatgcaaacacaagccgtgcacaagcagcagccgaacacaccaaggaaaaaacacgcagagcagaaataaccaggtaagcaagtcaactacaaaaattgtaaaaacccaaagaccggcacgtatacgaaacccctgtagaaacgtcaacaaacaaaactggacaccagctacgtcattaagagaaaaaagagccagtcacagctaggaaagaaaacagtttaacacgcggcaaacactggaggggtaaaaaaaaaagaaaaatccccaaaacgcagtaatctgaccggaggctactaggtaagtattcctgttagaaataccaataaaacaacaatgtcaacataaactgcctgaagctttgcacaaaaacattagacctcttaacagttgtatatatcagacatttctgaattgaaatatcaaaacattgccaggtatggcctccttatatagaacattagaggttagaccgttacatatttaagagtataaacttcttaaaataaagccaaaaggttaacaaaaagaagatgacaaacacagaaaatgatcatccctgttcatgctgccgctccacacatcaacagttacttcatgtgctggatgtgctaacagagtcatcaaaaacgcacatgcacatattgaactaaagatacaacaatattatattggtatgcaacaaataaaattagaccatgtgaagttcaaataaaagaaaaagaaaccagatatgctcgtgatttgatcaaactttaattgcatacattgttcaagagtgaagacaaactcaaataaccacctgatttcatttcaattgaaatgggacaagcaagctgagaatacctgccataattcgtcctacatctgttatttgcccattttcatcaattgcatcgatgaggtataattgcctcaaagcatcttctaatgattcacctgcaggtcattgtgcatcaaaggtaagagatagacaatactagtttttatttcacaagacaatttgtacaggcaaagaagtggatgcagtttcactgaggatctcctgataccaaacaggaatagtaagctactagttgatatccccgcgctttgctgcgggatatgtggatgaatgcatattgtacattgtataaatggtatatgtatatgtttaaataatgtaaaaatgatgtggaaataatgatttgacattgcttgcatattgagttctaaaaatacaacaaaattgtaaatgatatgtcatgtttgcatgacatttaaaatactctagataataactgctatggatgatgatgtggtacacttgcatgtgatttaaaatattctagataataaatgctagagggtgatcatgtggcacacttgcatgttgggctttaggagttagcgggcatcaactcctaaaacaggtgcatcaaaagatattatcataatccaccacagtgccaaatggagcgtaaggttagtactctctctgtcccattttaagtgtagccatgattttctatgtccaactttgatcgtctgtcttattgaaagttttttggaaaaaaaattataaacataagtcacacataaagtactattcatgttttatcatcttataacaatgaaaatattaattataaaaaaatttcaaataaacggacaatcaaagttgggcacgaaacctcatgattgcacttaaaatgggacggaaggagtaggtcatatgccttttgaaataggctcgtccagccaccatgaaagtatttgggtggaggctggacctagaacaataaatgtaataacttaagttaaaccatgcagaaccaagattttaccaacagctacttatgttgtgaatagcactacatttgtattcaaatatatggcaattgactttattcaatctttggtgtgcaactttgaccactacttgtctattagaatataacgataatatctaacaaattataatattgtaaaagtacttgtaaagaaaaacctaccgatatgattttttatgttttcaaaataaatattttgagagctattgatggtaaaactttccaaaattgaacgaataaagtcaatgggatcatatatttatatacgaagggagtatatatctagtttctgtagattagggtgttcttctcgttttcctttgccaatggccgttgtctatgtttgccttttggagctaatccaatagataaagtgatttctaacaacaaaaaagcattaaagatggatgaagattgaagagctataattaagaatagagaattctggagttttatcttacgagatggtgggtcaaggaaatcaaacttcagtatgttgatatcaggtagatctaacgattttagatacaaaacacttccggcaagagaagaacgctggatttctgggattgtagcctcgagaaactccttttgataaatggaaattgggtataacctatagcacttcccaggccgagttcttccagctcgcccagctcgctggtcagcctgcactcttgttattcaagaagtagtatggtaaatattatggatcataactagatatctctgaacaggatcatgatctagttgaacagatgaagacagtagacagataaccacagtgtgtgcaacatagtatttacctgctaatctgaactacgtcaagtgaatacattccagacgatgggttatactggcgttgctttacataaccacaatcaatcacaaacctagtgcataaaaaaatattttagtgatttgcatacaaacccaaaagaaaaaggaaaaaacacgtctccaagaacaaaattgcagccattccaagttcagcagggtaatagaaagattgcaaattttgataacgcaatatcagttcagcagtttcttatttattaacaaaacagctaatgaaatcacaaatgttcatcagcacattattttaatcgtaacactaatttctcaggatgaaagatcatactcaaatcacaacttcgtacgtacattaaagagcgagtggcaaagctatattcaagctttttcctcctagacatgtacaaggtatctccaagttatgcatatttcttttatataaaatcaaatagataattagtttgtgaattcaacatataaaccatatatttttttccttttaagtttaagaatataagcattcatgtgaatttaatgatattatagccatttgctcctaccatttttttttacaaaaatacacttcaaaaactgatactagcagatcagttgatgtaactctcataaatttaatagcatgttactagtagttcataacaaaaattctagccatttccttgcataactctaaaaaaagtatttatttgcatatacttttccacaaaatcagctaaatacatcataaacacaataatctatcactaaataaataaaaaaggctgaagatggaaactgaaagtatatgtgcactttaactgactatgtttgcagtttgctgcttacacaacaccatccacagtaagagatgtttcagctacatttgttgcaacaatgaagcgtcgacaatttggaggtgctggagcaaatacccggacctattgtgacaagggaatacatcagcaatgatactatagagcatcaaacatttaccaacaaatggaatgaaggacaattaatgaatataaatactaataagtgtgcttaaacccaaaaagattagaccaaaacagcagctttggcaacaaatcgggatcgaccttgcttttcaactctcagttgagcctattataattcgcatccatcagtgcatccatttgttagaacgtgatccccaggtagttaaattttgctatcatagccatatattgttagggggttggttaaatatcatccaaggttatcctgttgcagcaatgcagcaagcacagaataaaaaagatactctagtcccccaagaaagtcgatcaacagcaagcaatacacacaacaaaaaaggaaaaataaacattgaaatattcctagttggcaatttttttcagtgacatcacaaaatcttacaaattttgctttaatataatctactactagataagtaattgtaaggcttgttcagaagacttttgcctgctaagaaatttcacttagctgcaatagtgtaggaactgtacattgcaatgccaagcttcattgatcaattagagaaatggagaagaaacatggccaggtgtgtttattaggttcagtagctatggatcactagataagctcatatacgaaaaattaaattgattaagtaactgaaagattaaaatatattctctgttcaaatttgtattataatctaaaacatacactcaaatttccttaaattcaaacatcagtatataaaaaacatatttcaggtgaagttgacattatcaaatttgttaataatagtatttcacactccgtctattctcaaacagatgatgttttagaacgtgtgcagtcaaaccttggaatcttgactcataaacaaatgcaaacacctcctaatcgctataagatttataggtgaatgacattaataggcctgtcatgaagaatacctaaaagatttataggtgaaaatgaaattaataggcccgtcatgaagaatactttcatatcgctatcaataatgaattttatgactatgtcatgtcccaaaagtcaccaaaaaagaacggaggtagtaatataaaagctccacgaaattttcatgagcataatcaaacaaagtattcaaaggcgcatattggagaccacatacatgtccaaaatgtcatatacaagcattcatgggatgtcatatatgcaagaaacaaatataacaatacactagaatggaagattaatgaattacctgttgttcaggtggcaaagaaccgtgaagtggaaggacaagagcatccatacaagaaccttcctctagattttgaattctttcctccaattttgataccatcttannnnnnnnnnnnnnnnnnnnnnnnnnnnnnnnnn

SEQ ID NO: 57184 - DNA, 2258 bp, Oryza sativa
  unsure (1)..(2258): unsure at all n locations
nnnnnnnnnnnnnnnnnnnnnnnnnnnnnnnnnnnnnnnnnnnnnnnnnnnnnnnnnnnnntgttttagaacgtgtgcagtcaaaccttggaatcttgactcataaacaaatgcaaacacctcctaatcgctataagatttataggtgaatgacattaataggcctgtcatgaagaatacctaaaagatttataggtgaaaatgaaattaataggcccgtcatgaagaatactttcatatcgctatcaataatgaattttatgactatgtcatgtcccaaaagtcaccaaaaaagaacggaggtagtaatataaaagctccacgaaattttcatgagcataatcaaacaaagtattcaaaggcgcatattggagaccacatacatgtccaaaatgtcatatacaagcattcatgggatgtcatatatgcaagaaacaaatataacaatacactagaatggaagattaatgaattacctgttgttcaggtggcaaagaaccgtgaagtggaaggacaagagcatccatacaagaaccttcctctagattttgaattctttcctccaattttgataccatcttatcaatgtcatcctgacaaaataccattcaattaattcaaaaggtctgtgtaagtacggagtacaacaaaagaaagggagaaaagtttagcaaagaaatggagatcatccattgatccataaatgtttagttaatcagtgttccaaaaacagaccagtaaacgttgtgtttttttgccatactagtaacatgcccatgcattgcaacatgcccatatgattagaatgggttgcatgggcccatatgactagggatgggttgggagtgtgaatcgagacccaaccacttatgggcggtggggtgagagaagggatggagggagaatcgagatacaactgattacacgatggaagaagagtaaggaggaggactccgcttttaagtagtagagatatacaataaagtaaacacggggctgttttggggcattaaattataactagatgaaagcccaaaaatccaggagtattactgattttatagcatatctctgacgatatccttagtgtcaaatagaacaaaaaaaatatccttcaaagtttcagaaacatcaagctcaagcatgcaaaaaaaatatatattctgctaacctttcctgtcatgaatattaagacatcaccaggggattccttaacatgaatatctgttgaagaaaaagaatgtttggaactgttagaaacactagctaaatacctgtgatttgctatggataaaaatgaattatacatgtgctaacattgtttggaacaagttaattgtaagatttttggaacaatatcatccctgattccctgtggatgtctttgcatggtaaacataaattctagggatgaaataagatattaacaatatgtagaagtactgttttataaaattaaagtacacataggagtagttggtaaaaaaatacaacagagttggtgggtggcagattcactgccaccaccattgtcttcttttaaaggagtatagatatcaaatagttaagcaaatatgaaacaccatggcccaaaagtttaacaaaatatattgttattattttcaaataataaaaaatttgatttttccagcatgaatataaatcatatgtcagcagacatactcctctgacactaatatgtgtatttcgttaaaaaaatcatggtattgttaaggcggtaaggcgtaaggcgaggacccagcacaccttacaccttaggcagtaaggcataaggcgaggcaacgccttatacagatagaaaaataggaaatgaaagactttttcgtaatatctagagtccaaggattaaaatggaagatgaaaataggaaatgaaggacttctttgtaatatctagagtccaaggactaaaatggaagatggtgacagatatttatctatccatccccatccccgtccccatccccatcctcaatcccatcggcgccacctactcgccttcgctccactgccaccgacggaagacctctccgcagccgtcgcgtccatcccctctggtccttccttttnccctgccgccaccgcttctcatcatcaggtggtgctgggcatcgaggaaggtggatctggctttggcagtggtcggggacgacagcgacaaccacataggtcagctattttcattccttcccctttccctgctgccgctccttctncaggaatggnttatccccttga

SEQ ID NO: 57185 - DNA, 6472 bp, Oryza sativa
  unsure (1)..(6472): unsure at all n locations
nnnnnnnnnnnnnnnnnnnnnnnnnnnnnnnnnnnnnnnnnnnnnnnnnnnnnnnnatttttcccgcatgaatataaatcatatgtcagcagacatactcctctgacactaatatgtgtatttcgttaaaaaaatcatggtattgttaaggcggtaaggcgtaaggcgaggacccacacaccttacaccttaggcagtaaggcataaggcgaggcaacgccttatacagatagaaaaataggaaatgaaagactttttcgtaatatctagagtccaaggattaaaatggaagatgaaaataggaaatgaaggacttctttgtaatatctagagtccaaggactaaaatggaagatggtgacagatatttatctatccatccccatccccgtccccatccccatcctcaatcccatcggcgccacctactcgcctccgctccactgccaccgacggcaagacctctccgcagccgtcgcgtccatcccctctggtcctccctcttcccctgccgccaccgctcctcatcatcaggtggtgctgggcatcgaggaaggtggatctggctttgccagtggtcggggacgacagcgacaaccacataggtcagctattttcattcctcccccttcccctgctgccgctccttctccaggattggcttatccccttgattttgccctttctctagtttttcccgtaaagcggaggcagcgccttaccgccttaggggcgccttaacaaccatgatggtatcccaagatatggctttaaaaaaagtagttttttaaaatgatgttttataatgttagtaaaaccagtgcggagtgtacttaacataaataagagccatcagatacagacacatcccaaattcgccagagctttaaagaggttattcataggtgtagcaggtccagcacttatttcatcttttttttttacattatttgtccatccaacttgaccatagcaggacgaatactgtaagagagattcaagggaaactggcctagttaccctcttgccactataatgctagcccattcatgggcacatatcaaaaccatccatgacatttgttacatagcttatctgttatgacaatgattgatgtattccagtagtgaaataacacatagtgacttaatagagatgcaccaacaatattcacatgtcattgtcaaggtttaaaatatagccacataaagaaaatgataattacctatagcggttctcagagaagattctatataattcgttggatgttctgtgctgtaaaacttctccacagggaataaggttccagggatattcaacacaggacatccagagaagaactttgacactttcaaaccatcaagagtagcagaagtgatcagaactttcaaatctgaagctcgatccttaattaatcgtttcattaaacctagaagaatatcactgtaaacaaacaaatatcagaacgcgactaaagctttcaacaaatagcaacaaaatccagcggtcgtgtggccgatgccaaacaagaaaaagttagtactgactatcgatcactttaaaaatacaattgctagcttacaattgaagcatctgagaaccaattataataaatatgggcaaaatatggagaacgaaaaccacagtaaagttgcatcctacagttagtaaatagttactaggcatttgcgatccgaggccctcccattcaaagttgtccaggtaaacatctaatatagagaactatcgattatatcaaagtcaattttgagaacacatactagatgtctacattacttgtgagtgaaaatatcgtataggtactaattcctagcagtagagaaagaacgcatcagaagaaaaggcaaaactaagttgattttatataaaataggtaccaggaagaccaaataataaccaatacatttatgttgactcccagtttcatggcacacagaatggcttcccagcactgttttgttcactgttccaaaaaccggacacataagcaacaaaagttcaacaggcatgcaatcaatcttgggtaaatctatgtagtgtataagcaaaaaaagtttagcatattactataactaaatgtagtgtatgacccattcccggtaattatcttattttgttttcaaatcacaagttttcaattcaaacaacaagaaatgggtgtggaataactgaagagtaagcagcaaacttgataaagtgctaaactttaattcaaactcttatagatcagttgaacatataaaacgcatacgtgtttaaactgcgctcgtgagcttcatccagaataattactgaatactgcttcaactcagggtctgaaaggctttcgcgcagaagaacaccatctgtcaggtacctgcatatccgaaaatagaatgagttcgcatattgttcaagaagaaattcaagtcacataaacaccctctgaggcttactttatgcaggttttctctgaagttctatcttcaaatcggatggcataaccaacttcatcaccaaggggaacactgagctcctgtgctactctcctgcaaatattcagattgccagcattcataatggcatcctaaaaaacattttccacacttgaatataggcatagcacaagactacactggaaaactattcttctctgtacatgtataaatatgcatatgctgtaaacatagtgctgctcgccaggaagaaccacttcaaaatttcttaacaagcaggttcttaagttttctccccttaaaacacttctaaattaaaataaatggcttggctatccagaaagcagctgcagtttttacaaacgatgttctcgtatctccaccatcacgattctaaatttcaagatgaatctgcaattttcgtatcccttaagtgctaatggccaaaatccaacacatctgagagcttttcaggcataaccagacccacacgaacccagtaagaatgtaccctgagctaaaaggaaaccaacatttgaaaataacaacatgaatagaaagggggaagttgtactaaactcccaggtagcagataacaacgagcgcgcgcaggtgcgaccgtgccaccgtgggggaagacaagcgaagcacggagtcgggttacctggaaaccgagacggcggcgacgcgacggggctgggtgacggctatggcaccacggcgggtgtagccgcggcggtggagtatctgggagagctgggtgctcttccccgagccggtctcaccgatcaccaccaccactgggttcgcctccaccgcagccatgatctcgtcctcgtgctccgagatcggcagctccggcggcgacggctgcggcggcggcggcggcgatggcatggcggaggaggccgctgggatgtgttagggttttgatttgtttttgtttttcctcctctctctctctctctctctggtttttccggccgttggactgccgcccggtgatgaaaggaaaaagtccaccgaaggtccctcaacttgtcatccagttacaaaatcatccccgaaccacaccaggtattcgacgtacctcaactcacagagccgttcattttaggtccctcggaccccagttttttcctacgtgacggctgagtcagtatgagacccatatgtgcccacatgtcaggatgccacgtaggctcctctcccttcctttctctctcacttctcctctgcaggatcacggcgggaaggggatgagtgcaggcggctggcggagaaggaggtcctgcgcggcgagtgcggcgtgcgtgtccgacggccaacaggggaggagggccagcgcgacgggcacggccggtgcccagcatgggaggaggccctggcccagcgtgtgcggcgggggcatctagcagccggcaggggaggagggtcgtgtgcggcgggcgtggctggcggccagcaggggggagtgcagtggaaaggagggccggcgcgacgggcggcgaggaaggagcggggctaggctgacgatgggcggggagaggagcggaggtggagacggacgcggcggcggcgccaccggcgacagcctcttcctcgccctcgccttgcgtcgtctcgctctccgctctgctcgacgggaggcgactccagcggtcgcccgcgcgtcctcctaaacttggcggtgttggccctcgttggcagcagcgacgctagctggcgaagactagcggggaaagaagcagcggccgtcggagaggagcttgacgttggcagtggcagccatcggctagacccagtgggcgccgtcctctgccaggaacgcgtagcggcgagaccggacgtcgagcccggcgggcttgtcggagaggtcgagctcgacgcccatggcgtgggcctgctccccgtttccgtcgaagaggaggagcacctcatcacggcggcatcatctgcgactttgcagactcaccggcctccccgcttcgccccgtcggcctccttcccacctgccggttgcggtggcggtgccggtgggggcggcgtggggggaggccctcctggtccggtgctcccgcgccgtcgcttcctctcatcttcttctccaaggccactataaatacacaatacacctcgccatgaacactcccaggcccagcacacagcaaagcagcagtagcagtgcaagctcgagctagctacaagtacaagctagcagcctagcaaagctcgatctatagcaatggcggcgaaggcggtgcttgttctagcggtgagcctcctcaccatggccgtggcggccagcaccgggtcgtcgtcgtgcccacgcgacgcgctgaagctgcgtgtgtgcgccaacgtgctcagcctctgttgttccctgctgctcgctgctcaacgaccttcccccgcgtcacagccgccgcccgctgcctcctcctctcctgcctcgccctggcggcctcctccctagctgctggccagctcgcctagagaagagaagagaagagaagagaagagtgagagacagacaggaggaggaggaaggcagagtggagaggaggggagaaagaggatgatgatgtggcatactgacacgtgggggcccacgtgggtcccacgctgactcagacgccacgttggataaatctagggtcaaaaccaccgaaggacctaaagtgaccggttttgattagttgtgggacgccggatatcttgttttatggttcagggatgattttgtaactcgatgacaagttgagggaccttctgtgtactttttctgtgatgaaatgaagtttcggcctcctgggctcgtaggcttctcaagcacaaatgttaacaatatggcccattcgtttcccttaattggatccatgccattgtaaatatgccatattggaaaaatgccactactattcatgaaatcgggtatgtcggagatatgggcccgggggtatgtggagtagaggagaattattttccttccggccacgtgactccgcaggttggccccactcgcgcgccacgcgagtcgtacaagcgcgggaggggggggccttggggcatgacgtcaccccctcgggctctcccgcggcttcgccccgaggccctcgctcggctgccgcgcggcagagagagagagagagcaagaagggagcgcatgctgaatagccataaatgtgcgacgccccaactgtccctcaccgcatttaatgcggtcaggacagacgtgcggcgcgcctagctaacccctgtccatcgggtatgaccggtttgtgaccggcccgtctccgtcccatccgatggataaggcaatcatgtcctcatgtcgcccttgtccccggcggagtgggggtgggtatgacccgtcacatccggacgctactcgaggaagggctgttgcatgtcatcgttcatttataagggaatgacagggctgacccccgtgtcaggggggacggcgccgagttccgcgcaagaatcggttattggttagcttccgagagaaggcacggtttgaaacccaaaaaggtggagtggggtttccccccccccccatggaggggaagtagaggtggcacatgtggtatccccttaagctataaaaggaggaccctgcccacctaggaaagaaaaggaggggggagagggccaaaaaaagaaaaagaaaacccgaactccagaagagaggaagcaagtgcgctctctcaaggaaaaaaaacccttgtaaaactcatccataatcccaaacacaggagtagggtgttacgctcaatagcggcccgaacctgtataatccgactgcgtgcattcactcctgagagtcgtagggacgagcaagcgactaacgagagacgagcctccggccgaactcacgaaaggagggtctcacgactccccgctattgagggtcttccctcgacagggtagataccactgaaatcttctaaaattagaaccatgacattccatcacgttttcccgtcatttttgtcacattttctgtcacgg

SEQ ID NO: 57186 - DNA, 8809 bp, Oryza sativa; identical to SEQ ID NO: 16902

SEQ ID NO: 57187 - DNA, 858 bp, Oryza sativa; identical to SEQ ID NO: 16903
  unsure (1)..(858): unsure at all n locations

SEQ ID NO: 57188 - DNA, 1041 bp, Oryza sativa
  unsure (1)..(1041): unsure at all n locations
cactcggatcctgttattcagggattcacaccgcatatgctatatattaatattaagtcacttggttgactataattatcaaaaccactcagttggtgcatctattaggtacatctattcgatgcacctgagtttatttttcagccctccacagtcttcatatttggtaaaagtactcgggagatcatggcgaagatgattgaagcactcggctttgaagtaatctagttcgagagaagattatctttccgactgtgaaggtctcaggggctactgtggagattatgggtaccgcatacccacacggcatggttatccgactagtcataggggatagcttatatctatggaatatgtaaccgatcatgacttgggtattacgtttccttttatattatggagcggcctaaagtcctgatttgataatattgtaaaatagatttaggaaaccgatactgtattggttaaagtttctatcttgtaatcctgtcccccatcctatataaggtgggcaggaggccctctagggggcatgacacaaactgatcgtcagatcaatatacacccggcggattcaaatccccaaacaagagtagggtattacctctcatcgagagggcttgaacctgtctaaatcctttgtctccgcatccatccacttttaggtctcgtgcgctacccccttttcatattgccgaaaatttgtttcgacaactttatagatcgaacttaaccgatgcagcatcaagcataaaaataaccgtaagatctgaacaagtcaatgaaaacctctgagagatggtagatgcacgatataatctagattaataacgagatctaactctattggctacttcctaacagaagaaaccagccgatcgcaaattatatagcgcaactaacagagattataaagtatttatgataactcgacgaattacataaacaagattagagtgtcataaagatggaagcactaatctnnnnnnnnnnnnnnnnnnnnnnnnnnnnnnnnnnnnnnnnnnnnnnnnnnnnnnnnnn

SEQ ID NO: 57189 - DNA, 1243 bp, Oryza sativa
cttgttcctcaaagaactccatcacctccagtacgtcccacatataaaccaagagtatgtattagttctcaatctatggtctgagtttattttgcctttataccaatccttaacttttgattcattgcagaaaaagtttgcttccaagaagccacaagcaccagccccatcggttaaatttctcaatcccaacgaatttcattttcagttcttaagtaaccgaggctaatctgtagttgtgttgtcagcctcctcgtcctccaactctgatttctgaatccagtgagcaaactccatcggctgcaggaagtcatcacatagaaggagaagaagaagtagcttgccgttgtccgtgatgaactctttttgcactccgaaacggcaaacaatgtttttccatacaaacttctgtactgctgccgaagtgaccgctccgaggggttcagcctcaatccatcgggagaagtattcgacggccacaattgcgaacttgtacccgtttcgcgccaccgggaacggcctaatgatgtccaacccccatctagcgaaaggccagattggtgcgatgggttgcaactcgtactggggcgcagttgggcttcggccatggcgctgacagctttcgcatttcttgacttgcacaacacagactttcagtatggtgggccaatatattccttgtcgaaacactttggaggcaactgttcttgcggcctggtttgcgccatagagcccctggtgtatttccttcgccatttccccgccttcggcaaaagagatgcagcgaagcaaaggttggagtacgccggagcgatatagttggcccgagaacattttttatttcgcggctctgagctgtaagcgctttgcttctgcttcatcttccgggagctagccgctcttgaagtattttacgaatggggttcgctagtctgctggatcttcacccagtcttgcttggtcgattgccatgacatccaagtcctctgcgtgcacacttggtacgtataggacttcgaaaaaaatgcccgatgaatgtgggcccccaaaagcagcagattttgccaaggcgtctgcttgctcgttctggcctctaggtaaatgttcgaccgttatgccgacgaagcgtttttccatagaccgaacaacctccaaatacctcttcattccttcttcctttgcttcaaaggacttatcgacgtgacctgccaccaacttggagtcagggtaccgagctcgaatt

SEQ ID NO: 57190 - DNA, 1664 bp, Oryza sativa
ccaaagggtactgcaatggcaccgtgactttgtgggcctgaaaatagtgtttaagcttgcgcgaaaccatcaccaaggcgtaagcaagtttctccatttcaatgtgtcttgttttcgctccttgcaatgcttcggagacgaaatagaccggtttctagcctgactctgtttcttggacgagggcagcactgactaccactggcgaagctgccagatatagtagcagttcgcttcctggtgttgggctgatcagagcgggcgggcttcgcagatattgctttagctcgtcgaacgctgcttggcattcgggtgtccaggtgaattttcccgcgcctcggagggtcttgaagaagggcaaaccactttcggctgcctttgagaggaatcaactgagtgccgcaatttggcctgcgagcttttgtacttcacgtacgctcgacgggggcttcatttgctgaatggcatcgattttctcggggttcacctcgatgcctcattcagaaacaaggaaacccaacaacttgcccgcgcgaacaccaaaaacacacttcttaggattcagtttcatacccgccgcgcgtaagttgttgaaggtctcctacaggtcagacgcgtggtcgaaagccttgcggctctttacgacgatatcgtcgacataaacctccacatttcatcccaacttcttgtaaaggaccttgtacacctggcgaaggttgccccggcgttcctcaggccgaaaggcatcctgaggtggcaaaaggtgccaaatggcgtgatgaaggttgtcttggagatgtcggccgggtccatgtggatctggtgatagccggagtttgcatccaagaagctcatgagttcgcagccagctgtcgaatccagaagttggtcgatccgtggcaaggggaaatcgtccttcggacatgccttgttcaagtctgtgaaatcgacacacatgcgccatttgccgtttgatttccgcactagcaccggattcgccaaccactcaggatggtcgatctcttgaatgacccaagccttgagcaatttttggacttcggcttttgctgcttcttggcgatcagcggacgtcttgcgtagcttctatttccttggcttggcacccggcttgattgccaggtgatgcatgatgagatctctcgaaacacctcccacctcatcagggccccaagcgaagatatcaatgtttttcttgagcacatctatgatattgtcaacctcttctttgcccatgtcgccccaatgatacgagctttgaggggttggcgtcatcaatctgcatctttattaccttgccgtgaggggcgggcttcggcgcgtgcttcgctcggtcctgtggttcggcctcaacattatgcactgctctgttgattatggccagattgccttttgaagcagccgaaggctgtatccccttgaccacaatcactcctgccgggccaggcatcttgagcttaagataattgtgctgggaaatggcttcgaacttgttcaaggttgcacggctgaagatggcattgtagttgtacgggatgtcgacaacgtaaaactatatttgctcttcgcgtctattttcgcctgtgccaaaagctaccagcaattgtgcttgacctagaacttgaactgcttctccgctgaaacaatgg

SEQ ID NO: 57191 - DNA, 967 bp, Oryza sativa
  unsure (1)..(967): unsure at all n locations
acacttgtgtttgcatctatgtcctagggtaaaaatgaaaaagttttagtttgccctcaaattttattcatgcaagagttagatcaacttcacctaggtttaaaacggaaaattttggtccacaaaattgaagaactttcctttcaactagttttgacgaaaatttcttaatcataaaattcgggtatgttacagtacgacaccactcgagtccggatttggtgagaggaaaagggaaactgattttcaatcaatctgatctactatttccttctagatttggaaattcttcttcctcctcccagtgccggaaacagcacgaccgatctattcacgggcaaaccagaaactcaagcaaaacctagatgcaactccaaaactgaccgataaaaacttctgaaaactacgaaaatagaaccgtggcaacgagccgattccgttttcgtaggtcccgacgacaacagagacacggtggctgcgatgactgtggtacaaaacatgaccagaactcgaaactctaaatgaactagacactaagaccagcaacatgacatgacgatgcaacacaaaactcaaaaaagaaaaaactgaaaagaacaatgcaatggcacaatatggctaggtaaatgatggtatttttttatggctattttctggttatgggtagaaaaaaactcaccggggaaacctctagagtcgacctgcaggcatgaaccttgagctccactctaggctgttgttggcccgatctttcggtgagttgatgataactacgatttgggagaaacgttgacgacccaactacaaccgtactagacattattgtgttgcgccttagcgatcgatacacctctccataggttgttgatcttgccagtgcagatcaaccttattcctgcaagcaaatcaaagnnnnnnnnnnnnnnnnnnnnnnnnnnnnnnnnnnnnnnnnnnnnnnnnnnnnnnn

SEQ ID NO: 57192 - DNA, 1443 bp, Oryza sativa
  unsure (1)..(1443): unsure at all n locations
agctgggacccagggttgggttgccagttcggtctgaatcatcgtaggccttgggttaaggcaggttcgtgagggttcacggccttgattgataatattgtatagctctaggatcgtctttacaaaatagctttgggcaactaagtgacttttaaatgctgtttactgcaaaacttaacccctatattattaaccccttgtacccccttgcattaatcatgcatctgccggtgtgacttgctgagtattgtggttgtactcattcttgctcaatctttcccctcttcagtaagagaggctttggagaagatgtcttaggtggagtcctggcttataccccagttgagcgcctgtgaagatggagccctaggcccgctagtccgctgctgtttatttttgattgccaggcctgaagtgcctttgtaataatgtaaatattatcgatataataaagatgtgtcttttatatcatgtttgtgtggtgtaccccggcttttcctgggacggggattaatacactagcgttcgggaaaatgcaaatttcctcggtcgcgacatagggcgatcaaatttgctagtttatttttagtttcgccgtactattaagaggggtaatgacctagcaaagagatgattttaattgccacattaagtcattatgtatttagacttgggctcacacttcacacacacacacacacttcactcggttcggcctgaccaggggcggtcagaccggccacatagtggcggtctgaccggcgtgccctggtcggtctgaccggccacaagaaggcggtctgaccggcgcataaggccggtctgaccggcggcacatgcgcggtcagatcggcctccttgagatcgggatggtgctgctctggatggccgatacagagccgacggagccgtattcggtcagaccgagtcgatggcagtctgaccgagccgaggtcggtctgaccggccaccccatgtcggtctgaccagccaggccgatggggccctctgactgggctacaacggctagttttctagccgttgcagagtagcacggtctgaccggccacatacctccggtcagaccggcagagcacagagttgggggatttcgcccccaacggctagttttggtgggtgggagtataaatactcccccaccagcagcaagggggctctcttggcacccaattcaatttgcacacaccccttgcacctctctcacactcacttgagctttgtgttcatccatctagtgtgttagagggttgtttagccaagagtcaagtgcatttgcttccattgtagagctagtgtggcacttgatcatctccacaccgggtcattgcttgttagtcttggagtttgccgcctcctagacggcttgtggaggagttgcctnnnnnnnnnnnnnnnnnnnnnnnnnnnnnnnnnnnnnnnnnn

SEQ ID NO: 57193 - DNA, 799 bp, Oryza sativa
  unsure (1)..(799): unsure at all n locations
tttctagccgttgcagagtagcacggtctgaccggccacatacctccggtcagaccggcagagcacagagttgggggatttcgcccccaacggctagttttggtgggtgggagtataaatactcccccaccagcagcaagggggctctcttggcacccaattcaatttgcacacaccccttgcacctctctcacactcacttgagctttgtgttcatccatctagtgtgttagagggttgtttagccaagagtcaagtgcatttgcttccattgtagagctagtgtggcacttgatcatctccacaccgggtcattgcttgttagtcttggaggttgccgcctcctagacggcttgtggaggagttgcccggtgacctctctgagaagattgtggaggaggcccgacgccggtttgtgagtggtttgaaagttcactaccttcggagtgaaggaagaactaccccgagtaattgaggcttgggtagtcctctccgtgggctggctcccaccttgcccaccccttgacgaagggggcgtgcggtggcttcgtggttgagcggtggagttgggcttgcctcaacggagagtaggaaaccggcgagtttccgaacctcggtgaaaaatctcttgtctcattgtctcatttgattgtcgcatttacatttgtgcaatttactttcctagagatataattgagccactatcaccctaggcttgcaaaacatatcttagttgctgtcannnnnnnnnnnnnnnnnnnnnnnnnnnnnnnnnnnnnnnnnnnnnnnnnnnnnnnnn

SEQ ID NO: 57194 - DNA, 783 bp, Oryza sativa
  unsure (1)..(783): unsure at all n locations
nnnnnnnnnnnnnnnnnnnnnnnnnnnnnnnnnnnnnnnnnnnnnnnnnnnnnnnataaacaagcataaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaagagaattattgcgtcagcggctagggtttgcggtggaccgggtgcacggcagcggttcacgggaatgaacggccgagatcgatccatccaaaacggacggccgagatcaatcgggtctacggcggctcacggcaaacggccccgatgacgtcagcggcgacgtcacctccggcggcggctcggcggctcggacggcgcacgctcgccggcgaatgatgatgcttcggcacgaacgaaaggcaccaggacgtagagcgcgacgcggcgaactcaccggtgaccaaaacggcggcggaagatcaacggacggcgacggcgacgaggtcgaagcggcggagaagatcgggtcgacggcggcgacggtgctccggcggtcgtcggcgatgacgaaggggcggacaaggacgacgacgacttggcgaccacgatggcgacctccccgagcgacggtgacggctggagcgagggcgaagcacggctggagcgacggcgacgacggcggcgctaggtcacacggcgctagagctctt

SEQ ID NO: 57195 - DNA, 5991 bp, Oryza sativa
atccgattcgaactcggatccataattttccaaagcgatttagccgatgattcctaaatagaaaaggtagagaagatctcaaagattgtttcccctcaattcatttctccgcagaaggaaagacgcggccgaatttgaaagaatacgacggcggcccggcgctagggtttcggccggcggtggccggaggtaaacgatgagtccgacaagtgggacccacctgtcagcgacagcgcgctcgcgcggctgcgggctggactgggccgacttgggccggggaaagagagagagacagagggttttgggcccactttcggcccaaagcccaaagagacttttaaaaacctttttcaatttaaattattcatgaaatgcaattccatttattaaaaatacttccttagctcaaataaatcccagaaaaatctaggaattatataattaagcaaagtatttaatgaaattttatctggccccattttatattggaatttattaattaaaattagatcttctcttctagacttttaaaataaattctaataattccaattaaacaacaatttatatatttaggatttttagggtgtgacactcatctttttgtctcttcaatccatcatgctcccttgctgacatcctataaggtgctttagcaactggcttggttcctggtttcaactcaatactaaactctacttctctatccggtggcatacctagcaagtcatcagggaacacttctagatactcattgactattgggacaactccttttgcaattgccacattcacaaccctctttttaaactcattcatcttagaattacttttgtactcaacgttttgtccatctgcaccaactatctccacaaccttcttagcacaatctagtttgcctctatatttagacaatcaatccattccaaggattatgtctaacccgctcatatttaatagaagcaagtccactaagaatgacattcctatttacaaccttactcccaaacaaatagaggaaactaatgacttagttcccggtgcataaatcacccgtggcacttctaaagtggataaaggtaaatgacttttcaaaataaaactttcggaaacaaatgaatgggtggctcttggatcaaacaacaagaaggcaagctctaaattaacctggaacttaccaattatgacatcagttgcttcttcggcctcctatatgttgacgtggttaacacgatcacgtggggcaccttagttgatttgccttccaggctgtcctccatgagcctagaatcctccacggttctggaaacctccacgaactggtactccaccatgattttgctgggctggttgtggtgctctcaccactctgactcgtcctgttgcttgagcttttgctgcttctgatggaagatttttccatggacaattgggtctagtgtggccgatctgatcacagttgtagcacacaacattattacggggacaatattacttcagatggttacctccaaaaatgtaacatggaggctgaacttggcgtggaaatgctcgtggtggtggtggatgttgatccctataagtctaaacagacatttttgtcaacatcctgccttgggtaaccctttggactaccccaccctgttgcttctgatacctcttgcgagactcctctaagttggtacgggtctcttccttctgaatggcatcatcaacaagctcatgaagtgttgcaaatttgaaaccagacaggtggaacttcagagagtcttgcatgccattgaagaaagcttcaaccttcttagtctcagtgttaacatcatctagagcatacctggagagataggtgaattgctgcatatagtctgccacacacattcctttgcttcaaattaagaaattccattcgcttttgtgccattatcccgattggaatgtgtgctttatggaactgctaaacaaattccgccatgtaatggtattcatagttgctcctccaagtagatgcactatcagtgagctgatgagatgcatacaactccttctcacgatcattgcattgcaccgtgttcaacttcctctcaacatcacagatctagtcatcagccttcaaaggttcggttgctccagcaaacactggtggcttggtcttcaggaaatctgaccatttattacctagtgcagatccatttgatgatgatgcttctagagtacgattactcatcaactgagttgcaatagcctcaagaaacttcaactgattcattgcattaacactttgatttctctcaagggccgcaaggactcgagccaaactaggctcttctccaccattgccattactttctaacatgctgaccactgtcctaattagtcaaatctgcagcgatttaaatagagatagataagaataagcaagaatagagtaagttaagacagaatagaataaagacaaaagagaaaagaatggatagaaatgcaattttcgtaaccatgatgcataaatctacctaccacaacaaaatactttttaaaagcgaaaccaaattaacaagatgtagctacaaatcctagtggatttggcatacagcttgcataaaacatgccaatcaacacgtctactaaggttcaaagtctaattcttacgtgagaacaaggcaagagacaagaaattttgaatttagaaacgatgataagacaaaaaatatttagaaaataaaatatattttagctagtattgctaagacagagggggtaagaaagcactaaagaaggtatggaaggacgaaaagtaattaaacttaaggtttttcaatatatttttatatttaaaaatagctttttatcaaaaatcgactctaaaccatctaggtcaacctactgtcaagctaggctctgataccaagtctgtggggatacccagtttgagtacggtatctcgaaaccacccgcgaccgtccaggatttcaatcgcgcacagattgataaacagaacagtttttgacatatataccccaagtttttacataaattattacataaaagttaactaagacaggttttaggggccgactagctaaacactccttacaaacaaaagacccatacacaaaataggataaaaaacaccacaggcaatgcctgagagcagatcgacctagaacatgaactcgtcagcaccgtagaattcttccccttcatgcgccttctcagggaaggactgatcgtctgaaccacattttatgcaagaggtgagtaccgaggtacccagcaagacacatccataataatacaaatagaatgtatgcaaggcgtacaaggaatatagttcatcaaggaggtttcataacaagtcgattataaatagtttttccctacttcatcaaacatttcattcgcaaacaattgtaaatcatcattttaaaatggtatcaatattaatcaccattcatcctcatcttcaacatattacatattttaatttaaaatctactcataccatgataaataggaatcactcaatcacatagcttcttaaccggaagcgcggcaacattcgaatgatttaatgcaggggctacatttgccaggctagtgtacagggtcttgggatcacaattggggccaaacgtcgaagcctatgttgatgacattgtcataaaaagtcgcaaggccttcgaccacgcatcagacttgcaagagacttttgacaacctccgcgcaaccagcatgaagctaaatccagagaaatgtgtgtttggcgttcgtgctggtaagtagttgggattccttgtgtccgaacgggggatcaaagcaaacctcgaaaaaatcgatgccattcagcaaatgaagccaccatcgagcgttcggcaagtacaaaagctcgaggggcgaattgcggcacttagtcgattcttgtcaaaggcggccgaaaggggcttgccattcttcaagacccttcgaggggcaggaaagttcagttggatgccaaagtgccaagcagccttcgatgagcttaagcggtatctccaaagcccacaagctctggttagcccattggcagggattgaactgtggctctatctagcagcttcgcccgtggctgtcagcatagctttggtgcaagaaaccaaagcaggccagaaactagtatacttcgtctccgaagctctccagggggcgaaagttagatacattgaaatggaaaaacttgcttacgccctagtaatggcttcaacaaagctcaaacactacttccaagcccacagaatcatggtaccttcgcagtatcctttggacgaagtgcttcgaggaaaagaaatcacggggtgcctaagtaaatgggccgctgagctatcacctttcgacctacactttgtcgctctcactgcaatcaagtccctagtcctcactgatttcgtggccgaatggacacgcacgtccgtcccagagcccgagccagtcgaacagccatgggtcattcaatctgacggctcgtggtctcacaagtgggcgggcatcgcttcaatcctgacttcaccagggggtgtaccaattcgttacgcagcaagactgcagttcgacacaaccaacaacgcagcagaatatgaagcagtgttaatgggcctgaggaaagcgaaagctttgggcgttcggcgtttcctagtccggacggacccaaagcttgtcgccagccaggttgacaaatcctttaaagcgaaattagaaggaacgagaaaatatctagaagccgtttagtatatgggtaaatgtttcgccggcataacggtcgaacacttgccctgaggccagaatgaagaggctgatgcgctagcgaaatcagctgcttgtggagggccgcattcgccaataatctttttcaaagtcctgtatacaccaagtgtgccagcagatagccaagacatcatggcaattgaccaagtctagttgggcgaagacccaaatgactggcgaacgcctttcgtcaagcaccttaaagagggatggctgctagatgaagaatctatggcgaaacagttgcaactcagagctatgaattacaagctaatctccaggcaattgtatcgaaccggaatactgcagcccatgcttcgttgtgtctctttctccgaaggtgaggagatggtgaaggaaatacactaggggatatgcgaagcgcaccaggcagcaaggaccgtcgcatcaaaagtattttgctaaggcatatattggccaaccgtacttaaagtacgtgttgaacatgtcaaaaaatgtgaaagctgtcagcgacacggccgaagtcaaacagcaccacagtacgaactacagctaatcgcaccaatctagccagtcgcaagatggggcttagacatcaacggcccattcctagtggcgcggaacaattacaagttcgccattgaagccattgagtacttctctcgctgggttgaagccgaaccacttggcacaataactgcagctgcggttcagaagtttgtatggaaaaacattgtttgccgattcggggtaccgaaggagttcatcactgacaatggcaagcagttcgattctggaaagttcaaggaaatgtgcgaggggctaaacctgcaaatcagattcgcttcggtcgcacacccgcagttgaacggggcggccgaatgagcgaatggaaagatcctcgaggctctaaagaagagactggaggtggcggcgaagggaaaatggccagatgaaatgctatccattctctgagcccttcggacgacccccacaaggccaacaaagttcagccctttcatgctcctctgtggagatgaggcgatgatgccggcagaactaggggctaactcaccaagggtgatgttctccgggggcgaagatgggcgtgaagtatcgcttgaactcctagaaggggtgagagtcgaagcactagaacacatgcgcaagtacgtggcaggtacttcggtaacctacaacaaaatggttcgaccg

SEQ ID NO: 57196 - DNA, 2060 bp, Oryza sativa
  unsure (1)..(2060): unsure at all n locations
acaccactaaactcaccaactacctaacactcgaaaacaaaccaacgcatgcacttacatcccaccactgatgtaatcacatgcgagacacacacaaccaaacctaaaacaagcaaactaacacaatgatctaagacaacggtttgacaaggcactctaagtcttccgggcatcggagttgattgaaggctcgttcggctcatcttcatcatcttgagtggctccccactcgattttggaatgggtgcgcttggattcttctacttcatcatcacttacgttgacaaccggaggatccgctagggctggggtaacttctttttccaccacacgaacctttggcgccaattgatagcgagggacaaatagagctctcttccttgcggtaagagaatcctggccttctgcggtggtgcttctcccttcaaggcggctagttctttctccaaacgatccactttgtcctctagcttgcaaatcttaccacgattccgatcttcacgatcttgagctgctaacacagtctctgcacgggtttcatccatagcccacagcatctcaaccaaatgccttgggtagcatcattctcaattccgtcagtctcaaggtagctgccacggtcacttccctgtggtgacgaggatggtagcgatactcagtgtcggccaactgatcactgtagcgatcgcgaagctctcctatggcgatccttgccacctcctgacatgcatggatgtagtttcttcctccagcttcgaacatcactgaggggatatcttcgctattactgtttaaggtgactttgacccggcacttctcttcatgacgatcatgaggaatctgggcataaaaaggggcagtcccaaatcctatggcaaaggacatcgtacgcaactcctggacaaatccctcaacaccaaacaagtactcagccttgtagcgcggcatctaaagacaagtgaaaggagggagttaagacatttatccaatcaatagcacaagtttttggattaatttgaataaagttagaaaatcaaagtaaaaagtaaaccaaacttgcaggataatttgaaacagttggaaacaaggccacaaattttgtgcttttgaataacaggtttcaaaagaaataaaagaaagtcataaaatcaacatgctaaatttatttccttgcagcaagattaaataaaacaatgttgtagaacttttgctggtaaatgagccattagtacagtaatagatgtacagtactaataacactggaataaattttgaatgagaacaactaaaagagattacgaagtgcatgtgccattattttggtttaattaaaagagaaggggaggagaacagttctacttttccaatatttttagagggcttctatgggtaaccatttggcataacctagggtcaaggaggttctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacgactccattccacaggtagcttgaccagggctacacctaatcctccacaccatcagcatcattgtagaactcttcctctgatgaatgattgcaaggtgagtatatgacatactcagcaagccacgcagcaaatatgcaagtgctcaggataacaaaggatggcatagtagggtttcatttgcataaacagcatttaataaacatttcagaatttaataaaacagttaagtgataattaaacaatattaatccaacgctatacaacataccctgttgcataggcccaaccattctgaacaaccatcccggctgcacagttctatccccaaaccaggaatataccattccaaaccaggagctaatcaaattattatnnnnnnnnnnnnnnnnnnnnnnnnnnnnnnnnnnnnnn

SEQ ID NO: 57197 - DNA, 826 bp, Oryza sativa
gtctcatcaaattgaacatcggcggtttcttccacaatacctttattcttgttgtagacccggtatgccttgctatttgaggcataacctagaagaaacccttcatcacaccgactttcaaatttggttagtctaacaccctttcggtaaatataacacttgcaaccaaaaactcgaaaataggcaacatttggcttcctcccaacaattagctcataggaagtctttttcaagagacgatgcaaataaagcctattggttgcatggcaagcggtgtttatggcttccgcccaaaaggaatcggaaacaccatattcatcaagcatagtccttgccatctcaatcaatgtacgatttttcctctctactacaccattttgttgaggtgagtaggtagcggaaagttcgtgtttaatactaagatcatcacaatagtcctcgatattggtattcttaaacttggaaccattgtcacttctaattttcacaagagtgcaactaaattcattttgggccctttttgcaaactttttgaaaagctcggcaacaatacacttatcatgcaaaaagaacacccaagtatagcaagaataatcatcaacaatcacaagacaatggctattaccaccaatgctcttataggttgttgggccaaacaaatccatatgcaagagctccaatggtctagatgtggacatgatactcttagtaggatgagaacatgcaacttgcttgctggcttgacaagcactacaaagcttatctttctcaaacttcacatctttcaagcccacaactagatcacgttttgaaagtttgctcaatt

SEQ ID NO: 57198 - DNA, 1756 bp, Oryza sativa
cattacccctcttaatagtacggcgaaactaaaaataactagcaaatttgatcgccctacaccccgatcaattctaaattaaagcgctagttttaccgtcttctttccctttacttttgcgccgtcaattttaatccatcgataatcatccatgtgcacatatgaagtggacctaacttaaaatgtatagctcaaagacaacggttagtccacaattagcgcttgttattaattaccaaaattaacaccgggggcctagatgcttcagctagcagtagaaaatgaatttgataaatatgatttttctaatgcgcaaatgattaaggctgctagtaataagtttacctcttctacattattttggtggatttatgttagtaacaaacctgaaacttgggatgaattcaaaaccatgatgagaaaacttgtgagttcttatttcaaatgtactattcgtgagaaattagaacatctgaaataaggagatagaactgttagggagtacatccatgaatttaaagtttgtatcatctatagtgatctaaaagagtgcgatgaaaacaaaatgcacagatttttcaaggggcttaattttcatattcaggttgtgcttgctaatgtgatatataatcatattggacatctattcatgtttgctcatagcattgagagtgaaatcaaatgcaagaaagcatgaacaatgtgatttatctcatgtttctgaatcccctatatctttgtgcaatgatgatatgcaaacattggaggagcaatgtcttgtgcctcctgttactaacattttacaggaggttcagaacattaaacaaaaggagggagaataatgaacatgtgaaaaaagaggagaagcatgaagcacctataatatttgaagaaagtttgcaaggtaaattcaatggtgctgagataattgaaggtgagtatactccaggtgtgctacagatgtccacttttcatgctatagtagagcaaccattagtggaaccaattgctgagatgcctttgtcattagttaatttacttgctgttccttgtgataaagaagggttgtgtgataatgcttcttcacttatatccatgccacaactagtgaatgaacatgttatttctagtgtttctttgtgtgttgattttaagcatgttgtttagattgctaatgaagtagatgaacgtggattgttatcttctttaattactttgggctatgttcggtttgatgttttttgttagctcaaaaatttgaaggagaaattatttgctaaatctaatttgccatgtccaactaatgctatttttcatatctttggtgaatataatgatgttagaatatatttggtgcatagagtttacatatgttcggatttaaaacctcatgtacataaggataaaacctacaagctacataggaatattattgctaaccaaattatctcgagtttgccttcttttgattggaagaaacaagttgttttaaatggactacgcgaagagcaccatatggaaaaaccaaggacggtttttcatgaaggagaggatgatgtgaccatggctactatggatacaaccgtttctcacatcatggatgaacaagaagatatcaagatcaagtcctccatgtgctggaatccaattcggccacgtgctacactgctgacttcaaacggccgccaaatatgcatacgagctccgttttgggtccacgagtacttgatggaaagctctcggagtcgtctttcca

SEQ ID NO: 57199 - DNA, 3024 bp, Oryza sativa
catgcatacacacgtatgacatggttcaacttgagtcttctttgtgcatttggatttttggttggcattgcatattaggacccatgagcataaataaaagataaagattcactaagcaaacctataaccacacttgagcaataattataaagagttggcccactatgttgaaagtctgtgttgagcaaataaagaagtgcgaaagttgccagcgtcatggccgaagccaagccgcgccccagtatgatctgcaggccattgcgccaatatggcccttcgccagatggggactggacatcatcggcccgttcccggtggcacgaaacgggtataaattcgcaattgtagctgtggaatacttctctcgatggattgaagccgaaccccttgcagcaatcacttcggcagcagtacaaaagtttgtatggaaaaacattgtttgccgtttcggagtgccaaaagagttcattactgacaacggcaagcagtttgactctgataagttcagagaaatgtgcaaagggcttaacctggaaatcaggttcgcgtcggtcgcacacccgcagtcaaatggggcggccgaacgtacaaatggcaagatcctaaaagcactaaagaaaagactcgagggggcagcgaaaggcaaatggctagaggaattgctattggttctctgggccctttggacgacccccacaagaccaaccaagtttagtccgtttatgcttctttatggtgatgaggcaatgaccccagtagagctaggggctaactcaccaagggtaatgttctctgggggcgaagagggacgtgaagtatcactcgaactcttggaaggagtaagagtcgaggcgctttagcacatgcacaagtacgccacaagcacttcagcaacttagaacaaaaagagaaacccccaaaaaggcggtgctgtcgtcatcgactcggcggggatccggccctttcgccgaagcagggtttggcttgcgaggggccatggcgaacggtacgtttgcaatggcgaagaaagagaatgggtgaaacgcttgaggggacaagagatgctgtggaagaaagaaacggaggaagagaccgcacgcggtaaaatggcaagtgtggcggtgaaaaggaaagagcggcgggaatttatagctcacccgggcgaccgttcgactacccaccagtaataaagcaccacgtgtcgcaagggtaggcgaaacggtaaattcccaccgtccgagcggcacagtaaaaagcccatgaagggaaagcccaatactgttccgttcggcccgggaaaagaaaacatataaccaccaatcgcaggaggcgaagcgcggcaaaataataccagccgcacaagtaacaaacttcatttgcaggaataatgtaggtttcggcaggagcatcggtcgaaagaggggcgccgcataccataccacatggtttgcacggttttggccgaagctccaatctcccttgcccgtgaggggcttgttgccgaatggcatgaggcccttcgaccaagtctgccgaaacccatggcaaaggctatggagcaagaacggcgtgagacgaagagtcgtacgagtgccttgccgggccagaggcgtctcaggcgaagggtgcaaggcgaagactatccgccgaaggaagacgacttcgccatgacaagttcgcccgcgagggccgaagaagcctttccggcccatcaagcttagggactatagggccggcgatcgcctgacggcccatcaggggcccatgagcccctacaacattatgtacccctgtaaatgtccctttcataagggtaatcatgtaaattcccctgtacaacctaaaccctagtagtaagatcctgtaatggggctataaatagtcccctagggccatgtaatggggggatccccgaaaaaaggaattcaaaattcaatacatttcgtttccttccaaccactgttgagtaaccatgtccttcgacgtatgcggttgtcatttcgacaacacttataatccatctctttcaccggtaacgatttcgctgtctaaaagaaataacggtaatgatttctcctttacctccttctatttttttatctaaacaaattaagacatatttctcatttaacctgggttttcaaataattaattaaattaagactccctccaataactcgctattgattcagttgtccctgatgatccccgtaccgaatctcctaaataacccactactgattcggctatccctgatactccccgtactgaaccatctaaatctgttggcatctcctggaccgaactaacaacgccctgctcggtcctttgcatgctcgagccagctgctaacaatgcatatatctgaccactactaccgttaccgcacagatcaattccaccatgaaaacaatgcacggactctactagatctactctaaccgaaccacatcctgacacattgacatgtctattctaccatgtctgaccgtagcataagaaacgtgcatgccatccgacacaaacccaattgatacacaaaactaacaccatcgctagagtcacacacattatgcaccatggtacctccaccactagataaaccggcttgcatagattttgtcgaggagtaatcctctctagcgggtggtcgtgagggccccctttgtaagttcggccgggggaaatggcgcaatgatcaagggcctacttccgcttgcagtctaattgccagatcactctcgtggctgagtgggagatcggggattatacaggttcgggctgctgtcgagcgtaataccctactcctgtgtgtgggattatggtgaattattacaagaggtatcgagctctaagggaaacctagctgttcttcctccgagctcaagttctctgagagtcgtccccgttctcggtggacgaggtccaccttttatagttcagggggataccacatgcaccgtttgcacctaccccttcatgggaggagggggccacttgggcccaatcatacccgtatccttt

SEQ ID NO: 57200 - DNA, 1111 bp, Oryza sativa
  unsure (1)..(1111): unsure at all n locations
nnnnnnnnnnnnnnnnnnnnnnnnnnnnnnnnnnnnnnnnnnnnnnnnnnnnnnnnnnncattatgcaccatggtacctccaccactagataaaccggcttgcatagattttgtcgaggagtaatcctctctagcgggtggtcgtgagggccccctttgtaagttcggccgggggaaatggcgcaatgatcaagggcctacttccgcttgcagtctaattgccagatcactctcgtggctgagtgggagatcggggattatacaggttcgggctgctgtcgagcgtaataccctactcctgtgtgtgggattatggtgaattattacaagaggtttcgagctctaagggaaacctagctgttcttcctccgagctcaagttctctgagagtcgtccccgttctcggtggacgaggtccaccttttatagttcagggggataccacatgcaccgtttgcacctacccctccatgggaggaggggcccacttggccctaatcataccgctatcctttgcttcaaccggaagcaacatggtcatttggctacaagtggggcccagcgacgccctccgcctgacacgggggacgcccctgtcattcaatcataaatgcgtgaagacttcggcagttcaccacgcgcggcaggtgctcctgggaccatgttgatgggacggggcatacctacccccactccggctgacacaaagcgagacgtgggggcgctgccacccgtcccatcgcctgcgaccagtcacagactggtcatgcctgattgacgggggtcaatcaagcggcgccacacgcccgcccacgccgcattaaatgcggtgcgggacggttgggggcgcacgcattgaaagcgcggagcggtgtcccttgctccgcctcctccccccgccacgtggtggccgggcgagggcctcggggtggcgcgtgctgagggcccgagggtcgtgacgtggtaccccaaggccccctggccgtgttagcactacgtggccgtttcccccgagggggcgggggaaatccaggccactcagccacatggccatacgggaaaacggtttccctctactgtgcatacccctgggcccatatcactgacagta

SEQ ID NO: 57201 - DNA, 3192 bp, Oryza sativa
  unsure (1)..(3192): unsure at all n locations
nnnnnnnnnnnnnnnnnnnnnnnnnnnnnnnnnnnnnnnnnnnnnnnnnnnnnnnnnnnnnnnnnnccaaagtctctcctccttccctctcttttcctccctcctccattccttctccttgggccggccaaggccgccctgccccctcccgcctgggcctaccccggcccaggccgagcggacgtcttcctcccacgcccctgacatgcgctgactgcacccgaccggtgggtcccactcacccgagtcatcgtcctcctcccgcccggctcctccctctcccatgaaaccctatccgtttcctccctcaaatccgcgtgaatcaattcccttcattccaaattgattgggggaattaatcccctttccctcctctctctttcccccataattcccccttgaatggcgccctcagttgcccggaacggccgcgcctttcccggccaccctccttggccgccggccgacttttccgccaccattccccgctcctccctgtaacatacccaaaagtccaggactcagaaatttcttgtcaaaataattagaggttaacttctccaatttttgagagccaaacatttccgttttaatttaggtgatgaccaacttaaaccattgcatgattaaaatttgagaacaaaataaaaccttttcattcccaacattatactagaaatgtcatcaagcatttgagcatacatgtgcataatgcatgcctaggctcgagtcccttgtgcatttggattatggtctcgcatttcataataggtcccatgagcataatctaaaagaattatattactaaacaaacctatagttaatcttgggtgataacatgtggacttaatattaaactcaaatatcatcttctcagcccaaaagaagtttaatgtaatccctgtaacaatattaggtgcaattaagaagtgggaacacatatataaagtaaagtaatcctaattctctaaaatattatgtgcaagttaaaatcatggaaaaaaattagatagacaatgtttagcacaaccaattcactataatattggtacaagttaataactaagtttaataccacaaataaatcagtcaaagcagaaaactaaaaggaatcaaattaaattttaatcggctaaagccatacttcatccaaaagtacatttaactgctcataagtgaacatggaaaataatttattcaaattctagattatttatcatgcctaaatataatttttctagaattgtcctcctctgtttaagcctcctaaaaatcagtctagctttctaatagcccatctttgtttaatttctgtgagcagtctacccattatttttacgtgcaaccaaagaaaatggaatctagatataaacatctaccaccagtaaaatctacactaattcttctagtccacatattaagatattgagttgcaaacttagggggaagaaataattctgaagattatccaaaaactaagtctacccaaactcctacccatacctctcttcccagcctagcttccatcgacatggccccacctggcagcctctccagctcgcccttcctctgtccctcatcctcagccgaccaagaaacacagagagggagagatcgagagccgaccgagtcctggacgtgtcgacgtgtggtgacgacgtgtcgatgccttcaagtcactgagtcatgcctccatctcctctagaccgagtcgcccaactccacacatcactctggagctgaagaagccgagggagaggtcctcagcctcttcgtcatcctcaacttcgccgccaggcgtagtgacgacgaccttcgccatctccgtttgagtcaaggtcacctccatctctttcgcgttcccatctctccacacaatgccgagcatttcctcttttgaccaaaaccactctggtacagtgcatcgccgggaacgcaagccacaccaacaacgccttggagcacgcaccggagcgccgccgcttcaaccatcgtcgtcgtccggccattctcgaccacctcggagcaagccactgcgccatcgtcatcgcctcaacctcctcttcaatacgcctcaagaaacccagccgaagatgtgaaggactcggagaacacatcttttcttcaccggcaccgatctagaatcgcctccgccgtcatcatcgataaccgctgcctcggtgagccattgttcgattccttcagtatacaccatctccttgacctcacaaccctcgtgcattcttgcttgaagcagctcattgtcccgttcgagccgtcgtcgttcacccgaggaggagcactgtcgccgagccgttccacaagtcaccgctgccgccaagaccgcgacaatcctagcttgacccacggtgagcatcctgaaggctagaagaccacatgcatgcatccttttcatacggaatcgacttccatgcacacatgcactttcaccccaagaaccactgccgctcacactcgccatcggcgctactccgatgtcctctaaccaataaaactagaggaatggaatcacgagagcttgctcttcattttatctcttgacctcaacctcaaacgagccaccgtttgccgccggcgagctcgagatcgagctcagccatggctagctctgctctgtctagagcagagggatgacttccgtgaattagattaagtgcagggatccgtttacaattgtagaaacacactgacatatgggcctaggactgcgggttgattcctagaaacctcaagggcctttgtgcatattggtccctcacagccatgtggacccaatcctttaaaatctgaagaataattaagaaaatgcccaaacaaatatatgtttagcagaaaaatgcacaaagttgtaaaatctatataaaatcaaatatagctcattttgaagtgattctagttgctgtagattcttgaagttatgaactttattccaggcatataaaacttgacactcactgtacaaataatgtctctaaaatttatctaagataggtcatacataaaacatgtacaaatttataaaacacatagaaaattcatctcaactcattttgaaacaacctcaaacactgcagattcatcatcatgcactctctggttaggtgaaataaaagtaattacttactttgcatcaaatgcctctaaaactattatatctaaaatgattagttt

SEQ ID NO: 57202 - DNA, 3673 bp, Oryza sativa
gtgtgtggtgatacattatgacttattgttaagtatggcaataagagattgattatgatggaattatgaagatgttaataatgaaacttaaaacttgtctttgttaattgaagcatcaactcctttacaaaagaattgcgaaataaaacttgctttatgctgaaattaaactacatattgccttcctttgaatatatgccttacatgtagtatggtacgattgacttgtgcttgccagtacattaacttgtttaatgtactgactcttgctcttgatataaccttttgtttgcaggttagacttagtctttgagtgatgcgggttccgattgcttcttttaggatgagaacttaatgggggtaaacccctagtcggtgtgcttgtgattgggtagtcaagcttccgctgttctctaataagtctatttggccggtcggcctatgtaattattaagttgttgtaagtcttaagtttctttcatcttagttgtgtttgctatgtataatcatgcttaagatgaaagtgtgaatctagtgcatatcctgggaactagatttacatgagtatgagttaggaatatttgagaggttgtagatctttagccatttttgtcaagtctcctgaatgtgtaacacatctggtcgccgccttctagtggtttgacgggcacatatcaggctgaagttgactggcaggctaagggctcagcaatgtctccaatatttctctctcgaggcgtcggatgtttcattatgcttgtttgatgacttgaattatttacttcatctctcaaatataatggaaggtccggagagtctacgacagcatggtatcagagcaagtaccgactatatggagccccttaagttggtcgcttagaattgcttcttaaaaaaaaattattttgagggctttgctctcaaatacaaattatttgcgaaaatcatattcaatcttatatctcatccctctatagagattgttttactttatgtctcatgttttgattttaaaactcgtatcttgctctataggaccgaaaccttttgaaaatgttacttctgtaaaaatgtaaataaaactacttataggtcatcataaagcagtaacaaagtgttttgaaaagtttcgaaatccatttgcaaactactcctatgtactagcacggatttgtaaaatatcgggttaaacatagcccctagtgaatgggttttgaaaatgagtctataaaatttaaaacttgctagataatatagagattctatctccttatgttatctctgaacaaaaaaaaatgaatttggtgggatttttcactttcctctcccgatatttcaaaattttaccggtatggcctaaaacatgtagttggtatagaatagaatttgctgtgcttaaccctctagattgtttgcttagatggaccacccaaaattcatctatcctctggaccaccctaacataatgtgactaaaagatgataacatttatacaacctaaaacttgattaaagtttcattttgtgccgattgttcttttctggaatcttgagtcagtctgcttgttaattttgtctagactaaaccgtaggtgataaacctgagaatttttacatgcatcatgtagactaacccagtaagcttcatgaattttggcataatttttagacccctgcatcatagtgaaacaatctagatacttagcataatcatattctggaaatttgtagtagctgcattcatcttttcatgtagcccaaaacataattgataaaatatgcatctttttacagtagttttcatacataacctgtaggctccacgaattttggttgaatttttgagtcattgcgtcatggcataaaagttcatataatactgtatagttctgtcctgaaatctgtagattgtcagtttcacaaatttgtgtagcctaaactataaatgataaaatcatgattcctttagggtagctcctaatctaacccatctatctctctgatttttgtcaaaatttttgtatctttagagctagacctaaaaatttgattaagacagtaaagtgatgaatcccagcacctagcactcatgtcggattaacccctatcctttgaagattattagaaaaccctagtgcaaaaatttattttattttaagggggatagtaagccatatttgtatcaaaaccaaagataaaatttttaaccttgcataattcttcttagacctaaaatagaaatcccattctaagtaagccctgtaccgttaatatgaccaaaattaatgattagaggtctatataaccataggttgttaaaaaaaatgtgtgtcgaccttaataataacagtaagggaaaccttaaatttgtaagtgcttaattttaagaggttctggctgatccttgttcttcattttattcttatagatgcctaccatgtacacaccgtactgctattgccgtgggttcacctggaactcaactcagcatgtgctatggcttatgcttcagtacgcccggttcacctatccacctgagtatcatatcctcaagaaacccattggaacatcccaaaccgcagtcatggttcgtgtaagcattcggggtagaactccactagagaaagaccttcaatatactggttatgggtgggatattaagtccgctttgcaaaactgtgcttatgttgctatcatccgccttcctatgagctacctgagttagaagaattttagtgctacatcccatccttaactgagggagctcaacacactacttacccagggttagctgaaataggtgtaggactacataccccatacctccaacttgcaaactttgtgcgctcactagatatgcgttatcgctcaaccttagctgagctgcaacgcgtccgcaccaaggtagccactttagaaagaagcattatgccaaggtatcgccagggacattatacaccggagttcatgtttggtgaggatgccatgcttgcaccagcacaagatataccaccacctgttggaatgtatattgaaagaagcccaccttcgcgcgtcgatgtcaggactgcttatcctccacttggaaccactggactgtatggactgccagagtatgttcaatggtatggtcgagtcttcaagctgaggatgagagactaagcaatagtcctatataacctctactgtcacggtagtatgacttaaggacaagcttaaggaatacgctaggtatatggtggcccattttggaagaaaatcatggtatgtaatatatgtaaacgagggcggcgctcaccgcgtggggggtcacggccaagtagagtagcggcggctcctctggcctcggggccaccaggatcggaggggaggtgaggtaggccttcaactggttgagggctcactcggcctcctccgtccacacgaacggccctgagcgcttgaggagcttgaatagggatagcgccctctctcccagtctcgatataaatcgacttagggcggccatgcatccggtgacacactgcacatccctaagcttattttctcgggattagcttctatgcctcgagacaagaccataaaaccgaggagattgcccgccggcacaccgaacacacacttttcggggttcagtttcaagcacgtggacctaaggctgtcgaaagcctcag

SEQ ID NO: 57203 - DNA, 2117 bp, Oryza sativa
aaagtgcaacataaaattgagctagataaaatttcattaaatactttgcttatttttctgtttactggatttttctgggaattatttgagcaagggaattatttttaatcaacgaaacatcatttcatgaattattttaattgaaaaggttttaaatcttcccctaagccgttgggctgattccagcccatctccctcctttgggtgcacggctgtgcagctcagtcaggccagccgagctttccccttctgtttctttctttgctttattttcagtcggcccaatactgaaagtctactttgcatacctgtgcactgttcttcttcaacctctggcagccgacctgagaccgaattggctcggttttccccctccaaatccggcctttcctttcatgcaatttctaaaactagttgaggggatttgtttcccttatcctcttttatcccttcccccaaaaatccgattttatccctttgaattagatgcgaatttggattcgttttcgaatttctctccaaactaaccatcggattttccggctcaaatcctctcgtttggagtccgatctccctcacccaagcctatataaagcatcccctagtcgtcctctttcgtttgcctcaagtccaagccgcagccgtcgcctatagtgcagccaccgcgcaaaccctagcgccgtcgccgccgtagccgcttcagccgctttgcgccaccgctgtggtcgtcgccgccgccttccgtcgccaccgtcggattcgccaggtgaaggagaatcctgtccgccccttcgccgctgctacatctcgctggagcgtcgccgccgtcgtcaagccgagccgtgctgccgtcggagttcgtcgttggtcgtcgttcatcgtagttctttgcaccggtgagtttgcgtcgttgtcttcttcttgtaggtgccttcggtttagccgccagagctctctatcgtcggcggagtcgtggtccagtgccatggctgcgatgatgtcatcctgacatcataaatcctttatttaaatcgtaataattttctgtattagatgaaaatctgattaaacttcataaattcataactaaatcatcgtaactcggattgaagtggttcaagttgctatattcatctaaaattgatatctatatgttaaaaatatccacatgtactgtttatacttgtttttgtactgttttgttgattttgttcatttgctttagtttccgacgttccggaggagaacgtttacattgaagaaggtttagaagcgtttgaggaagctcaaggtaagtcactcagatcccaaacaactctttgagcatgttgatcccgtttaaagctaatgttttatttcaacttatgcattattttccaatgtcatcgagtggtgagcctttcccaattaattagtggccgaagatgactttattttcatatgggttataaattgattagcttgaaccttatatattggtttggttcagctaaatgctttatatatataattgcttagtcatgcttagaaacattagctcattaatgagatgaatcaccttacattatacttatggttgtatttaatggtagctcacgatggttaatcgtgttatcataattacttgatattaaaaccggattaaaggtgagctgtgagcacatggttttgatggtcgtgctcatgacaattaaggaccggttcgtaagctattgttgtgaaatattaaccgtgccaaccagaagccagcgtgggcaacggctttaccttttgtatagcatagttcattatggggtgccagactgcgaagcggtgaaaagtccgtggggtcgctggggagtccatgcctctggttgtagagggggtgattatggtccaggtatggtgcactgtggtgagttgtgttgtgcgaggggtattgtcacagttcctttccgatgtaccgtggtagtattgaggcgcatggtgacatgtcgtggagctgtgtcttgagggtacagtggtatatctctggctagagtaaaactattcgaatacccgtgcccgcggttatgggcgggtctaacaatgtttttcgtgattagtctcacactactcattaatgataatactgtgat

SEQ ID NO: 57204 - DNA, 2573 bp, Oryza sativa
  unsure (1)..(2573): unsure at all n locations
ctggagattatcctgattcccaaaagttagtgaataaggctattcgccagaggacaaagtacacccgcatgaagcaaaaggaacgccggattgctcaattcaagacacaccaggggaataatcaaaacccgcgtcttactttaggaccccagtccatgccacagggaggttcttcgtctgttgttcgtccgcagcgtcagttcttcaacaacaatgccggcaacaacatccgtaatcaagctccacgccctgttgcagcctcgacatagcaacaacctgccaagagggagcaaggcagcaagcccgtggtgtgtttcaactgtggagacccaggacattacgctgacaagtgtccgaagccccgacgtgtgaaggttgtccctacccagagcaactctaccgcaccagcatcaaaggcccgtgtcaatcatgttgctgctgcagaagctcaagatgctccagatgtgattttgggtatgtttcttgttaacttagttcctgcaacagtgcttttcgattctggtgctacacattcattcttatctatgagttttgcgggaaatcatgggatggaagtagaagatcttagacgtcctatgatggttagtaccccaagtaatcaggcactctctttgcaacgtagcccctctgtcagaatagaaattcaaggcgtaccatttctggccaatcttatcctattagaatccaaagaccttgatgtcatcctagggatggactggttagccagatataaaggtgtgatagactgtgctaacagaaaagtacctctcaccagcaatgatggtcgagttgtaactgtttatgcattgtcttctgagtctttaaggtcaagactaaaccaaataactttggaagagatttctatagtccgggagtatctgatgtgttcccagatgatttacctggtatgcctcctaaaagggatatagagtttagaatagatttggtaccaggaacaactccgatccataagagaccttatagaatggcagccaatgagttggcagaagtcaagaggcaagtggacgatttgcttcagaaagggtacatcagaccgagttcatctccatggggagctccggttatttttgtggaaaagaaagatcatacccagaggatgtgtgtggactatcgtgcattaaatgatgtgactatcaagaataagtatccgctacccagaattgatgatttatttgatcagcttaaaggtgccactgttttctccaagatcgatcttcgatcaggatatcaccagttgagaatcaaagaggaagatatacctaagacagcttttaccactaggtatgggttgtttgaatgtactgttatgtcttttggacttaccaatgcccccgctttcttcatgaacttgatgaataaggtgtttatggaatacctagacaagttcgtggtggtctttattgatgacattcttatctactcccgaaccaaagaagagcatgaagaacatcttcgccttgcactggacaagctgcgagaacatcaactgtatgctaagtttagcaagtgtgaattttggttgttcgaagtgaagttccttggtcacgtcatctcagcaggaggagttgccgtcgatcctagtaatgtggaatccgtaaccaattggaaacaaccaaagacagtttcagagattcgtagttttctaggcctcgcaggatattatcagaggtttatagagaatttttccaagattgctaagcccatgacacgattacttcagaaagatgtaaagtacaagtggtcagaagaatgtgagcagagttttcaagagttgaagaatcgcttaatatcagctcctattttgattttacctgatccaaagaagggattccaagtgtattgcgatgcatccaaatttgggttaggttgtgttctaatgcaagatgggaaggtggttgcttatgcatctcgtcagttacgtccgcatgagaagaactacactactcatgatcttgagttagctgcagtagttcatgcgttgaaaatttggcgtcattatcttttcggtactcgtacagaggtgtataccgatcacaagagtttaaaatatatctttactcagccggatctgaacatgagacaacagagatggttggaattaattaaggattatgacatgggaattcattatcacccgggaaaggctaatgttgtagcagacgctcttagcaggaaaggctattgcaatgctacggaaggacgacagttgccattggagttatgcaaggaatttgaaaaattaaatttgggaattgtcagtagaggtttcattgcaaccttagaagcaaagcccactctaattgatcaagtgagagaagcccaaattaacgaccctgatattcaagaaattaagaaaaatatgaggagaggaaaagctatcggtttcttggaagatgagcaaggaactgtatggttgggcgagagaatctgtgtccccgacaacaaagatttaaaagatgcaattctaannnnnnnnnnnnnnnnnnnnnnnnnnnnnnnnnnnnnnnnnnnnnnnnnnnnnnnnnnnnnna

SEQ ID NO: 57205 - DNA, 783 bp, Oryza sativa
agatgttaccttaaaggagccctttgccatgagacaaagtggagcgaagagtgatggagcctccttgatggcaacaacggccatcttcttcttcatggagcttgcatcatcaccaccttcttcctcggacccggatgaggcgaagctctcctcatttgagtcccattccccaatgaaggcctcaatcttcttcccttccttcttaagcttccttcctacatccacaatactccaaatatggaagctcatagccttgaggtgagtagacattttaattttccaagtggagtagtttgtgccattaaacatgggagccttccctacatggtttacctcgttcgaaatcttctctctaggcggtgaagcccaataaagagaaacctggctctgataccacttgtaggatcgagatgtcgactagagggggggtgaataggtgatttaaaactaaataacacctaatcaaatctaacctaagatgctaggcttggtgagggtgaactctaactaagcaactaagttatgttttgcaaacctagggtgatagtggctcaattatatctctaggaaagtaaattgcacaaatgtaaatgcgacaatcaaattagacaatgagacaagttatttttcaccgaggttcggaaactcgccggtttcctactccccgttgaggcgagcccaactccaccgctcaaccacgaagccaccgcacgcccccttcgtcaaggggtgggcaaggcgggagccagcccacggagaggtctacccaagcctcgatcactc

SEQ ID NO: 57206 - DNA, 706 bp, Oryza sativa
acattgtggtctctaggtcttccaacaaaagtccacaccttgtttcttgcaaagttgttgagctcttcatgaatagcattcatccaatccggatcataaagagcttcatctacatgttttggctcaagacaagaaacaaacgagtaatgttcacaaatcgaagcgacaggagatcgagtttgaacacccttactaatgtcacccaacacttggtcaattgggtgatccttggaaagagcggtgtatatccgtggaggcataggtggatcttgtgccttctccttctccacttcaacttgagcttgacttggcgaagcggaagtagatggctcatcttgagtggaggtggatggcttgtcttccacttcaataggcttgacatctccaatagacatgttcttcatagctctcatcaagccttcatcacctacatcatccaaattctcgtgcccctcttgggagccattagtctcatcaaattgaacatcggcggtttcttccacaatacctttattcttgttgtagacccggtatgccttgctatttgaggcataacctagaagaaacccttcatcacaccgactttcaaatttggttagtctaacaccctttcggtaaatataacacttgcaaccaaaaactcgaaaataggcaacatttggcttcctcccaacaattagctcgggtaccgagctcgaattcgccc

SEQ ID NO: 57207 - DNA, 1342 bp, Oryza sativa
  unsure (1)..(1342): unsure at all n locations
tgacccgggaaaggggcctttatcattttgccaagtaaacaagattcgcatgtctcaaatgattcaaattcaaaagagtgtagaagtccatctctatgaagcttctccatgcgtttctcatttatatgacccaagcgacaatgccaaatataggacgttgcctttttgcattcatgttatagactgaacatccatcaagattcacaatgtataagccattcatcatgggtgcatggaaatagaaaatgtcattataatagactgagcaaccgtcgtccacagatctaaaaccataaccctctgcttgcaaacaagaagcagagataacgttcttacacaaagctagaatgcaataacaattatttaactccaaaactaatcctgacggtaaagataatgccattgtgccgaccgcaacagcaacaactcttgctccattggccacgcgaatgtccacttcgcctcttgctaagctccaacttctttttagcccctgcaatgatttgcatatatgagcaactgaccccgtatcaaatacccaagaatcaataggaagtagcaagattaatttctataacattaatacctgaggtggaactctntncatcttgctgcttctgcttgagctgctctaggtatttctttcagtttctcttccaatgacctgtctccttgcaaaagaagcactatgcatccttagcggaccctgtcttttgaaccttggtcttagagttgctagtactcgtgatctcatgagagtttagctttctcttttgaccactcttcttgttgttgggtttgcgcttatgcataaccatcacatggttggagtttttcttaatgctttcctcggcagtctttagcatcccatgcaattctgccaagatcctgttcaggttgtttatgttgaaattcattatgaacggctcaaacctgggagggagcgattggagaatcaaatcagtagccaactctcggctaaggggaaaaccaagcttatccagactctcggtgtaaccaatcattttgatcacatgtaggctcactggattaccttctgcaagcctgcacgcaaacaagaactttgaggtattaaacctctcagctcttgcttggtcctcaaacatgttacgtagtcccgtgattattgtatgatcattcagtgcctcatattgcctttgaagctcaggggacatagtagcaagcatgagacagcttatatcaaggtattcattgcatcgcctttcatgctccctacattgagcagcaggagcattgttgggcaagtcagctggaaaaggctgtgtaagcacaaactctttgtgctcttgcctgagaacaa

SEQ ID NO: 57208 - DNA, 2052 bp, Oryza sativa
  unsure (1)..(2052): unsure at all n locations
gagcattgcgcacccgcagagagcttgtacgtgctgggctgaactttttcactttcacccatctagtttttcgcttttttcgctcttgatgtacagaagggcttcggcttcccctacccaggttctcgtggcgcacctgagcgcgaagcggtctgccttggagcggctggacgtgtaccgtcttcgacttccgaaggccgaagaggaccttcaccataaagaggacaaacgccgagtcgtgccggacgccctgaagaaggcgagcgcagagaacaagtcccttgtgggggaaaataaatctctctgcaccgacttggagggggtgaacaatagggccgccgaaagggagaggcagcttgctatggccgaagaaaaagtcaagtctcttgaggcccggcttggcccagccgaagctgctgctgaagctttggcgccgacgacagagtctgccaaacaggcttgctatactcttcggctggctctcaactaccttggggcgcatgtagaaggcgctctgggtgaagatggatcagcgttcgacttctctgagtggacgcaggatgcggccggctcagttgtcgaagcggctggcgcatacggcgactgctgcgcacgagttgccgtgggcttcatgctcagcattcttcacgaacatggttgttaccatgttgaggactttccccaaaccgtgaagaaggattggcccgaaagttcccaatccgtcacgtttgctttgaaggcctttcggaagaacttctgggaaagcggcggtaaggatggggcgaagacccggcttcgcgagcagctggagaaaatagcaagggccgaagatgccactgccgccaacactggcgaagaccccgagccgtcggggccggctgttggccgtgagggccaaggcactgaaagccgacaccaccctgaagtgtgaggacctttgccctcacgtttttcgcttttttagacttttatagccgtagtttgtttacatatatatatataagtgctttgcatgttcggctggagccggttttttttaaaaaccccccttaaaaattttcccccttttttgggggtaaaaagggcccccccggttttggttggcctttttgcttattaatgaaaagtttttgtttcaccaattgtgcaacttttctagaatgtgttattgactttgttagcacttcttcccccttcgctgcactattatgccttgttggtaggattttagccgaaagtcatgcgttcggccccccttggggattggtgaaataagaacgagaagttcgtggcagtgaaggatttgccgaagaccaagtgtctctttcggcctatttaccgcgaaatgttaataaatggcaagagttacaaggttataaaagtagcggggtggatgcgtgcacatccaggtcgaaccctggaggactgtgaccgctaccatgtcgctcgtcgtgcggaaagcaccagtttgggttgtgtataatattagtagtgatgacgaaccctgttcgccaatttgtagcgtagactgggacgaatgtataaatgatgatataatatttttgtaaggtttacttacataaatacaacagatttgcaccttcgcttactttacattgtgaatctttcgaacatattttcgtgctatcgttcgcatagtcactattgtgctgtcgttaggtcgaaacgtgtcggcccctttgcgtactatagcaaaaggatatgtttatttctcagatctcttcttccgttttcggctcgtggcaggcgtgctacgaagcatcatggcatgtgcataagccgagtacaacagtgttttgacttgtattttcaaaaatcaagctgtcgtggtttcgacgtttggtgagctatgcttcgaccgattcgtttcgcacccctggcgtgttcgctgatcaggagtttgccttggggtttttccacgaagacattgttcacaaaaaggaaggcgaaaagacacaaagatttttatactggttcannnnnnnnnnnnnnnnnnnnnnnnnnnnnnnnnnnnnnnnnnnnnnnnnnnnn

SEQ ID NO: 57209 - DNA, 1191 bp, Oryza sativa
  unsure (1)..(1191): unsure at all n locations
nnnnnnnnnnnnnnnnnnnnnnnnnnnnnnnnnnnnnnnnnnnnnnnnnnnnnnnnntgagattagaaggtttcatggtttggcaggatactatcgtcgcttcattgaaggattttcaaagattgccagaagttattgaagaaggataaatcttttgagtggtcagataagtgtgagaagagtttccaagagttgaagacaagattaactagtgcgccggtacttgtgttgcccggttgccaaaaggactttcaggtgtactgtgatgcatctcgacgaggatttggatgtgtgttaatgcaacatggaaaagttgtatcttatgcctcgagacaactgcgacctcatgaagagaattatccaacacatgatttggaattagcagcagttattcatgcattgaaaatttggagacattatctactaggcaacaagtgtgaagtgtacactgaccataaaagtttaaagtatatttttactcagccggacctgaacttaaggcaatgcagatggttggagttaataaaagagtatgatgttgacatccagtaccattcagggaaggcaaatgtagttgctgacgccttgagtagaaaaggacactgcaataatgcaatgattcaacagtgtccagcagagttacagaaggaagtgcaacaactaaggttagaatttgtaaaacctggacttttgttagctttagaagttaagccaacattttagatcaagtccgagaggcacaaaaggaagacaaatatttagaacagattcggcaggatattcagaaaggagtcaccacttattctactaaagatgagcaagggacaattaagtttaaaggaagattatgtatacctgataagaaggaaattagggacatgatacttgaagaagctcatgattcagtattttctattcatctaggtagcactaaaatgtaccatgatttgaaggatacattttggtggaagaatatgagaatggagattgcagaatatgtcaacttgtgtgatgtttgtcagaaagtaaaagcagatcatagacgaccagcaggtttgctacaaaccttgccactaccagaatggaaatgggatgaaataggaatggattttatcactggttttccaaaggttaggtcaggttacgatgnnnnnnnnnnnnnnnnnnnnnnnnnnnnnnnnnnnnnnnnnn

SEQ ID NO: 57210 - DNA, 1935 bp, Oryza sativa
  unsure (1)..(1935): unsure at all n locations
nnnnnnnnnnnnnnnnnnnnnnnnnnnnnnnnnnnnnnnnnnnnnnnnnnnnnnnnnnnnnnnnnnttctagcctaggaccagcacggtacttgactttgaacaattattcaacttttcattatctgagttgagcatttgctattcctttgctacatatataagcctacccagagctccacagatttgattacagccataccgcaagtatttgccaaggcatcgatacatccaacctccattggggtgcttggttgagtcggtgtatgtcaccattccacttgcattggtaagatcttgtaagagcttggttaaaagcttgagtgtgtgtgatttttgagctgccactacctagtagttaataggaacgcgcatatttttgggtatatttcttgttttctactaacaatggcagggatacgcaagataattggggatagctgtgctcaacatcgacatcttcatcaagacatgaggagtgatcaacatgaccattatgaggtaagtgatgatgttctaggtaagatcaaatctgcactgccttatttcgagggaaactatgatcctcatgcttacattaattgggagctagcggttgatagtgaatttcaaaagcatatcttgtctgagaaacaaaaggttatgtgtgcctctagtgttttaattaaacatgcttctaatgattggaaacatctttgtaggcataacaaaataccacaatcttggaaagacctgaaacgatatttcagaaatgtttatgttcccatgtattatgctgacattttgttcaacaaactgcaatgtttaaaacaagataccagaactattacttcatactatcatgatatgcaagcttgtttattacgttgtggtttagatgaatgcgaagaagctaaagaattgaggtttttacgtgggcttaacaaagaaattcatgacatgcttgcttgtgaaaagtatagatctctttctcatttgttacaacttgcttgcaatgctgaaagtaaaatagagtaggatatgaaaaagaaacacgctatgtctttgcctacaattactaaccatttgcaggaagtgcgttatcacgaaaaggaggaaagagacatgaaagagccaccaattccattgttcacactcaagttcgagacacctccatcatctgaagaggacatcaaaggtaaacttaatggtgctgaaattaataaaggtgagtgtgtcgttaatgaattgaatctgtccacatttcatgctatagtagagcaaccattagtggaaccaactgctgagattcctttgtcacaagttgatttgtttgctgttccttgtgataaagaagagttgtgtgataatgcttcacttatatccataccacaactagtgaatgaacatgctattactactgttaattattactgcgctgattttaagcatgttgttcacattgctaatgaagcagaggagcgtgaattgagatcttctttaaatactttgggctatgttcagtttgatgatttttgtgagctcgataatttgaaggagaaattatttgctaagtctgatttgccatgtccaaccaatgttatatttcacatctttggtgaatataatgatcttggaatatattttgtgcatagagtttacatctgctcggatttagaacttcctgtacatgtggataaaacatgcaagctagagagaaatgttattgctaaccaaattgtctcgagtttctcttgttttgattggaagaaacaggttgttgtaaatggactacgcgatgagcaccatatggaaaaattgaggacggttttccgtgaagaaggggaggatgatgtgaccatggctactacggatacaaccattgctcacatcatggaagaataagatgatatcaagatcaagtcctccaagtgctggaatcagattcggccacatg

SEQ ID NO: 57211 - DNA, 4833 bp, Oryza sativa
  unsure (1)..(4833): unsure at all n locations
annnnnnnnnnnnnnnnnnnnnnnnnnnnnnnnnnnnnnnnnnnnnnnnnnnnnnnnnnnnnnnnnnaaccaatcgttttaataacgaaggataaatttgaccaatgaaatccaaagcccaacctcgaaacagccatggttttgatgatagaattcaatacggcgacaggtgccaattgaacattgccaaaccgttgataagctgtgcatcccctatagtatttgaaataatcatcgattattttcggacaatagaaccccgctctcctaagcaaccaattcatcttatgggccaattgatgaatttccgcaaatcccttgacgtacttctcccatagcaaccttagaaaaatcactccatctatatttcggcgatataactctctatcaagcaaaatgtatttgaatgcttaccaccgaatttcccgatcaaccctaagactagaatctttcaaatattccatcaaagggattttccagtctacttctgactcatctatatctatatctatactaatataaaaatgaggagttgcacccctccaatgctacaggccaaatcatctggatcaatccgtaccatccatcctcaaatcatgtaaatcttcaccatacgatttcaccacgtcaccacgtgaatacacagcctctccactcgtgcgacggactgcactggatctcatgtctttgattccactttaattcccctattgatgtcaacaacatgtgaccatgtgaactatctccagtggttgaattatctcgaggaaatgtacttgaatgtctctggttaatctaactaataattcacagcagttatacattttattgaatcaagtatgtgcagtttcacataataatttgcagtacatgtgtttgatttgatgcacgttatcttcaataggtccagagggctggagctacacaatcagctaggtcttaccctggtaaattgttttcggttattctcaattgccgttcggtgggctcaggataaccgatcgaaattagagttgtgatagttgatttgcgggtctatggaggggaatgtggggtttacgctcatgattttgagggggtttctgttcggttcatgcaccggcctcctatagtgtctttgtttgatttatcctatttgcgcacataatgcaaaccatttaggtttacggtggtcgttggacagaagtagcatgtgtttacccatcggcgtgcccaatgcccacctacatctattttcttgttagcgaggatatcgatcaattgactgctcaattaatcaattcatctattgtgtgggttattcaggtcaatcggctcctcccctcagcccacttccatggtcaatgcagtaagctctacatccggacctgctgcaaggccaggtcaatacactccatattttgcttcatttgcaaatcggttttgcagctaactaattggatgagaacagatgtcacatgtatgtactgctcatatatcttgatatcatctcgatctcacaaaattttgatggtttgcttctcaaattgttttttactgctcaatgtaatttttgtattccgttttatagcgatttgtcatatacttctaatagatctcaacctgtattgctgatggttgcttcttccagctcaatgctttttctccctgtattccatactcctgatttgtcataagtttggagatctcaaatgcttcactatatgacaacatgtacagttcaagctgaatagtttacagaggaacataatagtagctgtctaggattggagataatttctgaacctcaagacctcattttttctacatatacggccattacgattgtttagctgtatattaatgtttagttatatatgattgtttaacttaattatatgcttatcaaattgctttgaattttatccaaattccacttggaacatcaggtcagcagctgtcaacaggtgcaacgaggacaaatttgtttggccaatgttaaattcactcgacatattttcaacagaaattttatttgtttaattctgttcatcgagccgcgccccgccgtcggtcattgtcgtcgtgcactgatccactatagtcgccagccagacttgtgagcgtgacggagggagcacgccactcttcaatctctacctcaagcggcgaccctcaccaatggtaggagcagttgtgtcctcctcccctcctccttactgtgctttatttggggatccatccatgatacatctcagtctcaggttctcccgatctattgaatcacatgcatctttcctttacttttggattcaaatttcttttaggtcttggcactttagttaactaggaatttctgcaatttctgcaatgttgagcgatttgggtgtttcagtggcatatcttagtggaactcagtagttaatgtcttgctcagtttgcttgtaaattagacagacttcactgaagttgctctgaactgtttactctcacaaaattacaattttatgagtgttttgtatccaaactatatttatctaatttacagctgaagtagctccagcgaaacgtaatttcataatgcatcgagaataccttgtggagttattactggtcgcatgggtgaatgaactcatcacaagcattggcatcaatcaacttcatgttccctctagaactactaaggaaaaattcatgacatcaaagtttatacctgacaaccactgctcggtggataaggtgagaagcagcaaagattttgatttctcctttaatataaattattttgtttggtttaaatatttgtatactccctaaaatttattcccactattattcaagcttgaagccttgaatgttgttcactaaaggaaagacatgccgtgaatgttgtataatctattgtctcctttggttttcaaggtaactgctacattgagagagactggtcttcaatcatcaattttgatttcttggttttgaaataccaaaagcaatgaatagtcagatgaggttacttctgtattacggttaaatgcactggctgtttcctttaagctaggtttctatcaattttacttgaggacacgttttggtttaagcaagcaaattttcttgctaaatttctctatgcagatatattcctttagaaggaaaattctgcaacattgtttggatggatatacatgctccgccagttgttctcccatgatcagcagtagcttgatgatcagcagtagtgaaacatgttgattagcttaacccttacctgaattattgtttttatccgctggttgcaaattgttatggtgaggggatatagttgcttatttatgataaaattagttgctatgatttaactggtggtggcacttgcaaaagtttctttcaatgaagtgagtactgaaacttttttttagacggtagcggaaacaaaagggaccaaggagggttttttccttattcttcaccgaagaagtccctcatttgtcacttatttttcatgttagcattagtggtttagaatgaatttgttgtttttaactattaataaaattgaatcaataagtttaacatgacgtgcattgcacgtgcacgattactagtgggcacaaatgtccgaattcacaattaattcggcctttgaatcaattgtaatgtgcccccagcttcctgtctgggaccggtcagaccagccacgcaatgtcggttagaccgccccgtctgcccgatcagaccggccatgcagagccggtcagaccgcctctggtctatgactttgccaatttcttccatacttttgaaatcaagcatcggcttttagtatataaatttttttcacattatagccagatgcttggtgtatcaaattattgaaccaaaattccttctttctagacatatgaaaaattataacacccaactaatatgtctagatgaatactagtttcaagtggctattgaaacaataatcattaaggcataaaaatacttagccacttgaagtgtgattaataatgaatcaccaaagtcatatgtctcgtacacatgaattacaataaactccaaatataaataatcggcttgagcatgtatgcaaaatattaaaacaaggccaatgttccaaaacataacaactctaggcaatattagaacaaatcatcacattggccgttgacataagccaaattactaagaagcaaaactttcatggtgtagtaattatgaagtctatatcttatatggtgatccatagaaacacgcatgatttggcttttagtaaatatcaaatactcatgagccaaatcatacttcaaataaattatatgccaatttgccaattctaccactcggaactagcatttgcaacatatatgtataatatcaatttgatgagcaaacacatgtgctagatagcaagcaatattttaacatggcataggcatataatataatgatgaccacaataaatccataccttgccttagcgtccaacaaacggcagctcaaagatgtgatgttgtatccatcgccgttcttctctctttatttcttcataagcatattgacgtcttgccccccaagcaaaatcggctttcttgattgcgcgatttcgaaggcaagatgaataccgcactaacacccatagcatcatgtgaaggagacttatctctaatgaccggtgattcttctctcatcaaattggatttatcactactttgggaaatcaccgatctcttaacttttacctctttgagtctccacacttgcctaggtgatgttcgaggctctaaattattacatgttttgttctccacatctttggcctccttttcttttagacctatggctcga

SEQ ID NO: 57212 - DNA, 2716 bp, Oryza sativa
tggtctttgctccatcaagcttgcatctttaaaataatcatcaaactcatgctccatttgtgaccatgtagaaattgaactaggaggaagtaaactaaaccatgttgatgcaaagtttgacaaagaaagatgaaacaattttaacttaagtaaatcatcactactggccttaccacatttgttcaataaattggccgatatgctcaattgttgttctagtatcttcacctgtgaatttcgtgaagttgagcacctcaaatccttgcgggtatgggacataatctacgtattcaggatatggcctttgatatgtatgcatagctactttggattctacactgctaccctgcaagacattgtcactatctattccaacacccacatggccgatctataattcggtcttaggtaacaatactaatttacttttgcttgtgacacaatccgaactgtcatatagttcggctatattttcaatggtgctattgtctaagctagcaacacaatccggaccaacacttagttcagctatattagttattgcattgttgcatgaattattagcacaatccgaaccgtcgtttggtttggctatacatgttattgcgttatcatctaaactagcatttaagctattgtcatccactcggctttcctgagccagagcttcatgcaacacatgatcaacatcaaaaaatatctggccattcaatttctctttaatagaatcaagcaatacattatatgcaatgtcggccaaatccttttcagttgtattcaaactaaaacatcgacttttagcatctctaaacctctcaatataatcagtgacagattcattgtacttttgcctaatcgatgttaaatcagacaacctaaactcagtttcactagtgtaaaaataatcgtggaatttttgttctaattgagctcaagtatgaatagaatttgccgacaaagaagtaaaccatgtaaaagcaataccggacaaagaataagaaaacaagcgcaatttaaatgcatccgaattgctagcctcaccacattgcgccaagaattgacctatatgctcccatgtagtcctactatcctcatcattaaacttagtaaattcgggaactatatagccacaaggatatgggacattatcataataatcaggatacggcttttggtaaaccctagcacgattccttaccttgataccaaaattttccctaataatagtcctagtccgatcctccatagtttcaggccttggtggatttggtggcctaaaaagtggttgttgtggcacaatattattatattggccatatccaatgtcatgaggatatcctctattaggatcattataagcattagggatatgtgtagtagcatgacctacagtattaacaggtgatgaataataattaaaatcagcactgctagtggtggtataaaaacctgtagaaatttcaagggaactggtctgaccaggtattgcccagctatagatagcctggtctgaccggctaagcccccgatctgaccggcccatggcccgatataaccgatggttagtggtcggtcacacaggccacagtaggcccgatctagccaagatagggcacggtctgaccagctatggtgggcacggtctgaccggcatagtacacggtctgaccggccatggtagtcacagtctgactggcatagggcgcgtttagaccggtgtcatgaccggtcataccgtcagttaggttctgcatatagccgattcatgtgtaatcggctgtataaacacttgttgacccctccatagcattataagcatattatatagaagcaaaactaggagtagcagatgcatctacacaacgatcattaactttttgaatagcaagggatgggttaggcgaatcggagattacctttggtgaaactacgacctgagttgacgaagatattcctcgattaattctagccatataactcatagccaaaaccttgatatatttgacttgtgtacttagcaaaatcccaaaaatcaagagatcagtagccttggtcggccgatctcctgtgcagtaagcaaaatatttctcaaaaattaattagccgatgcaagctagacaaacagcattggtaagaaatttttattgatatacgtgcgcagtagtagatgggctttgatggatcggtctaatgcacgaacgttcgctggcagcgaacagccaacaaaaaagagaaacggagtgtcatagccctatcttttaggacgaggtatttaggattacttatttctgttaatatgttgcataattattatttttgcattagcttctacattcaattaaattttggagcaaattatacccctaattggcaaaacaaagcatcatctatgtgtgcattaagttgaacattagggaataactttcataatttattcaaatactagattgtttatcatgagttaacaaattttttctagaatttttacagtcagttctgaccttattaaaattcattgtagttctcagcataccccttttcacctttttgccagaattaaaatatttcgaatttttaagtgaaactttgaaaaatggaaactaggtaactcaatctatctccgcactagaacatatatttttgacactcttgtagctaggtcaaactagttacccaaggagagagagaaaattcttgaaaatccactattttcaat

SEQ ID NO: 57213 - DNA, 1773 bp, Oryza sativa
  unsure (1)..(1773): unsure at all n locations
ctaagagtgcccgtcgtggtgatcttctacttgtgtcatcagtagagccactgcctgctgcttcggtggcggcggcgcaacccttccggacacgagcgtcgtcggagaccaccatgctcgtcacgggtgccacgggctacattgggtgttttgtcgtccgcgagctgctccgctggggccaccctgtagtcactgactcgctgtcacgcgctcccggagcggcttgggcggccgcaatggccccgacgagttggtcgcggacctcggccccacctgcgtcgtcttcttcgacgtcaccgaggcgggcacgctcctcattgacctgttctcgcgtggccccatccacgccgcggtctgctactctgctgcctcgccaaccgcggcggtggcgtccaggactcgtggcgcgtggaaggtgggagaaggacggaagaagacgaaaaatgaagaggatggatggaaaaagtgacggcagtggtacggttttaattttgtaaaattttagtggcatagttataaatttgcagtggcatgaatcaaattaacccatgtttctaaccttcctttatctatcccgggggcccagctcgacatgctcccacctatcactgacttaggctctccaccaagccccatccaacctctaggtcgtgcacccacctgttgacggtcgttatcgatcagtttcggccgtcaatattaccaaaacagaggagacctagtgatgcttgcaatgcatatatctactagaatataatatcccactactataaggtatactaaccttttgcagagaatgacaataaagtggaggagaatcgacatcaactcaatcgataaatcaatcggacgatgtcgagaaccagacttatgtatgaatgggccaagaactcagaattaacacgacacactgagccaaaattcacaagtctacggagaggaacaccagaggaggacaccagccaacttgtgggctggttgggccagcccagggttcggccgaaccaatgctcgcgccgatggatgcagggttttgagggaacggtggagattcacgccctatggcggttggagggtattaccgacctttccaaccaccataaccgttactacctgcctatttaaggagttcactctcttcacttcaacacacaccttaagcatgagctcgctcatttctctcaagtttagtttagtagtatctagctggtggaataggaatagagtagaaatcaggagtccggaagcctttggaagagtttggatatggctctagtagctttccttttctcttttgtaagctttgtacttttattagaatactcttctatatacatttatggtattgaaatattttccgagtatatgagtacctactttacattatgttcatgctatactgaatatacggttagcatatctgggagatgctttggtgagggtataatgtttgcttatgcaattactctatgtcatgacgatgatattagagtagtatctgatagtttaggcgtggtgtctagattacgggatatcattatttggggttataaactgtggatgagaggtgagctactgatggtgacagttcagtacgagtattcctccgcactggtatataatcctaagttaattccctgcggagggtattcctctgtatttagccccggttgtatggtcatgacgggctgtcgtaaggaactcggcagtnnnnnnnnnnnnnnnnnnnnnnnnnnnnnnnnnnnnnnnnnnnnnnnnnnnnnnnnnnnnnnn

SEQ ID NO: 57214 - DNA, 1278 bp, Oryza sativa
  unsure (1)..(1278): unsure at all n locations
nnnnnnnnnnnnnnnnnnnnnnnnnnnnnnnnnnnnnnnnnnnnnnnnnnnnnnnacgattcaatttcacaaatcaacatagcacaacacatagacaaattataatgtgaacttcacatatgaatcaaccgaatgcataagatggtcacaagtatatcaatgtcataccgaccatccatcatagcacaagttcacattaagaccacataaaagggctcataaataaatataggctattacaagaccacgaagggtccaaatgacatagagatcaacaaaacgaaaaagaacacacaatatagagtaatagcccatacccatacataatatagcccaaacctccttaacctattagatatcaggtgactaacctcactaccactagtcccaacccacaagacatagaaacacacttttctcccccttttggcatcaagtactaaaaagatcttcattcttgtggtggagaaggaggacgcgccgaagtggaaggatgatgagcatcacgacgacgatgatacacaaatgcttgggtactctccaaagtttggactcgagaatccaagacacccaccgtagtatgcaatcttcccaccgaagtattcaagttgccaacatcggtgcgcaagccacgaacatcctcatgcaaagcttcatacccggtagacaagcgttgaatgctttcacttagggtattaatagccccaagtaccgggttgaagtacttattgggttgcattccaaaataagcatattgtggatggaaaaaagcacttggatcatacccatgaggaggaggaggaggggctgcacttgagcttgcaccttgatcaaaagttggttggtgcacaagaggagctctaggagtggagagttggagacgaggcttgtactccttatgttcttttaaattgtgaccaatttgtcccaacttgctttgtcaacctcattatgtagggagcataatagattccttatctaatagttgcctttgagatggcaatctccttcatcataaggttgataacatcaaaccgacgaccatccaaaattgcatcaatgacatgccaagcaactccgcgtatgtcatcattgttgccgcatcttgggaggatggtggcccttactatgcggttgatcacacttgggagagccctcaaacccgccacctttccatatgtgtgccttcccccttcttcataaaactgagaaaagtgatcaatnnnnnnnnnnnnnnnnnnnnnnnnnnnnnnnnnnnnnnnnnnnnnnnnnnnnnnn

SEQ ID NO: 57215 - DNA, 1975 bp, Oryza sativa
  unsure (1)..(1975): unsure at all n locations
nnnnnnnnnnnnnnnnnnnnnnnnnnnnnnnnnnnnnnnnnnnnnnnnnnnnntgcctcaccatcttcaccattgccactcccattgtcatcaccatcatcacttacttacatctcatcaccctaaacattttccatattttcatcatcactttgaacatactcatctccgcttgaatcctcattctcactgacgggatcgggcgtgggctcacgacgaccaaggcgagtgcggggaggcatggctaaaaaacaaggagcaaaggatggataagcaaaaattttagaagccacatagtgaagtgggagaagggggagtgctgtctgtcaggggcagtcagaccgagagccaaggccggtcagaccgcaagccccaagtcggtcagaccgacgtccataggccggtcagaccggcggctcacggccggtcagaacgacggtcctcggccggtcagaccgccactgacagtagcacaaccgaatccttccacaatccacacaaatgattctaaaaaaattgctaggacaaagtcgcacaagattggaacatgaacatcaaggtgtaggtctatttcattaagattgaagcaatggggaaactatccttaaccctagaaattgaaatagaccgatttgagagaatgcacaagagggagagtgatttaccagttgaaggagttgaatcacaccaagaaactaccctctattggtgcaaatcgaagaacacctcttccttcacctagggttccatgccatggatcacaaattcaataaaaactcaaacaaatccatggaatagagagaggaagaggaggagattcacttatggtgtaacccgagtgattttgacggttgaaccggatggatttggtggagggaggtggctagggtttggtagaggagagaggaggagttttttcgacttggggatgaatggggatgagaaaagaaaaggtaggtgcgggatggaaaaaaaaagggtaaaaaccttgggcccaccagctcggccggtcagaccggccctctgcggccggtcagaccaccccggccacgccggttagaccggccctatatgggcggtcagaccgggcagcgccctgccggctgtgcacagcccttacacaagccggcaacccccacacaataaaattcaacaaaaatttgatttttggagcaattttgaaatgtgtgagttgaaatattgccaaccattcataatatttgaaatttatgaagatttgcaacaaaagtcacttgagtgctaggaggtgaccttttatggtctataggggtttttggacgaatttgattttcaaacaacttttgaaatatttgatttttgaatatgatttgaataaaaaaaacatttcaaatcctcctctctaccaactttgttttaaaacttttctcaaattccttctcaaactcattttggggtttaatctcattttggccaaaaacaagattctagtttcttcaaaagagggccaaaaggccattttcatccaaaatacatttttcttgcaataagaggcttggaaaacatatagggacccttttaaacattttccaagagatagttttcaaatttcattgattttgcaaaagttttgacttatgttgacttggacatttgaaaatactactagcaccactagttgatttgctcacatataaagggaggtagagcacatgcaaaattcccccttaatgtgacatgctccattttcgcaatgaagaaccaaatggcaataaatccaaagcataagagcaaataagaccaaatatacaatatgcaaaaagaagcaaccatggtgcaccatctcaagccacattagagaaatttatgacatttaactcattcctcaacttgcaaaagcgggtttcatcaagaggcttggtaaagatgtcggctagttggtcctcggttcttatgtggctaatgactatgtcacacttggcaacatggtctgtta

SEQ ID NO: 57216 - DNA, 724 bp, Oryza sativa
tcgagctcggtacccatccttgagttgcttgatttgaagtccaaggaagaagctcaactcttcaatcatggacatctcaaattccctagacatcatatcaccaaattccttgcaaaatacctcattagtagaaccgaatatgatgtcatcaacataaatttgacacacaaagaaatcatcaccaatgatttttgtaaaaagagtggtgtcaacttttccaattttgaaatcctttgacaaaagaaaatctctcaatctttcataccaagccctaggagcttgttttaaaccataaagagcttttgagagtttgtaaacatggttaggatatttaggatcatcaaaaccgggaggttgttcaacaaagacaagttcggcaatttcaccatttagaaaagcacttttcacatccatttgaaatagttttatatcaaagcatgatgcaaatgcaagaaggatgcgaatagcctcaagtcttgccacggggccaaaagtttcaccaaagtccaaatcttcaacttgtgtgaaaccttgcgccaccaaccttgccttgtttctcaccaccaatctgttctcatcttgtttgttcctaaagacccactttgtccctatgacattgtggtctctaggtctttcaaccaaagtccacaccttgtttcttgcaaagttgttgagctcttcatgaatagcattcatccaatccggatcataaagagcttcatct

SEQ ID NO: 57217 - DNA, 908 bp, Oryza sativa
cagcatcggctttagtcttctccacttgtataatttcgttgcatctccagtaggtacttgaacatcttgagactcctccttggtagtaacgacctccagagctttggcttcttttctcacccacaccttctttacttttttaacctttgatccaccggaccgattcttgtgtgagaaacggtcttgtcttgagttaaatgaatgacttggaactgtcctaggtgattccttccattcttgatgaaacgacataggtgattgaggcatccacggcatataatacataaaaggataaccgtatagcgacattggatatggataccatggcgttacaaccggaggtttgtatggagttggtattgttgatggctccgatttctttgccgtttgaccaaatctcttcctaggagacgatcttggtcttttcgaatcactaggccgattatcaaatcgatcggccaatcccttcttgtatttagccataagcatctcaacagtgagcttcggctttttagtcttgttggaactagatgactcatcttttgtaactttataatcttcggccttagcattattaatcctaattgtcttgggccgaggatctctaataataacatttttccctttcgtggattcggcttgactaggccgaatcaacactttcttgttgtcaaagtcaataggactaataggaagaggattactagccattccagtcttaggcataggtgtaaccgaaatagtttcacaagtgatcgatgaattatcaattggtctttgctccatcaagcttgcatctttaaaataatcatcaaactcatgctccatttgtgaccatgtagaaattgaactaggaggaagtaaactaaaccatgtagatgcaaagtttgacaaagaaagatgaaaca

SEQ ID NO: 57218 - DNA, 1298 bp, Oryza sativa
ccaaccctgtgccatgacatctcgactaccgggccgcagctcgtgtagccttcatttgtcctagagaatgtccatcgacccccgacttcatccatctccatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgagaattcccaaagtctaaagttataaaaccacctaatattgcctaattaatcagcgaagcatctacctaaattcatactagtggaaccatgaatagaatacccactagttggggttttgtttatcctagggtgaacaaggtaataataacaatagcaataataataaggtcataacaaaggtaaataggcatggctaaataaaacagtgataacgcgggaatttaaataaagcgataatgcattaatttaaattaaaataattttataaactgggattcaatatgctcaaggatgatgtgacttgccttgctcagagataacggccttccgaaccttcggcgacggccgcgaaccacgcttcgggaacctccggaacgacgaaagctacgcgaagcacacaagcaaagctacaagcctataaaaaagcaataccaatacataaaaagaaagcacagagttctttaggttataacaaacattaagagacttgaacgggtcgattcggagttcgtatgaccaagatatgatcatccgaagtttaatgatgttatatggagatttacgggttattataattaggctttgcaactataaaacatgtggaagcgctagcctggaaaagacaggaaggctgcgctgttgacatgcggaccccacatgacaacctaaaggaccgcggtagaccgagtacacagagacggtccacgggtcgacgaaagcggaccccgtgtgtcaaccaaggcgagtggccgacaaacggagtccactagacaccacacgggctgcacacgtggaaaccacgcggctaccgagcgggcacactaacacggacactacacggtcaccacccgcacacgtgaacgactaccgacaccggtacacgggtaccggggtcgacgaccgcacaacgggtacggggcgacaccgaaaggacaaggacggggcagt

SEQ ID NO: 57219 - DNA, 997 bp, Oryza sativa
  unsure (1)..(997): unsure at all n locations
nnnnnnnnnnnnnnnnnnnnnnnnnnnnnnnnnnnnnnnnnnnnnnnnnnnnnnncttctgaagcagctgtcacagcctgattttctgtttcaggatttataaattatttaataaattattaatagaatttatattaaatgttcattaatttacaagtgaagttaaatgtgggaaataaaatttcctaaatataaagcatggctggatttaattcttattaaattctccatgattaattatactctctgaaattttctcggatttttcggagctcaattcttaattttaataatacaaagaacatttcagtaattatccacatattaaattaatcattaaatggtcttattacaatcttgttaagtactttgggtgtccaagtattttcaggatttttcttgaaattatttgagcattggaagtatttttaacaattcaaagatcatttcagtgattaatttaattgggaaaagtaattaaaatccccttttcattttcgggccgaaacaggaaaagttcacctttaattcttggcccattcttccttcttttcggcctgcagccctctccctctctttcccgaagtccaatttgcattcctccttaggctgtgtatttgaggcccagccaaaagtctaaattccctccctgcgctactgttcatcttccagctcaggcagagcccgagccagccgtgctcgtgcacagttgccgccgcctctcctcccaaatctggcctccacttccccggcgccgaagacctttagaagtacctcgccaacgtgaatccaagcttcgccgccgggggacggtggtccagccgcatctcgccgtcgcctcggccgtcgccctcctgtgccgccacctctctcggctccgcaaggtcaagagcaagcccggcagccggttcccttgcgtcgaagaccccgggaagcccgtcgttgcagtcaactcgaagttcgccatcgcgttttgatctccggcaaggacttgctg

SEQ ID NO: 57220 - DNA, 1832 bp, Oryza sativa
  unsure (1)..(1832): unsure at all n locations
nnnnnnnnnnnnnnnnnnnnnnnnnnnnnnnnnnnnnnnnnnnnnnnnnnnnnnnntcgttcaccggtgtagtttatccctagggtcttaatccaatctaacctaatccgatgtttgtctagcgtagtcgtcgtctccgtgtgttgccgccgggtggccatcgtcatctctccctctccgatcattttggtttggtgagacttctattcgtgttccttcggtttaggttttaatctctcatatgtgtcgtcgagtagccacgttgtcgctgccacaccgccgtgccgcgcttagctgctgctttagtgtgcgctagctgcctagccgccgccgcgtcgctccctgcctcagtcgtgctgttgcgccgtgccgttttgccgttgccggccaagctgctggtgttgcgatgccaccgctgccgccagcgccttgttcccatgccgtcgctggtgtgccgtgtcgcagcttgtgtgccgcttaaacctagccccccgctttagccgttgctcggtaatcaagttgtctagccgtaggtgcatccctaggttcctaccggcctatcatttgccgtaccggggctttaccgtgaatcgtgtctagcccaccggtttagccgcagctgttgttgagtcgttcgctcgttcgttcgaacgaggtgttccccgtgcttcgttcgttcgtctgtgtggagtcgtcctttagtttagagctgtccagagccgccggttccgttcgcctgtttcggtttaacatttggatgatctcgtgtcacgtagaattgactcgttgagtcggtatctcgtgaagcccgcttgccggatcgacccaagccatccgatattggtcaactcttggtcaagattaatctcagccgtcaaaaattgatataaatccgttctctcttttcagtggcatattatttctttttaatatatatcatctaccaaatataatctaatctttttccggaggttgttttaatcttttatctcagttataaatcattcgtaaatgatttaattaatttggaatagtcttttctttaataggtttaattggaattaaatcttgtaaaattcgtaactaattcatatgaagtcagaatgaggccgttcaagtctcataattcatctaaaatcatgatctacatgtttgtttactttaattgtactattcatttggtttttattagtgttttttcttgttttgcgttttaggtttagacttcccgttgtttcggaggatcattcgttcattggagaagttcctgaagacgaattgaagatgcttgtttgtaaggcaagtcacacagatcccccaaacaaccctttgagcatgttgaacatgtttaaagctattgatttatttcaacttatgcattgttttcgaatgtcattgggtggtgagcctttcccatttaattatggccgaacatgactttattttcctatgggttataatttgactagcatggaccttatatattggattggttcagctagatgttatttatagttgcttagccgtgcttagaaacattagctcattaatgggataaatcatgcttcactatcacttatggatatttaatggaagctcacgatggtcaatcgtgattggttaattaattaatttgccaaataaaacttgataaaggtgggttgtgagcacatggttttgatggtcgtgctcaaggcaattaaggaccggttcacgagtttcggttgtgaaacattaaccgtgccaactacaagccagcgtgggcaannnnnnnnnnnnnnnnnnnnnnnnnnnnnnnnnnnnnnnnnnnnnnnnnnnnnnnnnnnnnnnnn

SEQ ID NO: 57221 - DNA, 2792 bp, Oryza sativa
aaccctagccgctgacgcaataattcccttttccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtactgtttatgcttgtttatgtgctgttttggtgattttgctcttttctgcttagattccgacgtttccggagagtccgttttcgcaggagaagaatttgaagagttccaaggccagcaaggcaagtcacacagatcccaaacaaccctttgagcatgttgatcccgattaaagctattgtttctattcaactattgcatttattttcgaatgtcattgggtggaattaacctattgtttgttatagcccttttgttcttgattactttattccttgataccttgggttattataacttgactagttgggctttatatattggttcagctagatattagatatgaatgcttagccatgcttagaaacattagcacactattgggataacttatgattcactattaattatttaatgaggacttaatgatagttcacgatggtcaatcgtgattggttaattaattacttgccaattaaaacctgataatggtgggtttgtgagcacatggttttgagagtcgtgctcatgacaattaaggaccggttcacgagtttcggttgtgaaacattaaccgtgccaaccacaagccagcgtgggcaacggctttaccttttgtatagcatggtttattgcggggcaccagactgagaagtggcggagataagcccacgggggtcgctggggagtccatgccttgtttataagggggtgattatgatccaggaatggtgcgctgcggtggattgtgttatgcaaggggtattgtcacagctcctttccgaggtaccgtggtggtattgaggcacatggtgacatgatgtggggctgtgtcttgtgggtacagtggtacacctctgatcagagtaaaactattcgaataaccgtgcccgcggttatgggcgggtctaacaatgtctttcgtgattagtctcacacctctcatcataataaaagatgctataactggtaataatttgtttagctcctggtttggaatggtatattcctggtttggagatagatctgtacagccgggtatggttgttcagaatggttgggcctgtgcagcatgggtatgttgtacaatgttgattaatattgatgattaattgctctactgtttcacaattctcaaatgtttgctaaatgctgcttttgcaaataagccctatattatgtcattctttggtatccttgtgcacttgcatatttgctgtgtggcttgctgagtatgtcatatgctcaccttgcaataatcaatcaaacctcagttgaagacaagttgcgatggagaagacgtttggcttataccccagttgagctgcctatgggagtggagccagagcttcgctagattttatttttccgctgcagttttcttcgtggtgaggactaagtgcctcttatgtaaatatttattgctttagttattttgatgaatctgtatattaaactgtcagttggtgtacctcggctgattcctggacgaggatttcatacacaaattagttcggaaattactagtgaatttccgggcgtgacagcagcaaaggaggctgtttggataaagaaatttgtttctcaactaggtgtgatgactagtgcttctagccctatggacctctattgcgataatagtggtgccgttgcacaagccaaaaagcctagatcgcatcaaaagtccaagcacattttacggcgttatcacctcattcgcgagatagtgggtagaggagatgtgaagatatgcaaaatacatacggatttgaatgttgcagatccgttgacaaagccactccctcagcctaagaatgaggcacaaactagggcaatgggtataagattcattcatgattggctcgagtgcaagtgggagactgttagtgatatgccctagaggcaattatagagatgattgtatcacatactatgtttacatatttatccgacattgttccttgaaatagatagctcattattggttaatgaatatgtgattcgtttatgagactctatatgttttttgttactatttctaaaggatctctgatcaaatatcatatgtggaacaaatatgtttatatgatcagcatatgtattaattgatgatcatgtctcatggatcatggtatagagataccaaattaataatgtggacacatgttaatgaacatgttgttgaatagacccaacatgagacactgcaagagatatatgtgtcgtgtcatcaatgatctcatttagtgttggtgttgaatccttagacctgagatataatctatcaagttatataatctatcaacaggttcgagtgaatgattgagctattagaggatggcacatatctagccttgagcttaatcgatatcgtgaggcaaaggggttcacacaagtatacactagaggttcagccgatatgatctttatgtatgcccgatgggtcaatacgttctgctaggggtcactgttgacacgtggactgaaaaggagttttcgggttataaccgagtatacatgaacctacagggtcgcacgcttaacgggccggaataagaggattggatggatatccaatatgagctta

SEQ ID NO: 57222 - DNA, 4829 bp, Oryza sativa
ccattctcacttcacacacacacctcaagcaagagctctctcatttctctcaagcttattttattagtatctaggataaactctgtaaccacaatataccaggagtatttctacgtcattgttgagtattatatttctagtaatgtcgttaagaaataccaacaagcatttctggcgccgttgccggggaagattcataatagagattacatgaactaatactttatatttacctctgtataatcattttcctttgcaggcttaccttggttgttttcgcttttgttgtgaaaacagggtagtgcacgactggtttcaacttgacggaaaacttcaaagaaaatctagaagctttcttccggtgcgtcaggccgcgagtcgttgctccacagaaaactctaccgacaaagaaaccagtcgtaccagcgccaccaaccttcaagactatggctgacaagacccttcgcgagtttgctgctccctctgctgacaatgtggccattgggccacaaatcaacatgggagacgtggatttcgacttgaagtccagcctcatcatgatggcgaaggctagcccattctgtggcaagcctaacaaggatgccaatgctcatctgcagcagttcctggagatctgtagcacgtacaccatcaagggtgtcactccagacgccgttaggctaaggctgttttcattctcccttctcgggagagcgaagcagtggttctatgccaaccgtgctgctgtcaacacttgggacaaatgttctacggcattcctcttgaaattcttcccgataggcaaaaccaatgcccttcgtggaaggatttccagtttccagcagacgagggacgagtttattccgaaagcatgggaacgactgcaggagtatgtggccgcctatgcctgtcctcatcatgggatggacgactgactgatcctgcagaacttttacaatggactcaccccgatgtcccgtgatcacatcgacgcgacagctggaggagcattcttctctaaaacggttcgaggagccgttgattttaatagataagatggtgtccaatatgggttggagcgaggaacgactccagatccgttagcgaggcatgcacaccgtgaaggagtcggaattacttgctgccaagctggacctcctcatgaaacgcttggacgaccacgagaaacgaccacaaggcaccattaaggccttggactcacacgttacgtgtgaggtctgcgggtcactctgggaatgactgcccgtaaacccgtgaggaggcgatgtacatgggcaacaacaacaacgggtatcgtccacaaggaggtcaggggtggaaccaaccacgcctatatcatcaaggaggtaacaacaacgatccagagaagaccatgccgcaggagtactgacacacgattgctgtcgtttcctcaatggagtaggaaaccgtcagtggacgagcaattcgctcgttttgttgaagtaatccagaaaatccacatcaacgtgccgttgttggatgctatgcaagtgccaacatatgcccgttaacaaaaggacatactgaacaacaagagaccgctcccaacaacggaggtagtcaagctgacggagcaatgcagcaacttggtactccacaagctcccagagaagaacaaagatccgggatgtcctacgatcacctgcttgatcagggtacaacagttcgaccaggccttgtgcgatcttggagccagcgtcagcgtcatgctaaaggacgtctttgacaagctcaacttcacggtgttggcaccaacaccgatgcgtctacaactggctgactcgtcagtccgttacccggcagggatagtggaagatgtgccagtcaagatacgggatttcttcatcctggttgatttcgtggtactagacatggacacgggaaaagagacgccgttcatcctgaggcgcccgttccttagcaccgcgggagtcaatattgacgtgggaacggggagtgttcatttccatatcaacgggaaggaggaaaagtttgagttccagccaaggacggaacaatgctccatggtcaaaataaagtacgggccgaacccacagaatattcaagtggtcgaagtggagccacccaagacggacagcctggtgaagttcatgcagaatttcctggagaagaaaacaacgatgcccaggaaccgttataggaagacaccggtaaaagcaagtacaccggccaagaagctagagcagctggctcaaaggaagccgccgtccgcaccaaagccaaggaaggtgtggaaggaaaagccaaagacgcccgctccatcacctccgaagacgggtggaaaatccatgaactgaatcagaaggaggtacaatcttgcacgtcgaactttaaatgacgcgaccttcgccaataggtaaattggtatgtatccgcatatttattttcaacaatttaattcttgcatcaatacatgtttgaatttcaaaattgcatttaggatttttgaattttcaggaaattcttcaaatgattttttcagagcaagccaaaataaaattttcagcgaaaattcactgtgccataaccacactaaccgttggaatccaacggccgaaagtggggccggttgggcccaccaggggttcggccgaacccactggttcgaccgaacccgaacccactggttcgaccgaaccagccaggcaacggttacctgccacttttggcagggtaacggctagtgggtcccacatgccatttctgaccgttgtgggtaccctataaaagccagccggccaagagagggaattccaccccatttcaacacattttcattccctctccaaagtttgttctcaagttcattcaagctttgataatttccctcaaattcaaacgcttagttgcatatatacaagttgctttggtgaaactaaccggcgggtgaaactcttgctattctaacccccgccgagttagtccgttcttattccattgtgcagaatgaggaggtgattgtctcgtctgttcaaggggtccggctcttcatcaagtcatcatgacgagtctagtactcgttcatcagctattgtctcaatggaagacgccgaagctccgcgacgactcctgaacgacaccgatctcgaccttgtcggtgatcgggagagacaagcctactacatgctgagcgaccgggagtatgctaacacgcgagaatactctccggagctgctgaaaaagataggtatggatgttgaattttgtgctatttggaaagctgttggttggcagaaatttgttgtagtagatgagcctagttctcgtttgcttactttgcaatttctgtgcactttgaaagaaatagaagatggaatttcctttcgctttttccataaggagtatacacttacatggaaaggcttaagtacacttcttggttttcacgtatcctgtaaaatcgatctttagaaaggaatttctggattcgagaaaaataggtcttgggaagatatttctagtgctccaatttgcaagaaacctaggacgaatgatatccataatcctacacttaggcttatacacaaatggattgctatgacttggtttcctagaggtgatcttagacccattagggaggatgaattgattatcatgtttgccatggttagaaagatcaaaattgttcctatgaaatatatgataaggcaatggttagaaagtataaagttctctgctcctgttgagtgcacttctctgattactcggatagcaaaagggctaggggtcgttagcgaccaaattgcttttatctcagccactcgtccctgtattgatgagacctatctagtgcaagggcatattgtgaagcatggaataaatggatctttgatttactttttccccggttgtacaaatgaaatcccattgccaaatgcggggtatcatttgtacaactgccatgaactaaccattcccctgcagaccatagaagaatctcgtgcaggtggagcatacagggagacgcgcaacatgacaaggaacgaaagagaaagttcatcatcctaacacccgtgcagatgtatgaggcaggttgggagtcaactagggatgcacccggatggatccaagctccacgccacagcatcggagtctcaagctgggcgagtgctagtaaggcccggtggcgtgcgcctcatgacatacattcgggggacgaccaaccttccagatcaagtgacggaggagatccagtacaacctcatggaacacatcgctcaaacgcaagaatggcaacaatctgttaatgctcagttcgccagcatcaacaacatgatgcagcaacaacacgatgaccttcaagcgtacttccgctttcaagggtttaatccttatcaaggaccctgagcgaaagctaagcttggggggagagacatctgtatcacattgcatatttccctttccaattgcatatttgctttccaattgcatcttataaaacttgaaaacaacataaaaatttgcaaaatagaaaataccaaaaagataggataggtttgagtcatgctaggtaagacaagctagttctctttgttgaaatgatggatagttgctctgttttatatctcttatatattggttcataggtaagtgctctctcaaaggttaaatataagtagccaacaattatctgggaacctgaggtaaatgagctgcacttgctgatctgagtctaagttattgtaagatatgagatggtaaataagagttctatgatcttgatactagtttggcttgaattccggatgttttgtttttcaatgata

SEQ ID NO: 57223 - DNA, 787 bp, Oryza sativa
agtgccgcactccgattttgtgggatcaaacgggagaacgtcaggttttcgggaccgatatcctgagggaagccgaagaaaaggtgaaaatcattcaagaaaggttgcgtgtggcccagtctcgtcataagagttatgccgacaatcgtcgtagagatctaagttttggcgaaggagattatgtgtatcttcgtgtcacgccttttcgaggagttcatcgttttcacaccaaaggaaaattggcaccgcgttttgtgggaccttataagattgccagtagaagaggagaggttgcttatcagttggagttacctcaatctttggcaggagtccataatgtgttccatgtttcgcaattgaaaaagtgtttaagggtacctaccgaggaagctaatcttgaacagatagaagtccaagaggatctgacctatattgagaaaccaatccgtattttggaaatagatgagagaagaaccacaaatcgagttatccgtttttgcaaagttcaatggagtaatcactcggaagaagaatcaacttgggaacgagaagatgaattgaagtcagctcatccgcatctgttcgccagttcttacgaatctcgaggacgagattctgtttaagggggtaggtttgtcacaccctgaaaatcctaaatatataaattgttgtttaattggaattattagaatttattttaaaagtctagaagagaagatctaattttaattaataaattccaatataaaatggggccagataaaatttcattaaatactttgcttaa

SEQ ID NO: 57224 - DNA, 716 bp, Oryza sativa
ctctagaacctcgcaatcccagcccaactttcgaaggaaggccgggccccatcaggccgatagcctgctcgaaatggtgaagctccggataataaaagggataagccggcaaacatcgactgaccgccgcacttaatcccccccttccctacctccctccgacggagcgccgtctcaaaatgggcggcaccttctccaccgccttcgccatggcggtggccgccacctcccctaccattggcactgcgccattctcgtctcttactatccgcctttggcttcggcccaaaccccttctctttaatttttggctccttcttcccgtacccaagtgcttctcctgggttgaatccgtctcggaggaaggggaggaagaatgcgttgaggaggattccgaggaatccggtgccgggggggaagacgatgacggggaggacaacgacgaaaagccgcggcctgagccggtggccgcctctgggttcgagttcgcgtcggccgccggagggctacgtggagcccgccccgttcgacgagctgaccccggagtcgcccgaggacgtggcaacggcgtacgaagcgctctacgggccggcctttagcggcgagacggtcatgggcaacaacgtcttctaggtcaaggtggtggatcccgtcgacatggaccgggagcagcgccctagcgaccagttcaacgagcgggtcgagcatgtcaatcg

SEQ ID NO: 57225 - DNA, 1316 bp, Oryza sativa
  unsure (1)..(1316): unsure at all n locations
ccctagcgacgagttcagcgagcgggtcgtgcaggtcaatcgcgtcaccaaggtcgtcaagggcgggaggcagttatccttccgtgcgatcgtcgtcgtcgccgacatgaagggccacgtcggtgtgggcgttggcaaggccaaggaggtcaccaaggccatcaccaagcccgccatgaacggccgtcgcaatctagtcaccgtgccgctcaccaagtattcgaccttcccgcataggtaggtgacatcccttgctttattcctaattttgcatacgaggttatcatgtggatgctcttatacccatcgacccactagtttcaacttaatgtgcaaacagccggccgactagtactaattaatactacaagaaatgagttccatggaaactaaaacataagatactgtaaggatcgtgatttgttaatgatattgtttattagttgttactactagtttttgtggttttagccagcacagcaatttgtaacctgatttgctattatgcccaaatggtgtattcttattttctgttttacacagaggcactgataatttgcacaacagttcatggttgatagtgaaattggtagtatgcatcttcccttcgggcaggcattgcactcctatgaacaaatattttgtagaagatatcaaaatcgaaagtacaaaagattcagacttaatcttgtgccacactgtcacctacttcctccatccaaaaaaaattcaacctaggtgtggatgtgacccctccagattcgttgtactagaaggggtcacatccaattctaggttgagtacttgagtttttttgggacggagtacttatctgcattttcatggatatatgtattttgaatgctcctcctgtttgcatgagctaatgtgcaattatatttttcatcaaaatgtacctggattatcataaattgtggtgtcgtggtagatacctgacattgatggagtgattcttgacaaaggcatttgtagctcgtagtaagtgtgatcgagaacacattttcaactgcaagggttgttttatttaaattatgttaattgtactaaaattcaattcggactttaaagaataaagtgttgttaaaactcaggtgcatactagcgactctggtttttgaacattgatacgattgaatttttagcgaagtgctacaattgaatctggactgatgtgttctattctcatgctgattgtatggttacgtagttgtctgaaagctagttgataatcataaaacannnnnnnnnnnnnnnnnnnnnnnnnnnnnnnnnnnnnnnnnnnnnnnnnnnnnnnn

SEQ ID NO: 57226 - DNA, 4615 bp, Oryza sativa
  unsure (1)..(4615): unsure at all n locations
ttttatccctctccttaatacctgtgcccaactctgaaagtcattatatttggatggagggaatatttcttttgctgaagaagacaggaacatctctgagagagtgtttaagtctagggacatactagagctggataactgagtatatggaaccagtaaacccacgagtggtgttttgcatcaggaaggcatggaccttgggaacaaggatcagtggcaaatccagggggcaaaaggaggtctggcctctcccagcatgttgcttccccagcctggcctggcgaaaccattagatctctaaagctctaatgcaacccgcgggatatttaccaattattttcgtaatcattgtcactcggcaagtcgacccccctcatatctaaatcctggcttctccactgacagggatgccaagctccttgtcagtggcagtgcagagtggattggatttgaggagagcatgcagaggggattagattgtgcatggaggtgaatatggaaatgaaaattcgaagtttgacacagccttgaggtctcttcttcctctctcctaccatttgtatttggtatgactgttttgcagaaggaagaatagaaaaataggaaatgcaagtgatattcaggttaagaagttgaaagaatggaaagggaaattcaatttagtccaatgtggcacttcttagaccaaaccaatcaaggagttgcattttttcaattagcttttgggattggcaaatcctagagtccccatctaaagcatatgatcagttatcccagttctattatggtgttttgttttgtgctatgagatgtctaattttgttactgacattaggcagatgacaaaccgctgatgtggcctgtactttttggatatggcaagacctttttaaaaatatcagaactttagttttgtatgttgtatccttttgtttggaaaataactcttcccaatctatttcttcctgcatttggctaataaacatgtgatgcttaaaagcttggccgtacatttaattgttctgatctttgaagattaataaaaaaaattctttggcggagcaattttataggtgttcttcctgtgatggtatcaataattggaatttctaacactcaaatcttgtgcatatgagcatatcgacaataattgtgcatctcctatctttctggcagttatgtctatctacaataattgcaattctgagtattatttcatcttggtttgtcctgcacaacaagcagagcagatgcagactatggagcagccagggtcatgttgaggcctgcttgccctggatctggtgtaattgcaggtggagctgtgagggtcgtgctggagatggctggggttgaaaatgctctggggaaacagctgaggagcaagaaccccctcaacaatgcaagagctaccatctaggcgacccaaattatgaggcagttcaaagatgttgctgcagagcgcgggcttccaatggagcagctatggaaataatcaaataaataaaccttaaattgcctccaatattgttctgttctccatttcttgagatcattttcagttgtatctgtcagtggggataatcctacatttaagtcctctccccaccctaaatgcattatgtgtctccacatatacatggcaaagctttagatgaattgatctgcgaatacctttagcttcactagtaatagtgcatgtgcaagacacgttccgcacgtataaatgcgagtttattatgttttcccactatgcatattaaacagaccatataaatgtgaagtttaatatgccacatatctctctgtttacaatttgtcgtataaacggaaaacaatcaatgataccaaaaatacaatttgttatagtttgataaatgtttggcataatatgaagtgtataattgcagagaggagagagagagagagagagagagagagagagagagagagagagagagagtttttttatgtaagttatagcttccttggtcacctggttatgatgtgcatatgtggcttgatgacattgcttgccgataagaaaaccctgaaaaacaccaaatagaatgggagaaaaagcaaaaagaattactcgcagaaagtatcggcaagcactaccactataataaaaaagcattatattctttttataatgatgcatttagcataattagttactactcttgtctaggtagcacacaaattaaactgagtcatgtcgcaccaaacctgtcagatcagttatttttcataatctataccacaagatttcagcattatcttgctgctatcgtttttaattttggtgctacatctacgcctattgtaaagaaaaataatgaactgacttaaaaggaaaccaacctacactaaatctgacacaaaggagccatgaaatgttgtgtcaaaaaatataatatgaatatttgttggaattattttctggaaagatagtgctctatagctctatctgccctaaaagactacatttttttcttgaacctttatgttcataaacaatgttttagctaatctttattaaggcaaattattatagtttcagcataatttcagcagcaacgtcttggataggaaattgtattgcatgtatctatactgggcttcaaaatgcaggataaaaataggatgggatctacatattttataaatagattctcactgtttatcatgggattacatggagtcgtaccgacaatttttaattcagatgttagggctctcggttgtcaacgtaagcaatattattcttccctcacaataatatctccagaagcttctgaaacctgaaaaagacatattggtttgcataaacaaccactgagaaaaggaaatgctttgcagagctagtaccaagaaaaataaaattaaaagttgccatcagtaacttaagaaacaagagctttatttgataaaaggcagatacatccagcaccaaccgtctatcaaagccaagatctgtagcagcattttgtaataatgaaaattttacatatacacaaattgtggttccatgttgtttctaataaaaagtattcagatcagcttaaacatatatgcctattgagatgcagttaacaacagaattcacaattatttcagtagcattgatatggaggattataggacactccgaggaaattaacaaagtacgtcgcaggaagaagttctgtacaatgagcatatttgtatctcaagaagcttcctaataagcaaaattcaagggaactcaatggtgttcctgacctggaaactcaatcatgtgtcaaattgataggagaaacaatgcaggtccaaactgaatgaaacttgctatacaaattgatctatgtaggcaggggaaatactacatccaacactcttgcatgaatatgtcagtcatgcaagttcacatacaaagaatcatgaaagttctaccagtttttaatatgcttggtgagcccttgggttactaagggagacaatgctagcggttcagccgaacgaaaggaggttctttgagcccttaggtcagggtcagatcgagcaggactaaccagttaagttgtacgaagtgtcaacaaccaaatttggtaatttcagtatcagagatggagataaagtcgaagcggaatccaagatggagatcgttccgcaaacagaggaaggatcggctaaagtccgaattggctgtgaccgggatcggcagagtctgaattggacaaggttagctgatcgagccgagtccgacaatatggtgcggtacacgttgttctttttgagttaatgtgcttcatgaggattgccatgcacggattgagtcgtgagaaggcaattgtatctattaattaggatatttcatgtaatttccttagagatatgtttgggcaaaagtctgccgcaaagacttatggtatctaatagtttgttagagataagagtcgtttccgacacggacatattttgtaatctcgggtataaatagaccccgagcctcatgtaatacaacaacacacgttcaatacaatctcggcgcattgccacccctttactttcgttttgtttcgacaagttcttgctttcgggttgagctgcatcggtttcgatcttcaactagaggtaaaacttgttatggaggcttgcgttatcgggattagtgcttccatatttatgatactctaatcttgttcatgtaattcgtcgagttatcatatattctatataatctttggcaatattgttatctaacctctaatcggctaacatctgttacttgaaggcagccgatcaggttaaatactgacgttggcttagattatataggatatccaccactctatgaaacatccagcggcttgattatctagatgttgtccttcttttcatacttatagctgcatcagttgagtttgaccttataagtcgtgattagaatcacgatctctagcctgctttctggttgccgattagggtagtatcggggtttcagccaatcttacctgatttagctttatgttccatatgcttaactgatatgctagatctgccctttatgttannnnnnnnnnnnnnnnnnnnnnnnnnnnnnnnnnnnnnnnnnnnnnnnnnnnnnnnn

SEQ ID NO: 57227 - DNA, 1261 bp, Oryza sativa
cggttggttgtcatgcctggaaaataactatccagaatgctagtgtattaatccccgtcccaggaaaagccaggtacatcacacatgatacaaaagacacatctttattaattatcgcgataatatttacattattgcataggcacataagacctgacaacaaaagaaaaacaacactggactagcatgtctacggttccatcttcacaaacgcttaactagggtataagccaggactctgcctaagacttctgttgtcgaagcgacaactacgtacgttgaaggacgtggttattcaacagtgttgggaacaataaatgtattactttaagatttttcttcgggatcccccccttttacatgtcctagggggctatttataatcctattataggttcccccattagggcttaggctttacagggaaatttacatggctgcccttatgaaagggacgtttgcttgggtatatagtgatttggatacataggcctctaatgggccaattggcgaataggcctaagcaactgggatggcctcttgggcctcttcaaagtcgggcttgttatggcgaagcccccatccttcaacctacacactttgcccaagatgcatttgatcttgccagataccagcgcgatccttcagccttcgccatctctgctttatagtcttcgccatggggcttcgcctagatgatcttagcgtcttgggcctgaatcctcgctggttgcatggtttcggtaggtctggtcgaagggtctcgtgacataccgccaacaacttctacaaaagtttctctgactggagggtgaaagattaagcaaggatgagtacaaccaccatactcagcaagtcacatcagaaaacacacttaatgcaagggagtacaaggattcatttataaaagggttattttgaagtaaaggggcatttcaaatcatttaattgtttaagggcattttagtcaactcatgacctatctctagtctaattattatcaagccgtgtactcaggcgatcttgccttaaactaggcccaaaggtgataaatctagtcattcccgattattagaataaaacctctaactttaggtcattgctaggcttgcctataaccgagggcgcggctattcgaatagtttatactctagctaggggtgtacatctttacccacaagagcagtgttgattacatgtcagccgtgcatcgtgataccagaaaggtacccgaggagtcaagatcgcgacataacccacc

SEQ ID NO: 57228 - DNA, 1471 bp, Oryza sativa
  unsure (1)..(1471): unsure at all n locations
tgcataacccgattaagaaggtgatgtttgttttcccgtttggatcaactgatcccgttctgtttgagggcagaaaattttcctcccaggaagagcacgattcggggaatgagattgaacgatcgacatcacccttgatcgagtttaagcctcttccctttggcccacattatcgtgttctcaactacaatcgagaactgatcataatctgtcatgacaaatctcttggggggagaacttctaggccatggaaaagctagaggaactgactctgaagtccgacaggaaggaccatttaaacaagcatgaatgtttttttcttgaacatcaagaatcttgctctcttaaagtatcttcgaggtccgccacattttgtgccacaagcacattcaaccaccttaagatcctcgccgaaaaagtgttcagaaggctggatgtagatgcatatgtttatcataaacattacaaatttcgtggttgcacctgtggcactaaccttgcagtacaacttcaatgatgaatcaacaactggtggtgaagtggggactacatcgccaatggtggttgcaacgtaaagatttcccatggtcgagctttcgaccataaacaacgcactaccgggaggtagcccagattatcatttcccttcatcaaaaaagcaggtatatgtttttaggataagtttgctatcgggtacttttggtcactaaccatttcaggttaagattaaaaaagaatgatggtcacgtgatgcccaagaacatgggagctacatcatctctagaacctcagtgctttgctgatggaacaaattctgaaggagactcgaacaccacacacttcatttttggtgtcccctaatgcaaaacccaagtgtgggggagtttggtgcgtatctcataacaagttcctttcatgctaaagttttaccttggtttagatatgatgctagttctcacatcttgccttgctgaaaaaaaaagagtttgaactgtcctgcttttgacattaaacaaagctctgctgggagatactcgaagttcaccattcaaatacttatatttatctccatttgaatataacttgttcatgcttcctttatctattctcacatgctctggtttgaattttgaagtccattcaaaggctattcaaattaagcatggtgctaggttaaaaagtcttctttaatcaaattagatatggtgtctagtttgcttagtgaaccttagagttaatgtttgtatagatcttggttgtatagatatggactaacccctgcaggaaaatcttcaaaattgagcgggtaagtctttaagttggttcaaaatggagataactaaagggtttgcatacacgacaaagttgcacaatatatagaggaggctcaaaacgctcttgtgattatgttgagnnnnnnnnnnnnnnnnnnnnnnnnnnnnnnnnnnnnnnnnnnnnnnnnnnnnnnnnn

SEQ ID NO: 57229 - DNA, 1350 bp, Oryza sativa
cgaccaaggacgtgaacacgcaccccggccgagccgaagaagacagttttcggctgcgtgaactttacgcttcggccggagcgttcggacgcctggccggtgcctgcgttgatggcaaaatgggaccgcaactggatgcagaagtggttctacgtcgacaacccatactccaccgaggacgacaaggcgaactggctccgctttcggcgccttcctgtttccatcatcgccaagccaagtgtagagatcgacggcacactagtcccggctcatccttcttcacaacattacgcggcggctaagtacccgcgacctctatgaggaatggtgcagaaatactcctggtatattatggttatagagtttatccacaagcgcacggatataccattgtagcatttcacccgaaagtattctaagggtatcgtatttattttatcctttgggaagatcatgtagagagaacttgactaataatttatatgttacttgtgataatcatattctaagcaggggttaagataatccaagggtagagtgacacataagcattagctactcattctcataatatattatctaaactaaatggaaagaaaagagagagagaatctattcctacacttctaatatacatagtatacatacattctagttaaccgatatactagctaatacgctctatctgatgccctcctggtacttcgagaagctatccctaactgccgagttccttacgatagcccgtcatgaccatacaaccggggctaaatatgaaggaataccctccccagggaattaacttaggattatatataggcgcggaggaatacccgtactgagctgtcaccatcagcggcccacctctcatccgcagtatataatcccaaataatgatatcccgtaatatagacaccacgtctaaactaccagatactactctaatatcatcatcataacatagagtaatttcataagcaaacattatacccacaccaaagcatctcccagataagctaggcgtatattcagtataacatgaacatcatgtaaagtaggcattcatatactcagaaagtatttcaataccataaatgtatatagaagagtattctaataaaagtacaaagcttacaaaagagaagagaaaagctactagagccatacccgaactcttccgaagacttccggactcctgatttctactctattcctattccaccagctagatactactaaactaagcttgagagaaatgagagagctcttgcttgaggtgtgtgtgtgaagtgagaatggcaacttcttttatagcctcccaatgacggttttgacaattggaatggtcgg

SEQ ID NO: 57230 - DNA, 919 bp, Oryza sativa
  unsure (1)..(919): unsure at all n locations
nnnnnnnnnnnnnnnnnnnnnnnnnnnnnnnntgtgagagtcttcagtttgtaataatgaaactcacttaagatcaataaaagttaaattaattctctgtcctaagtagttttccccggtttctcttcttgtgctctgtccatgccagatggtgctcactcgcagcaacgggaatggccccaacaacaacaacaataacaataacaacaacaatggagagaatcccacacttgcccaagtcctggctcaacaggcacagcttatgaacatgatgatgcagcaactccagaaccagcagaaccagggaaataaccatgcacctccccagaacaagttagccgaatttcttcgtgtgaggccgcccattttctccagtaccactaatcctgttgaagctggtgattggctgcatgtcatagagaagaagttggatttgcttcagtgcactgatcaggagaaggtctcatttgcatcacaccagttgcatggccctgcctctgaatggtgggatcacttccgcctgaatcggactactgctgaacctatcacttggcttgaattcaccgctgctttccggaagacgcatataccattgggagtggtgtctctcaaaaagagggaattcaggtcgctcactcaggggtctcgctctgttacggagtatctgcacgagttcaatcgtctggctcgttatgctccggaagaggtacgcactgatgaagagcgccaggagaaggccttaatgatgagctttcttatccacttatgactggagattatcctgatttccagaagttagtggataaggctattcgccaggaggccaagtacacccgcatggagcaaaagaaacgccggattgctnnnnnnnnnnnnnnnnnnnnnnnnnnnnnnnnnnnnnnnnnnnnnnnnnnnnnnn

SEQ ID NO: 57231 - DNA, 1002 bp, Oryza sativa
  unsure (1)..(1002): unsure at all n locations
nnnnnnnnnnnnnnnnnnnnnnnnnnnnnnnnnnnnnnnnnnnnnnnnnnnnnnnnnnnnnnttcctgtcttccatagaataggaacatatccttagttcttctcaagtacttaaggatattctttacagctatccaatgactctcacctagatctgattggtatcggcttgttgcactaagcgcatatgaaacatctagacgtgtacatagcatagcatacatgatggatccgattgccgaggcatatggaatcacactcatcttgtttcgctcatcagtcgtttgaggacactaattcttgccaagattaatgccatgtgacatcggtaagaaacctttcttagaatcttgcatgttgaatctcttcaacaccttgtcaatgtatgtactctggcttaatccaattagcctctttgatctatctccatagatccttgtgcccataatatatgctgcttcccctaagtccttcattgaaaaactatttttcaacgatgtcctaacggattcaagcaaggaatatcgttcccaatcaataatatgtcatctacatataggattagaaacaccagtgcgctcccactaatcttcttgtatacacaaggctcttctttgtttttaacaaagcccaacgtcttgactacttgtcaaaacgaatattccaactccgagatgcttgcttcaaaccatagatggatttctacaatttgcatatctttttagctaattgtggatcaacaaatcccttgggttgtgtcatgtacacatcctcatcgagatttccattgaggaaagctgttttgacatccatttgccatatctcataattgaaataggtagcaatcactaaaacaatccgaatagattttagcatggcgactagcgagaaagtttcatttgtcttaaaccttttgttaccaatcgtgccttgtagatgtgaacatttccagctacatctgtctttttcttaaagatccattttgtcacgaccggaaataac

SEQ ID NO: 57232 - DNA, 3686 bp, Oryza sativa
  unsure (1)..(3686): unsure at all n locations
nnnnnnnnnnnnnnnnnnnnnnnnnnnnnnnnnnnnnnnnnnnnnnnnnnnnnnnagagatagatacaaatttgccatcggagatactaatnnnnnnnnnnnnnnnnnnnnnnnnnnnnnnnnnacatccctccccgataagcattggatattcccatggcgccactcaaaagtagcatcggccattgcaacctcggccgatgtatccgcttgaataatttcaacatcatcgccgtcccattgaattaaacattgatgcaaggtagaaggcacacaacaattggcatgaatccaacaacgacccaaaataacattgtagttaccttgcacatcgacgatgaagaaagcggttggtagcgtcttgtttcccacggtgagctctgccgaaaagataccctttgcctccgttggttcaccattgaaaccattgagaatcatgttggtcttcttcaactcatcatcctcacgccccaacttcttgaataatgagtacggcatcaagttcaccgcggcacctccatccactagtatcctagagatcggcttcccatcaacatggcctttgagatagagagggttcatgtgacggtttgactcatcgggcttctcaaaaaccgtgtctttaggacctaatgagaattgagcaacctcggcttcatccatagcacaaaactgcataggcaacatacataccatgttcatattcatgtcttcttttggagatgattcacctttatcaaccgattgttcctccttctcctctacaacaaccggtttttccttctctatggacttatgcctccataccggtggtggtcgcaactcattgaaccttttatctctttgctcttcggcttttttctctcttatctcttgagcccgaagacgttgcaaccttctcttttgagtagccgtcaaatccttaggcatccacctaggatccggctctgttccaggaggtaaataatgccctctattaaccttgtttgaagacgatgaagccctcacatcgccctttgcaaaccttctatcaaaccggcgctggagccgggtcagaccggacgtagaccaccggtcagaacgggcagatgcccccggcaaaacgacatttgggcgcccggcagacaaccttgaggggtcggtcggaccgctgtcgggtcggcggtcagaccggcctgatggcccgatcagaccggctgtatggctgcggtcagaccggccaaaaggcctggtcagaccatccgactgcgatgagctggtaccggcctcggattttttccttgaagactctccaacttcatctccagaaggtattgacacatcatgagaccccactttgatggtaattacttccgaagtccttacctccaccttgatgcgctttctttccctcttttcttcattagcccgattcttaccatataaccggccgttgttcggtgaaaataaacgctcatgaattggcctcctcggtcctccccacccttggttgaattgcattggagggcatgtaataaggataaggataacccggcggtggccattggataagaaccccatgacatatcttgtggatgatgatatggaggtgaatgcgactgtcttggtgaatgaccaaatcgctccctaggaagtgatcttggtctttttcctttgttgcgaaccctctcaccaccttgcttctcatacttttccaaaagcatatcaaaagtcactttggtctttctaggggctttagaagttgaagctccactcctattttccttccaaacgccaacctccggtttctttggcactatcattttaggccttgcttcaccaatgattactccttttcctttagtagattcggcttgctccggccgaatcaacaccttcttatcattgaaattaatcgcattcaccggaaaaggatcatgatcaagattcatcttggagccatcagtgaacttcaatcgtccttcatctatggccgattgaacctatcgtcgaaacacattgcaatcattagtagaatgagaatgagaatcatgccatttacaatatgctcgatgtaatcattagtagaccggaaataacccaacgggcattccttacgtgcgtgcattaatccttgtcccaggaggcaaggtacaccaaaagttgatacaattcagagtttaacaagcggaagcgtaaatagataacttattacatgggcaacgaaggcccagcacacacagagacaaacgagaaacagcggaagactagggcgacgaccacaggcgcttgacggcaggcacgagctagacaccgaagccttcatcctcctggaactcctcttctggggttgggaaaaattgagcaagactgagtacaaccaccgtactcaacaagacacacccacaagtgcagaataaatgcaagggagtacaaaggagttataccataaagggtttagggttgcagtaaacagcatttaaagatatttagttgctcagggctattttgtaaacacgattctagaactaaacaatattatttatcaaggtcgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgcttggcaacagaggcccgaagaccggtccttatatggccgaggtgctactatcaaaaccatacaccccgagcctagcctaaaaccattttgaggattttgaatagagggggaggtgtgaatccaattccacaataatccaaccattccatagtgtccaggtgatatgaatatcccaaagtctagagttgtaaaaccacctaatgttacctaattaagcggcgaagcatctacctaaattcatactagtggtaccatgagtagagtgtccactagttggggttttgtttattctagggtgaacaaagaaataataacaataacaataataaggtcataacaaaggtaaataggcatggctagataaaacagtgataacgcaggaatttaagtaaagcgatagtgcaataatttaaatcaaaataattttataaactgggattcaatatgctcaaggatgatatgacttgccttgctcgcttttccaaacgtcggcttcaacctccacgaagagcggatcttccgannnnnnnnnnnnnnnnnnnnnnnnnnnnnnnnnnnnn

SEQ ID NO: 57233 - DNA, 3412 bp, Oryza sativa
tatttttttaaatagtgaattatatatcattggaaagcttatgaatttagatgaatttaggttcaagtttcacttaaatcggagtaaaagtcgaatgcgaaagtcgattcctttttattacctttactatcagcgaactacggcaaacccaatttcgatttaaactattttgcgggtataaatattttgttgtcataagtttttaatttactcatcccgagcattatatccatataacaggttagaaatttctattacgagctaaatatcggacgaaatcttagaaatattatacaatttaatttagtctatgactaaacgattaaatataatacacggctaagattcctagtaattgaatccgaatttctaccatgaaccgatgacttatagagattatcaaaaataatctataataatctataagaattcatctaattgtttggttattaattatatctaaattactaccaattttaatctaatctgatcaagaaacatatatttataattaactcggaatttcgatcgaaataccattacgctcgaggaatttccaaaaataatctattattaaccccgaccatttttatttcctaaatcctcctaatttctcccccaatttcccttctattttctcctttccttctttttctctcttttctctccctctctttcttttcttttcttttctcttttcccttttcctttctttttctttctctccctttttcctttcttctctctttctctctctgtcggcctctcttttcctcttcctttctttctctcctctctcccggctctatctccctctctcggctctatctccctctctcggctctctcccacccgagcggcggcggcgatggacgcgagggagaaggagggcggctcaccggcggcagcagcggcgacgacggcggcggcgacggtggcgcacggcggcgcaagagcggcggcacggcggcacgggaacggcggcgcaggaacggcggcgcggtggcacgggaacggcaacgcggcagcacgggaacggcggcgcggcggcacgagaacggcggcgcggcggtggcgcacggcggcgcaggagcggcggcacggcggcacgggaacggcggcgcaggaacgtcggcgcggcggcacgggaacggcaacgcggcagcacgggaacggcggcgcggcggcacgagaacggcggcgcagtggagaggggagaggggagaggaagggttagatggggtgggggagaatggagagagggggggtatttgtagagaggggaggagcggcggggctcggggcggcttggtgtgacggcgatggcgacgcgacgatgacgcggcgcggcagcggcgcgggacgcgaggtggcgacgcgatgggcgagcggcgcgcgggtcgcggggcgcgagacggcgcgcggggcgcgaggcgacgggacggggcggcagcggcgacatgacgggcgcgcggcgatgggatgggcgggcggtagcggcgcggggcgcaaggtgcgatggcgacggacgagcggcgacgagacggtgcgcggcgcgatgggacggcgatgcggcggcgacgggcgacattggcgcgagacgacggcgacccgcggcgatggcgacagcgtggcagcggcggcgcgagcgaggcagcggcacggggctcgagacggcggcacggggcgcgaggccgacggcgacgatggcgacggcggcacgcgggcgagcggtgcaaggtggcgacgcgcggctcgggacggctagggcagaggtgggagagaaggggaaaggttagggaccaaatcgaacaccttgcgggcaatgaatagtgcactttcctattattcccgattttaggttattttcaatataaatttgatttcataatttctaaatcttgtataaatgaagtttatcccatatttgtgttatcctaactaaaattctccttaatttgatatcactcatattttgtttatataatttatttgagttttaattagggtaaattcttattctatcgcaattaaatttaattgatccaaatatggtcgcgataatattttatttattactacccatacctaatcttttatttttaatttatatttattttaccaatttatttttaaggtttattaaagattctataattttctaatgagaccgttattaacataatagcacattagctcaatttatctatatgttagtttattttatatggaggggtttaatatatcaaatttcaatccctaaatgcaattaggaacttggtgcaaaatcgatctacatatcgaattaaatactcctgtaattctattatatatacagagagctcagttcatttgaatgatcatcatttcatgtgtactcgtattatggcacccacctatattattcaaatattttaatatttgataaaataggttaataataacttttattttatttgattttaatatcttgcgcataattattcgtaggattaaatatattctcataaatcatatctattgcttaaatgtagttcttttctttaccttcttggtgatcatttatggtttggcaagcaataggaatcataacaaccagcatgatgcaaaagttttaaaaagttcgaaattttagtgattttttttattgtcttgaattttcaggatgttacacctagagatgctcccgccaccacgaattgaccccattctctcccggcgtgtcttcccccttttgctcgccgccggtggccgccgtcgaaatccgccgcctccgtccagttccggccacatccgagccgaggaatggagtctgcgtctccttttccctccctccggtggtctcccttcctcccgcctcgcctcgcggccgctccgccgacgcgcgccgccgcctgccgtccatctcccggtcggtctcgtcttcctcctctagccggcccgcgtggctgccacgtaggcgccacgtcagtgccaactcggctagaccgagtcaaaccggccagcctggctagccccctccgtgcgcacggaccacggtgcgccatgcggcggcacgtgggcctgtcacgcctcggtccacccggcgcaccaatcgtgagccgcatccacccgaaaccctaaacgccgcccgcgtgctcccatccctctgtgaaccgtgtcgccgacatgcgggccccacccgggacctcgcatggtgggttcggtccacccggaccgccccctctcccattcgcgcgcccctaatgggccgcctccttgcgcccgcgccggcccaatggctcggccgagcctctttcaacccattgggccatgcctcacgctcggcctaaaagtccatatttcctccctccgtccaagtcagtgtccatctctcatgagctaaaagtccatatctgctccctcccaattt
